United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 37

SEQ ID NO: 162334 - protein, 947 aa, Glycine max
  Coding DNA Sequence Number=SeqID_45556
  Gene Ontology: Mol. function=protein binding; Cellular component =cytosol; Biological process=protein transport
  Homolog annotation: Hit_ID=Q75WV0; Match level="QueryCoverage=87%, HitCoverage=85%, E-value=0.0, Identity=74%"; Hit description=ALG2 -interacting protein X
  Pfam annotation: Domain name=BRO1; Domain location=13-479; Score =482.5; E_value=5.2e-142; Accession=PF03097.8; Description=BRO1-like domain
MAASPSSSAAANIMLAIFEKKTNSVDLYRPLRNYVAFHYSEREAQNLEDDLQTLKQLRSDVERHSDPSLPTRRDLLQTYYKSLCLVETRFPISSDPDHVNALTFVWFDAFKPKQKASQQNIHLEKASVLFNLGAVYSQIGLSYDRNTVDGRRQASHAFIAAAGSFAFLRDNASMKASVGSSTTVDLSVECAGMLEKLMLAQAQECVFENTIAKGSTPGVCAKISRQARMKSLCLGYGVIVSYEFKLAHLEDVFSDFVVFSTTPYSRVEKGLTLKSVIIDHIGRMLDHLCNILEVDTGLSDVEELHIGWVGIYYEEALAALNVAPLSQHFDKSWIVHVQLKAALFYAEACYRYGLELHDKEEIAEEIARLRSAVNVLTEAKKSSKGAAAQILDAIGKLEANINRNLERAVKENDRVYLMRVPSPSSLLPLPAFSMVKSMVMNEVLDASKEKMFASLVPDNSAKALSRYTEMVDDVIRTQAEKLQQASELTRVRLKEMELPDSILALEGNFTLPTSLKEDVEAVQISGGPAGLEAELQQLKDLRRVNQELLVQTEELLQKEAREDSQFRSQFGTKWTRPQSSTLTKNLQDRLNRFAGNLKQAAESDGRIERSVREHSALMSILDARPIESALPSLARPIMSFDQNEDAIVGSLKQSLRQLETLGAQRAGLEDMLKEMKRKDDILPKLMTSTGSYDDLFKKEIAKYDHICEEIAQNIEAQEQLLLQIQAQNDEFSVIFNLEDYKASREKAYKQIEAAIAKFREIKDNINEGLKFYVTLQDAITNVKQQSNDFVMTRNIQCREMIEDVQRQVAGLSFQDNKNTGGFNSNYPSVGSQNQRSPTQTDPARPQAPYYQQPVEQPPVPPYGHHPPPPYGGPAQHHQPPPPYHIPPSSTAPYPPPQVHQQPPANHEYGQPAYPGWRGPYYNAQAQQPGSVPRPPYTIPSPYPPPHQ

SEQ ID NO: 162335 - protein, 68 aa, Glycine max
  Coding DNA Sequence Number=SeqID_45557
MATVQHLVMDNKKKRPIICRTKPDLNKTFKEATKAIRVLLTTLMEVLQIRVHNNNKLNQTDCPRWKIL

SEQ ID NO: 162336 - protein, 129 aa, Glycine max
  Coding DNA Sequence Number=SeqID_45558
MIMRGQDIYSNQDEATTPPSFSKSEEAKGEESSEEIYPQEEGQPLMVKEEWVPTNPKRIKVIPEWSTPPSVEGRSPKFQVPLDLRSNPFQGGGNHDVAPCEAYRPWIFFINGVLCFLNMNGSGMEMEER

SEQ ID NO: 162337 - protein, 122 aa, Glycine max
  Coding DNA Sequence Number=SeqID_45559
MTLLLIYILPSDHNSDLSLPKCQLVYNIMTQINVHVAQLISNAIHQFIGVAPPRHPVDPEKSNRALGFSTLITGTTAGAGPTAAAGLRRTTTASASATISRVHLSSHAEDRAPDACIHAAFG

SEQ ID NO: 162338 - protein, 283 aa, Glycine max
  Coding DNA Sequence Number=SeqID_45560
  Gene Ontology: Mol. function=amino acid transporter activity; Cellular component=membrane; Biological process=amino acid transport
  Homolog annotation: Hit_ID=Q8PLF8; Match level="QueryCoverage=92%, HitCoverage=55%, E-value=1e-110, Identity=74%"; Hit description =Cationic amino acid transporter
MRILGFTGGGGDRIEADVGEEHDGCRTEHAAPAEFTRHAGVFRNERLPVGRVDVGRADADEQADDGDLDRHDDRVDEGRLGHAHVQQAGHRRHDQHRWQVEQLAGGDELAAGPGDGRGTECIRERHVQRGGDEADQVFQHQAPADEPGHAFAEGGVGIGVGTAGDRHHCRELGVAQARQGAGEAGDHERQHHCRASMVGRGLAGQHEDTSADHRTHAKQDEVFSREGPFQRGFAVQAAFDGFASIDVPGRFDRLDPQQSFQHAVLPSDRMGWDADTLPATLEW

SEQ ID NO: 162339 - protein, 255 aa, Glycine max
  Coding DNA Sequence Number=SeqID_45561
  Homolog annotation: Hit_ID=Q9LI88; Match level="QueryCoverage=19%, HitCoverage=27%, E-value=1e-13, Identity=68%"; Hit description =Arabidopsis thaliana genomic DNA, chromosome 3, P1 clone:MYF5
  Pfam annotation: Domain name=Ribosomal_S21; Domain location=93-148; Score=43.2; E_value=9.1e-10; Accession=PF01165.10; Description =Ribosomal protein S21
  Subcellular localization annotation: CTP_CleavageSite=97; ConfidenceScore=5.93e-01
MAASSTINNFFSFFLPTKPPPPSPPQFNPTTTTTTPMNPSSQTHKPSSQPLIAQYNPPPPSPSSCSSSSELSSVICPSMAYSNTLFFQSPYNVQVVVAEDETEEKLLGRFRREVTKAGVVQECRRRRYFENKHEEKKRKSREAARRNRKRILKVSVNYDCKCSFKALGWSKRRAPVGDSCWIDFDGGSFIGINAMVGSVKICLKVWDLSTTLEEWGFSVRLPMSKTVGQKKQDVPATKREDDEDNWDLPEGDTLY

SEQ ID NO: 162340 - protein, 50 aa, Glycine max
  Coding DNA Sequence Number=SeqID_45562
MDEAIKIMDAPGKMKHIVGPLRIVQLWLNAILANHAQREIGAKLKFTYSR

SEQ ID NO: 162341 - protein, 259 aa, Glycine max
  Coding DNA Sequence Number=SeqID_45563
  Homolog annotation: Hit_ID=Q9FGY9; Match level="QueryCoverage=38%, HitCoverage=14%, E-value=1e-20, Identity=48%"; Hit description =Peptide-N(4)-(N-acetyl-beta-glucosaminyl)asparagine amidase
  Pfam annotation: Domain name=DUF590; Domain location=79-259; Score= -40.7; E_value=6.2e-06; Accession=PF04547.3; Description=Protein of unknown function, DUF590
MVFQFQLYSLSSVPPHQQKIFGAEQDTPVVNDSDLVAISDKLRLVSVNDSEPEPSAADLLKSDEELARLLQVEEEALMLQQYVASQNPREFDSRVWPYVDELDKAIFIASKDPSLYGIDEVEVKNQRKWTSDTRTQGIIAESQDGFHSHGGCEIYLMKEFTILSRDNTNSSTPKIIFVPGDVDLKTLLALLAFMFGMILMFACAFPPTFAFAAVNNLMEIRTDALKLLVILRRHVPRAAATVGVWLNIFQVPNILHKRV

SEQ ID NO: 162342 - protein, 85 aa, Glycine max
  Coding DNA Sequence Number=SeqID_45564
MTKARQKGVRKGKEGEACHPARPGELGCFLQKAPPSGELPGRPKWTWFLFAPPCSLNTPLAFFADSFFVTLRKLMNYVTILVFFL

SEQ ID NO: 162343 - protein, 112 aa, Glycine max
  Coding DNA Sequence Number=SeqID_45565
MEENMWAIIDKYKEKLSLAATHEQRLEDEYAKVSVLQAEREARERVIDSLHKEAMMWMDRFAFTLNGSQELPRLPAKAKAMADVYSAPEEVHGLLDYCQHMIDLMTHIIRNR

SEQ ID NO: 162344 - protein, 224 aa, Glycine max
  Coding DNA Sequence Number=SeqID_45566
  Gene Ontology: Mol. function=transition metal ion binding; Cellular component=nucleus; Biological process=proteolysis
  Pfam annotation: Domain name=Transposase_21; Domain location=1-122; Score=-0.1; E_value=1.3e-14; Accession=PF02992.5; Description =Transposase family tnp2
MKQKYIILCMMIAGLRQPGNHINVYLTPFIEDLRKLRVDRVDMYDGNLQQTFKLRALIFFTINDFPTYGNLSGYSVKGHYTCPICEKETSYIQLKHGKKTEIQSAPKPLVGHQVFDRVKDIITISGKTQKKDASEKNIWKKSKVVDPKKLDDLENEAAIILCQLEMYFLPSFFDIMIHLIVHLVMEISIVESYVTEEAIEFCSEYIETTTPVRLPQSHHDCTQG

SEQ ID NO: 162345 - protein, 60 aa, Glycine max
  Coding DNA Sequence Number=SeqID_45567
MENSLLDKDSEPENPSASAITWTVFSQEMKRVGYLAAPMITVTLSQYFLQIISMMMVGHL

SEQ ID NO: 162346 - protein, 398 aa, Glycine max
  Coding DNA Sequence Number=SeqID_45568
  Gene Ontology: Mol. function=drug transporter activity; Cellular component=membrane; Biological process=multidrug transport
  Homolog annotation: Hit_ID=Q5N7N1; Match level="QueryCoverage=97%, HitCoverage=79%, E-value=1e-125, Identity=53%"; Hit description=MATE efflux protein-like
  Pfam annotation: Domain name=MatE; Domain location=1-115; Score=1.1; E_value=0.0016; Accession=PF01554.9; Description=MatE
  Pfam annotation: Domain name=MatE; Domain location=176-339; Score =140.3; E_value=5.3e-39; Accession=PF01554.9; Description=MatE
  Pfam module annotation: Pfam domain module=MatE::MatE; Domain location=1-115::176-339
MGMASGLETICGQAYGAQQYQRIGMQTYTAIFSLILVSIPVSILWINMESILVFIGQDPLISHEAGKFTIWLVPALFAYAILQPLVRYFQVQSLLLPMFASSCVTLIIHVPLCWALVFKTRLSNVGGALAVSISIWSNVIFLGLYMRYSSACAKTRAPISMELFKGMWEFFRFAIPSAVMVCLEWWSYELLVLLSGLLPNPQLETSVLSVCLNTISTLYMIPFGIGAAASTRVSNELGAGNSHAARVAVLAAMSLAVIETSIVSATLFACRNVYGYIFSNEKEVIDYVTVMAPLVCISIILDSIQGVLTGIARGCGWQHLGVFVNLGAFYLCGIPMAALLAFLVRLGGQGLWIGIQSGAFVQTLLLSIITGCINWEKQAIKARKRLFDDQFSADNILV

SEQ ID NO: 162347 - protein, 111 aa, Glycine max
  Coding DNA Sequence Number=SeqID_45569
MESMEGVLRLRPNRVLTMGEREAMGYPHVRVDMAMVGSKISHVRLRVPLLRGQEGRSIKQRTLTLKDLGTHKDFDTHTSHEACNIDGLNTVEEETTTHVSKESVRANNLAV

SEQ ID NO: 162348 - protein, 106 aa, Glycine max
  Coding DNA Sequence Number=SeqID_45570
MPLQVEDESRTSSPPSEVMDKSLKVTGVGRDVFESVAVCHAFMMEVEEKEYIVVGNEKRECDDEEHDESGNGIQNNDGCTEERDGSSKLEEDSNLEGDSKCEGLKA

SEQ ID NO: 162349 - protein, 114 aa, Glycine max
  Coding DNA Sequence Number=SeqID_45571
MRFWSCQRVSVFVMVVGEGLEPSKGVSCLRLDHMLTMGEKERSRGMFYHSPMVGAKCSYQNPELFHVRVDMAKVGSRILNAGLRVAFVRRTREGTCKIKDFDAQSKVGVASPCL

SEQ ID NO: 162350 - protein, 604 aa, Glycine max
  Coding DNA Sequence Number=SeqID_45572
  Homolog annotation: Hit_ID=Q5RH01; Match level="QueryCoverage=28%, HitCoverage=27%, E-value=9e-13, Identity=31%"; Hit description=Novel protein
  Pfam annotation: Domain name=DUF1032; Domain location=1-537; Score= -150.2; E_value=0.0023; Accession=PF06278.2; Description=Protein of unknown function (DUF1032)
MHKVGVCALPVLDDLCCRHVRDMKPIIQQDHKDGPSVQPEESGPCAVTDEENDQFWGLDDIPVEEKNSLDGTTGKEVNLEHFIKPPANLVVLEGDCLDAGGDGGELESFLLSTTDLYQDFILLDTSDAVAVHEFLKGSKAATTQNDANRGTSARKSFHSPGHTGGSARRLSAAKNQGANNCTPKLNCGFDDENVRPSSPASAGLDDFNYGFDMDHGCDASRDSDNSDEDNDDPWKPLNPHEPGNLRVKPFRKLNTLKKNSINVRQPVSMNTLFPLAKLHGPISPELMEMWEMRHHVHERQRDSLALLYEKLRQSLVNEGNKTGGTFFNSEADNDDNEYDGGNPDFDTPDNAYMEEDLPPFSNEHEFDDAHINPDEAVDLSQASLEDLCRSHLNALLASIAETEKQTEMAARVSTWKQRIENNLEEQESHPPFDIQDYGERILDKFSLLSLEASSSGVLSFSDLVKGQEKHDVARSFSSLLQLVNNGDVTLERNGVDGSVCCTSVDPFHVRLLKQSSKEGDNAQLRLPKKRAKSPTKKPSTKGDKNKTVREKSPSSSRYGSTGVSPPTNCKFSVKLGKVSAMKSPEAKRRRRSQYVEPVNLHSAG

SEQ ID NO: 162351 - protein, 126 aa, Glycine max
  Coding DNA Sequence Number=SeqID_45573
MTDTDTLQQLQNRIAEMEQCHKEELIKLKADHDQLEARVRRPQGDEHSAHTFPECTQRESHPRHTVNTKNNPSLSHIHHPTGRTTRRHPFINQIMEIDIALGWKPLNLKWYEGTINPNEHLDAFLT

SEQ ID NO: 162352 - protein, 178 aa, Glycine max
  Coding DNA Sequence Number=SeqID_45574
  Subcellular localization annotation: CTP_CleavageSite=25; ConfidenceScore=5.07e-01
MSVANPNSQGLSSTTLVPNAVTPVCAVKKKKMAVKSKKEKEHLNLLLGSHLTTIHETLQVLDQTPPSSSSAKVTWDDVIKMAEQVSKQATTVGMLWTGEKPDAKAVEENMASYFNTLQGFLLLSHGSTVGAGPTLSSAVHASVKQVVDSSFRLMKETVSLYAKQDVSIRNENMLIPRP

SEQ ID NO: 162353 - protein, 35 aa, Glycine max
  Coding DNA Sequence Number=SeqID_45575
MAIIVLLLSHSSKKDILAISGGIFRAHGSVAIKIP

SEQ ID NO: 162354 - protein, 516 aa, Glycine max
  Coding DNA Sequence Number=SeqID_45576
  Gene Ontology: Mol. function=drug transporter activity; Cellular component=membrane; Biological process=multidrug transport
  Homolog annotation: Hit_ID=Q1SHJ6; Match level="QueryCoverage=87%, HitCoverage=94%, E-value=1e-122, Identity=48%"; Hit description =Multi antimicrobial extrusion protein MatE
  Pfam annotation: Domain name=MatE; Domain location=289-452; Score =126.0; E_value=1.1e-34; Accession=PF01554.9; Description=MatE
  Pfam annotation: Domain name=MatE; Domain location=68-228; Score =93.4; E_value=6.9e-25; Accession=PF01554.9; Description=MatE
  Pfam module annotation: Pfam domain module=MatE::MatE; Domain location=289-452::68-228
MWIPHYFSSFLRKEEQPNGGRKMNLTFFVSSPFFPSFLAGTKEREAEYVMRWSVFGEEMKRVGYLAGPMINVTLSQYFLQIISMMMVGHLGKLVLSSTAIAISLCAVSGFSLIFGMSCALETQCGQAYGAQQYRKFGVQIYTAIVSLTLACLPLTLLWVYLGKILIFLGQDPLISQEAGKFALCMIPALFAYATLQALVRYFLMQSLTSPLFISSSITLCFHVAFCWLLVFKCGFGNLGAAFSIGTSYWLNVVLLGLYMKFSTECEKTRVPISMELFHGIGEFFRCAIPSAGMICLEWWSFELLTLLSGLLPNPELETSVLSICLSVTTTIYTIPEAIGSAASTRVSNALGAGSPQSAQLSVSAAMTLAASAAILVSSIIFACRQVVGYVFSSELDVVDYFTDMVPLLCLSVILDTLHGTLSGIARGCGWQHLGAYVNLGAYYVVGIPIAAMLGFWVQLRGKGLWIGILTGAFCQTVMLSLITSCTNWEKQVASASKSKLCTWHSPKTPFSQCYVF

SEQ ID NO: 162355 - protein, 383 aa, Glycine max
  Coding DNA Sequence Number=SeqID_45577
  Gene Ontology: Mol. function=drug transporter activity; Cellular component=membrane; Biological process=multidrug transport
  Homolog annotation: Hit_ID=Q1SHJ6; Match level="QueryCoverage=96%, HitCoverage=79%, E-value=2e-98, Identity=49%"; Hit description=Multi antimicrobial extrusion protein MatE
  Pfam annotation: Domain name=MatE; Domain location=174-334; Score =84.7; E_value=2.8e-22; Accession=PF01554.9; Description=MatE
MSCALETQCGQAYGAQQYRKFGVQIYTAIVSLTLACLPLTLFWVYLEKILIFLGQDPSISQEAGKFALCMIPALFAYATLQALIRFFLMQSLISPLVISSSITLCFHVAFSWLMVFKSGFGNLGAAFSIGTSYWLNVILLGLYMKFSTECERTRVPISMELFHGIGEFFTYAIPSAGMVCLEWWSFELLTLLSGLLPNPELETSVLSICLSIITTIYTIPEAIGSAASTRVSNALGAGSPQSARVSVSAAMTLAVSEAILVSSIIFASRQVLGYVFSNEQDVVDYVTDMVPLLSISVIVDTLHGTLSAHRSICKPLSLLCCGNSNGCHIGFLATIKRKRPLDWNTDWCLLPNNYAISHHKLYKLGKTGLPPLPSLYGSALGTV

SEQ ID NO: 162356 - protein, 279 aa, Glycine max
  Coding DNA Sequence Number=SeqID_45578
  Gene Ontology: Mol. function=aspartyl esterase activity; Cellular component=cell wall; Biological process=cell wall modification
  Homolog annotation: Hit_ID=Q42920; Match level="QueryCoverage=63%, HitCoverage=48%, E-value=3e-66, Identity=58%"; Hit description =Pectinesterase precursor
  Pfam annotation: Domain name=Pectinesterase; Domain location=1-169; Score=124.9; E_value=2.3e-34; Accession=PF01095.10; Description =Pectinesterase
MAKDVGFENTAGAEKHQAVALRVTADQAMFYNCQMDVFQDTPYTQSQRQFYHDCTITGTIDFVFKDAFGMFQNCKLIVRKPLPNQQCMVTAGGRSKAESPSALVFQSCHFSGEPQLTQLQPKIACLGRPWKTYGPSADTSLRVKWSGVKTITSAAATNYYPGRFFELINSSTERDAWIVDARSFIASTSLLMKNVSGDKTSKAKVRSMGLHDRFMIWAWVERNEENESKRWHIWNSESNEDSEDIEVEKEEDRKRKGERFVILGIDLKPDLDLSLLFSC

SEQ ID NO: 162357 - protein, 134 aa, Glycine max
  Coding DNA Sequence Number=SeqID_45579
  Homolog annotation: Hit_ID=UPI00005A207A; Match level="QueryCoverage =59%, HitCoverage=13%, E-value=2e-12, Identity=50%"; Hit description =PREDICTED: similar to kleisin beta isoform 2
MTKGTSKPGGSGSGGFHAVHAERDLESNWEVDLAKKLEEYLLKICSGEIIGEEEGHSHVNFAEAALLLQGSIQVYSRKVEYLYTLVLRALEFLSQKSLPLVYAKMLFLDYIPLATGHQSETVQLYSCTRACPQH

SEQ ID NO: 162358 - protein, 136 aa, Glycine max
  Coding DNA Sequence Number=SeqID_45580
  Homolog annotation: Hit_ID=Q9SC90; Match level="QueryCoverage=44%, HitCoverage=10%, E-value=2e-18, Identity=67%"; Hit description =Pectin methyl-esterase PER precursor
  Pfam annotation: Domain name=Pectinesterase; Domain location=1-99; Score=-244.6; E_value=0.0042; Accession=PF01095.10; Description =Pectinesterase
MATAGGRNKADSPSALVFQSCHFTGEPELATAEPKVEFLGRPWMSYSKVVIMDSQIENVFLPDGPYECPNSYRAGPKSYRISPKSYRVNQSMRMGITGNNSENAGSNIQESFTTILAFHYGSITYPNMLEDIVVTN

SEQ ID NO: 162359 - protein, 84 aa, Glycine max
  Coding DNA Sequence Number=SeqID_45581
MSLVFSICRTFTDDAKTLCAEADNYTIFPTMLRACPSATVKLHGFTLVTSCQWDIIQKQHFCIHKGKAVYNPPAPPYFRKARSL

SEQ ID NO: 162360 - protein, 396 aa, Glycine max
  Coding DNA Sequence Number=SeqID_45582
  Gene Ontology: Mol. function=acyl carrier activity; Cellular component=chloroplast; Biological process=fatty acid biosynthetic process
  Homolog annotation: Hit_ID=Q5QMV2; Match level="QueryCoverage=97%, HitCoverage=97%, E-value=1e-127, Identity=58%"; Hit description =Putative acyl-(Acyl carrier protein) thioesterase
  Pfam annotation: Domain name=Acyl-ACP_TE; Domain location=93-387; Score=399.2; E_value=6e-117; Accession=PF01643.8; Description=Acyl -ACP thioesterase
  Subcellular localization annotation: CTP_CleavageSite=16; ConfidenceScore=5.24e-01
MAATFSYPASTYFVRCCSMRENHDQVNHQMNSSIRTNGSFRSPVKVESLSQTASTITTLGQAVTIGENGLRQNIPTKKQLVDPHRQGLIIEGGVGYRQTVVIRSYEVGADKTATLESILNLLQETALNHVWMSGLLSDGFGATHGMVRNNLIWVVSRMQVLIDYYPIWGEVVEIDTWVGASGKNGMRRDWLIRSQATGHIFARATSTWVMMNRKTRRLSKMPEEVRAEVSPWFIEKQAIKEDVQEKIVKLDKEAKYMNSDLKPKRSDLDMNQHVNNVKYVRWMLETIPDQILEEHQLSGITLEYRRECGSSDIVQSLCEPEEDEILHGVVEPDYCTNLLNGLSSDIINGSGVLTCLEKRPLRYTHLLQTKGEKQNDEIVRGRTTWKRKISTMPFST

SEQ ID NO: 162361 - protein, 109 aa, Glycine max
  Coding DNA Sequence Number=SeqID_45583
  Gene Ontology: Mol. function=aspartyl esterase activity; Cellular component=cell wall; Biological process=cell wall modification
  Homolog annotation: Hit_ID=Q42920; Match level="QueryCoverage=59%, HitCoverage=18%, E-value=2e-15, Identity=51%"; Hit description =Pectinesterase precursor
MVKNNREGLPFLASLQSFLWRWWPRRRLLSEEETLVDDYSSWVNEGQRRLLGLGGIKPNAIVTQDATSQFATLSDALKTVPPKNVIVGKDMTHVTVIGDGPMYKDEIHR

SEQ ID NO: 162362 - protein, 247 aa, Glycine max
  Coding DNA Sequence Number=SeqID_45584
MYNYHEKGRAPDLESVLADFMTYQASSKGDGYSMQQQETQFEKDYSLANYQWELEWQPYYHNEAEGLSNLDDLLMQFKGTLDSTQQGFKRAETQIGKLVDDMIKVMARREEEYAEIETHQESILQVNTIHHQLITKEETDEVSIIPEYPYIATTGYVVGKDKGQLELSVEDQKISFDLFEAMKHTDISDACFEEEEVEQEIELSASTMVLQFPLEKDPNYVIDCLVCDEELDDPKDNPIGHVVLEEL

SEQ ID NO: 162363 - protein, 78 aa, Glycine max
  Coding DNA Sequence Number=SeqID_45585
MSVSHASGQPCAFIYSVLHVNEVWERAKKCETSSFPLLYFPSKSKLVIKSGWRLVEETFKMQPSEICIYALYSDHSIM

SEQ ID NO: 162364 - protein, 73 aa, Glycine max
  Coding DNA Sequence Number=SeqID_45586
MNYINQECKFPKDKSWYAKMKTFYQILRGDLELLQVIADRYPYVEKQNLKELWPQLPDHETQQRLKKIVMIGS

SEQ ID NO: 162365 - protein, 984 aa, Glycine max
  Coding DNA Sequence Number=SeqID_45587
  Gene Ontology: Mol. function=single-stranded DNA binding; Cellular component=nucleus; Biological process=response to DNA damage stimulus
  Homolog annotation: Hit_ID=Q9ATY5; Match level="QueryCoverage=99%, HitCoverage=55%, E-value=1e-88, Identity=32%"; Hit description=DNA -repair protein UVH3
MRVDSLKALRLKELADDLKNQRMKKNSDTKGQKKSNQKDFVGSDLGGSHVKELDEMSVAKYAAKEDGNSSQATILTTYNQEELHEMLAASIAAEKNGIHARKGMPSIVINPLEEERDADEQIILPSVNAEVDMAVLAALPQSMQLDILAQLKGKKTEGLVKEVDNQNQHDVNYRGKGKGILLIEADMVGCSSRHDNVTSRSDNQHSIDEMLAASIAMEENEELVNNTSTSVGASAIEEEEVDYDEDEEMILPAMHGKIDPAVLASLPPSMQLDLLVQMRERLIAENRQKYQKVKKDDLQFILVSALLFLTSSCDCALNLICHSIGSFQDPAKFSELQIQAYLKTVAFRRDIDEVQKAAAVGGVGGVQTSRIASEANREYIFSSSFTGDKQHFYVLIKYDALWNLNVDNFLALFIPKYVRELTSTSLEKNKDTQQKVQGVHPSQNLTDSIVAGNDSNTSSGLVHNEPGEPADESIQTYLDERGRFRVSRLRAMGMRMTCDIQRNLDLLKEIEQERAYVNKAANIGTVENAENNGPYESSGIQLVGKSQEMNVDLVGQNMQNEQTMLDRDTLIEISFEYDCKNKFANDEDDIFSSLVGGNPVAIFGADDTAATEQPSHSDSDCDWEEGILEGKSNAYPEHDVVELKSSVADDHKNNEREVEWEEGDCDGANSTLLSGKLASQGWLEEESDLQEAIRRSLESIGDMKLKCMPAVDEHSNTYENKLDCGLEHGDDLYYSDPVDLNDNVGFLNNKNREDSTEKNELHEIEDGDKKHDFVSGNNEQTFHFHGSQSKSSVTFNSNNTEILIDTPCRMDSHSCFVDSISDTNVMTKDLVPMVAEQLLDKHDDGKVSFYCDNTSKVDPVGATEEGKKNYIQESEPLSNSTDTTKPAILVESSLKGSTEDLDIEPKLPSEDSNRNFYEERNSSLGNDVVNTPGHFPAHAAEVSLEEEMQILGQEYINLENEQRKLERNAESVNSELFTECQVWN

SEQ ID NO: 162366 - protein, 449 aa, Glycine max
  Coding DNA Sequence Number=SeqID_45588
  Gene Ontology: Mol. function=single-stranded DNA binding; Cellular component=nucleus; Biological process=response to DNA damage stimulus
  Homolog annotation: Hit_ID=Q9ATY5; Match level="QueryCoverage=79%, HitCoverage=21%, E-value=1e-109, Identity=58%"; Hit description=DNA -repair protein UVH3
  Pfam annotation: Domain name=XPG_I; Domain location=1-78; Score =114.5; E_value=3e-31; Accession=PF00867.9; Description=XPG I-region
MEAEAQCAYLELEKLVDGVVTDDSDVLLFGARSVYKNIFDDRKYVETYFMEDIEKELGLTREKLIRMALLLGSDYTEGVSGIGIVNAIEVVNAFPEEDGLLKFRQWVESPDPTILGRLDANSGSNSRKKGSKIEEKMNSSSCNVKESAVMQNICHAQEQNELSDYIQEIKQTFFNKHRNVSKNWHIPSSFPSDTVISAYYSPHVDKSTEPFTWGKPDHLVLRKLCWEKFGWTGQKADELILPVLKEYNKRETQLRLEAFYNFNERFAKIRSKRIKKAVKGITGKQPSDLIDDSAEEFSKSRKTGREPEDITLETSRGIEGNLEGRRKSKIKQSRKNDTVAKEQSKKKKVNDDPSSAPGTSEIENLQPSLQIEEEQHDGKALIRNRSGRGRGRIMGIKRGRDNKGLSFQSCETEASSGSSDIDDHGPRVHVDRVPKDVRRVNLHSDFSDL

SEQ ID NO: 162367 - protein, 189 aa, Glycine max
  Coding DNA Sequence Number=SeqID_45589
  Homolog annotation: Hit_ID=Q9AVH2; Match level="QueryCoverage=44%, HitCoverage=41%, E-value=1e-39, Identity=70%"; Hit description =Putative senescence-associated protein
RQNEREPTNGSLFWPNIVEEERDTGLIGDGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPC

SEQ ID NO: 162368 - protein, 232 aa, Glycine max
  Coding DNA Sequence Number=SeqID_45590
MRETHEAPQDHNLADFEPHLRHATEGKTFCSIPLPNTLRGPQYYPQLQPFHFAVGRVPPAMMKRGKFDHIEERLRSIERGKDYAFADMVELCLVPDVVIPPKFKVLDFDKYKGTTCPKNHLKMYCRKMGAYAKDEKLLMHFFQESLIGAAITWYSNLEPSRVGSWKDLMVAFIRQYHYNSDMALDRIQLQNMDLAVQVAPPMMEREMITMIVDTLPVFYYEKMVGYMPSSFV

SEQ ID NO: 162369 - protein, 660 aa, Glycine max
  Coding DNA Sequence Number=SeqID_45591
  Gene Ontology: Mol. function=RNA-directed DNA polymerase activity; Biological process=RNA-dependent DNA replication
MANRLIWVRCTKLPLHALEEEILVKVVLSFGSLSVRRYSSKPSQCRCWEWKYQKSTIDGSSNGSEIGVDIPSEFAEYEDMTHIGLEELIREDKDRADQQDNERCVIGLMAEVRNKDNLGTGKSMARGDTLGCEKEIFQTEGDIEVNGEGIKENGESNFGGMESERKYGLSKAQSCIEGEGHSRQNPIKETNTSLSTLNGLKTDENKSRRRKLRFKIHSLNNNIANGGIRNGEAMCKRIMDMENRDKHATSSSSRSQNEGDIASKEELQMMCLQETKNDVIEKKFCQGLWEENDGIDVVMVNVYASCERVARRRLWEDLKLWKENSEIKEWCVLGDYNCVRRASERQGVHSRDNKGGEMREFLILFMKWSWKREWHNMLEVSTQYILNRNIFDHCPILLKNLVVDWGPKPFRIVDWWLEEKECVALVEREWGSMEAYGFIEGDWERPLLDGVHFNTISHGDNNMLVGYFDEAEIKEAIWDCGSSKSLWQDRYNFKFIKKFWSTLKGDIMSLKVRQGLEDFHPISMVGCMSLVHSVLVANEVVDEAKRLKKEWMVFKVYFEKANDFGLSGLMREATSKSLFKGFCMGKDNIEVNLLQYVNDTIFVGEISWRNVMTIKVENGRVGVVVEFFNCRILSFPYTYLDLPIGANPRKELTWEPIIKK

SEQ ID NO: 162370 - protein, 70 aa, Glycine max
  Coding DNA Sequence Number=SeqID_45592
MAFIHSVTNYNSEVDNESEMRGSRRDFGRGSRVNTGRGCNGDRVENLIEEILDDFDETKHWKIFQRYGKV

SEQ ID NO: 162371 - protein, 151 aa, Glycine max
  Coding DNA Sequence Number=SeqID_45593
MPKIRKERGKRVISGGFLNPGSPRLASGLPGPPNSLWVKEKKKKEDKNEAKALSNYDRNRLLHRSLFVLRSSSGPTPYRFSPLFIKTSLEVVSVEAMSSKVILLMPMMPKNQESSKFQRFKNEVFKNQVSRIIKIKIQHSRFKNQEKNQSR

SEQ ID NO: 162372 - protein, 847 aa, Glycine max
  Coding DNA Sequence Number=SeqID_45594
  Gene Ontology: Mol. function=oxidoreductase activity, acting on the CH-CH group of donors; Cellular component=mitochondrion; Biological process=electron transport
  Homolog annotation: Hit_ID=Q67ZU5; Match level="QueryCoverage=99%, HitCoverage=99%, E-value=0.0, Identity=72%"; Hit description=MRNA, complete cds, clone: RAFL22-73-C24
  Pfam annotation: Domain name=APH; Domain location=42-300; Score =177.6; E_value=3.1e-50; Accession=PF01636.13; Description =Phosphotransferase enzyme family
  Pfam annotation: Domain name=Acyl-CoA_dh_1; Domain location=686-842; Score=119.6; E_value=8.6e-33; Accession=PF00441.14; Description=Acyl- CoA dehydrogenase, C-terminal doma
  Pfam annotation: Domain name=Acyl-CoA_dh_2; Domain location=701-831; Score=-7.1; E_value=0.0011; Accession=PF08028.2; Description=Acyl -CoA dehydrogenase, C-terminal doma
  Pfam annotation: Domain name=Acyl-CoA_dh_M; Domain location=573-627; Score=73.9; E_value=5e-19; Accession=PF02770.9; Description=Acyl-CoA dehydrogenase, middle domain
  Pfam annotation: Domain name=DUF227; Domain location=48-290; Score= -133.6; E_value=0.034; Accession=PF02958.10; Description=Domain of unknown function (DUF227)
  Pfam annotation: Domain name=Kdo; Domain location=44-209; Score= -87.3; E_value=0.091; Accession=PF06293.4; Description=Lipopolysacchar ide kinase (Kdo)
  Pfam module annotation: Pfam domain module=APH::Acyl-CoA_dh_1::Acyl -CoA_dh_2::Acyl-CoA_dh_M::DUF227::Kdo; Domain location=42-300::686 -842::701-831::573-627::48-290::44-209
MARNTADLVTQLNVAHHFPHDSLLRYCSSHVSGFPHPPTHFTVSQFGHGQSNPTYLLKVGSHGSLVKHYVLRKKPPGTLLASAHAVDREFQVLQALGAHTKVPVPKVFCLCNDPTVIGTAFYIMEYLEGRIFIDPKLPGVAPENRRAIYRATAKALASLHSANVDSIGLGNYGRRNDYCKRQIERWAKQYVASTREGKPASYPKMFALIDWLRHQIPLEDTSGATGGLVHGDFRIDNLVFHPTEDRVIGILDWELSTLGNQMCDVAYSCMTYVADIGHEKVREGMERSGLSEGIPSLPEYLADYCSLAGRKWPVAEWKFYVAFSFFRAASIHAGVYNRWVKGNASGGERARHTEVLANGLIDTAWKFIEHKSVLPQHPPSDANAQDYSKELVNGNDIQGLSNQGKFVPSQKVLALRNKLIKFMEEHIYPMENEFYKLTQSDSRWTVYPAEEKLKEMAKKEGLWNLWIPKLFLSIYQSSPSSQIDSAVRARNLLFDGSNNYRSSDANDLLLGAGLTNLEYGYLCEIMGHSLWAPQVFNCGAPDTGNMEVLLRYGNKEQLQEWLIPLLDGTIRSGFAMTEPHVASSDATNIECSIKRQGDSYIINGTKWWTSGAMDPRCRILIVMGKTDFNAVKHKQQSMILVDVQTPGVHIKRPLTVFGFDDAPHGHAEVTFENVCVPAKNIILGEGRGFEIAQGRLGPGRLHHCMRLIGVAERGMHMMIQRAVGRRTFGKLIAQHGSFISDMAKLFVLQCRIELESTRLLVLEAADQLDRHGNKKARGILAMAKVAAPNMALKVLDMAIQVHGAAGVSSDTVLAHLWAAARTLRIADGPDEVHLGTIAKLELQKAKL

SEQ ID NO: 162373 - protein, 556 aa, Glycine max
  Coding DNA Sequence Number=SeqID_45595
  Gene Ontology: Mol. function=transferase activity, transferring glycosyl groups; Biological process=sucrose metabolic process
  Homolog annotation: Hit_ID=Q00917; Match level="QueryCoverage=100%, HitCoverage=68%, E-value=0.0, Identity=72%"; Hit description=Sucrose synthase
  Pfam annotation: Domain name=Glycos_transf_1; Domain location=316 -506; Score=78.5; E_value=2.1e-20; Accession=PF00534.10; Description =Glycosyl transferases group 1
  Pfam annotation: Domain name=Sucrose_synth; Domain location=1-344; Score=323.7; E_value=3.2e-94; Accession=PF00862.10; Description =Sucrose synthase
  Pfam module annotation: Pfam domain module=Glycos_transf_1::Sucrose _synth; Domain location=316-506::1-344
MVHLLLEILQAPDPNTLESFLGRIPMVFNVVVVSPHGYFGQANILGLPDTGGQDSGSSPGHATVLNTWRESFAAHSGPIRLEQDCLRNTVTHDGQLVYILDQVRALENEMLIKIQKQGLDVSPKILIVTRLIPEAKGTTCNQRLERVSGTEHSYILRVPFRTKNGILRKWISRFDMWPYLETFAEDASHEIAGELQGIPDLIIGNCSDGNLVATLLSYKLGITQCNIAHALEKTKHPDSDIYWKKYEDKYHFTCQFTADLIAMNNADFIITSTYQEIAGSKNNVGQYESYTAFTLPGLYRVVHGIDVFDPKFNIVSPGADIGLLNDRSKPIIFSMARIDPVKNITGLVECFGKSSKLRELVNLVVVGGYIDVQKSTDIEEMREIEKMHNLIEEYNLHGQFRWIKAQMNRARNGELYRYIADVKGAFVQPALYEAFGLTVVEAMTCGLPTFATCHGGPAEIIEHGVSGFHIEPHHPDHVAAILINFFEQCQSDPGYWNKISDAGLRRIHERYTWKIYSERLLTLAGVYGFWKHVSKLEKRETRRYLEMFYILKFRDL

SEQ ID NO: 162374 - protein, 66 aa, Glycine max
  Coding DNA Sequence Number=SeqID_45596
MGILGSSSLVVVVTLDSDEVFIVVSLYTRIDTQAKLGFDVFKSQGKALNFITNESRFACRSRTLVR

SEQ ID NO: 162375 - protein, 125 aa, Glycine max
  Coding DNA Sequence Number=SeqID_45597
  Gene Ontology: Mol. function=RNA-directed DNA polymerase activity; Biological process=RNA-dependent DNA replication
  Homolog annotation: Hit_ID=Q1S6N2; Match level="QueryCoverage=65%, HitCoverage=27%, E-value=2e-11, Identity=46%"; Hit description=RNA -directed DNA polymerase
MSWAIWNTLQLLEDLLGDYERGYGEIGFWRKVGGMDPILFVTSSFISVLVNGSPTLEFKAQRGLRQGYPLAPFLFNIVVEGLCSMTRQAIEKNIFSSFLCKKLVSTYKRRKEKKEKTYFLIEGKG

SEQ ID NO: 162376 - protein, 231 aa, Glycine max
  Coding DNA Sequence Number=SeqID_45598
MAPTPADLRKIGAEGFALIDMFYGPPRRNSANYAYIPWAKRRTLLGSTPPPEFLLGPPQSAIKGDLLNLFLGSNLLTESLSLEPNQIHILSFPPSIEKESPEQARSHSPISVFLWKTFISHIQFFDNVGDKYEHIQFYSSLYNDKNHFKSITGALVARTQELESSLIIKTFGSLNLSSNKPKTQVATTLIKSVPTTPTFMAPPQADLWKIGAERLCSDRQVLWSIKGEQCQ

SEQ ID NO: 162377 - protein, 48 aa, Glycine max
  Coding DNA Sequence Number=SeqID_45599
MVFMGRRSSENNMWNVIGLVVCKLLGTYSLNVGSHATFGIIGTHGMEI

SEQ ID NO: 162378 - protein, 99 aa, Glycine max
  Coding DNA Sequence Number=SeqID_45600
MAPPTDLRVIGSEGFALIDGFYGPSARRRHNTNGVFPSRQGRWVVQMPNDELEDPISVINSRDAAARYGGIMIMNYPKPQTRLGSSSKNCNKIFCVDCG

SEQ ID NO: 162379 - protein, 93 aa, Glycine max
  Coding DNA Sequence Number=SeqID_45601
MSISTRPMDQRSEEGGYSSSDLIEERNGGSTWTMTREGHEGDDGRRGVPHQLLEASRKRLSSSKTSSVKQCLSLDIPLWTVEDMKEMEKRKIE

SEQ ID NO: 162380 - protein, 148 aa, Glycine max
  Coding DNA Sequence Number=SeqID_45602
  Gene Ontology: Mol. function=RNA-directed DNA polymerase activity; Cellular component=signal recognition particle, endoplasmic reticulum targeting; Biological process=RNA-dependent DNA replication
  Homolog annotation: Hit_ID=Q8S8M1; Match level="QueryCoverage=91%, HitCoverage=14%, E-value=2e-15, Identity=34%"; Hit description =Putative retroelement integrase
  Pfam annotation: Domain name=zf-CCHC; Domain location=121-138; Score =27.5; E_value=2.9e-05; Accession=PF00098.13; Description=Zinc knuckle
MPSYVGIYKRERLRDEEPEDFASETPEVVPRQYMSVEESYQKMEMVVIRANIDEDNEATMAHFLSGLNPDIRDVVDLQEYVELEDFLHKDKPKREEGSSTDQGKSLVKPNTSASSTGTSNIKCFKCLGRGHIAFECPTIRTDRAHEGR

SEQ ID NO: 162381 - protein, 157 aa, Glycine max
  Coding DNA Sequence Number=SeqID_45603
  Gene Ontology: Mol. function=RNA-directed DNA polymerase activity; Biological process=RNA-dependent DNA replication
MGAREHEPMCCSDDFGPKKDGTWKKYTECRPINNIPKLNDLLDELHDACIFSMINLKNGAKGAQLDEEKVKVIEEWPMPKTMSEVRSFHGLASFYKRKSKLQPRGDGPFQVLERINSNIYKIDLAGNDGDIEAQGSTQGLRGHMTKARARKAEETLR

SEQ ID NO: 162382 - protein, 152 aa, Glycine max
  Coding DNA Sequence Number=SeqID_45604
  Gene Ontology: Mol. function=oxidoreductase activity; Cellular component=ribonucleoprotein complex; Biological process=translation
  Homolog annotation: Hit_ID=Q1SIM7; Match level="QueryCoverage=38%, HitCoverage=14%, E-value=6e-22, Identity=84%"; Hit description =Aldo/keto reductase
MREIKVQKLVLNISVSESGDHLTRATKVETPSHLTASTNGDATFGEWFEGEGIYELLRRNISDTGCFGFGIQEHIDLRIKKSSGFSMYRGVTRPDRYVASFGEFSYHYSKWRSSVPFVEQLQAFQELMNEGKVHYIRVSNETSYGVMEFVHA

SEQ ID NO: 162383 - protein, 184 aa, Glycine max
  Coding DNA Sequence Number=SeqID_45605
MELQVVEGEVVGGPERINISSQGLCGSYAKEHIAKDGVGGRVVVGSWEVLVNVHSLCDLSRNKTQWDDLKATKSFSSIGLWCILGDFNIVWGPYEKHGIGYEELSLGKRSLFNQFIQEMEVANVLWLVEVLLGTCLMAKLAKSKLDKFMVSCLWFNIFPSSTSFILERNISDRCPIIMKDLRVD

SEQ ID NO: 162384 - protein, 172 aa, Glycine max
  Coding DNA Sequence Number=SeqID_45606
  Gene Ontology: Cellular component=integral to membrane
MECYSYGLHEEERHLEEVDLVEGELVRVADYYPEGEEGEGEDRVENGKLGLVDREVIAGVYGVGVEVVEPGVDKHGEYSLGIVTGLVWLAEAEGFDLIDRFYGAPIRRPANVSKQRQGRSGVQATHQNHKEEPVVINSREAASKFGGIMVVNYYPKTKPQNRWGKFIQAFKP

SEQ ID NO: 162385 - protein, 139 aa, Glycine max
  Coding DNA Sequence Number=SeqID_45607
  Subcellular localization annotation: CTP_CleavageSite=54; ConfidenceScore=5.19e-01
GFPSSDYGLCQFYGVPVAPNKVIRPRINRAFIKKVLCPQTGVGRDTTVALGWPVAGNRRTATTSRVHLCSSTKRFGVLPTPHGRPIGDQVQSQSHIGTHLVAHDPKNLNKTSTSSEGSKIPGICMYIAKIPHKNIHMFR

SEQ ID NO: 162386 - protein, 159 aa, Glycine max
  Coding DNA Sequence Number=SeqID_45608
  Gene Ontology: Mol. function=protein binding; Biological process =defense response
  Homolog annotation: Hit_ID=Q1S328; Match level="QueryCoverage=77%, HitCoverage=15%, E-value=4e-15, Identity=36%"; Hit description =Disease resistance protein
MASACYRVPLLLEPVGGFLKRKRVKVWRQNKKLSKVLGCDTKSFTSIKKYLDDVLEDKPIIKECFMDLGLFPQDHKISIAALVDIWTERQHKPDDDLDLRQLDEDHAMNVVYDLTDWHLANIVVRSNDNVNHGGRDNGGGDYDSHGSSGHHDDYVFEIF

SEQ ID NO: 162387 - protein, 117 aa, Glycine max
  Coding DNA Sequence Number=SeqID_45609
MTIICLRMSSGSSPLDDKRRRMTIICLCVPSDTIVSGWPKVCGMTIICLHMSSGSSPRDDKRRRMTIICLYVPSDTIVSGWKKGQYDRDCGAAEKSEALAPMYPQFEMRNSDLRSSG

SEQ ID NO: 162388 - protein, 113 aa, Glycine max
  Coding DNA Sequence Number=SeqID_45610
  Gene Ontology: Mol. function=solute:hydrogen antiporter activity; Cellular component=integral to membrane; Biological process =regulation of pH
  Homolog annotation: Hit_ID=Q75L14; Match level="QueryCoverage=71%, HitCoverage=15%, E-value=5e-23, Identity=59%"; Hit description =Putative Na+/H+ antiporter
  Subcellular localization annotation: CTP_CleavageSite=62; ConfidenceScore=5.02e-01
MKSRLGLRVEGGIPAWLAEREANLGRSNPKRGIHAVTSLNATAAMATSPMRVVRSLSPARVRASTGSTVIERATPMKTRMPHMKGREVPTAAMQNAFRPLRQMEWRSSSRPKS

SEQ ID NO: 162389 - protein, 99 aa, Glycine max
  Coding DNA Sequence Number=SeqID_45611
MEGINIYNLALEGDDIELEIPTKPNDKTTNDLSLCFVARFFTDRAIIRGPWSFDKHLLILGVSKEGEALENVPLFLVLFWVQVHGLPMGFMLDKWPQIS

SEQ ID NO: 162390 - protein, 40 aa, Glycine max
  Coding DNA Sequence Number=SeqID_45612
MVLQDQYETESIAQHGVELLYATMTKIFSSLQEAYKGQFC

SEQ ID NO: 162391 - protein, 185 aa, Glycine max
  Coding DNA Sequence Number=SeqID_45613
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=1e-23, Identity=32%"; Hit description= UPI00006A17C9 related cluster
RGLHALAFIELHSLTFKGLHILIFKRLHVRTFRELHALTIGGLHVLTIRGLRVLTFRGLHALAFRGLHILALRGLHVVPFRGTHALALRGLHVLAFRGLHTLTFRGLHVLAFRRLHVLAFRRLHALPFRGLHVLTFGLHVRTFRELHALTFGGLHVLTIRRLHVLTFRGMHALAFRGLQPSPSED

SEQ ID NO: 162392 - protein, 211 aa, Glycine max
  Coding DNA Sequence Number=SeqID_45614
  Gene Ontology: Mol. function=ATP-dependent DNA helicase activity; Cellular component=intracellular; Biological process=DNA recombination
  Homolog annotation: Hit_ID=Q1GXB5; Match level="QueryCoverage=100%, HitCoverage=30%, E-value=4e-81, Identity=71%"; Hit description=ATP -dependent DNA helicase RecG
  Pfam annotation: Domain name=Helicase_C; Domain location=30-107; Score=79.2; E_value=1.2e-20; Accession=PF00271.21; Description =Helicase conserved C-terminal domain
GHQAYWVCPLIEESEALQLQTANDTFAYMQQAFPELRVGLVHGRMKTAEKQAVMQAFAANDIHLLVATTVIEVGVDVPNASLMVIEHAERMGLSQLHQLRGRVGRGSAKSTCILLYNKQQCSQIGRQRLKVIFESSDGFEIAQADLHIRGPGELLGTRQSGVPMLKIADLERDADLLDIAKTMADQLLQRAPAAVSAHLQRWLSQAEDWVK

SEQ ID NO: 162393 - protein, 85 aa, Glycine max
  Coding DNA Sequence Number=SeqID_45615
MLMCNHQFSSVGLIELLCTIGRTPDGILNILEATMTPTRQNEFVGYLLTGINPKKFDIPSGCTMDEPKDLIKQIAPHGIPPYGIH

SEQ ID NO: 162394 - protein, 180 aa, Glycine max
  Coding DNA Sequence Number=SeqID_45616
MAPQADFGKFGFEIEKLFGRQKSFGNGNAPATHQNLCQYKFYPTYGATKVVHMHVEDVKCNEAASRFISEKRTELQMKGAMAATKRIGVLIMFFALAYYVDAISRTKPVASPDIYKGRNVAKDKIAPGEKIVNVLSFGAKPDGKFDCTQEYHAIKANHCISKVQDLSNPTREYDTFYEGL

SEQ ID NO: 162395 - protein, 45 aa, Glycine max
  Coding DNA Sequence Number=SeqID_45617
MGIVDVLSEKGLHWIVAESEVGAYTSILYNMFQTQINGTKSLTKT

SEQ ID NO: 162396 - protein, 809 aa, Glycine max
  Coding DNA Sequence Number=SeqID_45618
  Gene Ontology: Mol. function=phospholipase D activity; Cellular component=plasma membrane; Biological process=lipid catabolic process
  Homolog annotation: Hit_ID=Q9LRZ5; Match level="QueryCoverage=98%, HitCoverage=67%, E-value=0.0, Identity=60%"; Hit description =Phospholipase D p1
  Pfam annotation: Domain name=PH; Domain location=276-402; Score=19.7; E_value=0.011; Accession=PF00169.19; Description=PH domain
  Pfam annotation: Domain name=PLDc; Domain location=537-564; Score =44.2; E_value=4.6e-10; Accession=PF00614.12; Description =Phospholipase D. Active site motif
  Pfam module annotation: Pfam domain module=PH::PLDc; Domain location =276-402::537-564
  Subcellular localization annotation: CTP_CleavageSite=55; ConfidenceScore=5.14e-01
MATEQLMSGGGSRYVQMKSSPPSSPPAAAAEEMSSVPSFRHSGAEANRIFEELPKASIVSVSRPDASDISPMQLSYTIQVQYKQFKWELTKKAHQVFILHFSLKKRAFIEEIHEKQEQVKEWLQNLGIGEHTAMVQDDDEGDDETVPLHTEETHESAKDRDVPSSAALPIIRPALGRQHSIADRAKRAMQGYLNHFLGNISIVNSHEGYLLSKSVVVFLYYTGNSGNSLSILRAKVACIRPSQDPTMVGACALGCLLVCKFLEVSKLSFSPEYGPKLKEEYVMVKHLPKIQKDDDSRKCCLSDCFSCCNDNWQKVWAVLKPGFLALLADPFDTQPLDIIVFDVLPASDGNGDGRLSLASEMKERNPLRHSFKVTCGIRSIRIRVKSSSKVKDWVAAINDAGLRPPEGWCHPHRYGSFAPPRGLVEDGSQAQWFIDGRAAFEAIASSIEAAKSEIFICGWWLCPELYLRRPFHTHASSRLDNLLEAKAKQGVQIYILLYKEVALALKINSVYSKKKLLSIHENVRVLRYPDHFSTGVYLWSHHEKLVIIDNHICFIGGLDLCFGRYDTSEHKVGDFPPLIWPGKDYYNPRESEPNSWEDTMKDELEREKYPRMPWHDVHCALWGPPCRDIARHFVQRWNYAKRNKAPYEQAIPLLMPQHHMSSQERRFIFLIFPRQDIPLLLPQESDGLDTHEGDQKLNGVISFSHQLDKPRRISSGLPFSFRKAKIVAVGPDTPMKGFVDDLDSEHDREKMSLDRVAHIDLQSTNPEWWETQERGDQGGFAEESGQVGPLASCRCQVCCSHDLLKYNCH

SEQ ID NO: 162397 - protein, 56 aa, Glycine max
  Coding DNA Sequence Number=SeqID_45619
MCSLVQGSAVNRFEKGAGKIREVSGNEFLGAKRSLMEGSREQKCLYDRVTASVGVT

SEQ ID NO: 162398 - protein, 106 aa, Glycine max
  Coding DNA Sequence Number=SeqID_45620
  Gene Ontology: Mol. function=RNA-directed DNA polymerase activity; Biological process=RNA-dependent DNA replication
MACEKLKHKGKGFQDFYRKPSNSKGVICLDVSVGSKRRPTMFLVISLQVNFNMLLGREWIHGVKAVPSMIYHKLFFRNEDGKLEMVEVDQSSYGIYTNSYIGSLNG

SEQ ID NO: 162399 - protein, 113 aa, Glycine max
  Coding DNA Sequence Number=SeqID_45621
MYGPCARLNYPENDVECITKPAASLNSDKLKCSEVGVLHDTKEKQDLFEDYVVDNAKEESKAVCKITQTRKARQEFMTGLSRRTLKQTYLENVNITERIISLKFYGHEIWSWL

SEQ ID NO: 162400 - protein, 1098 aa, Glycine max
  Coding DNA Sequence Number=SeqID_45622
  Gene Ontology: Mol. function=transmembrane receptor activity; Cellular component=membrane; Biological process=defense response
  Homolog annotation: Hit_ID=Q1SI46; Match level="QueryCoverage=96%, HitCoverage=94%, E-value=0.0, Identity=51%"; Hit description=Leucine Rich Repeat, putative
  Pfam annotation: Domain name=LRR_1; Domain location=664-685; Score =8.7; E_value=6.7; Accession=PF00560.23; Description=Leucine Rich Repeat
  Pfam annotation: Domain name=LRR_1; Domain location=687-709; Score =12.2; E_value=1.5; Accession=PF00560.23; Description=Leucine Rich Repeat
  Pfam annotation: Domain name=LRR_1; Domain location=711-732; Score =10.4; E_value=3.2; Accession=PF00560.23; Description=Leucine Rich Repeat
  Pfam annotation: Domain name=LRR_1; Domain location=734-755; Score =4.1; E_value=48; Accession=PF00560.23; Description=Leucine Rich Repeat
  Pfam annotation: Domain name=LRR_1; Domain location=778-799; Score =7.9; E_value=9.4; Accession=PF00560.23; Description=Leucine Rich Repeat
  Pfam annotation: Domain name=LRR_1; Domain location=801-820; Score =6.8; E_value=15; Accession=PF00560.23; Description=Leucine Rich Repeat
  Pfam annotation: Domain name=LRR_1; Domain location=822-843; Score =7.5; E_value=11; Accession=PF00560.23; Description=Leucine Rich Repeat
  Pfam annotation: Domain name=LRR_3; Domain location=641-660; Score =23.5; E_value=0.00077; Accession=PF07725.3; Description=Leucine Rich Repeat
  Pfam annotation: Domain name=NACHT; Domain location=238-390; Score= -20.7; E_value=0.0024; Accession=PF05729.3; Description=NACHT domain
  Pfam annotation: Domain name=NB-ARC; Domain location=198-493; Score =121.5; E_value=2.4e-33; Accession=PF00931.13; Description=NB-ARC domain
  Pfam annotation: Domain name=TIR; Domain location=47-176; Score =148.0; E_value=2.5e-41; Accession=PF01582.10; Description=TIR domain
  Pfam module annotation: Pfam domain module=LRR_1::LRR_1::LRR_1::LRR _1::LRR_1::LRR_1::LRR_1::LRR_3::NACHT::NB-ARC::TIR; Domain location =664-685::687-709::711-732::734-755::778-799::801-820::822-843::641 -660::238-390::198-493::47-176
MAYFFVFCLLCFGLFFFVCWLLQKLSDPVVEKPVSEDNKAPQTKYDVFVSFRGKDVRGNFLSHLDEIFKRNKIYAFVDDKLKKGDEIWSSLVEAIEQSFILLIIFSQSYASSRWCLKELEAILECNKKYGRIVIPVFYHVEPADVRHQRGSYKNAFKKHEKRNKTKVQIWRHALKKSANIVGIETSKIRNEVELLQEIVRLVLKRLGKSPINSKILIGIDEKIAYVESLIRKEPKVTCLIGIWGMAGNGKTTLAEEVFKKLQSEYDGCYFLANEREQSSRPGIDSLKKEIFSGLLENVVTIDDPNVSLIDIDRRIGRMKVLIVLDDVNDPDHLEKLLGTPDNFGSGSRIIITTRYVQVLNANKANEIYQLGEFSLDKALELFNLIAFKQSDHQWEYNELSKKVVDYAKGNPLVLKVLAQLLCGKDKEEWEGMLDSLKRMPPADVYKVMKLSYDVLDRKEQQIFLDLACFFLRTNTMVNVSNLKSLLKGNESQETVTFRLGRLKDQALITYSDDNVIAMHDSLQEMAMEIVRRESSEDPGSRSRLWDPNDIFEASKNDKSTKAIRSILIHLPTFMKQELGPHIFGKMNRLQFLEISGKCEEDSFDEQNILAKWLQFSANELRFLCWYHYPLKSLPENFSAEKLVILKLPKGEIKYLWHGVKNLVNLKELHLTDSKMLEELPDLSNATNLEVLVLEGCSMLTTVHPSIFSLGKLEKLNLQDCTSLTTLASNSHLCSLSYLNLDKCEKLRKLSLITENIKELRLRWTKVKAFSFTFGDESKLQLLLLEGSVIKKLPSSIKDLMQLSHLNVSYCSKLQEIPKLPPSLKILDARYCSSLQTLEELPSSLKILKVGNCKSLQILQKPPRFLKSLIAQDCTSLKTVVFPSTATEQLKENRKEVLFWNCLKLNQQSLEAIALNAQINVIKFANRCLSAPNHDDVENYNDYDKKYHFYQVVYVYPGSSVLEWLEYKTRNNYIIIDMSSAPPSLPVGFIFCFALGMYGDTSLERIEANITISDREGEGKKDSVGMYIGLRNGTIESDHLCVMYDQRCSAFLYSRAKNQKEFKIEVSMVLRSSSKEILTLPQQMFKGFGISLIDTLGLA

SEQ ID NO: 162401 - protein, 102 aa, Glycine max
  Coding DNA Sequence Number=SeqID_45623
MGAVEYMSLNSLNKSSPKSFILDHIKNTHEQYQVMYGSIFKRMPEPGKVSQLKQYCVSVRGKGDAEGRKYLGCYQAQPNSIRLMKLMHGVAQFHLLNETVIC

SEQ ID NO: 162402 - protein, 56 aa, Glycine max
  Coding DNA Sequence Number=SeqID_45624
MSNNNTPPIKYDPFVGALQRNKINAFAADQLEKGDEIRPSLVEAIEPKTMLLHDGV

SEQ ID NO: 162403 - protein, 65 aa, Glycine max
  Coding DNA Sequence Number=SeqID_45625
  Gene Ontology: Cellular component=chloroplast envelope
  Homolog annotation: Hit_ID=Q5JL23; Match level="QueryCoverage=60%, HitCoverage=10%, E-value=1e-10, Identity=75%"; Hit description=ABC -type transport system-like
MTPENTELLQKSIYTLIFTLKNIENVSSDILGFTGDEATRKSLKLLIKSLSRMEVILNDCQSHFS

SEQ ID NO: 162404 - protein, 52 aa, Glycine max
  Coding DNA Sequence Number=SeqID_45626
MKSGNLERLVTTQGNVVGTHGGVGLVWWLLVAREVKRERRRAQPPLCGRYDN

SEQ ID NO: 162405 - protein, 1132 aa, Glycine max
  Coding DNA Sequence Number=SeqID_45627
  Gene Ontology: Mol. function=transmembrane receptor activity; Cellular component=membrane; Biological process=defense response
  Homolog annotation: Hit_ID=Q1SI46; Match level="QueryCoverage=96%, HitCoverage=95%, E-value=0.0, Identity=49%"; Hit description=Leucine Rich Repeat, putative
  Pfam annotation: Domain name=LRR_1; Domain location=663-684; Score =8.7; E_value=6.7; Accession=PF00560.23; Description=Leucine Rich Repeat
  Pfam annotation: Domain name=LRR_1; Domain location=686-708; Score =11.7; E_value=1.9; Accession=PF00560.23; Description=Leucine Rich Repeat
  Pfam annotation: Domain name=LRR_1; Domain location=710-731; Score =10.4; E_value=3.2; Accession=PF00560.23; Description=Leucine Rich Repeat
  Pfam annotation: Domain name=LRR_1; Domain location=733-758; Score =4.7; E_value=37; Accession=PF00560.23; Description=Leucine Rich Repeat
  Pfam annotation: Domain name=LRR_1; Domain location=777-798; Score =6.6; E_value=16; Accession=PF00560.23; Description=Leucine Rich Repeat
  Pfam annotation: Domain name=LRR_1; Domain location=800-819; Score =7.6; E_value=11; Accession=PF00560.23; Description=Leucine Rich Repeat
  Pfam annotation: Domain name=LRR_1; Domain location=821-846; Score =6.7; E_value=16; Accession=PF00560.23; Description=Leucine Rich Repeat
  Pfam annotation: Domain name=LRR_1; Domain location=863-884; Score =5.9; E_value=23; Accession=PF00560.23; Description=Leucine Rich Repeat
  Pfam annotation: Domain name=LRR_3; Domain location=640-659; Score =23.5; E_value=0.00077; Accession=PF07725.3; Description=Leucine Rich Repeat
  Pfam annotation: Domain name=NACHT; Domain location=238-389; Score= -19.6; E_value=0.0019; Accession=PF05729.3; Description=NACHT domain
  Pfam annotation: Domain name=NB-ARC; Domain location=198-492; Score =120.6; E_value=4.6e-33; Accession=PF00931.13; Description=NB-ARC domain
  Pfam annotation: Domain name=TIR; Domain location=47-176; Score =164.9; E_value=2.1e-46; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_3::NACHT::NB-ARC::TIR; Domain location=663-684::686-708::710-731::733-758::777-798::800-819::821 -846::863-884::...
  Pfam module annotation: Domain location=640-659::238-389::198-492::47- 176
MAYFFVFCLFCFVLFFFACWLLQKLSDRVVEKPVSEDNKAPQTKYDVFVSFRGKDVRGTFLSHLIEIFKRNKINAFVDDKLKPGDEIWSSLVEAIEQSFILLIIFSQSYASSPWCLEELEAILECNKKYGRIVIPVFYHVEPADVRHQRGTYKNAFKKHQKRNKNKVQIWRHALKESANISGIETSKIRNEVELLQEIVRLVLERLGKSPINSKILIGIDEKIAYVELLIRKEPEATCLIGIWGMAGNGKTTLAEEVFKKLQSEYDGCYFLPNEREQSSRHGIDSLKKEIFSGLLENVVTIDNPNVSLDIDRRIGRMKVLIVLDDVNDPDHLEKLLGTPDNFGSGSRIIITTRYVQVLNANKANEIYQLGEFSLDKALELFNLIAFKQSDHQWEYNELSKKVVDYAKGNPLVLKVLAQLLCGKNKEEWEGMLDTLKRMPPADAYKVMKLSYDELDRKEQQIFLDLACFFLRTHTTVNVSNLKSLLKGNESQETVTFRLGRLKDKALITYSDDNVIAMHDSLQEMALEIVRRESSEDPGSRSRLWDPNDIFEALKNVKSTKAIRSILIHLPTFMKQELDPHIFGKMNRLQFLEISGKCEKDIFDEHNILAKWLQFSANELRFLCWYRYPLKSLPEDFSAEKLVILKLPKGEIKYLWHGVKNLMNLKELHLTDSKMLEELPDLSNATNLEVLVLQGCSMLTRVHPSIFSLGKLEKLNLQDCTSLTTLASNSHLCSLSYLNLDKCEKLRKLSLIAENIKELRLRWTKVKAFSFTFGHESKLQLLLLEGSVIKKLPSYIKDLMQLSHLNVSYCSNLQEIPKLPPSLKILDARYCSSLQALEELPPSLKILDTRYCSSLQTLEELPSSLKILKVGYCKSLQTLQMLPRFLKSLTAQDCTSLKTVVFPSTATEQLKEYRKEVLFWNCLKLNQQSLEAIALNAQINVMKFANRRLSVSNHDDVENYNDYDKKYHFYQVVYVYPGSSVLEWLEYKTRNNYIIIDMSSAPPSLPVGFIFCFALGMYGDTSLERIEANITISDREGEGKKDSVGMYIGLRNGTIESDHLCVMYDQRCSAFLYSRAKNQKEFKIEVSMVLRSSSKEILTLPQQMFKGFGISLIDTLGFSSFKQQMELHDSLHV

SEQ ID NO: 162406 - protein, 47 aa, Glycine max
  Coding DNA Sequence Number=SeqID_45628
GGDTAACHDAESSVVAVCYSWHVCGCIDGKEQYLLHSLTVNDELLKN

SEQ ID NO: 162407 - protein, 288 aa, Glycine max
  Coding DNA Sequence Number=SeqID_45629
MVMGDPISRLSFPENTETFSSLTSYPELRRSEFLIGGYVGARASLLSTTPPFVAMTQELTKFGHSAHMIRGDTLRLSAPLCYLDTVVVRWHAETKFGHSAPKIRGDTLRLSAPFCHPEAAGPMTSRDQVWSFCTQDTRRYLTVIRTLLSSRGGGPDDKQRPSLVILHPRYAEIPYETKFGHSAPKIRGDTLRLSAPFCHPEAAGPMTSRDQVWSFCTQDTRRYLTVIRTLLSSRGGGPDDKQRPSLVILHPRYAEIPYGYPHPFVIQRRAQQRPSLVILHPRYTEIPY

SEQ ID NO: 162408 - protein, 83 aa, Glycine max
  Coding DNA Sequence Number=SeqID_45630
MKSDDMRGYPILTCTIRQPGANETIEARRLTSSSTPFVVLTGDMRCYLMVTRTFGQLVAKKPVDAQRLASSAAPFVVLTREVR

SEQ ID NO: 162409 - protein, 123 aa, Glycine max
  Coding DNA Sequence Number=SeqID_45631
  Subcellular localization annotation: CTP_CleavageSite=17; ConfidenceScore=5.26e-01
MVSGLAMPRSKKTGATCAKTRRNRFNRAVRKLAKSGKVLRALLSAVRKESIGYDYVDYEELREPKPQMEMWPSGERRDSKSDSSLSSVTGAAEDMAGEVYEGCVGGYVHRPGAAARCGLETQR

SEQ ID NO: 162410 - protein, 158 aa, Glycine max
  Coding DNA Sequence Number=SeqID_45632
MEISSLSVEPCEGETLVVTVFEIRKSEIPDFIKREVEFRFLAVLPETLDGKAFDFPAQIGHLMWQFLRSFVLVIVMRNFSTIDVKFYVSAWWEWDAYSNQNITSVLAAKNLGETAYNNFVDHTYLADRKTTIRDYLATTGSGIMEEQPPESLKHRYGG

SEQ ID NO: 162411 - protein, 371 aa, Glycine max
  Coding DNA Sequence Number=SeqID_45633
  Gene Ontology: Mol. function=triacylglycerol lipase activity; Biological process=lipid metabolic process
  Homolog annotation: Hit_ID=Q8L570; Match level="QueryCoverage=99%, HitCoverage=50%, E-value=1e-107, Identity=55%"; Hit description =Lipase class 3-like protein
  Pfam annotation: Domain name=Lipase3_N; Domain location=45-126; Score= 79.5; E_value=1.1e-20; Accession=PF03893.7; Description=Lipase 3 N -terminal region
  Pfam annotation: Domain name=Lipase_3; Domain location=230-363; Score= 81.7; E_value=2.3e-21; Accession=PF01764.16; Description=Lipase (class 3)
  Pfam module annotation: Pfam domain module=Lipase3_N::Lipase_3; Domain location=45-126::230-363
MATAAGAAVMLYYVLSRRMARKEEDDGEDHGGEVPKLSRSVRRRRLSRRPAQAPATLLESIVTLSETIRFTYSETLGKWPIGDLAFGINYFMRKQGNLAVASVYAGSDCVQLKGDEIIVELYELLRLLTLCMLFSKKPFPVFLDSAGFSLDDVLIQKPKAGIWLYMEKLCGLFEIRGSYGLYYLGVLGILKVTPIFFSYSKFVNIKRPLVVLLLKPAFTIIRDTQSKCLLLLIRGTHSIKDTLTAATGAVVPFHHSVLNDGGISNLVLGYAHCGMVAAARWIAKLCTPTLLKALGECPDFKVKIVGHSLGGGTAALLTYILREQNEFSSTACMTWELAESGKHFITTIINGSDLVPTFSTSSIDDLRSEVR

SEQ ID NO: 162412 - protein, 208 aa, Glycine max
  Coding DNA Sequence Number=SeqID_45634
  Homolog annotation: Hit_ID=O04892; Match level="QueryCoverage=39%, HitCoverage=20%, E-value=7e-20, Identity=52%"; Hit description =Cytochrome P450 like_TBP
MNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGAREVGKNGSVTSGKGLALRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 162413 - protein, 90 aa, Glycine max
  Coding DNA Sequence Number=SeqID_45635
MYIINKQNNTKALHSRKSHGRDIIPYLVLAKKTKRGTSNNLKVVHSGTKEFKIASNKRDLFLGFSEHQERLRKKLALEEGRIFAANEQLY

SEQ ID NO: 162414 - protein, 69 aa, Glycine max
  Coding DNA Sequence Number=SeqID_45636
MEAQSQSQSQDYFGECDYYVMHWMSTIILGTFRNNWEAYFNDPRPLEPERLKALRIQWAQFYLRDRDQA

SEQ ID NO: 162415 - protein, 207 aa, Glycine max
  Coding DNA Sequence Number=SeqID_45637
  Gene Ontology: Mol. function=protein binding; Cellular component =integral to membrane; Biological process=xylan catabolic process
  Homolog annotation: Hit_ID=Q1T435; Match level="QueryCoverage=97%, HitCoverage=21%, E-value=5e-31, Identity=37%"; Hit description =Leucine-rich repeat; Leucine-rich repeat, cysteine-containing type
  Pfam annotation: Domain name=LRR_1; Domain location=41-63; Score=9.1; E_value=5.6; Accession=PF00560.23; Description=Leucine Rich Repeat
  Pfam annotation: Domain name=LRR_1; Domain location=65-87; Score =21.4; E_value=0.0033; Accession=PF00560.23; Description=Leucine Rich Repeat
  Pfam annotation: Domain name=LRR_1; Domain location=89-111; Score =1.8; E_value=1.3e+02; Accession=PF00560.23; Description=Leucine Rich Repeat
  Pfam module annotation: Pfam domain module=LRR_1::LRR_1::LRR_1; Domain location=41-63::65-87::89-111
MFWIWRGQEVEYHDTWLLKNLDRSTNNLSGEIAPELFGLTQLGSLNLSRNHLMGKIPSNIDSMKNLESLDLSYNNLSGEIPAAISDLSFLSFLNLSYDDLIGQIPLGIQVETLDAWSYGGNPRLYGRPLTKHFSKDVNPDEAKQGGANGSQNELLYLGIGVGYIVGLNGFWYSLILNRAWRHKYFRILDHILDWLYLFVALKLNKVG

SEQ ID NO: 162416 - protein, 196 aa, Glycine max
  Coding DNA Sequence Number=SeqID_45638
  Gene Ontology: Mol. function=protein binding; Biological process =xylan catabolic process
  Homolog annotation: Hit_ID=Q1S5Q1; Match level="QueryCoverage=94%, HitCoverage=29%, E-value=1e-18, Identity=29%"; Hit description =Leucine-rich repeat; Leucine-rich repeat, cysteine-containing type
  Pfam annotation: Domain name=LRR_1; Domain location=104-126; Score =0.7; E_value=2.1e+02; Accession=PF00560.23; Description=Leucine Rich Repeat
  Pfam annotation: Domain name=LRR_1; Domain location=128-150; Score =4.6; E_value=39; Accession=PF00560.23; Description=Leucine Rich Repeat
  Pfam annotation: Domain name=LRR_1; Domain location=152-172; Score =13.1; E_value=1; Accession=PF00560.23; Description=Leucine Rich Repeat
  Pfam annotation: Domain name=LRR_1; Domain location=18-37; Score=3.5; E_value=62; Accession=PF00560.23; Description=Leucine Rich Repeat
  Pfam annotation: Domain name=LRR_1; Domain location=40-59; Score=0.8; E_value=2.1e+02; Accession=PF00560.23; Description=Leucine Rich Repeat
  Pfam module annotation: Pfam domain module=LRR_1::LRR_1::LRR_1::LRR _1::LRR_1; Domain location=104-126::128-150::152-172::18-37::40-59
MEEQLVWDVSLDISNFKSLVLINLGENHFAGVVPTKMPESMQGMILRCNQFTGNIPPQNKLSGFIPPCLFNITSMDGARRMSHYQFSVDLFLKGSEMEHRGTWLFGSLDLSTNNLSGEISTEIFGFTQFVSLNLCRNRIMGIISSNIGGMKNLEILDLSYNNLSGNPKLCGPPLIKNSSDEEANHDKAKQGGANDS

SEQ ID NO: 162417 - protein, 173 aa, Glycine max
  Coding DNA Sequence Number=SeqID_45639
MLHVDCFYNFFRYRSALVDAPDYRPRIVDFYIWWTQPMPSYYHFAVPMLEVIIPSKSYSPPVDDTMSSTKSDSSSKDTDATSSALMSPQSVLLETWVPPEVNLMDLVSKDEGKVAEEDTSRPMSTRSVLPKSWVPPWVDLIDLVFEDEGEDVEKDTSIKEDTLMDEEKPIMEL

SEQ ID NO: 162418 - protein, 92 aa, Glycine max
  Coding DNA Sequence Number=SeqID_45640
MQYQAHDCNSMAQPSITLPTSDDAQHSSLYRQWCTQDANMLASMHLPYMYFLEGLLLVTHRITYPNVKGVWFRPPSFNQWSDQCKINFALFD

SEQ ID NO: 162419 - protein, 86 aa, Glycine max
  Coding DNA Sequence Number=SeqID_45641
  Gene Ontology: Mol. function=ATP binding; Cellular component =extracellular space; Biological process=cobalamin biosynthetic process
  Homolog annotation: Hit_ID=Q8LEZ2; Match level="QueryCoverage=73%, HitCoverage=20%, E-value=2e-23, Identity=82%"; Hit description=ATP binding protein-like
MRRLGSIRSYAKHLRIDGVKDTIAVASGKGGVGKSTTAVNLAVALARKCQLKVGLLDADVYGPSIPTMMNINTKPEVTHGISFSFF

SEQ ID NO: 162420 - protein, 536 aa, Glycine max
  Coding DNA Sequence Number=SeqID_45642
  Gene Ontology: Mol. function=type I protein secretor activity; Cellular component=membrane; Biological process=protein secretion
  Homolog annotation: Hit_ID=Q4KDN5; Match level="QueryCoverage=56%, HitCoverage=80%, E-value=2e-94, Identity=61%"; Hit description=HlyD family secretion protein
  Pfam annotation: Domain name=HlyD; Domain location=279-535; Score =32.7; E_value=1.3e-06; Accession=PF00529.10; Description=HlyD family secretion protein
MTHLAWSIFAGIVCGIVTSCLTIKPTKLAWPIITSLALMIVASLLDSQSNNLTRPDQLMVSQFLLGFGSAFFLAPAMLAAIGGVIADPRNLVSFSVMFGMSQNLGGLLGSAILGTFQTWREKYHSSLLADQLTTLNPLVNERIQLYTQMYKSLIGDSSLLGTQAITQLQSVTALEANILAYNDTYLLTASIAAATLVWILWRLLRLRITARMALKNATGNNQQDAAKEQANTRKNVRIVSVFTAAAIGLVGVLVILYAWQLPPFTRHVQFTDNAYVRGQTTFISPQVNGYITEVKVQDFVQVKKGDLLLQIDDRIYRQRVHQAEAQLAMKIAALNNNLQQRKSAEATIAKNEAALKNARAQSLKTQADLKRVKDLTADGSLSVRERDAALASAAQGSADIDQAKATLEMSRQDLQTVIVNRGALEADVENAKAALELAQIDLQNTRIVAPRDGQLGQIAVRLGAYVTAGTHLTTLVPPQHWVIANIKETQLAELRVGQPVKFTVDALNDKAYQGRVESISPATGVEFSAITPDNAT

SEQ ID NO: 162421 - protein, 88 aa, Glycine max
  Coding DNA Sequence Number=SeqID_45643
MKKIQGLQAPQGATSLTRRVPMSEIEEVQEQMKVDMEALKEQMTMMMEAIMSMRKMMEDNTATAVAASTATEMDSIHLADFNQVIVQS

SEQ ID NO: 162422 - protein, 218 aa, Glycine max
  Coding DNA Sequence Number=SeqID_45644
  Subcellular localization annotation: CTP_CleavageSite=76; ConfidenceScore=5.85e-01
SVNTSRRLRRSSFGCTRASSCCFTSRSTSGTTLASSSPNSCASAFASAVHWRSPRWQLPASYSYLNRSLSGGDQPPAATHGHCVASEGVVDFHLQRCLFVLGGESGFSRLSARKYFILVVLAAGPSANLKGLHMQNAVNSSDILADNFKQAVNSETNEMEVLGHLIAEILHSGMPVTNKAIIAALIGRLEQEADVVQLDVYRHLLELVIHHTLDDFSL

SEQ ID NO: 162423 - protein, 232 aa, Glycine max
  Coding DNA Sequence Number=SeqID_45645
  Gene Ontology: Mol. function=Type I site-specific deoxyribonuclease activity; Biological process=DNA restriction-modification system
  Homolog annotation: Hit_ID=Q8PUP0; Match level="QueryCoverage=99%, HitCoverage=22%, E-value=8e-95, Identity=72%"; Hit description=Type I restriction-modification system restriction subunit
MKALLPQAVFIGFTGTPLLKADKQSSQEVFGGYIHTYKFGEAVEDEVVLDLVYEARDIDQRLGSSAKIDAWFEAKTRGLNAWQKQELKAKWGTMQQVLSSRSRMERVVADIVFDFSVKPRLSTDRGNAILVASSIFEACKYFALLQKTPFKGRCAVVTSYTPQAKDVTTEEVGANTESDKQFIFNTYTELLKSVQAKPGMSPTETYEEWAKALFATEPANMKLLVVVDKLLT

SEQ ID NO: 162424 - protein, 204 aa, Glycine max
  Coding DNA Sequence Number=SeqID_45646
MTTLAQTWIILSFSNLIPTSHTSDVTLDRAKLIYGIIMKMDMNLGYLISHQISLIAQHDTSRLGFPALITTLCKARGVQSDSRSLQNLSPAINLAYIKKNCRNLDDPTVTFRGPSKARCKRSEVPTTQHHQRQQLILLPQLQYLPFRLQLFLQHLHRYHFQLLYLQDFQTLYLHHRCFIPCSRAYTGGSPSSCRAFRAWACHPS

SEQ ID NO: 162425 - protein, 36 aa, Glycine max
  Coding DNA Sequence Number=SeqID_45647
MEKEESPLTEDQIQDSPLSVLRCHEAYLNKLRYGLN

SEQ ID NO: 162426 - protein, 40 aa, Glycine max
  Coding DNA Sequence Number=SeqID_45648
MADQQATKSRAKAIKRPAQDVKEALLGGNLVEGYLGYACM

SEQ ID NO: 162427 - protein, 164 aa, Glycine max
  Coding DNA Sequence Number=SeqID_45649
  Pfam annotation: Domain name=GRP; Domain location=1-118; Score=-2.4; E_value=0.00012; Accession=PF07172.2; Description=Glycine rich protein family
MGSKISTVPTLGLLAMLLLISSEVLATSGGAGNFGGGNPSVGGGLPGGGGGDVGLPGGGRGGFPIGGDVGLPGGGRGGFPVGGGVGLPGGGRGGFPIGGGVGSPGGGGRRGGLPVGGGVGFPVGGGSGFPGIVGTFPSGGGTPRGRGGSPPGRGGFPGGVGGFP

SEQ ID NO: 162428 - protein, 64 aa, Glycine max
  Coding DNA Sequence Number=SeqID_45650
  Pfam annotation: Domain name=GRP; Domain location=1-55; Score=-22.8; E_value=0.016; Accession=PF07172.2; Description=Glycine rich protein family
MFSKETLLVLGLLAMVALISFSVTVRNLAETSSMCTTVAKEKNDVPDVKYGENSCYFYNDKIIT

SEQ ID NO: 162429 - protein, 230 aa, Glycine max
  Coding DNA Sequence Number=SeqID_45651
  Gene Ontology: Mol. function=DNA-directed RNA polymerase activity; Cellular component=mitochondrion; Biological process=transcription
  Homolog annotation: Hit_ID=O47884; Match level="QueryCoverage=80%, HitCoverage=17%, E-value=2e-33, Identity=47%"; Hit description=RNA polymerase
MAAKDLYYYPKQTTNKTMLTTRQFKCMLEKHKLFLLPVRFQSTSNWISHFANTLDMPENKSENRAKIESFWEGALKDIYEETLMYDNNDVVHSPDECVDPETRKIKVPKSEFVKTYKNSVFSLLDCYRYENNDAQTLESLQREIEDLTLNFSEDSIYKTSPNIMVMLTKNNLPSAKEFLRGKYLMDKEYPGRMTIYAESRSGDSLETSGSELSDEENKNLRCVLSESDKS

SEQ ID NO: 162430 - protein, 232 aa, Glycine max
  Coding DNA Sequence Number=SeqID_45652
  Pfam annotation: Domain name=GRP; Domain location=1-132; Score=-16.7; E_value=0.0037; Accession=PF07172.2; Description=Glycine rich protein family
MVALISSNVTARNLAETSPMSTTGEVAKEKKVTDVKYEQNPSHGVCSTSNCFGWGIPGFGSIFPGWGIPIGGGGPGVGAPGMGKPGGDGPGGGGGPKGGTGSGGGGPVGGGYGGGPGGGAGPGGGAGPSGGGSEGGAGPGGGGHEGGTGPGGGGPVGGGYGGGPGGGASPGGGESGGGAGPGSGGYGGGPGGGAGSGGGGGPGGGTGPGGGGYGGGPGGVGPGGGGGPGGGA

SEQ ID NO: 162431 - protein, 59 aa, Glycine max
  Coding DNA Sequence Number=SeqID_45653
MEGDNGIAPRQYKWRLQSLLVLSNVWEPYKSNQRRNLRNLKKLLEMPISLSEDTEIMKW

SEQ ID NO: 162432 - protein, 85 aa, Glycine max
  Coding DNA Sequence Number=SeqID_45654
MVATRSLWGFRLIKEVATMVWICGGDNKVVIGSLGFNAVAGWGRGGSDVVGRFGFMVTMRSLTTKLREKLEILRFCEARAKRSSN

SEQ ID NO: 162433 - protein, 268 aa, Glycine max
  Coding DNA Sequence Number=SeqID_45655
  Gene Ontology: Mol. function=receptor activity; Biological process =protein amino acid phosphorylation
  Homolog annotation: Hit_ID=Q84KS6; Match level="QueryCoverage=82%, HitCoverage=66%, E-value=2e-25, Identity=35%"; Hit description =Membrane located receptor-like protein
MWRERALLVILLLLLVQQICATKKQDHGCPLSSCGKITNITYPFRLKGHPKSCGDNRYELACENNVTVLHLYSGKYHVQAINYNNFTIRVVDPGVDQQTNCSSLPRYFLSRSNFTDTYSDIYNMDPYQAGQYSGRSNWDRLAFQHIVYMNCSNPVTQNGKYVDTASYVNWDSKDKYIYAIAGDLKAEDFQVGCHVKLVALTSWWGLDTNNYSYSAMHTGLVYGFEISWMRLICEQHCPSKHGCYYYNCFFDSVSQELNYWDGDSLGSE

SEQ ID NO: 162434 - protein, 750 aa, Glycine max
  Coding DNA Sequence Number=SeqID_45656
  Gene Ontology: Mol. function=nucleic acid binding; Cellular component= signal recognition particle, endoplasmic reticulum targeting; Biological process=SRP-dependent cotranslational protein targeting to membrane
  Homolog annotation: Hit_ID=Q1VZW1; Match level="QueryCoverage=92%, HitCoverage=56%, E-value=1e-126, Identity=35%"; Hit description =DEAD/DEAH box helicase-like protein
  Pfam annotation: Domain name=DEAD; Domain location=435-593; Score= -21.6; E_value=0.00037; Accession=PF00270.19; Description=DEADDEAH box helicase
  Pfam annotation: Domain name=ResIII; Domain location=431-589; Score= -0.1; E_value=4.8e-05; Accession=PF04851.6; Description=Type III restriction enzyme, res subunit
  Pfam annotation: Domain name=SNF2_N; Domain location=437-716; Score =282.6; E_value=7.9e-82; Accession=PF00176.13; Description=SNF2 family N-terminal domain
  Pfam annotation: Domain name=SNF2_assoc; Domain location=69-425; Score=-164.7; E_value=0.035; Accession=PF08455.1; Description =Bacterial SNF2 helicase associated
  Pfam module annotation: Pfam domain module=DEAD::ResIII::SNF2_N::SNF2_ assoc; Domain location=435-593::431-589::437-716::69-425
MQLVWKADQPAEIKFYTAIASFQNKFNEEADATEMEALKLIIRNPQGLDTYYHDHTISEAISSKSLIPVKLNLLKAEILLTVFKKEPFYEITGELLFNDISLSFKNVIIRHDCFIYHQNTLNLIDNPDLLRVIRFFKSNNEILLIHASKYEHFLHTVLSPLETHVQINYSYIRTASPVQLQEKDFQMEKIIYLHQEGNYISITPVMKYGSVEVAVYSRKQLYDTDQNGNLFKIERNYEAETALTSIVMIQHEDLQDQLEGHEYFYLYKDKFLDADWFLRTFEAWRNEGITILGFNELKNNKLNPHSAKINIQVTSGIDWFNAKLSVRFGGKEASLKQVHRALRNKTKFIQLDDGTQGILPDEWIKKIDRYFQIGDIDGELLKIPKVSFSEVSDWFEKEVLSKEVQTEIHSYSKQFSVLKKAPEIPVPAGLRTTLRDYQKEGLNWLGLLDHYNFGGCLADDMGLGKTIQILAFILYRKEKYHSGTHLIIVPTSLLFNWQEEIEKFAPSLRVLMHYGPDREKSTNLFQDYDIILTSYGMLLSDIRFLKTFHFDYIFLDESQTIKNPNSEKYKAARLLQARNRIVITGTPVENNTFDLYGQLSFASPGLLGSKQYFKDTYAIPIDKFEYNKRTIELQQKINPFILRRTKKQVAKELPEKTEMVIYCEMDAEQRKIYDLYERELRDFISASTDDETLKNSMHVLTGLTKLRQICNSPVLLKEGYSGDHAVKIQLLTEQIEINQKNTKSLYFHNL

SEQ ID NO: 162435 - protein, 85 aa, Glycine max
  Coding DNA Sequence Number=SeqID_45657
  Gene Ontology: Mol. function=nucleic acid binding; Cellular component= oxygen evolving complex; Biological process=DNA integration
  Homolog annotation: Hit_ID=Q1SD84; Match level="QueryCoverage=91%, HitCoverage=7%, E-value=1e-22, Identity=47%"; Hit description =Integrase, catalytic region
MEFVCSKRGIVVSLQKYILDLLEETGMSGCRPADTPIDPNGKLWEKGSVPIDVGRYQRYLKRNPGKGLFFKKNSDLEKSKCLHTP

SEQ ID NO: 162436 - protein, 51 aa, Glycine max
  Coding DNA Sequence Number=SeqID_45658
  Gene Ontology: Mol. function=metal ion binding
  Homolog annotation: Hit_ID=Q9ZTM6; Match level="QueryCoverage=93%, HitCoverage=18%, E-value=1e-08, Identity=68%"; Hit description=PGPD14
MPETYKNKMVWILCNDCGVNSHVQFQIMALIATHTTQDRYREYLLHQAHLG

SEQ ID NO: 162437 - protein, 47 aa, Glycine max
  Coding DNA Sequence Number=SeqID_45659
MARVRDKIKSIDGSRETLKLSVRITDLWFIGILEKSEQAKMVIVDSD

SEQ ID NO: 162438 - protein, 59 aa, Glycine max
  Coding DNA Sequence Number=SeqID_45660
MYLEEMKEHQLNGSEEKSSNSVEDPATMFSGINETLGLIRILVVDLKRANKATLTLVNF

SEQ ID NO: 162439 - protein, 45 aa, Glycine max
  Coding DNA Sequence Number=SeqID_45661
IDCGGRMNSARQSIHGSSNKIENGELTNSARQSIRGAPDSMVVDA

SEQ ID NO: 162440 - protein, 221 aa, Glycine max
  Coding DNA Sequence Number=SeqID_45662
  Homolog annotation: Hit_ID=Q9AXP8; Match level="QueryCoverage=93%, HitCoverage=90%, E-value=1e-18, Identity=32%"; Hit description=PnFL-1
  Pfam annotation: Domain name=PAP2; Domain location=75-220; Score =70.8; E_value=4.4e-18; Accession=PF01569.12; Description=PAP2 superfamily
MGHGPKPPPAAPPLLRRIHNLDHTISLYIHNLTRPIAPRPLLRFLELLADFRFFFPVSLALYLAAPSSSTLRSHLLLPLLLCSLLDLLFVALLKFLVRRSRPSYANHSQYNAVVSVDNFSFPSGHSSRVCFVASVFSLSRNSLLADLSRPRVAILVRRWFARDDALAVDLLLAAAWAWAVITVISRVALGRHYVIDVFFGACFGVLEAMFTFRVLDFQGLI

SEQ ID NO: 162441 - protein, 63 aa, Glycine max
  Coding DNA Sequence Number=SeqID_45663
  Gene Ontology: Mol. function=ribonuclease H activity; Biological process=DNA integration
SRMKSAFDKRMCPHKFSEGDLVLKKAFSGGALLLMNMDDEELPSPMNFDVVKQYYACYWGQFE

SEQ ID NO: 162442 - protein, 78 aa, Glycine max
  Coding DNA Sequence Number=SeqID_45664
MTTPIPHSGPLLQNCRCQLQSRSVTVVDPTTRHSERRANQPPRKVMHDIKLQIYNVGSSFDALNLHALTVNKMMTTNL

SEQ ID NO: 162443 - protein, 332 aa, Glycine max
  Coding DNA Sequence Number=SeqID_45665
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=Q9SUW0; Match level="QueryCoverage=91%, HitCoverage=85%, E-value=1e-115, Identity=65%"; Hit description =Trehalose-6-phosphate phosphatase-like protein
  Pfam annotation: Domain name=Trehalose_PPase; Domain location=101 -326; Score=269.0; E_value=9.3e-78; Accession=PF02358.7; Description =Trehalose-phosphatase
  Subcellular localization annotation: CTP_CleavageSite=42; ConfidenceScore=5.25e-01
MHSSLQAYSEQDSPPSPGKGSRSNSRKSTGNVDDVRSNGWLDAMKASSPPRKKLIKGSSNQVASIDDDFEDYCSWMLEYPSALDSFEEIIDLAMDKKIAMFLDYDGTLSPIVDDPNCAFMSESMRSTVRSVAKHFPTAIISGRSRDKVFDLVKLTELYYAGSHGMDIIGPVSETLSKNHPNCVKSNDHPIFRILVEITKDIQGAKVENHKFCVSVHYRNVEENNWTTIGQRVHDVLKDYPLLRSTHGRKVLEVRPVIDWNKGKAVEFLLESLGLADRNDVLPIYIGDDKTDEDAFKMLRESNRGYGILVSSVRKESNAFYSLRDPNEVQIST

SEQ ID NO: 162444 - protein, 105 aa, Glycine max
  Coding DNA Sequence Number=SeqID_45666
MSVWEEVPSFGSKYLPFSSAQKHETIRDYQFGCVDILIVMYYVDGLMWKYKNLDVNMLIQCSELFVVAFDLMMNAFNVVTFVLSGMVLDIRKVEFLSENQCFCSY

SEQ ID NO: 162445 - protein, 124 aa, Glycine max
  Coding DNA Sequence Number=SeqID_45667
  Gene Ontology: Mol. function=sequence-specific DNA binding; Cellular component=nucleus; Biological process=regulation of transcription, DNA-dependent
  Homolog annotation: Hit_ID=Q1S5S6; Match level="QueryCoverage=98%, HitCoverage=43%, E-value=3e-32, Identity=54%"; Hit description=Zinc finger, GATA-type
MQQALTRGAGGLVHPPAPLGHAGAGEVAASEEERGNECGVFWMQMPSLWCGEDATVVNRTDGIENSMQRVWHEVQVREAGTGIPVGGEFNVHVNEAFKFASEGFGAQATEGDVAITASSVVDES

SEQ ID NO: 162446 - protein, 99 aa, Glycine max
  Coding DNA Sequence Number=SeqID_45668
RLGISVRHLTSRVRMTESAEDDGAEDDVSLYMLLDSESDRQRKSVYTDNQLGISACHLTSRMTTLASACQSNLGSPNDEVRITERCLRMLPDSWVMIAK

SEQ ID NO: 162447 - protein, 313 aa, Glycine max
  Coding DNA Sequence Number=SeqID_45669
  Gene Ontology: Mol. function=ATP-dependent helicase activity; Cellular component=intracellular; Biological process=protein modification process
  Homolog annotation: Hit_ID=Q5ZEC6; Match level="QueryCoverage=95%, HitCoverage=28%, E-value=1e-132, Identity=75%"; Hit description =Putative DEAD/H box polypeptide 36 protein
  Pfam annotation: Domain name=Helicase_C; Domain location=215-300; Score=8.1; E_value=0.0028; Accession=PF00271.21; Description =Helicase conserved C-terminal domain
MKGRDTHLLFCTTGILLRRLLADRKLKGVTHVIVDEIHERGMNEDFLLIILKELLPHRPELKLILMSATLDAELFSSYFNGAPIMFIPGFTYPVRTHFLENILEMTGYRLTPYNQIDDYGQERMWKMNKHAPRKRKSQIASAVEDAIMAADFKDYSLQTQESLSCWNPDCIGFSLIEYILCNICENERPGAVLVFMTGWDDISSLKEKLLTHTVLGDANRVLLLTCHGSMASSEQRLIFEEPEDGVRKIVLTTNIAETSITINDVVFVLDCGKAKETSYDALNNTPCLLPTWISKVSAKQYYWTSFLNLSSLS

SEQ ID NO: 162448 - protein, 288 aa, Glycine max
  Coding DNA Sequence Number=SeqID_45670
  Gene Ontology: Mol. function=zinc ion binding; Cellular component =integral to membrane; Biological process=ubiquitin cycle
  Homolog annotation: Hit_ID=Q1SZZ2; Match level="QueryCoverage=86%, HitCoverage=92%, E-value=8e-64, Identity=49%"; Hit description=Zinc finger, RING-type; RINGv
  Pfam annotation: Domain name=zf-C3HC4; Domain location=111-152; Score= 36.5; E_value=9.5e-08; Accession=PF00097.15; Description=Zinc finger, C3HC4 type (RING finger)
  Subcellular localization annotation: CTP_CleavageSite=45; ConfidenceScore=5.53e-01
MQTTKYDVFARLKANYSETVLPPPPPPPQITPSTLISFTVVVAVVCFVGFSILCFFRCCFVNISSTTLVHLSPNASPFRGLDPSQLQAFPTFLYATVKDLRKEKNQYSLECAICLLEFDHDSMLRLLTVCYHVFHQECIDLWLRSHKTCPVCRTDLDQSPLITNKSPEHQNEDNIVEQEISTDHHHVCIDVKEGDDSEGMQEQKIEFARSHSTGHSIVMVRGEGRHADKYTLRLPENVAFKIVKGGHNYSKSCSSSKDMARLAAPCRNCGYVQTVFQSSSSRSDIKNI

SEQ ID NO: 162449 - protein, 102 aa, Glycine max
  Coding DNA Sequence Number=SeqID_45671
  Gene Ontology: Mol. function=nucleic acid binding
  Homolog annotation: Hit_ID=Q1T6L0; Match level="QueryCoverage=95%, HitCoverage=35%, E-value=6e-11, Identity=44%"; Hit description=RNA -binding region RNP-1
  Subcellular localization annotation: CTP_CleavageSite=45; ConfidenceScore=5.44e-01
MESFKTTSTSVTVPLWAKRSLMSAAVRDQDKLTTYSFFTLSVGCVSSGVSSVAATSCKVEHNWKQSLPVLKEDLEEKKREVEAWSLMEIGAFAEKRWLLENR

SEQ ID NO: 162450 - protein, 250 aa, Glycine max
  Coding DNA Sequence Number=SeqID_45672
  Homolog annotation: Hit_ID=Q5ZEC6; Match level="QueryCoverage=45%, HitCoverage=10%, E-value=7e-37, Identity=64%"; Hit description =Putative DEAD/H box polypeptide 36 protein
  Pfam annotation: Domain name=DUF1605; Domain location=154-243; Score =5.9; E_value=0.031; Accession=PF07717.6; Description=Domain of unknown function (DUF1605)
MSHQQQHVIQMMGNFTDAAWEWDFKWRRQLFDDEIDMAAKFLEDLEGISIHLDREDKWIWKEDAAGVYTVGNAYKMLMTCHTDENQDGAFTELWKVKLAEEAKSQFCGAYSDHLALVRAYEGWRDAEMDLGGYEYCWKNFLSSQSMKAIDALRREFICLVKDIGLVDSNTASCNEWSSDVNLIRAIICYGLYPGICSVVMPFPSNQWWVGVGNMRGSFPSTPLFALTLHAILTCLQLASFPNVSFLNNLI

SEQ ID NO: 162451 - protein, 205 aa, Glycine max
  Coding DNA Sequence Number=SeqID_45673
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=Q5QMV1; Match level="QueryCoverage=75%, HitCoverage=39%, E-value=4e-54, Identity=61%"; Hit description =Oxidoreductase, 2OG-Fe(II) oxygenase-like protein
MPILSFICMFFVCWSLEVLGCAYFDNDTSAMYIQKHKEYRHRIMLNYPPLCKQIYSMDAEKFFTPSFLRAVEENSEASFRSIMAEPRKGLYTFEMLQPQFCEMLMSEVDNFERWVHDTKFRIMRPNIMNQYGAVLDDFGMESMLERLMNDFISPISRVFYTEIGGTSLDSHHGFVVEYGINRDVELGRFLKLRSSYCGYAIGWNL

SEQ ID NO: 162452 - protein, 207 aa, Glycine max
  Coding DNA Sequence Number=SeqID_45674
MKKKGKVTITLDDVASLLHLPITSVFHSFEPLHMDDVVFLLVELLKVSSEEARAETCWIYEHFPSIGYAIVAEDYNERKSRACRWKFEKALPVSTYLKRLDRLTLMLCTGFHTVTIVHSESLRLSLYFSDISDKVYLLSYIDRIGLYDNLDMRSAYTTFIRLHGCPTNDFVKNIQHTIDFVISVTMIFSSLISQLTYGCPTNDFANS

SEQ ID NO: 162453 - protein, 196 aa, Glycine max
  Coding DNA Sequence Number=SeqID_45675
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=Q5QMV1; Match level="QueryCoverage=50%, HitCoverage=25%, E-value=2e-43, Identity=74%"; Hit description =Oxidoreductase, 2OG-Fe(II) oxygenase-like protein
MVLGGKGWEGFHVDDAEVTLNICLGNEFSGGELFFRGVRCDEHVNSDIQPGEIFDYPHVPGHAILHPGRHRHGARPTTSGNRMNLIIWCRSSAFRELKKYRKDFSSWCGECRRKKKEKERLLVMATQQNACAKAQETTQQSPISGVALDIADLLMDEDQWMYDSIISEEVDMNDQNEDKAGVNLVHVDCSNAFNTS

SEQ ID NO: 162454 - protein, 273 aa, Glycine max
  Coding DNA Sequence Number=SeqID_45676
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=Q5QMV1; Match level="QueryCoverage=98%, HitCoverage=57%, E-value=4e-77, Identity=51%"; Hit description =Oxidoreductase, 2OG-Fe(II) oxygenase-like protein
MAEPCKGVYTFEMLQPQFCKKLMSEVDHFERWVHGTKLRIMRPNAMNKNKHGVILDDFAFEAMLDRFMCDFIQPISRVFYPELGGSSLDSHHGFVVEYGINKDVELGDAGSSITIKVSGSQNRSRPGSNSNINQSGQNKGNSSVAFSGLHEDEAEVTLNVCLGKEFSGGDLFFQGVRCDAHVTTNTQPEEAFNYSHVPGHAILHPGRNRHGTRPTTSGNRMNLILWCRSSAFIELKRYQRDFYSWCAECRRKKAERVRLSVVAAKQELLKSEI

SEQ ID NO: 162455 - protein, 133 aa, Glycine max
  Coding DNA Sequence Number=SeqID_45677
  Gene Ontology: Mol. function=nucleic acid binding; Cellular component= mitochondrion; Biological process=DNA integration
  Homolog annotation: Hit_ID=Q1SRN1; Match level="QueryCoverage=92%, HitCoverage=10%, E-value=1e-23, Identity=41%"; Hit description =Integrase, catalytic region
MSNPLDSHWTTIKRILRYLQRSLSHGLRLKPAISSQPLPLRGDADGHLKWMIGAAVYLGVNLISLWSRKQQMVARSSNEAEYRSLAQHWLTILYFIQGTKHPKIDVFSVRERVLTIRLTVHHIPISQGQTQCA

SEQ ID NO: 162456 - protein, 175 aa, Glycine max
  Coding DNA Sequence Number=SeqID_45678
  Subcellular localization annotation: CTP_CleavageSite=21; ConfidenceScore=5.11e-01
MSLTITSYLCMWLIATYMPISCNTNRTRIPHAMFRSTKISSIAISLQSPLVRVLRISVWEKELSWSGLEMYDDCSEDLSMTVLDFIHGFDHHLLPLHVVRHCLHVCDANCTRTPHAMFHSSKISSIVISLLLPLTKMYSDCYKELSMTALDLSEIIVFDHQIEESKGSGEVSGGN

SEQ ID NO: 162457 - protein, 253 aa, Glycine max
  Coding DNA Sequence Number=SeqID_45679
  Gene Ontology: Mol. function=nucleic acid binding; Cellular component= beta-galactosidase complex; Biological process=DNA integration
  Homolog annotation: Hit_ID=Q1SRN1; Match level="QueryCoverage=99%, HitCoverage=18%, E-value=2e-40, Identity=36%"; Hit description =Integrase, catalytic region
MVELQFNAKIKNLQTNWGGEFGPLALFLAKLGINHRLICPHTYHQNGVVERKDRHIVEFGLTLLKHASLPLKFWDYAFTTYMILINRPYNKHKLDYKSQECLFLRYSSSHKDYKCLSSSRRLFISKDVFPLTLFHHLLTIVSNLFLWFPLHQLPLSVANSTSGEHSISSKSATDASAIPIDHSVAVENHNSDSRLPSNSGTTSCNGDPSVDTIGHSTDISVPNVSNTASVDHSESNTLVHPSLPTTSTNTHPM

SEQ ID NO: 162458 - protein, 41 aa, Glycine max
  Coding DNA Sequence Number=SeqID_45680
MAFFRVNSSFDQKSPTLINCNHIKLQHAGHLHNGGTLGMTA

SEQ ID NO: 162459 - protein, 112 aa, Glycine max
  Coding DNA Sequence Number=SeqID_45681
MTNVKQFARIIAFSLKQESKVHSTSTIVVYIANYIGVWVGGCGGWGVWVWVCGWGWGWVGVGGGVWVWVGGWVGGWGCVRVVGVCGCHEGVCDEGLCVCVMRVMRVVNCDII

SEQ ID NO: 162460 - protein, 192 aa, Glycine max
  Coding DNA Sequence Number=SeqID_45682
  Subcellular localization annotation: CTP_CleavageSite=57; ConfidenceScore=5.45e-01
MPTSSPQATCGPWNFFQPCKKPFTSKDSQGMYPPLFSLNLVDVPSTRTDPQEMYSLLFSVKPKEWEESKEFSDCVVLNSLTREKGDTKEFRQLVLPSFGKGRRETQKEFRREKRMKRMNSSSFQGLENQKTSESFWYKEEEEVQRDFKRFKACKRLYEFVRKIGKMIDSKCKTKPCFYRLFMSDQEDHSEEL

SEQ ID NO: 162461 - protein, 291 aa, Glycine max
  Coding DNA Sequence Number=SeqID_45683
  Homolog annotation: Hit_ID=Q9AYF0; Match level="QueryCoverage=20%, HitCoverage=4%, E-value=2e-07, Identity=44%"; Hit description =Helicase-like protein
MENYKESMNCILAIYHYSTLYSFLMENMDIELTYFTVILHPTKKESYTMVEYERLSYIRNNQKKLRVDKYCSLQNSLDTGIAKGLTKGKRVILPSMFVGSPRYMETIQDMRKKAQANQKHNIAPHVLSREGYEYSENKLMDEKRKKKLEEAAQSGSTDTVIDPLSPIRQHMKWKMARTKKTGQMTSEAAKEIAEKIESLEEQASYGFFVAIGRPEHRSRVGVVGVGVTIKKYFGLAPRTSRMSSSMAPEDLEQLMQQIRDQLEESITEKVTQRLMLSFQATVHPEIRAIEI

SEQ ID NO: 162462 - protein, 195 aa, Glycine max
  Coding DNA Sequence Number=SeqID_45684
  Homolog annotation: Hit_ID=UPI00003C004D; Match level="QueryCoverage =65%, HitCoverage=6%, E-value=3e-07, Identity=29%"; Hit description =PREDICTED: similar to centromere protein E
  Pfam annotation: Domain name=MSG; Domain location=63-128; Score=2.6; E_value=0.071; Accession=PF02349.6; Description=Major surface glycoprotein
MTTWNKVERKDKELTGSSNDVIGGYHKWLKSRTQGITWLPKLKSLSGEKAKMPEESEEVQALKAELEKTRVAKDKLKVAVTRVRKECDELKDINMTAAEALERDMKKARKEKWSKNKFRGALLGSSNELKLRKAKRDKSKMESLMLEDKLKSCQSLKRSLKEQLRKTEENLLIIIDQYKEKVNLAASHEQMLEDE

SEQ ID NO: 162463 - protein, 92 aa, Glycine max
  Coding DNA Sequence Number=SeqID_45685
  Subcellular localization annotation: CTP_CleavageSite=29; ConfidenceScore=5.27e-01
MFHDCLSADPQGNPPFSPFFGAPGMSLSSAVHVSSIIKRGASGDWEICSSVVFRIGSFAKHQKRRSRDENRHHGKGRMDEIHVLSLLPSYLR

SEQ ID NO: 162464 - protein, 89 aa, Glycine max
  Coding DNA Sequence Number=SeqID_45686
MPTFNDDCFGIGSRIDVDTPSEPILPLTWMNCEGRSQSTCRQRTATTRTKNHATLDMPIILRQPPTKGKYAEGRIQHRAAPSSKKDVDH

SEQ ID NO: 162465 - protein, 103 aa, Glycine max
  Coding DNA Sequence Number=SeqID_45687
MSDDELVELAQLQFPRGEVEFARWKQRNEVRLLNINRSRSFLARRRDLIERVKWNENEAQHNAFEEFYLTSNHNQSQFLPQKKRLRYPTLGFFVNKSIRETYP

SEQ ID NO: 162466 - protein, 68 aa, Glycine max
  Coding DNA Sequence Number=SeqID_45688
  Subcellular localization annotation: CTP_CleavageSite=41; ConfidenceScore=5.08e-01
MNHRRGVCESPSGGALRPRRLGPTHGCGSRSHRFASGQFPSSMMVGTLENGLGISHFGERGQFHHINF

SEQ ID NO: 162467 - protein, 87 aa, Glycine max
  Coding DNA Sequence Number=SeqID_45689
MMNHLKVEESCAVNRPYNSHNLLISEIKHMNVAETEVKYQLRRLAALTKKKRMTTSSNTTLATKDKNCNRLHANSTATPHQQLSHIK

SEQ ID NO: 162468 - protein, 106 aa, Glycine max
  Coding DNA Sequence Number=SeqID_45690
MLACRNICLVKGKKERYHYHEEMRRRFDIERQQKGREGGEREEKQWYGRCREEIAYFAYGYSFPIPPYPCLPPILSPFSSLFFSGSGECFFSSSMFMSQFTRKEAF

SEQ ID NO: 162469 - protein, 135 aa, Glycine max
  Coding DNA Sequence Number=SeqID_45691
MKTYNNEHVGTLKVHKQELQQDDGVKKENLLLLALRKQGKHHRELCLENERAFKERDTLMKEFHILEGHMTSRCRDFPKKGASNTFRTNKKGPKKIWEPKIKIIHVANVFNNRKDKLIMVPKQWLLMAHDKRKGV

SEQ ID NO: 162470 - protein, 185 aa, Glycine max
  Coding DNA Sequence Number=SeqID_45692
  Gene Ontology: Mol. function=carboxylesterase activity; Biological process=metabolic process
  Homolog annotation: Hit_ID=Q0ZPW9; Match level="QueryCoverage=75%, HitCoverage=57%, E-value=2e-23, Identity=36%"; Hit description=CXE carboxylesterase
  Pfam annotation: Domain name=Abhydrolase_3; Domain location=55-168; Score=-28.8; E_value=8.2e-06; Accession=PF07859.3; Description =alphabeta hydrolase fold
  Subcellular localization annotation: CTP_CleavageSite=55; ConfidenceScore=5.25e-01
MAAEPTKAKLTLPWKVHLLTSLLSTLGGASRRSNATINYRLFNLADRQSLPNPILIDGVSSSAIFATSLNVVVVSVYYRLAPEHRYPSQYHDDLDVLKFLDQNDNVLSDVADVSKCFLAGDSMGANLTHHVAVRISKEKLQMVNVIGLVSGKELQLIDYPNTFHGFYLFPELPKEFMTKQMAIVN

SEQ ID NO: 162471 - protein, 740 aa, Glycine max
  Coding DNA Sequence Number=SeqID_45693
  Gene Ontology: Mol. function=zinc ion binding; Cellular component =COPII vesicle coat; Biological process=ER to Golgi vesicle-mediated transport
  Homolog annotation: Hit_ID=Q6ZDG9; Match level="QueryCoverage=71%, HitCoverage=67%, E-value=0.0, Identity=73%"; Hit description =Putative SEC23
  Pfam annotation: Domain name=Sec23_BS; Domain location=419-524; Score= 166.8; E_value=5.3e-47; Accession=PF08033.2; Description=Sec23Sec24 beta-sandwich domain
  Pfam annotation: Domain name=Sec23_trunk; Domain location=125-411; Score=357.3; E_value=2.6e-104; Accession=PF04811.5; Description =Sec23Sec24 trunk domain
  Pfam annotation: Domain name=zf-Sec23_Sec24; Domain location=53-92; Score=85.4; E_value=1.7e-22; Accession=PF04810.5; Description =Sec23Sec24 zinc finger
  Pfam module annotation: Pfam domain module=Sec23_BS::Sec23_trunk::zf -Sec23_Sec24; Domain location=419-524::125-411::53-92
MAEFLDLESQDGVRMPWNVIPGTKQDAQNAVVPVSAVYTPIKHFTSMPLLNYSPLRCRTCRSVLNPFCIVDFAAKIWICPFCFQRNHFPPHYASISDDSLPAELFPQYTTVEYNSDAVGPTNTPSVPPVFLFVVDTCVIEEEIGFLRSALAQAVELLPENSLVGLITFGMFAHVHELGFGAVPKTYVFKGSKDVTKDQLLEQMSFFAKKPRPAVGVVAGARDGLSTESISRFLVPASECEFTLNSVLEELQKDPWAVPADQRAARCTSTALSIAASLLGACVPGSAARIMAFIGGPATEGPAPVRATHEACVVMYKLGNIVSKQLSEPIRSHKDLDKDSVPHYHNCVKFYDGLSKQLVHQGHVLDLFACALDQVGIAELKTAVERTGGLVVLAESFGHSVFKDSLKRVFQSGDYDLGLSSNGIFEINCSKDLKVQGIIGPCASLEKKGPLCSDVVIGQGGTSAWKMCGLDKSTSLCLFFDVVRKETPDATMQSTSNQFYFQFLTYQNNSGQMRLRVTTLSRRWVAGPESIQDQDLLSAKNLKWLKRCARFEMSDDLMGVSFMRLDILISYTKIVEQVYPVQFKEYYGQVCIFSSRGEARVRGRVSFHEDPRRTHAGNMDEQQQGYNRANWRDKKDWGDVREIFISKQKNKNGRRYDFARFKGVKDAHKLARELDQMVIGGLKMYVNIPKYGRDMARMVAAQPKPQRYEEKHQNTAAYWRQPHATPASTSYVAVVARNKRG

SEQ ID NO: 162472 - protein, 92 aa, Glycine max
  Coding DNA Sequence Number=SeqID_45694
MVACPGELRLSHEAIDSPRRAGYLTWKSFGGPGELEAILGERGARKLNEKTILPLLLAYFPFLIKTLNDPSFCAVTGIERCSLASENQKHQL

SEQ ID NO: 162473 - protein, 52 aa, Glycine max
  Coding DNA Sequence Number=SeqID_45695
MQGLLSRTTRTTNLRQSEDQQSCGWLWRLTQARLRRSEGPRYDPSRKAKIAN

SEQ ID NO: 162474 - protein, 149 aa, Glycine max
  Coding DNA Sequence Number=SeqID_45696
MKLHCYQASRRPNMTTDRPPLLMAHIDPAESPSVATYPTTGGRGKKPKERRPKRKMCGSRHQRLFEENIRKTKKGSANIENKGSGVVYAWGRVLDRRLQKDWARAAKESPGVLMNLREVSLAIRELLKEVFSKKLLKEVFSRKLLKEAT

SEQ ID NO: 162475 - protein, 287 aa, Glycine max
  Coding DNA Sequence Number=SeqID_45697
MGDDMVLLLGLTDAKAKRMMQEAREGEESMFYSLEKWNPSLRMGQRLTWVQCWGIPLLAWDKTHIQKIVAAIGDLVDVDDDVDAARRVDRARVLIRTPWSPAIQRTITVYVGGEVYKVQVVEKYSQSIETCHCRRRSVLWSSEEVKSDDSSIRTSVSGMRRAPYNDDEAQAITVPPNTAGRRRTFSDFSIRRDDLGTAAIPNGLTIHLSPLGNCFNPRVTVTCIDKDEDQVARQGLVANEMSPVKERSFLGWRHETYIRMKEWVIVGWTFLSTPPLKQKAILVAAHN

SEQ ID NO: 162476 - protein, 119 aa, Glycine max
  Coding DNA Sequence Number=SeqID_45698
MVNEKDGKNQLEEVAVIWNMAQELGATCLGRGVKWAAIRRMIKEEHIDMICIQETKKENIDKSICQALWGDAEVSWEVQPASNTAGGILCMWSEETFKLQSKVIRGGFILLRGQWLKED

SEQ ID NO: 162477 - protein, 53 aa, Glycine max
  Coding DNA Sequence Number=SeqID_45699
MDPWFEFDRQRLVQAWKNSTMDNNNYFNGVIKDCLALMDFHDLDRLVFAFRTS

SEQ ID NO: 162478 - protein, 337 aa, Glycine max
  Coding DNA Sequence Number=SeqID_45700
  Gene Ontology: Mol. function=hydrolase activity; Cellular component =nucleus; Biological process=metabolic process
  Homolog annotation: Hit_ID=Q0ZPW9; Match level="QueryCoverage=95%, HitCoverage=97%, E-value=1e-122, Identity=65%"; Hit description=CXE carboxylesterase
  Pfam annotation: Domain name=Abhydrolase_3; Domain location=90-308; Score=285.0; E_value=1.4e-82; Accession=PF07859.3; Description =alphabeta hydrolase fold
  Subcellular localization annotation: CTP_CleavageSite=65; ConfidenceScore=5.51e-01
MASETPKPKPVLPWKTRVSISFLSTLTDYARRSNGTVNRRLMNFLDRKSQPNAKPVNGVSTQDVTVDAKRNLWFRIFNPAAASGGGLPVVIFFHGGGFAFLSPDSFAYDAVCRRFCRRVPAVVVSVNYRLAPEHRYPLQYDDGEDILRFLDENRAVLPENADVSKCFLAGDSAGANLAHNVAVRVAKSGPLREVRVVGLVSIQPWFGGEARTAAEVKFEGAPLVSTARTDWLWKAFLPDGSDRDHGASNVSGPNSEDLSGLNYPDTLVFVGGFDPLQDWQKKYCEWLKKSGKKAQLIEYSTMIHAFYIFPELPESSQLISEVKDFITKRISDLKSNM

SEQ ID NO: 162479 - protein, 84 aa, Glycine max
  Coding DNA Sequence Number=SeqID_45701
MTGREAMGTTANERMDRRKERLRVGSTVTSEEETLLTVVGFGGSFRLKRLKRRRLTVPLERREAVVKVERGETANELFIKGRGL

SEQ ID NO: 162480 - protein, 108 aa, Glycine max
  Coding DNA Sequence Number=SeqID_45702
  Gene Ontology: Mol. function=oxidoreductase activity, acting on paired donors, with oxidation of a pair of donors resulting in the reduction of molecular oxygen to two molecules of water; Cellular component=membrane; ...
  Gene Ontology: Cellular component=Biological process=lipid metabolic process
  Homolog annotation: Hit_ID=Q6DAY6; Match level="QueryCoverage=82%, HitCoverage=25%, E-value=1e-27, Identity=59%"; Hit description =Putative fatty acid desaturase
AGAGRDAARLVSPCVRHHLRLADPAALAGILARRGEPAFDASSVPALEPPPLPGAEPHHRRGSAAFRHRLPPAGVGGAVAPAAALPQRDGAQTALALHADCARRYAVH

SEQ ID NO: 162481 - protein, 113 aa, Glycine max
  Coding DNA Sequence Number=SeqID_45703
  Homolog annotation: Hit_ID=Q0EDR1; Match level="QueryCoverage=37%, HitCoverage=78%, E-value=9e-07, Identity=53%"; Hit description =Hypothetical protein PHA57
  Subcellular localization annotation: CTP_CleavageSite=56; ConfidenceScore=5.31e-01
MRPARFIWNRCWSSTKWSVCAWRARSAPCRWSRWWFPSTFPPARPDKAPRQCDFMPAAVISRRNSEATTNSPSTLALQMITSQPMRFHQGAGAAVAVLSCIASSLLSDSRVHG

SEQ ID NO: 162482 - protein, 315 aa, Glycine max
  Coding DNA Sequence Number=SeqID_45704
  Pfam annotation: Domain name=DUF241; Domain location=55-307; Score= -48.3; E_value=0.0048; Accession=PF03087.5; Description=Arabidopsis protein of unknown function
  Pfam annotation: Domain name=DUF793; Domain location=1-308; Score= -203.2; E_value=0.0019; Accession=PF05633.2; Description=Protein of unknown function (DUF793)
  Pfam module annotation: Pfam domain module=DUF241::DUF793; Domain location=55-307::1-308
  Subcellular localization annotation: CTP_CleavageSite=19; ConfidenceScore=5.12e-01
MRAPSAILRSLSLRRIQPRAASAVVAPLPATTRFSRDLAAELTTLQPLGTSGGEHGMAQLLDAAITTQKIALNSLAQVSYLADVDRGAMEEYLETNTDILDACNYFVERIEDMKKYVESLRIVARSCTNATTSRALDQLESCHGIEKRLKTMEKRGSCLKKTMLRQKLGQESEFSEIVCGSKVMALMSCFSLEHALSFDCSKGGFPVVKCHPMSCSWLRIMQDLAEGSGEKKKIRRSMIELQQIVDAARELKEQIKGKREKEKVEYSCVERVKRSCGELEGGLGFVEGKVRDLYKSLIDVRMALLGILFQAFRSD

SEQ ID NO: 162483 - protein, 260 aa, Glycine max
  Coding DNA Sequence Number=SeqID_45705
MTEPGHWNPVLDRLEAAIAHFAATQASMAARLDVLLLKIDTPLISQHPPSSSFAQPPSANIPMPSSSPPMSIPLSCPVPMQQSQAPMLAPHLSTNSKHHVPHAPSSIFNQLVHARAVDSFNNLLSVVVHYGCAVTPHDKLLENRDMTLFEMRVESYGSAMVARKRQLAAFALWMAAKPSEFRRDRPWDPGITFGSHGLKPQHLEDKVFLMGQGMLGGRKQTSSKPLLRAQPQSQMENRITKTLKEFHITNYVRASELAGY

SEQ ID NO: 162484 - protein, 345 aa, Glycine max
  Coding DNA Sequence Number=SeqID_45706
  Gene Ontology: Mol. function=helicase activity
  Homolog annotation: Hit_ID=Q1SMF8; Match level="QueryCoverage=94%, HitCoverage=98%, E-value=1e-79, Identity=50%"; Hit description =Tetratricopeptide-like helical
  Pfam annotation: Domain name=PPR; Domain location=115-149; Score =10.6; E_value=0.41; Accession=PF01535.11; Description=PPR repeat
  Pfam annotation: Domain name=PPR; Domain location=187-221; Score =22.7; E_value=0.0013; Accession=PF01535.11; Description=PPR repeat
  Pfam annotation: Domain name=PPR; Domain location=222-255; Score =18.2; E_value=0.03; Accession=PF01535.11; Description=PPR repeat
  Pfam annotation: Domain name=PPR; Domain location=292-326; Score =13.1; E_value=0.21; Accession=PF01535.11; Description=PPR repeat
  Pfam module annotation: Pfam domain module=PPR::PPR::PPR::PPR; Domain location=115-149::187-221::222-255::292-326
  Subcellular localization annotation: CTP_CleavageSite=45; ConfidenceScore=5.02e-01
LPRSIFVNKRQQTMSFLRKSPNKTLTTLRRFATTLAAKPFPDDPTAAYYDQLAFAAGDSGDFHALRDVLNKRIQDGFLNTKITFNFLKDTNFSPSVIDNLVQTLSHLNQGATRRSALDSLVTRLCKLRRADEALRVIDSLARDNVCAPAACTFYPVLKCLTREEKSLDHARRVVDHMARLGIALDVTAHNIFLMAHCYAGELDAAAGVLKRMEEDGVGADPRTFDALVLGACRAGKVEGAMVVVRRMVDDGVPMLYSTHMCIIGTLLKMKCYELAMKYVRVFVGKDKLLDSELLGCLACKLVNLKRVKEGMSVLEEMKQKGVPMGHKLNKFYEMNAGNENGARVD

SEQ ID NO: 162485 - protein, 78 aa, Glycine max
  Coding DNA Sequence Number=SeqID_45707
  Subcellular localization annotation: CTP_CleavageSite=55; ConfidenceScore=5.34e-01
MSRGGTGKTRPPSGTGMGGVFTPPSVSGAGAGAGREMGSLGLGWGKQNPTPTRPVAMPRKGQGKQREILENYSWQDIL

SEQ ID NO: 162486 - protein, 269 aa, Glycine max
  Coding DNA Sequence Number=SeqID_45708
  Homolog annotation: Hit_ID=Q01AC6; Match level="QueryCoverage=94%, HitCoverage=52%, E-value=3e-19, Identity=27%"; Hit description=[S] KOG4843 Uncharacterized conserved protein
KGGGTIDLEPCLTHTSTVEPTLAPVATERTITTRAAASNALRQQRFVREVTIQYNLCNEPWIKYSISIVADKGLKKPLYTSARLKKGEVLYLETHSCRYELCFTGEKMAKAIPATQMHDLDTEKSQNHHHHPTNGDKADSDNVMVDVFRWSRCKNPLPQKLMRTIGIPLPLEHVENFFSSIMTYESNSCITVEYFHLPVSLLTRLLRCTTYEMGEDGSVFLEGKGENLMVLEENLDWEDVQWSQTGVWIAGKEYTLARGGGDRRGTVLG

SEQ ID NO: 162487 - protein, 521 aa, Glycine max
  Coding DNA Sequence Number=SeqID_45709
  Gene Ontology: Mol. function=transposase activity; Cellular component= membrane; Biological process=transposition, DNA-mediated
  Homolog annotation: Hit_ID=Q1SMF9; Match level="QueryCoverage=96%, HitCoverage=96%, E-value=0.0, Identity=78%"; Hit description =Transposase, IS4
  Pfam annotation: Domain name=Transposase_11; Domain location=290-454; Score=7.9; E_value=0.0024; Accession=PF01609.11; Description =Transposase DDE domain
MAYVDDDASSGSGDDVNLLDGHKRQAGMPSNSCGVRKRGRKATGAAIVDAMLEIASASKMRASAIVKNEERFSINKCIKVLDEMQGVDERIYFLALDLFEDHPNAREVFISLKDKKRLRWLQGKCDTPISMDDIDLELDEMELVAAAAGYHYYSCLTKQPARGLSPRRCEFMTEVLNGHGDFCREMLRMDKHVFHKLCDILRQRAMLRDTAGVMIEEQLAIFLNVIGHNERNRVIQERFQHSGETISRHFNNVLKAIKSLSREVLQPPQLKTPPEILNNARFYPYFKDCIGVIDGMNIPAHVPAKDQSRFRNKKGILSQNVLAACTFDLQFIFVYPGWEGSVTDSRVLRAVLDNPDQNFPQIPQGKYYLVDKGYLNTEGFIAPYQGVRYQHYEFRGANQLPRNAKELFNHRHCFLRNAILRSFNVLKTRFPILKLAPQYSFQIQRDIVIAGCVLHNFIRREERNDWIFNSVGGSPVEEISDIDELPDVPMLSSIQEQLAFSSRDSIASSMWDDFLTKWDEW

SEQ ID NO: 162488 - protein, 528 aa, Glycine max
  Coding DNA Sequence Number=SeqID_45710
  Pfam annotation: Domain name=RRM_1; Domain location=70-140; Score =21.4; E_value=0.0015; Accession=PF00076.12; Description=RNA recognition motif. (a.k.a. RRM, R
MSRERNSSERECREANTGEWERVRYRARNTERNGASGFRVPHRIHDGNRDGQKLSYNRANWRDKNDISSFYFTRIAEGVTELDIWNQFRKWGAVREIFISKQRNRNGWRFGFARFTGVEDAHRLAKQLDQIIIGGLRLYVNVPKYGRDETRKVGAQMQPERMDGKKQNENLHRKQYQVSTDMTSYAEVVARGKRNNSHSSKPINQRGEPQSSLQLDITATDKEWLRNTWVGRLKNLRWYDRLDEDPLWDFGEDITPKYIGGDMVLLLGLTDKMAECMAKEITKAEALFYSLEKWHPSLRPGNRLTWVHCWGIPLEAWDKKNIQRIVSVLGDMVDIDDDTEESRRMDRARVLIRTSRGPAIHHTINVDIRGDAHRVQVVEEVSRSGETCQCWRRRTKWSSEEIESDHSAFGSPINESFDPCRGEDRFRTWNLADMLETARNPAKDTAGTIAAYQLQAPEVPSPLLPKGPSIDVGPMDNSIVQRTQLRIPTVPVTDTCNEKRTQHVISQEAATELQQGEFQQNQKKKGEQ

SEQ ID NO: 162489 - protein, 120 aa, Glycine max
  Coding DNA Sequence Number=SeqID_45711
  Homolog annotation: Hit_ID=Q01AC6; Match level="QueryCoverage=43%, HitCoverage=18%, E-value=3e-07, Identity=51%"; Hit description=[S] KOG4843 Uncharacterized conserved protein
  Pfam annotation: Domain name=Rxt3; Domain location=51-114; Score =15.7; E_value=8.8e-08; Accession=PF08642.1; Description=Histone deacetylation protein Rxt3
MKRIRGKAEVSSVVYKVGESMQELIKLWKEYELSQSQVEKNSESSNGGPTLEIRIPAENVTATNRQVRGGQLWGTDVYTYDSDLVAGYCRPTASPPHMAVQELRTTIQVLPPQDCMSLHE

SEQ ID NO: 162490 - protein, 181 aa, Glycine max
  Coding DNA Sequence Number=SeqID_45712
  Subcellular localization annotation: CTP_CleavageSite=58; ConfidenceScore=5.78e-01
MATPPSSPPTPSPSFSPPSLTEAASQSPFTLKLTRKATRLRSLATRPVGADRLMVHVDSAIRKADGPHKKKLRTYLGIVARDKVVVTYENWKQAEFDIPGASDIRTKQKILQTMGEQWRQFKSDLTSKWTLAVDKDSVDDTAKNTALARRNGPNFVRAVETPRGRMCGENHRPSRSKTLPP

SEQ ID NO: 162491 - protein, 129 aa, Glycine max
  Coding DNA Sequence Number=SeqID_45713
MTPTYDALLYYNGRWNMSHQNEFVGYLFTGKNPKKFDIPSGCIIDELKDLIKHVAPHGISPYGIHESQTLKTNDDVLKVLVQSNYWKHFEPIEILAIFSKQPRPSCITLHSNYVRSEPLLCLRMTMCTP

SEQ ID NO: 162492 - protein, 484 aa, Glycine max
  Coding DNA Sequence Number=SeqID_45714
  Gene Ontology: Mol. function=nucleic acid binding
  Homolog annotation: Hit_ID=UPI000060E704; Match level="QueryCoverage =96%, HitCoverage=31%, E-value=5e-13, Identity=23%"; Hit description =UPI000060E704 related cluster
MSGVPKRSHEDSVHQSSKHPHQDSGTYSKLMPSVSNDHHIPYDMSQDSRVAKTVRTEPRDADRRSHLHTVYRMPLSSNDSHADHPIGPESRTESRDFKESREPRFENRDTKTEKKELHGEARRDSQIAKSEKDVRVDGRGDDNKDIRYEWDGHNDSKGDIKTDKDGYGMVSSSSHLNWKESKEYRGKRFSDAPGGSLDSWHTSRGNTPTEVGKDSSMAEERDYLETHEAKRREVIAEALRPVNNNSGDNKESAKEDRDVEKWERERKDLPKEKESSKEKEKDHSKRESLNGMEKDGLNDGKELCEEKNTELENVLPEQKKQKDVDSWKNVDGEVRERRKERDADLEGDRPDKRSKIDKQSEDGSAHGEGTGEKEREVHNYNVQHRKRIHRSRGSPQVANREARFRSHTQAPDNEENMDRHGNKNSVREEVEGSDRMHAVVRKIVVDRLGSWHHARKRDYEGSRWGEEGYCVVDLAPRVISKISL

SEQ ID NO: 162493 - protein, 177 aa, Glycine max
  Coding DNA Sequence Number=SeqID_45715
MVVVVPMFFRRSLLPLVVVLCWIYEHFPSVASIVAAKDYNEMRLRACRWTSSKALLVSMYRRRLDRLTLDAFDYIQTIPSHPVVSSLSAAEIDDRWMQFGDYIAPVGQLCAVSGHCSPDYLDWFYMILHPFMSPAQQGDPPRVPSIQQHEEFVEADMYPQPMATAAPNEADIDQHHL

SEQ ID NO: 162494 - protein, 160 aa, Glycine max
  Coding DNA Sequence Number=SeqID_45716
  Homolog annotation: Hit_ID=Q6Z0Z0; Match level="QueryCoverage=49%, HitCoverage=6%, E-value=2e-11, Identity=45%"; Hit description =Putative DNA polymerase V
MDSPSTSGGSAMLEFHIGVFKDLAAASKSVREVAAKQMVMELKVVHNAYDSHEKESGEGGLKLEAEKDDGLDNCAPSVRYVVRRLIRGVSSSREDHQSVIRMVVGIGDPYGSYQSVCSLHTSSSPTTKIDHNPPYTPHQHTYTTGEQIRFQTALNGSNVH

SEQ ID NO: 162495 - protein, 116 aa, Glycine max
  Coding DNA Sequence Number=SeqID_45717
  Subcellular localization annotation: CTP_CleavageSite=12; ConfidenceScore=5.21e-01
MLVRMIRTRLFAAARVKSCPSMHSSCVIASLSGCARTVGPPPISGGGPGTVKRKLLVWIWSPLKVRMRSPLKARACSPMKFRTCRLSKARECSPMMARTCNPLKVRACPPLKMGNM

SEQ ID NO: 162496 - protein, 103 aa, Glycine max
  Coding DNA Sequence Number=SeqID_45718
MKKIEEEVSTTSLLSEMVSIERIIGREEKFGNWKSAEQGRKTLSELAFLNMKLESCVYDLKVAEAYRTALKNPVGLTPFQMIYGKLATYRWNWRIRPIGPSSF

SEQ ID NO: 162497 - protein, 146 aa, Glycine max
  Coding DNA Sequence Number=SeqID_45719
MDLMGCSFMLFVRGVSMLRQLCHHQRGDHYKGSIMLKASSCTMAMKTTMIYGTIPIGGVVEESVLRSSKDHKVGHIVWWFMCGGRGLTHATNILQIYIASSRSRIHMTTWMLDGYWLHDVEILCATVRMLDDLETNDTTLLPNRRR

SEQ ID NO: 162498 - protein, 105 aa, Glycine max
  Coding DNA Sequence Number=SeqID_45720
  Gene Ontology: Mol. function=DNA binding; Cellular component =mitochondrion; Biological process=DNA integration
  Homolog annotation: Hit_ID=Q1SDN3; Match level="QueryCoverage=99%, HitCoverage=11%, E-value=3e-15, Identity=55%"; Hit description =Polynucleotidyl transferase, Ribonuclease H fold
MSASCIEEETGMSFSKPAFTLSRTIWQSISMCLGSVLRLGGATRHCRLLLGSPRNERLSKINEEPNDGAPCVSAPCPIGVTEGFESEVTMSNKENARTRRTFEVA

SEQ ID NO: 162499 - protein, 100 aa, Glycine max
  Coding DNA Sequence Number=SeqID_45721
  Gene Ontology: Mol. function=oxidoreductase activity, acting on single donors with incorporation of molecular oxygen, incorporation of two atoms of oxygen; Biological process=aromatic compound metabolic process
  Homolog annotation: Hit_ID=Q1SMG9; Match level="QueryCoverage=93%, HitCoverage=35%, E-value=3e-38, Identity=82%"; Hit description =Extradiol ring-cleavage dioxygenase, class III enzyme, subunit B
HKYPAPGAPQLARRVKELLIKSGFSRVDEDTKPGLDHGARVPLFLMYPEADIPVCQLSVQSQQDGTYHYNFGKALAPLKDESVLIIGSGSAILHLELPGL

SEQ ID NO: 162500 - protein, 152 aa, Glycine max
  Coding DNA Sequence Number=SeqID_45722
MSSSHFGEGSGGDQSLVFRQKSMLATEILGIGEETKGYYESSLSFQDEEEFMQMMKGLEGVGKNSDEKIVFDKMDTNCGDITIVVEDDAGDDGVENMEEDVDTYAFYFQSAKSIKELEDRSNFAYVYEDLFKDLDITLPFTNFECEILIEMN

SEQ ID NO: 162501 - protein, 538 aa, Glycine max
  Coding DNA Sequence Number=SeqID_45723
  Gene Ontology: Mol. function=DNA binding; Cellular component=beta -galactosidase complex; Biological process=DNA integration
  Homolog annotation: Hit_ID=Q1S7S0; Match level="QueryCoverage=93%, HitCoverage=79%, E-value=1e-67, Identity=42%"; Hit description =Integrase, catalytic region; Peptidase aspartic, catalytic
  Pfam annotation: Domain name=zf-CCHC; Domain location=214-231; Score =10.2; E_value=0.021; Accession=PF00098.13; Description=Zinc knuckle
  Pfam annotation: Domain name=zf-CCHC; Domain location=250-267; Score =13.8; E_value=0.0052; Accession=PF00098.13; Description=Zinc knuckle
  Pfam module annotation: Pfam domain module=RVT_2::zf-CCHC::zf-CCHC; Domain location=402-538::214-231::250-267
MVSELFLKKSSAVSPLSFTLPCFPLICFLTMNESMLSTDSYLYLHPSENLAVALVSPPLDSSNYHSWSRSMMTALSAKNKVEFVNGKAPEPLKYDRTHGAWSRCNNMVVSWLVHSVSIPIRQSVLWMDKAEEIWNDLKSRCAQGDLLRVSELQQEASSIKQGSLSVTEYFTKLRVIWDEIENFRPNPERQLGNHPLSSFNLEPKEISSINAVKSVCEFCGRTGHNESVCYKKHGLPPNYNGKGKGYSARKTCTYCGKLGHTIDVCYKKHGYPPGFKFNNGKAIANSVVAAEGKATNDQILSQESQEHVRFSSEQYKALLALIQQPSAGTSASIKPQVASISSCTNNDPTADHTLTKVKYPLHSVLSYSRLSHSHKHFVMSITAITEPRTYAEASSHDCWIKAMQAELNALQQNHTWILTPLPPHKKAIGCRWVYKVKHNADGSIKRYKARLVAKGYTQQEGLDFLDTFSPVAKLTTVRMLLALAALRNWHLRQLDVNNAFLHGDLNEEVYMKPPPGLVMDEPNLVCRLQRSLYGLKQA

SEQ ID NO: 162502 - protein, 185 aa, Glycine max
  Coding DNA Sequence Number=SeqID_45724
  Gene Ontology: Mol. function=phosphatidylglycerol-prolipoprotein diacylglyceryl transferase activity; Cellular component=integral to membrane; Biological process=lipoprotein biosynthetic process
  Homolog annotation: Hit_ID=Q8UDB4; Match level="QueryCoverage=76%, HitCoverage=61%, E-value=4e-60, Identity=69%"; Hit description =Prolipoprotein diacylglyceryl transferase
MPLPGMDHEDPEHFAEKLADLWRGDEITRTAEGFATLVITVFRDRPEAESEHRGGEHHAHCQPVAGEITDLGRPEGVDGDCQDDDEHEPFEARFIELARVPRKGAARREHDRPWHVGNAAPQFTIDEIGDAPEQQADGRDGGDDVEHAPDRNAVLAGEEDHGDRRADQAAMERHAAVPDLDRPDG

SEQ ID NO: 162503 - protein, 677 aa, Glycine max
  Coding DNA Sequence Number=SeqID_45725
  Gene Ontology: Mol. function=nucleic acid binding; Cellular component= mitochondrion; Biological process=DNA integration
  Homolog annotation: Hit_ID=Q1SRN1; Match level="QueryCoverage=63%, HitCoverage=32%, E-value=1e-152, Identity=55%"; Hit description =Integrase, catalytic region
  Pfam annotation: Domain name=zf-CCHC; Domain location=134-151; Score =6.5; E_value=0.083; Accession=PF00098.13; Description=Zinc knuckle
  Pfam module annotation: Pfam domain module=RVT_2::zf-CCHC; Domain location=288-545::134-151
MREFLSQIKNIVDELAGVDNPVPHDEHVDAILEGLTQDYALVISIIESKFETPPVSEVEALLLAHESRANRFRKHSFAPSVNYSQGYVFSNSNDSSTRNNSSGGYGRDGGGRDNNSGRRGGGHGRGRGGRFANFQCQICLKYGHTANICFYRADSNYHPHESLVLYDPHTLQPVQINPSQPTNKTSNTWPSNSSPSSAAVPSEQPILSSNNSLHNTETSPTSVSQPESDSSSPQESFEPVPRTTNVHPMQTRSKSGIHNPQIHHSLFLAHNEPKGVKQALADPNWLSAMQFEYAALLKNHTWDLVPLPSNRKAVGCKWVFRIKENADGSINKYKARLVAKGFHQVHGFDFHETFSPVVKPITIRLIITLALTNNWELFQLDVNNVFLNGLLEETVYMVQPPGFEVEDKSLVCKLNKALYGLKQAPRQWFDRLKITLIQFGFQASKCDPSLFMYKHQAHTIFLLVYVDDIILTGSSSSLIQQITTQLNSTFSLKQLGQLDYFLGIEIKYLPDRSLLMTQSKYDPTLYRSIVGALQYVTLTRPEIAFAGTISHGLLMKPAAVGKPLSITAMCDADWASDVDDRRSTSGSAIFLGPNLISWWSRKQQVTARSSTEAEYRSIAQTSAELTWVQALLQELQVPFSTPMLLCDNQSAVAIAHNPVFHSKTKHMEIDVFFVREK

SEQ ID NO: 162504 - protein, 54 aa, Glycine max
  Coding DNA Sequence Number=SeqID_45726
MEITLGEMITLFLTSYEDLYNNQHQDRYNHAKEIFARSSYPTVASLSHKFPVLF

SEQ ID NO: 162505 - protein, 62 aa, Glycine max
  Coding DNA Sequence Number=SeqID_45727
METSLRYKIIYGLDIWKDHLPKSLSSFIGAPILHNFDFQPKDPAINNREESFPGLHPEAQNS

SEQ ID NO: 162506 - protein, 66 aa, Glycine max
  Coding DNA Sequence Number=SeqID_45728
MADTGKWWSFCPRKTLLSGFVPCITGLDDTPQPKSKATATWIIVKTIGAREIKGASHPVGTTLSPT

SEQ ID NO: 162507 - protein, 187 aa, Glycine max
  Coding DNA Sequence Number=SeqID_45729
  Gene Ontology: Mol. function=sugar binding; Cellular component =membrane; Biological process=protein amino acid phosphorylation
  Homolog annotation: Hit_ID=Q40099; Match level="QueryCoverage=73%, HitCoverage=37%, E-value=7e-23, Identity=45%"; Hit description =Secreted glycoprotein 2
  Pfam annotation: Domain name=B_lectin; Domain location=35-135; Score =62.0; E_value=1.9e-15; Accession=PF01453.15; Description=D-mannose binding lectin
  Subcellular localization annotation: CTP_CleavageSite=63; ConfidenceScore=5.20e-01
MILSTCSSPRVMGRPWYQKLESLNLGFSALVVPRNKTVVWVAKTPSRFLRHLNTQQHRQSCPNNSHKQAQNPVVVLLDSGNLVIKIKGQADPEAYLWQSFDNSSDTLLPGMKLGSNLRTGLNRRYTSWKSPDDPSPGDVWVFLGFFLIHPLTPSTLWTWCVVLLNGSRIGSDIRKKSEPNSILKISS

SEQ ID NO: 162508 - protein, 196 aa, Glycine max
  Coding DNA Sequence Number=SeqID_45730
  Gene Ontology: Mol. function=protein serine/threonine kinase activity; Cellular component=membrane; Biological process=protein amino acid phosphorylation
  Homolog annotation: Hit_ID=Q60EJ2; Match level="QueryCoverage=91%, HitCoverage=27%, E-value=3e-44, Identity=46%"; Hit description =Putative receptor-like protein kinase
  Pfam annotation: Domain name=Pkinase; Domain location=38-195; Score= -103.7; E_value=0.022; Accession=PF00069.15; Description=Protein kinase domain
  Pfam annotation: Domain name=Pkinase_Tyr; Domain location=38-193; Score=-100.8; E_value=2.8e-06; Accession=PF07714.7; Description =Protein tyrosine kinase
  Pfam module annotation: Pfam domain module=Pkinase::Pkinase_Tyr; Domain location=38-195::38-193
MNKLEFWTSNCLIYRQLQLPLMISPPKIRSEKVVLDLYTRGMQGILANRQEISVNTLSRNSWQGVTEFINEVNLIAKLQHRNLVRLHGCCIQGQERMLIHEYMPNGSLDSLIFGYNRSKLLEWPQRFDIVSGISRGLIGYIAPEYAVDGSFSVKSDAFSFGILALEIVCGKRNRGLNQTDKSLNVVGCQYQKIGLQ

SEQ ID NO: 162509 - protein, 139 aa, Glycine max
  Coding DNA Sequence Number=SeqID_45731
MTRLKDSRRSRYQMDSHGIIEDRDESWEVELGRAGLGYLGDLRGDHVVQVHVYLYNNTINKAGPVDVEIIGVGGMSENEMTPRQVELDLNGLVVREGVQCLSIELDDLPSNFAIFRQAVLRVIDVGLELLHQSYIDVLL

SEQ ID NO: 162510 - protein, 479 aa, Glycine max
  Coding DNA Sequence Number=SeqID_45732
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=96%, HitCoverage=59%, E-value=1e-111, Identity=42%"; Hit description =Protein kinase; EGF-like, subtype 2; S-locus glycoprotein; Curculin- like ...
  Homolog annotation: Hit description=(Mannose-binding) lectin; N/apple PAN; Type I EGF
  Pfam annotation: Domain name=B_lectin; Domain location=80-193; Score =131.5; E_value=2.3e-36; Accession=PF01453.15; Description=D-mannose binding lectin
  Pfam annotation: Domain name=PAN_2; Domain location=349-417; Score =117.6; E_value=3.6e-32; Accession=PF08276.2; Description=PAN-like domain
  Pfam annotation: Domain name=S_locus_glycop; Domain location=207-332; Score=177.6; E_value=3.2e-50; Accession=PF00954.11; Description=S -locus glycoprotein family
  Pfam module annotation: Pfam domain module=B_lectin::PAN_2::S_locus _glycop; Domain location=80-193::349-417::207-332
MSNNRELLYSMKILSFMMLVICIVVPSLRICVANDSVNVLQSMSDGERLVSKGGNFELGFFSPGSSQKRYVGIWYKNIPTQTVVWVANGANPINDSSGILTLNTTGNLVLTQNGSIVWYTNNSHKQVQNPVVELLDSGNLVIRNDGEPNPEAYLWQSFDYPSHALLPGMKFGRDLRTGLERRYTAWKSPEDPSPGDVYGVLKPYNYPEFYMMKGEKKLLRQGPWNGLYFSGFPDLQNNTIFGINFVSNKDEIYYTFSLVKSSVVTINVINQTGRTYRYVWVEGDQNWRIYISQPKDFCDTYGLCGAYGSCMISQTQVCQCLKGFSPKSPQAWASSDWTQGCVRNNPLSCHGEDKDGFVKFEGFKVPDSTHTWVDESIGLEECRVKCLSNCSCMAYTNSDIRGEGSGCVMWFGDLIDMKQLQTGGQDLYIRMPASELEKDKTEKDGVNLTTFDFSSISYATNHFSENNKLGQGGFGSVYK

SEQ ID NO: 162511 - protein, 173 aa, Glycine max
  Coding DNA Sequence Number=SeqID_45733
  Gene Ontology: Mol. function=protein serine/threonine kinase activity; Cellular component=membrane; Biological process=protein amino acid phosphorylation
  Homolog annotation: Hit_ID=Q70I29; Match level="QueryCoverage=99%, HitCoverage=19%, E-value=5e-56, Identity=63%"; Hit description=S -receptor kinase-like protein 2
MARTFGLDQDEANTNRIMGTYGYMPPEYAVHGFFSVKSDVFSFGVIVLEIISGRKIRGFCDPYHNLNLLGHAWRLWTEKRSMEFIDDLLDNSARLSEIIRYIHIGLLCVQQRPEDRPNMSSVILMLNGEKLLPEPSQPGFYTGKVHSTMTESSPRNTDAYSFNEISNSLLEAR

SEQ ID NO: 162512 - protein, 322 aa, Glycine max
  Coding DNA Sequence Number=SeqID_45734
MEIEAALCIPGRGFILNAKGHPGRILRKDLTTLAQVWSVLSYSNLAPTSYTSDLTVDRARLIFCLVSHMDMNIGALISGQMTSIAQSNSSRLGFPTLIIALCRARGVVSDSLTFERLCPIINLAYIRKNCWNPYDLTVFIRGARRASARPVELPSTSTAPTPASTSIAPSVPAQTDSQCFEAILQSIHQGQIILLQSLQPGAQPSLHREDEGPTAQVPQHVEDASSKATILEPFIVKEEAGETQVRQEASATPERSREVTPVVDLSSPQHVEDPSTPILEIPEDPTTPVLTLNTSPPATPALHLTDEEDVQTQDTQDQSQEF

SEQ ID NO: 162513 - protein, 111 aa, Glycine max
  Coding DNA Sequence Number=SeqID_45735
  Gene Ontology: Mol. function=histone-lysine N-methyltransferase activity; Cellular component=nucleus; Biological process=chromatin modification
  Homolog annotation: Hit_ID=Q945S8; Match level="QueryCoverage=64%, HitCoverage=20%, E-value=5e-10, Identity=52%"; Hit description =Histone-lysine N-methyltransferase ASHH3
MESEQSMPLKESNIYLTKKVKRSRFDDDGIFCSCTPSPGSTSVCGRDCHCGMLLSSCSSGCKCGSSCLNKPFQNRPVKKMKLVKRSSNLVKCVSLLTGGIFLFFFLVLKVL

SEQ ID NO: 162514 - protein, 110 aa, Glycine max
  Coding DNA Sequence Number=SeqID_45736
MARSLLMWLHGECVASTTGEKRGDVGVLPAPLARSLPHMQKPPTAMARHVPTWNMLGLNHLKASCSYVRVTCFVAVQGSHGYSVPIKWPEDFGENWLHRHALIMACVVFI

SEQ ID NO: 162515 - protein, 118 aa, Glycine max
  Coding DNA Sequence Number=SeqID_45737
  Gene Ontology: Mol. function=catalytic activity
  Homolog annotation: Hit_ID=Q6AV57; Match level="QueryCoverage=98%, HitCoverage=73%, E-value=5e-34, Identity=60%"; Hit description =Putative thioesterase family protein
  Pfam annotation: Domain name=4HBT; Domain location=48-118; Score =37.7; E_value=4e-08; Accession=PF03061.12; Description=Thioesterase superfamily
MEDQPLSSKSKTAALDQTLHSIGFEIEDLSPQKISGRLPVTQKCCQPFKVLHGGVSALIAESLASMGAHMASGYKRVAGIQLSINHLKRAEIGDLVYAEATPLNVGKTIQVMFIAIYL

SEQ ID NO: 162516 - protein, 239 aa, Glycine max
  Coding DNA Sequence Number=SeqID_45738
  Subcellular localization annotation: CTP_CleavageSite=73; ConfidenceScore=5.31e-01
MAATSRAPFSVRVSILTTSTPLAGDTIPAPVISEQQTPNLQSLVAAAPPTTVARNLGFRPSPELGLLSHLFVLSMAFGAFFSVAVFSIATLIVVAVLIPQKLGINATDLIGIVAFGRLGSSVKKLSKVVSEEVPGTLYSLKLSSVELSDLPNNLVISGIHKEMKDRSTARSRSFRKKNATSGCQHCFGEQAYMFLEMSLVEQQLNEGFYVDPETSKLPTLTQSMLANLGLAGIEFVCGG

SEQ ID NO: 162517 - protein, 574 aa, Glycine max
  Coding DNA Sequence Number=SeqID_45739
  Gene Ontology: Mol. function=RNA-directed DNA polymerase activity; Biological process=RNA-dependent DNA replication
  Homolog annotation: Hit_ID=Q1T5K4; Match level="QueryCoverage=35%, HitCoverage=26%, E-value=3e-27, Identity=31%"; Hit description=RNA -directed DNA polymerase
MERMMREHIKELYGRIEQLENQENREDDGGRRRRRKRRDNDGGDAREDKIEGNYVEFEDLVHQVAKVEQQLKRKGTMRKSSSNFNSPSWNDKNKNKGGHIASLCPSNMTMLLKKVEEIISDSSSNFVPSSDEEGKGVEGDLFMVRRLSGSQAKDLDEAKEKIFFTQGVSSKERPYKLQWLNEDGYMTVKKQVEVRFSIEKYEDVVLCDVVPMEACHLLLAYIYLSCNTENKREYISCGSVQVERTSTWLFKENKGGYIPCGSLLVKDFTRLLEISRTGGCLGTGQFKGGAYVYKEKLKLLKKELKAWSMEKYRDLEGKKSFLIQQIGDLDKREEEGNLSIQEVAVRSHPEPEKVKEKGSNFFAIGSGKKEINGNLLDSVVIVNVVIQDAKLRKRPCVIFKEDIKKAYDFVKWSFLCTMLGRLGFCTGWISWIKGYMESSTMSVLVNGSPIEEFCNQKSLRQADPMAFFLFLVIAEGLVGLTRIVVAKTLFVGSKVGGREYGGTQRCLKMEEILNYKVMQIPFVYLEMSVGVNLRKVPIWNPMVCAVKESGGLGIKNLEFFNKAFLSMWMWTFMN

SEQ ID NO: 162518 - protein, 349 aa, Glycine max
  Coding DNA Sequence Number=SeqID_45740
  Homolog annotation: Hit_ID=Q7XEJ0; Match level="QueryCoverage=34%, HitCoverage=45%, E-value=7e-18, Identity=44%"; Hit description =Expressed protein
PHQDGPAYFPVVAILSLGSPVVMDFTPHARFKQNFEEDINKDLDGGTFEIGKDKWFDGHHQFSILLVPRSLLIFKDKAYSDYLHGIKDCAVHCYNGAVNEDEALKHKESNGDLFSSEDDALETLLPAPLLFVPPITATTVVFVLAFVEAAVIAEDVEHVDHAADKVYEQLEEAIVDDVVVDARGFSSGSQNTSVLMDYVHHEHPELKLPSRRRKVEKFGRPAPEIEVGEVTITLDAMTSLLHLSITSVFHSFKALHVDEVVDLLVDLLESEKALLVSTFDIVCWIPYGDYRAFRKFECATDYKKWFYMISHPFMSLAQPENPARHPPVVHNETFVELDPPQQSIVATTM

SEQ ID NO: 162519 - protein, 136 aa, Glycine max
  Coding DNA Sequence Number=SeqID_45741
MSGQIYQTETILETIYQTGSLFKVFARGVYFFVDAASRIGEIVVPPLSMARSMVSWRVPPLSMARSMLRAMARQLMWTLSRCSHGRETLREDGTAIGNGETVDMDVVSLLLLARSVTWTHVKTASACTMLLQCFME

SEQ ID NO: 162520 - protein, 134 aa, Glycine max
  Coding DNA Sequence Number=SeqID_45742
  Subcellular localization annotation: CTP_CleavageSite=70; ConfidenceScore=5.10e-01
LCNFSLHPPSKLERPSPHRRVSPPLPPHLRQPQQLCNFSLHPPSKLERPSPHRRVSPPLPPHLRQPQQIYGAPASKWKMLKNRRLQNWGMIHHFMMQSYPAKTLDRRLQVNWAKDAREGPRVLMSLRRDFRPMG

SEQ ID NO: 162521 - protein, 198 aa, Glycine max
  Coding DNA Sequence Number=SeqID_45743
  Gene Ontology: Mol. function=translation release factor activity; Cellular component=cytoplasm; Biological process=translational termination
  Homolog annotation: Hit_ID=Q9C815; Match level="QueryCoverage=72%, HitCoverage=55%, E-value=2e-48, Identity=70%"; Hit description =Peptide chain release factor, putative; 8726-9996
  Pfam annotation: Domain name=RF-1; Domain location=3-91; Score=-3.5; E_value=0.00012; Accession=PF00472.11; Description=Peptidyl-tRNA hydrolase domain
MLPEPLGRGAHAAERGGQHRNKRESAVRLKHLPSGIIAQASEDRSQHKNRASAINLLRSLIALKVRKTVDLEAYSPPRELLRILPPKSSIRGPDYGPQIGPNNPKFASGMQALLDLIFAVAGSVSEAAKYLGLSTGAVSRLILSDDSLRKEVNDLRATKMGLLALDPQLGNFYIRKKRRGLRNQVGKLLFSSLLGLAT

SEQ ID NO: 162522 - protein, 702 aa, Glycine max
  Coding DNA Sequence Number=SeqID_45744
  Gene Ontology: Mol. function=protein serine/threonine kinase activity; Cellular component=mitochondrion; Biological process =protein amino acid phosphorylation
  Homolog annotation: Hit_ID=Q1SB26; Match level="QueryCoverage=72%, HitCoverage=94%, E-value=1e-149, Identity=34%"; Hit description =Tetratricopeptide-like helical
  Pfam annotation: Domain name=PPR; Domain location=269-303; Score =19.7; E_value=0.011; Accession=PF01535.11; Description=PPR repeat
  Pfam annotation: Domain name=PPR; Domain location=304-338; Score =31.4; E_value=3.2e-06; Accession=PF01535.11; Description=PPR repeat
  Pfam annotation: Domain name=PPR; Domain location=339-373; Score =39.6; E_value=1.1e-08; Accession=PF01535.11; Description=PPR repeat
  Pfam annotation: Domain name=PPR; Domain location=378-413; Score=0.6; E_value=6.3; Accession=PF01535.11; Description=PPR repeat
  Pfam annotation: Domain name=PPR; Domain location=431-465; Score =33.3; E_value=8.7e-07; Accession=PF01535.11; Description=PPR repeat
  Pfam annotation: Domain name=PPR; Domain location=468-502; Score =47.5; E_value=4.3e-11; Accession=PF01535.11; Description=PPR repeat
  Pfam annotation: Domain name=PPR; Domain location=503-537; Score =38.1; E_value=3.1e-08; Accession=PF01535.11; Description=PPR repeat
  Pfam annotation: Domain name=PPR; Domain location=538-572; Score =16.1; E_value=0.092; Accession=PF01535.11; Description=PPR repeat
  Pfam annotation: Domain name=PPR; Domain location=573-607; Score =33.9; E_value=5.5e-07; Accession=PF01535.11; Description=PPR repeat
  Pfam annotation: Domain name=PPR; Domain location=608-642; Score =58.5; E_value=2.3e-14; Accession=PF01535.11; Description=PPR repeat
  Pfam annotation: Domain name=PPR; Domain location=643-677; Score =16.5; E_value=0.082; Accession=PF01535.11; Description=PPR repeat
  Pfam annotation: Domain name=Ribosomal_L2_C; Domain location=1-129; Score=236.1; E_value=7.5e-68; Accession=PF03947.8; Description =Ribosomal Proteins L2, C-terminal domain
  Pfam module annotation: Pfam domain module=PPR::PPR::PPR::PPR::PPR::PP R::PPR::PPR::PPR::PPR::PPR::Ribosomal_L2_C; Domain location=269 -303::304-338::339-373::378-413::431-465::468-502::503-537::538 -572::573-607::608-642::643-677::1-129
CMPLSAMRIGTIIHNIELNPGQGGKLVRAAGTSAKILKEPTSAYCLIQLPSGVKKLIDSRCRATVGVVSNPSHGDRKLRKAGHSRWLGRRPVVRGVAMNPVDHPHGGGEGKSKSGGRFGRGSLTPWGKPTKSGYKTGPLKRKSAATTTFLYATKPETTMLLRFHRTASTSRLHPLITSLFYSHPFSTSPPPISDAAHRTLLLNSIRTLETADAVVAVDFFHRMLTLTPFPCIQDFNLLFGLVAKSQHYATAISLIKILHSLGDGSADVCTLNIAINCLCHMRKTTLGFAVLGLMTKIGLEPTLVTLNTIVNGLCIEGDVNHALWLVEKMENLGYHCNARTYGALVNGLCKIGDTSGALECLKKMVKRNLGPNVVPNVVTYNCLIQGLCGEFGGWREGVGLFNEMVAEKGIVPGCANVFDFGGWIGVEPNVVTYNSLIAGYCLRSQMEEAMRVFGLMVREGEGCLPSVVTHNSLIHGWCKVKEVDKAMSLLSEMVGKGLDPDVFTWTSLIGGFCEVKKPLAARELFFTMKEHGQVPNLQTCAVVLDGLLKCWLDSEAVTLFRAMMKSGLDLDIVIYNIMLDGMCKMGKLNDARKLLSCVLVKGLKIDSYTYNIMIKGLCREGLLDDAEELLRKMKENGCPPNKCSYNVFVQGLLRKYDIARSRKYLQIMKDKGFPVDATTAELLIRFLSANEEDKSFKEFPQI

SEQ ID NO: 162523 - protein, 438 aa, Glycine max
  Coding DNA Sequence Number=SeqID_45745
  Gene Ontology: Mol. function=phospholipid binding; Cellular component= coated pit; Biological process=endocytosis
  Homolog annotation: Hit_ID=Q1RZR4; Match level="QueryCoverage=90%, HitCoverage=100%, E-value=1e-133, Identity=63%"; Hit description=ANTH
  Pfam annotation: Domain name=ANTH; Domain location=36-309; Score =207.7; E_value=2.7e-59; Accession=PF07651.6; Description=ANTH domain
  Pfam annotation: Domain name=ENTH; Domain location=36-165; Score= -23.2; E_value=0.0032; Accession=PF01417.11; Description=ENTH domain
  Pfam module annotation: Pfam domain module=ANTH::ENTH; Domain location=36-309::36-165
MGVDIQGKLRLALGSVKDHASIGKAMMYHNYQHDGFSNIEIAVLRATGHDNGTIDDRYMHEILFLVSNSPGSIPFLAERISCRLGKTKDHVVALKTLVLIHRLLRGGNRSFEQELCKAHVSGHLQLQISTTRCFTKSSSVVGFLHKYAAYLEERMSWLINQAGKLEPVMSKGLEFRRYDEKSIDMAFRILPKCQMLIDKVLECSPHDVLCSDHSLAQAAMSNTLRESFQVYMTFSEGIAALVNMFFDLTASARGLACEILKKASLQSQKLHDLYESCKQVVENKSLDYPFVKIISMNHIVALEQLGSPQNELEASHVSLKSISSRPPPISGHFTKSKEIELAVEAKESKRSEESIGIDLSPTPTLLSWTLETKISMVWVVFEDEFPNNESKVNPAQQKLAGVDAVCDIKSEYGRPSVFLNPFSSSFQTSMSTKVQCFG

SEQ ID NO: 162524 - protein, 208 aa, Glycine max
  Coding DNA Sequence Number=SeqID_45746
  Gene Ontology: Mol. function=metal ion binding
  Homolog annotation: Hit_ID=Q9ZNU9; Match level="QueryCoverage=64%, HitCoverage=83%, E-value=2e-18, Identity=37%"; Hit description =Putative zinc finger protein
  Pfam annotation: Domain name=zf-A20; Domain location=3-27; Score =37.0; E_value=6.5e-08; Accession=PF01754.7; Description=A20-like zinc finger
  Pfam annotation: Domain name=zf-AN1; Domain location=95-135; Score =62.0; E_value=1.9e-15; Accession=PF01428.7; Description=AN1-like Zinc finger
  Pfam module annotation: Pfam domain module=zf-A20::zf-AN1; Domain location=3-27::95-135
MVPSLCANGCGFYGSSATKNLCSKCYIDYLKENVTKSKECETKNLSDQVFVLDQSSATSCKPCASEVSNTDDATMVDVSLTDPEGIINNKRKKRCKCCNKKVGLLGFECRCGDVFCGTHRYPEKHACHVDLKEIGRQVDRQDVDIVLGSALTGPPRKHNKQPRMNDLMLWKSTQNHKPWFLSWGGEWREKEGMFETSLSNQKFTHLTF

SEQ ID NO: 162525 - protein, 74 aa, Glycine max
  Coding DNA Sequence Number=SeqID_45747
MGRFKSNEKHETVIERCWSLPSECAFVCEKERRNWHGFGVPSARIEASRVGTWLLSVVFAEDDDAVSKLHNWQR

SEQ ID NO: 162526 - protein, 97 aa, Glycine max
  Coding DNA Sequence Number=SeqID_45748
  Gene Ontology: Mol. function=endopeptidase inhibitor activity
  Homolog annotation: Hit_ID=Q1T467; Match level="QueryCoverage=92%, HitCoverage=44%, E-value=3e-16, Identity=57%"; Hit description =Kunitz inhibitor ST1-like
MRAKPGAIFTETPLDIAFVDKPKCATSSKWVAVVDDFPSKWLGIGGAQDHPGLKQIITGNFNIKKYDLGYKLVFCPPVLVLVLTLRGMMIRTGGVFY

SEQ ID NO: 162527 - protein, 451 aa, Glycine max
  Coding DNA Sequence Number=SeqID_45749
SATSEVVKEILHDQLRLTRLTELDSIAKQIKALESIMREDNRKFTKSEEADSPRLDSDEENVTREFLHMLEDQKARGFKINQSKIPSLQMAESEVYLSDLGKGLGCVVQTKDGGYLTSLNPLDNAVARNDTPKLAMQMSKPYVLASNQFPNGLELFQKLAGIGLDELSSQVFSMMPLDELIGKTAEQIAFEGIASAIIQGRNKEGASSSAARIVSALKGMANAMSSGRQERISTGLWNVDETPLTAEKILAFTMQKIEFMAVEGLKIQVDMAEEEAPFDVSPLSTEEGNKENELLASAVSLEDWIRDQSYSDTSNITLMFVVQLRDPMRRFEAVGGPVVVLIHATGEEDTKGSECDHYQDDEEEKMFKVTSMHMGGLKVRSVTKNAWDSEKQRLTAMQWLIEYGLGKLKAGKKGKHALLKGPDFLWSISSRIMADMWLKTMRNPDIKLVKE

SEQ ID NO: 162528 - protein, 92 aa, Glycine max
  Coding DNA Sequence Number=SeqID_45750
MGMGYGGEGWWNRRENKRVKVGTEERDKHSPSNIFLTLHLPKLPTDSSVISKLMSPCYLFLLVYQQTSCTSTNRAKPKRFPCLSLFAGINTS

SEQ ID NO: 162529 - protein, 1395 aa, Glycine max
  Coding DNA Sequence Number=SeqID_45751
  Gene Ontology: Mol. function=RNA-directed DNA polymerase activity; Cellular component=chromatin; Biological process=chromatin assembly or disassembly
  Pfam annotation: Domain name=Chromo; Domain location=1130-1177; Score= 28.8; E_value=1.9e-05; Accession=PF00385.14; Description='chromo' (CHRromatin Organisation MOdifier
  Pfam annotation: Domain name=RVP_2; Domain location=234-364; Score= -21.4; E_value=4.7e-05; Accession=PF08284.2; Description=Retroviral aspartyl protease
  Pfam annotation: Domain name=RnaseH; Domain location=658-779; Score= -23.6; E_value=0.0092; Accession=PF00075.14; Description=RNase H
  Pfam annotation: Domain name=rve; Domain location=843-980; Score =57.7; E_value=3.9e-14; Accession=PF00665.16; Description=Integrase core domain
  Pfam module annotation: Pfam domain module=Chromo::RVP_2::RVT _1::Retrotrans_gag::RnaseH::rve; Domain location=1130-1177::234 -364::441-627::1-85::658-779::843-980
MDGRALAWFQWMTSNGQLTSWPVFLQALHARFAQSQYEDPTGALFKLTQKGTVGDYLAEFEDLATRVVGLPPPFLLSCFVSGLSPDIRRDVQAMQPLTLAQAAGLAKLQKEKFLDHRLPPKPRNPAPTTQRPFIRPSPPTPSPKSFFPTPISTAPAPLLTAPPRTPPPVKRLSPEEVASRWERGLCFSCDEKYHRGHKCASRVFLIIAAEDDPPLPNLNPADPDPDPPDPPDINPAQISLNTLAGNVAPEMLHLVGIISDHHIILLVDGGNTHSFIQEQLVTQLRLPCQDIPPLRVMIGNGQHLVCSHMCPRVSITIQGAQFTVDLYVLPIAGANVVLGVQWLKSLGPILTDYTTLCMQFFHEGRLVQLNGDRDASLHMLTLPQFRRFCRRHEDALYLHVSMTSSETPQQTPTQEPHSLPPPRETDHHIHLLPHSSPVNVRPYRYPHFQKREIELQVELMLQKGALNSVTVKDRFPIPTIDELLDELGGARCFSKLDLLSGYHQIRMHSANIPKTAFRTHHGHYEFKVMPFGLYNAPSSFQATMNTIFRPYLRQFVIVFFDDILIYSGSLDEHLSHLQTTFQPEVEYLGHVVSIRGVEPVASKVETIRQWPIPQSTRALRSFLGLAGFYHRFIRSYATIADPLEALSTAPVLILPDFTQPFTVETDASGVGMGAILSQRGRPIAFFSKPFSPKLLHASTYVWELCAITTAVKKWRQYLLGQRFTILTDHQSLKELLTQAIQTLEQHVYLARLLGYDYVIHYRSGLNNQVADALSRLPEQFATKLMILSVPSLTFIEDLRCQLTNHSGYQQKLQDIRESPSTNPKFSVTRDLIIHKGLLCPLPAPSKPWEDLSLDFIIGLPAYHGHTVILVVVDRFSKGIHLGTLPSAHTAHTVALLFINIVVKLHGLPQSLVSDQDPMSSAYHPQSDGQTEVLNRVIEQYLRAFVHRRPGTWGKLLPWVEWSHNPSWTASTGTSPYEITYGRKPFNFSEYIAGTSKIDAVDEILIDRDHTFQEIRKKLVKAQEQMKKYADNKCREIHYNPGDWVLLRLRPRRQTSAKGSLTSSGKLAKRYYGPFQVIERVGEVAYRLQLPAEEKIHSVFHCSCLKPFHRSPEQVDTSPLPQQFVGDQPMVTPLAILDYRRSPVDVNTWQVLVQWTGLSPDETTWEDWNQLREDYHLEDKVVLQGPRDDRPAETSKKETSATSSSWPSKPSLSFFPNICILCLTLEKQFFVEKRLMVNLPRLARGHSSLHQKDIRNRVRPNVAQEDVRRLGLAVVAAYADNCLAIGEASHDNSWALKVILRSFKMVSGLKIIPIGANPCRYETWKPIIKVFDSRLASWKGIQQRFLWNGLVEKKGSSQKRCLGIWYKNIPFQSVVWAANRANPINDSSGILTINTT

SEQ ID NO: 162530 - protein, 146 aa, Glycine max
  Coding DNA Sequence Number=SeqID_45752
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=86%, HitCoverage=14%, E-value=3e-35, Identity=50%"; Hit description =Protein kinase; EGF-like, subtype 2; S-locus glycoprotein; Curculin- like ...
  Homolog annotation: Hit description=(Mannose-binding) lectin; N/apple PAN; Type I EGF
  Pfam annotation: Domain name=PAN_2; Domain location=59-127; Score =108.2; E_value=2.5e-29; Accession=PF08276.2; Description=PAN-like domain
MILLKEFCDSYGLCGAYGNCMITETQVCQCLIGFSPKSPQALASSDWSQGCVRNTQLSCNDVDKDGFVKFEGLKVPDTTYTWVDESIGLEECRVKCLTNCSCMTYTNSDIRGTVSGCVMWFGDLIDMRQFETGGQGLPINYSLRSL

SEQ ID NO: 162531 - protein, 394 aa, Glycine max
  Coding DNA Sequence Number=SeqID_45753
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=99%, HitCoverage=45%, E-value=3e-92, Identity=43%"; Hit description =Protein kinase; EGF-like, subtype 2; S-locus glycoprotein; Curculin- like ...
  Homolog annotation: Hit description=(Mannose-binding) lectin; N/apple PAN; Type I EGF
  Pfam annotation: Domain name=B_lectin; Domain location=69-182; Score =147.5; E_value=3.5e-41; Accession=PF01453.15; Description=D-mannose binding lectin
  Pfam annotation: Domain name=PAN_2; Domain location=340-392; Score =56.9; E_value=6.6e-14; Accession=PF08276.2; Description=PAN-like domain
  Pfam annotation: Domain name=S_locus_glycop; Domain location=196-323; Score=140.5; E_value=4.6e-39; Accession=PF00954.11; Description=S -locus glycoprotein family
  Pfam module annotation: Pfam domain module=B_lectin::PAN_2::S_locus _glycop; Domain location=69-182::340-392::196-323
MDIFSVMTMVACMLPSLRISVANDSINVSKSMTDGESLVSKGGKFELGFFSPGNSQKRYLGIWYKNVPNQTVVWVANREDPINDSSGILTLNTTGNLVLTQNKSLVWYTNNSHKQAPNPVAVLLDSGNLVIRNEGETNPEAYLWQSFDYPSDTFLPGMKLGWNLRTGHEWKLTAWKSPDDPSPGDVYRVFKLYNYPELYVMKKTKKLYRFGPWNGLYFSGMSDLQNNTVHSFYYVSNKDEIYYAYSLANDSVIVRSVTDQTTSTVYRYKWVVGEQNWRLSRSFPTEFCDTYSVCGAYGNCVSSTQPQACNCLKGFSPNSPQAWKSSYWSGGCVRNKPLICEEKLSDGFVKFKGLKVPDTTHTWLNESIGLEECRVKCLSNCSCMAFANSDIRGE

SEQ ID NO: 162532 - protein, 67 aa, Glycine max
  Coding DNA Sequence Number=SeqID_45754
MSQSRTFRPIKLMPQPEKPSPKPTTSPVPYTTKHHSTENQILGGGKKRRSTKPIAKHNGAPNPDLRL

SEQ ID NO: 162533 - protein, 150 aa, Glycine max
  Coding DNA Sequence Number=SeqID_45755
  Gene Ontology: Mol. function=protein serine/threonine kinase activity; Cellular component=integral to membrane; Biological process=protein amino acid phosphorylation
  Homolog annotation: Hit_ID=Q70I28; Match level="QueryCoverage=57%, HitCoverage=10%, E-value=2e-28, Identity=73%"; Hit description=S -receptor kinase-like protein 3
MSNPPPLSNNPTLVDQLRNLNDEVKKKATKEARDKLEEEFRGCERTKIIQFLDLRRVESIKISTNCWKDKSEKDDNIDLQAFDFPSISNATNQFSESNKLGQGGFGPVYKGMLPNGQEIAVKRLSNICGQGLDEFKNEVMLIAKLQHRNL

SEQ ID NO: 162534 - protein, 409 aa, Glycine max
  Coding DNA Sequence Number=SeqID_45756
  Gene Ontology: Mol. function=chromatin binding; Cellular component =chromatin; Biological process=chromatin assembly or disassembly
  Homolog annotation: Hit_ID=Q1SAV4; Match level="QueryCoverage=89%, HitCoverage=98%, E-value=1e-126, Identity=54%"; Hit description =Integrase, catalytic region
  Pfam annotation: Domain name=Chromo; Domain location=318-369; Score =39.0; E_value=1.6e-08; Accession=PF00385.14; Description='chromo' (CHRromatin Organisation MOdifier
  Pfam annotation: Domain name=rve; Domain location=34-190; Score =118.5; E_value=1.9e-32; Accession=PF00665.16; Description=Integrase core domain
  Pfam module annotation: Pfam domain module=Chromo::rve; Domain location=318-369::34-190
MVVDVKSFIHECRVCQQVKHVTRKIAGILQPISPPTGVWEDLSMDFITHLPSSHGFTVILVVVDRFSKGLYLCALPTQFTAFKVATLFLEIMCKLHGFPSSIISDRDPVFISSFWRELFRLSGTTLRMTTAYHPQSDGQTEVMNHTVEQYLQSFDHKRPAEWHKFLALAEWAYNTSQHSGTGVTPYEIFYGKPPPSVLGYIMGSSRNDAVDTLLHSRTELHASLHRKLHKAQDEMKHFANKRHRDVQYEIGQLVYVKLRPHRQLSLQRIGNVAYRLQLPEGSRIRPVFHCFLLRPHHGPLDLPTSPLPADTSSPHPILEPLAILDSRMDSSINPPTRMVLVQWVGLTPEDSTWERWDDVRHAHHLEDKVSFAGSDNVSSTNIDKKDSSHDEQRRRNSTRPKHLEDYVLY

SEQ ID NO: 162535 - protein, 842 aa, Glycine max
  Coding DNA Sequence Number=SeqID_45757
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=96%, HitCoverage=93%, E-value=0.0, Identity=49%"; Hit description=Protein kinase; EGF-like, subtype 2; S-locus glycoprotein; Curculin- like (Mannose-binding) ...
  Homolog annotation: Hit description=lectin; N/apple PAN; Type I EGF
  Pfam annotation: Domain name=B_lectin; Domain location=87-200; Score =153.3; E_value=6.5e-43; Accession=PF01453.15; Description=D-mannose binding lectin
  Pfam annotation: Domain name=PAN_2; Domain location=355-423; Score =114.6; E_value=2.8e-31; Accession=PF08276.2; Description=PAN-like domain
  Pfam annotation: Domain name=Pkinase; Domain location=515-796; Score =124.8; E_value=2.4e-34; Accession=PF00069.15; Description=Protein kinase domain
  Pfam annotation: Domain name=Pkinase_Tyr; Domain location=515-796; Score=127.6; E_value=3.5e-35; Accession=PF07714.7; Description =Protein tyrosine kinase
  Pfam annotation: Domain name=S_locus_glycop; Domain location=214-338; Score=174.8; E_value=2.1e-49; Accession=PF00954.11; Description=S -locus glycoprotein family
  Pfam module annotation: Pfam domain module=B_lectin::PAN _2::Pkinase::Pkinase_Tyr::S_locus_glycop; Domain location=87-200::355- 423::515-796::515-796::214-338
MHIIIIQISEYHKSSDPMHILSFIILFTCILVPFPKISVANDSINLRQSMRDGDTLVSKTRKFELGFFSPGSSQKRYLGIWYKNIPIQTVVWVANRENPINDSSGILTLNNTGNFVLAQNESLVWYTNNSHKQAQNPVAVLLDSGNLVIRNDGETNPEAYLWQSFDYPSDTLLPGMKLGWDLRTGLDRRLTAWKSPDDPSPGDVYRDLELYSYPEFYIMKGTKKVYRFGPWNGLYFSGVPDLRNNTIFGFNFFSNKEESYYIFSPTNDVMSRIVMNESTTIYRYVWVEDDQNWRIYTSLPKDFCDTYGLCGVYGNCMTTQTQVCQCLKGFSPKSPEAWVSSGWSQGCVRNKPLSCKDKLTDGFVKYEGLKVPDTRHTWLDESIGLEECKVKCLNNCSCMAYTNSDIRGAGSGCVMWFGDLIDIKQLQTAGQDLYIRMPASELESVYRHKKKTTTIAASTTAAICGVLLLSSYFICRIRRNNAGKSLTEYDSEKDMDDLDIQLFDLPTITTATNDFSMENKIGEGGFGPVYKFLLTANSMQGILVDGQEIAVKTLSRSSWQGVTEFINEVKLIAKLQHRNLVKLLGCCIQGQEKMLIYEYMANGSLDSFIFDDKKRKLLKWPQQFHIICGIARGLMYLHQDSRLRIIHRDLKASNVLLDENSSPKISDFGMARTFGGDQFEGNTSRVVGTCGYMAPEYAVDGSFSVKSDVFSFGILVLEIVCGKRNKGLYQTDKSLNLVGHAWTLWKEGRALDLIDDSNMKESCVISEVLRCIHVGLLCVQQYPEDRPTMASVILMLESHMELVEPKEHGFISRNFLGEGDLRSNRKDTSSSNDVTITLLEAR

SEQ ID NO: 162536 - protein, 338 aa, Glycine max
  Coding DNA Sequence Number=SeqID_45758
  Gene Ontology: Mol. function=RNA-directed DNA polymerase activity; Cellular component=chromatin; Biological process=chromatin assembly or disassembly
MAEHGTRRTTTDRLEDAISILSEKHSDLTSKVDAMYEQLSQMHSAPHPSTQRSGHPRPPVKLEVPRFDGHDPLGWIFKISQFFEYQGTPEEDRITVASFYLDGASLSWFQWMYRNGFITSWSALLQAIETRFAPSFYDDPRGTLFKLMQRGSVTEYLTEFERLANRIVGLSPSVLLSCFISGLNPEIRREVQALQLASLPHATALARLQEDKINDRRRSSRPSFSPSPTPNPTPSSQIASSTPRPKTPFIQRTQEEMTYRREKGRCYNWDEKWNSSHRYKGRVLFFIAASDNPPSPDSTTPDLTAPFPNDPSPTFDPTSLHPHISLHAMAGVPATETF

SEQ ID NO: 162537 - protein, 252 aa, Glycine max
  Coding DNA Sequence Number=SeqID_45759
  Gene Ontology: Mol. function=protein serine/threonine kinase activity; Cellular component=membrane; Biological process=protein amino acid phosphorylation
  Homolog annotation: Hit_ID=Q70I29; Match level="QueryCoverage=60%, HitCoverage=17%, E-value=3e-54, Identity=66%"; Hit description=S -receptor kinase-like protein 2
MARTFELDQDEENTTRIMGTYGYMSPEYAVHGSFSVKSDVYSFGVIILEIISGRKIKEFIDPHHDLNLLGHAWRLWIQQRPMQLMDDLADNSAGLSEILRHIHIGLLCVQQRPEDRPNMSSVVLMLNGEKLLPQPSQPGFYTGNNHPPMRESSPRNLEAFSFSEMSNSVLVGLLPQHPPGPPTTTQTTLLSLTHRHFEGCEAVVDQFAVSGSLAVDINGTGGDENNFLSEGVELLTCSQIIPNLPYANLPSS

SEQ ID NO: 162538 - protein, 613 aa, Glycine max
  Coding DNA Sequence Number=SeqID_45760
  Gene Ontology: Mol. function=RNA-directed DNA polymerase activity; Cellular component=chromatin; Biological process=chromatin assembly or disassembly
MVGNGSILDCQQLSPATKLLIQDHTFTVTLRVLLLSGADIVLGVEWLRTLGPIITDYYAFTMHFSHQGHSITLSAGVQSDTDPVSANQVRRMLHTQSTSALFHLSLLPANPIEPPPDPPHPISTINELLLHFSSLFHQPSSLPPPRQHDHHINLLPSANPINVRPYRYPHFQKTKIEKQVTALLESSFIQPSRSPFSSPVLLVKKKDETWRMCMDYRALNSITVRDRFPLPTIDELLDELGRASWFSKIDLRQGFHQILMAPEDISKTAFRTHHGHYEYRVMPFGLCNAPSTFLAAMNAVLGPHLRKFATVFFDDILIYSETLPDHLLHLERVFASLTQAQYYLKRSKCLFGLRKLDYLGHVVSEKGVQPDPSKIQAILDMPAPRSAKELRSFLGLTGFYRKFVKDYAAIATPLTRLLCKDAFQWLPESQEAFLMLKRAMMAALVLALPDFSLPFALEIDVSGTAMGAVLQQQRHPIAFFSKPFCPRMQQASTSGTNTCSAISLLSSPTTAASMTLCLRSFKPRNSSFIWQSFSDSLSRIDHTSQAQCLLLSVPHHEFLTQLKQALLDSPDFQTLKEAIQAHPEDHPHFTIANELIFFKNAIWIDSRNPCSIA

SEQ ID NO: 162539 - protein, 132 aa, Glycine max
  Coding DNA Sequence Number=SeqID_45761
MIITISMNVVSFFFSDVVRSHLCRQRTNISVHAAVSPAKPPESPDEEVDDPLYLMTLTIPQLFLKPLQVMWDATIFGVFNQNFPLYIKHEDLSEIAHGGQCLSISVIQLWILHLTETSVRAGNSDVYGFLEP

SEQ ID NO: 162540 - protein, 114 aa, Glycine max
  Coding DNA Sequence Number=SeqID_45762
MEHETFLATWLAEIDFSPNGLDGGSSQHCIIIVILQRIILLGERAVYAMMLVFPPEFSPLKTILFGNPSQNTVESLMEALEEDYKDGNEINESRQFIEGVLDLEKRINRLDTLT

SEQ ID NO: 162541 - protein, 97 aa, Glycine max
  Coding DNA Sequence Number=SeqID_45763
MTHSRCVFVFGLIAILFQGVTAPPLPPLGRPTPSHLHWLLALLVLLIHSLIQIVFGYIQIKLSVIGQDAPHTIGGDHTKSIASAIRPERCAIVDEEQ

SEQ ID NO: 162542 - protein, 60 aa, Glycine max
  Coding DNA Sequence Number=SeqID_45764
MTNKAKGKGKEVGGKGSAGKRKGAFDDDKTGGGRKRNKMNMPDKGQSSRPHVVPKEEMLA

SEQ ID NO: 162543 - protein, 98 aa, Glycine max
  Coding DNA Sequence Number=SeqID_45765
MNVVKYVFLKARSLLCQFHIDKNVKAKCKTYVATKEAWDQVMDACGSLKDVPSQSKYEGCLKMFGIVEFTHWSLKRLIHNSIEDLCKCWDAMNNLITL

SEQ ID NO: 162544 - protein, 106 aa, Glycine max
  Coding DNA Sequence Number=SeqID_45766
  Homolog annotation: Hit_ID=Q1STZ2; Match level="QueryCoverage=62%, HitCoverage=14%, E-value=4e-07, Identity=41%"; Hit description=IMP dehydrogenase/GMP reductase
MRKIPKREGKMVIWRLFQAPGLPKLASGSLRPLESLGLNLEVASLQELGQRMGQLQRQAFRKTYGKIWDLAMIEVFDESIASLAQYYDQSLRCFTFGDFQLVPTVE

SEQ ID NO: 162545 - protein, 77 aa, Glycine max
  Coding DNA Sequence Number=SeqID_45767
MKERVELVRVGLQKFLGSCGQQRWWWRKILFSSWMILPFEDVSDDFDWWVWKRIEKDEDWTLFEAASVIDYNLAVLM

SEQ ID NO: 162546 - protein, 194 aa, Glycine max
  Coding DNA Sequence Number=SeqID_45768
  Gene Ontology: Mol. function=protein transporter activity; Cellular component=membrane; Biological process=protein secretion
  Homolog annotation: Hit_ID=Q48404; Match level="QueryCoverage=52%, HitCoverage=72%, E-value=8e-44, Identity=85%"; Hit description =Fusaric acid detoxification protein
MPMINDFNIEGVFVPGLLLISLVALTWTDRTGVFKMKSLLSLLGRYLLTLSAVAVATLLAFILWKHYVQTPWTRDGRVRADVVQIAPDVSGPVLNVAVRDNQWVNRGDVLYSIDPHWLRLAVVSAQADVEAKRHEMLMRQDAARRRSQIKGVISSEDLQQTASAASVAAANYHGALAAQDLAELNLSHAIVRSP

SEQ ID NO: 162547 - protein, 105 aa, Glycine max
  Coding DNA Sequence Number=SeqID_45769
MKWLGRGGLGVEHVAEEGESGGVGGVGGEEVSVERRKVVEDEAFLLPPAQLLHSCLLLRRQSSSSSPPLPPLLLCLGGSLSFAFWFLLAIAKNAVRKLLGCLRIT

SEQ ID NO: 162548 - protein, 133 aa, Glycine max
  Coding DNA Sequence Number=SeqID_45770
  Gene Ontology: Mol. function=RNA-directed DNA polymerase activity; Biological process=RNA-dependent DNA replication
MVNVNNEASTNIVLEGDQQLESNKHLLMVDLAIRPARVHYPHKHVMHLTGFMDFLKEIVGRILGIFYGLFLMTLIFLGVSWEILMIFYQMETKRGWLIIIFDSRFSDKASRMQTLLILLLGRIPTLGGEVLTF

SEQ ID NO: 162549 - protein, 288 aa, Glycine max
  Coding DNA Sequence Number=SeqID_45771
  Gene Ontology: Mol. function=binding; Cellular component =intracellular; Biological process=protein kinase C activation
  Homolog annotation: Hit_ID=Q1T484; Match level="QueryCoverage=97%, HitCoverage=66%, E-value=1e-101, Identity=56%"; Hit description=IMP dehydrogenase/GMP reductase
  Pfam annotation: Domain name=PPR; Domain location=113-147; Score =27.7; E_value=4.2e-05; Accession=PF01535.11; Description=PPR repeat
  Pfam annotation: Domain name=PPR; Domain location=150-183; Score=5.8; E_value=1.5; Accession=PF01535.11; Description=PPR repeat
  Pfam annotation: Domain name=PPR; Domain location=35-68; Score=4.3; E_ value=2.3; Accession=PF01535.11; Description=PPR repeat
  Pfam module annotation: Pfam domain module=PPR::PPR::PPR; Domain location=113-147::150-183::35-68
MSERNVVSFTAIVSRFKRVGGAMRVFGEMLERDVPSWNTLVAGCTQNGAFTRIKLFRRMVCECNRPNGVTVACALSACGHTGMLQLGRWIHGKCGSLGKARKVFEMNLEKRLTSWNSMINSFVLHGQSDSAIAIFEQMVEGGDGMGPDEVTFIGLLNACTHGGLFEKGYWYFELMGMSMEPIEVVWASFLNRCKVPGRTNLAEFAAKKLIEIDPHNRGYRIMLADVYGELGKWDEVRNVWRTLKQQKSYKVPGCSCIVDDQVHQFYSLDKSNLKTKRLVHCLRKSSWF

SEQ ID NO: 162550 - protein, 61 aa, Glycine max
  Coding DNA Sequence Number=SeqID_45772
MDHPNLQSLSIEDDEEEEMVFPNDVVTKTGTYGNGMSMVEGVSIMECSRSSSIITRTCRGL

SEQ ID NO: 162551 - protein, 798 aa, Glycine max
  Coding DNA Sequence Number=SeqID_45773
  Gene Ontology: Mol. function=heat shock protein binding; Cellular component=integral to membrane; Biological process=protein folding
  Homolog annotation: Hit_ID=Q1T494; Match level="QueryCoverage=99%, HitCoverage=97%, E-value=0.0, Identity=57%"; Hit description =Aminotransferase, class-II; Heat shock protein DnaJ
  Pfam annotation: Domain name=DnaJ; Domain location=66-127; Score =109.2; E_value=1.2e-29; Accession=PF00226.21; Description=DnaJ domain
MECNKDEATRAKEIAERKFAAKDTLGAKKFALKALNLFPDLEGISQMVATLDVYIAAENKTNGEADWYGVLGVDPLADEDTVRRQYRKLALQLHPDKNKSIGADGAFKLISEAWSLLSDKAKRASYDKRSGRDRKVSTKFGGPSSQKGTNGSFNFTKTAPSCATTRKNTAKEHASSSTHKSKSNTFWTVCRRCKMQYEYLRVYLNLKLLCPNCHEAFVAVETAPPPASGIRPATQWSFSQKQNSSRQPNKSKSNAGKNNMAAPNVGGGSCSKTDSYEKANFQWAPFSKISGVSNVAQAASVVQQAYDKVKRDREEAQAARKREEALKRKQHASKKGYYNPSKRRRGGMEDASASNHGKETNSFRSKQGNFEYNRVNGISKTGHVGDISPVQLKNLLMEKARKEISNKLRQVQSNAVDKTAMKENGNDFQEVSEKGEKCSRNSEMCAQDNIEKSEDRKSGSRAIKPFAGSTIAKVSRKFLETTPVDVLYPDFHDFCKDRTEGSFGENQVWAVYDNDDGMPRCYVLIRRIISLNPFKMQISWLNPNTNSELGPLKWVASGFSKICGDFRTSRPEICGSTNFFSHKVRWRTGAEGAICIYPRKGDVWAIYRNWSPDWNELTADEVIHKFDVVEVLEDFIEGHGIDVIPLVKVAGFRTVFHHHLDPKEIRIIPREEMFRFSHQIPSYVLTGQEAPEAPKGCRVLDPAATPFELLQVIEVVKKENVADDEDSDVKKTSDNMKKDNDEEMIDAMGKHGEEKEAKDEDMQEVEPSDNMKKGNEEMTNDTGRLREEKEGKDKDMQE

SEQ ID NO: 162552 - protein, 119 aa, Glycine max
  Coding DNA Sequence Number=SeqID_45774
MEELINKIQLFLKIISTSSSRLGGSINESHFSYSTVITLLPRTKVRDHHRYQPHGTKIARWISNKVIAPPMYIHNISSQCIFNIINISSQHQHHLISMTLTTTTTSSHINIIINNNINS

SEQ ID NO: 162553 - protein, 49 aa, Glycine max
  Coding DNA Sequence Number=SeqID_45775
MTSKITIDTSEPYTGAMGDTMHEPQANLGLDQKFSPGRSKTRNGGVGKN

SEQ ID NO: 162554 - protein, 56 aa, Glycine max
  Coding DNA Sequence Number=SeqID_45776
MEEIHGVDDEEQGIKLHVELVGIGSSYEWTPLLLKDQWQRNEEGGKVNGDVTSMRR

SEQ ID NO: 162555 - protein, 44 aa, Glycine max
  Coding DNA Sequence Number=SeqID_45777
MAGRKIGGEGFRESERLQGRVVIDYSNMVIDYQRATLQEIIACN

SEQ ID NO: 162556 - protein, 252 aa, Glycine max
  Coding DNA Sequence Number=SeqID_45778
VMSEIEEVQEQMKADMEAMKEQMATIMESMISMKRMMEVNATTVIVASTATEVDPTHPSDLNQINHPALNMVGQGGKELGSVCGPHFVQFQNKHSFPPYGLPPNYTPPNVAHAPDKNVNNSTPILIKRQQPQSDHAHVSQPMGEAHEAPRDHNLVNFEPYLIPPAMVEKEKSDHIKERLRAKEEGGEFAKHNLQWLSTRKNPEEDELSSSLNALLQVIKRTASAHLLSETSVLSQNPLMRAKRSRSALSARA

SEQ ID NO: 162557 - protein, 488 aa, Glycine max
  Coding DNA Sequence Number=SeqID_45779
  Gene Ontology: Mol. function=nucleoside-triphosphatase activity; Biological process=protein transport
  Homolog annotation: Hit_ID=Q1T499; Match level="QueryCoverage=88%, HitCoverage=60%, E-value=1e-122, Identity=58%"; Hit description=ClpX, ATPase regulatory subunit
  Pfam annotation: Domain name=AAA_2; Domain location=357-488; Score =57.4; E_value=4.7e-14; Accession=PF07724.4; Description=ATPase family associated with various
MSRVFGRWKNAKEMALLSGSLPRGHHRTGFNFCPISTHLNMIAGHRWREAPVGVQERYKWDRGGSDDTSSRKIRAEANCPRCTKDMNLVFSNRHFPTPQIESELGGGEREKGYQSVNLCPSCKTAYYFRPYDTTPLQGTFVEIGRVTSTNNNGVNNVSGKGPSPRRITHGKGGGKEGSSSSTNKGEEFGGKSNSNASKWLEVSLWETLMAYNGGAGGGDGSNGEPPESWPLPPDDGSNGNGNGNGLAVHTPPGPPFAPGINVIRATGPRNGGSGGAGGGKGEKTAWGGSNLGKDFPSPKEICKGLDKFVIGQQRAKKVLSVAVYNHYKRIYHATLQKGSAADSGASEVLDDDDNVELEKSNVLLMGPTGSGKTLLAKTLARFVNVPFVIADATTLTQAIGSLVLRQNFVVIDLKEDSTLQAGYVGEDVESILYKLLVAADFNVAAAQQGIIYIDEVDKITKKAESLNISRDVSGEGVQQALLKMLEGT

SEQ ID NO: 162558 - protein, 82 aa, Glycine max
  Coding DNA Sequence Number=SeqID_45780
  Subcellular localization annotation: CTP_CleavageSite=66; ConfidenceScore=5.30e-01
MAGLCNTCEDIIPQNPTYLSLSAAFIFLLLRTPPPFTTTPPGQLRDFFSSPLSRFSYSLFFSSSISLENPFSFPRETFQIQM

SEQ ID NO: 162559 - protein, 401 aa, Glycine max
  Coding DNA Sequence Number=SeqID_45781
  Gene Ontology: Mol. function=translation initiation factor activity; Cellular component=chloroplast; Biological process=translational initiation
  Homolog annotation: Hit_ID=Q9XIR4; Match level="QueryCoverage=95%, HitCoverage=88%, E-value=1e-146, Identity=63%"; Hit description=APO protein 1, chloroplast precursor
  Pfam annotation: Domain name=DUF794; Domain location=12-401; Score =760.7; E_value=8.8e-226; Accession=PF05634.2; Description =Arabidopsis thaliana protein of unknown function (DUF794)
MLQFNCQQFCKGRSTLPGVLVCASRRPKGTIWRRKTLQQNEDLPPILPKNKKKPYPIPFKEIKQAGREDRKLAHMGIEKPLEPPKNGLLVPDLIPVAYEVFGAWKLLIKGLAQLLHVIPVHGCSECTEVHVAQTGHHIRDCSGTNGRQRRSSHAWVKGSVNDILVPIESYHLFDPFGRRIKHDTRFEYDRIPAVVELCVQAGVDIPEYPSRRRTNPIRILGRRVIDRGGNLEEPKPWRFADPSSLNDFDTYRASERFPLPSLSDLPKIAQETMSAYETVKKGVKKLMRKYTVKACGYCTEVHVGPWGHNAKLCGAFKHQWRDGKHGWQDATVDEVFPPNYVWHVRDPRGPPLASALRRYYGKAPAVVEVCMQAGAQIPEDYKPMMRLDIIIPDTEEARMIA

SEQ ID NO: 162560 - protein, 67 aa, Glycine max
  Coding DNA Sequence Number=SeqID_45782
MEPVDGSVFVVYVEEKKGGVSDGTNDARDEGGAGAAKGNGTVLAARVDVEVAGGNEEEKRRRRRTLN

SEQ ID NO: 162561 - protein, 53 aa, Glycine max
  Coding DNA Sequence Number=SeqID_45783
MNSSSLVFRYLICGFPYAMLLCMFLLNSPSVGYGQNRFFAYVEQHNALNVLPI

SEQ ID NO: 162562 - protein, 59 aa, Glycine max
  Coding DNA Sequence Number=SeqID_45784
MFLQSHQVLRSHRRRSPKPPLSISKIASIVIRGFSSSPSHVFDGIAGFVLSNGIRPHIR

SEQ ID NO: 162563 - protein, 246 aa, Glycine max
  Coding DNA Sequence Number=SeqID_45785
MEAPSIGDALSNPTLHLEQQLRVFKRPQLSPAIASFAASLRMTLDDEISFEDDGFGQQDVEHVLLDEDGLDDNECLENNVSGDNELEDEEDFDNEVSDDEHYHKIVLEDDPPNPSLFNPLVVATTKPFVAALKTVITVTVQEPLAPKIPGVEIALPMSNGGRLRRRQMKVDGDCHEEAKFMNEEESNCNTHFVQQFDRQRFEFEVEAKAIPERRRTGKLTVRLDQKTCHYGKPQKVHMQCAYVIAA

SEQ ID NO: 162564 - protein, 43 aa, Glycine max
  Coding DNA Sequence Number=SeqID_45786
PSILDEAAEPEVELEIDDLIPDRQPSRVGNVLATEAKWFTAEQ

SEQ ID NO: 162565 - protein, 101 aa, Glycine max
  Coding DNA Sequence Number=SeqID_45787
  Homolog annotation: Hit_ID=Q7XA06; Match level="QueryCoverage=77%, HitCoverage=14%, E-value=8e-13, Identity=45%"; Hit description =Synaptotagmin C
  Pfam annotation: Domain name=C2; Domain location=1-66; Score=54.9; E _value=2.7e-13; Accession=PF00168.20; Description=C2 domain
MDLLGTSDPYVKLSLIGDKLPTKKTTVKKNNLNPEWNDKFKLVVKDPESQLLRLQVYDWDKLRAFENPQVSFEVKPQKKLWLGMGVGIVRKLGHKFHTRHA

SEQ ID NO: 162566 - protein, 115 aa, Glycine max
  Coding DNA Sequence Number=SeqID_45788
  Gene Ontology: Mol. function=phosphatidylserine decarboxylase activity; Biological process=phospholipid biosynthetic process
  Homolog annotation: Hit_ID=Q10L35; Match level="QueryCoverage=100%, HitCoverage=80%, E-value=3e-38, Identity=58%"; Hit description =Expressed protein
  Pfam annotation: Domain name=DUF1077; Domain location=20-115; Score =87.9; E_value=3e-23; Accession=PF06417.2; Description=Protein of unknown function (DUF1077)
MEKGKGVMGSGGRRWGVDFSDNSTSRDIPDPPAWEVAQAPMKNLLMMGFMMWMAGSTVHLFSIGITFSALWQPISALQSVGKMFEPYKDNKVELLGPKLLFIALNLGGLALGVWK

SEQ ID NO: 162567 - protein, 120 aa, Glycine max
  Coding DNA Sequence Number=SeqID_45789
MASRDQVWSFCTQDTRRYLTADTVVSDGKQRPSLVILHPRYAEIPYGYLHPFARQTQLCPMASRDQVWSFCTQDTRRYLTVICTPLLGRHSCVRWQAETKFGHSAPKIRGDTLRLSAPLC

SEQ ID NO: 162568 - protein, 93 aa, Glycine max
  Coding DNA Sequence Number=SeqID_45790
MDPSGSDFGQSVLVSMSRKGVETFEIGHVNHHIMWRRLLEAHGVMINIKVAIKPGQGTGLEMVCREDNGDIMAELHNSYTTIINPSWSRLWLS

SEQ ID NO: 162569 - protein, 286 aa, Glycine max
  Coding DNA Sequence Number=SeqID_45791
  Gene Ontology: Mol. function=RNA-directed DNA polymerase activity; Cellular component=nucleus; Biological process=regulation of transcription, DNA-dependent
MWLQDEEYEDIVQYLWIRGGRITNNISRTWCKSGFWGFSKFGSLKKKIKEARDKIKKRLNGPNQSNEDDTGRIFTEEEDMECVDRDEIKESLLQINPTKALVEDGYCKKIESCASRDCVDKTQSAFVDDRKITNNALIGFEMFHYMKKKVRRRKGCMALKVNMAKAYDRIEQRFLECVLNHIGFPTNFTKLVIRMTKDFNPVLLAKQWWRMLSCKESLMEKVFKAKYFPHSNALEAKKGPWASYTQNIIHGAKEVLKEGTLWKGGMSKEFEKCSLTKWQKVSWPYL

SEQ ID NO: 162570 - protein, 641 aa, Glycine max
  Coding DNA Sequence Number=SeqID_45792
  Gene Ontology: Mol. function=protein-tyrosine kinase activity; Cellular component=integral to membrane; Biological process=protein amino acid phosphorylation
  Homolog annotation: Hit_ID=Q8LEI6; Match level="QueryCoverage=94%, HitCoverage=84%, E-value=0.0, Identity=63%"; Hit description =Receptor-like protein kinase
  Pfam annotation: Domain name=LRRNT_2; Domain location=26-67; Score =36.7; E_value=8.2e-08; Accession=PF08263.3; Description=Leucine rich repeat N-terminal domain
  Pfam annotation: Domain name=LRR_1; Domain location=119-141; Score =8.9; E_value=6.1; Accession=PF00560.23; Description=Leucine Rich Repeat
  Pfam annotation: Domain name=LRR_1; Domain location=170-192; Score =6.0; E_value=22; Accession=PF00560.23; Description=Leucine Rich Repeat
  Pfam annotation: Domain name=LRR_1; Domain location=194-216; Score =9.5; E_value=4.7; Accession=PF00560.23; Description=Leucine Rich Repeat
  Pfam annotation: Domain name=LRR_1; Domain location=218-240; Score =10.0; E_value=3.8; Accession=PF00560.23; Description=Leucine Rich Repeat
  Pfam annotation: Domain name=LRR_1; Domain location=242-264; Score =11.9; E_value=1.7; Accession=PF00560.23; Description=Leucine Rich Repeat
  Pfam annotation: Domain name=LRR_1; Domain location=95-117; Score =11.8; E_value=1.7; Accession=PF00560.23; Description=Leucine Rich Repeat
  Pfam annotation: Domain name=Pkinase; Domain location=438-639; Score=- 86.7; E_value=0.0021; Accession=PF00069.15; Description=Protein kinase domain
  Pfam annotation: Domain name=Pkinase_Tyr; Domain location=438-641; Score=-68.1; E_value=2.7e-08; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::Pkinase::Pkinase_Tyr; Domain location=26 -67::119-141::170-192::194-216::218-240::242-264::95-117::438 -639::438-641
MACSVHLLLLLTSLLALFFNPTCVYGNDELRTLLDLKSSLDPEGHFLSSWTIDGTPCGGSFEGVACNEKGQVANVSLQGKGLSGKLSPAIAGLKHLTGLYLHYNSLYGEIPRELANLTELSDLYLNVNHLSGEIPPEIGMMESLQEKSPLETLYAIVKTILDKLISSGLIARVLQLCYNQLTGSIPTQLSDLKKLSVLALQSNQFAGAIPASLGDLGMLMRLDLSSNNLFGSIPTKLADLPLLQVLDVHNNTLSGNVPPALKRLEEGFVFEHNVGLCGVGFSSLKACTASDHANLTRPEPYGAGVGGLSRDIPETANVKLPCNTTQCRNPSRSKQAASITVGIVLVTIAVSAIGIFTFTMYRRRKQKLGSTFDISEGRLSTDQAKSIYRKNGSPLVSLEYSNGWDPLADGKNVNGDRQDMFQSFRFNLEEVESATQYFSELNLLGKSNFSATYKGVLRDGSVVAVKSISKTSCKSDEAEFLKGLNILTSLRNENLVRLRGFCCSRGRGECFLVYDFVSNGNLSCYLDVKEGDGEVLEWSTRVSIVKGIAKGIAYLHAYKAKKQALVHQNISAEKVLIDQRYNPLLSDSGLYKLLTNDIVFSALKGSAAKGYLAPEYTTTGRFTEKNPHGEAEDHKRNAPCC

SEQ ID NO: 162571 - protein, 125 aa, Glycine max
  Coding DNA Sequence Number=SeqID_45793
MVTLKGQIRVFVLYRNRKPSWKIPLRLKGSSRCGFSMENNDGLWLLMVAVGDGESAWNFRNGFGRKKEEEMTFFLSYRKAKAETKFREDPTVNEGWAAFLPRQLHVAFSRSFIKKLPPEASSWLL

SEQ ID NO: 162572 - protein, 89 aa, Glycine max
  Coding DNA Sequence Number=SeqID_45794
  Subcellular localization annotation: CTP_CleavageSite=49; ConfidenceScore=5.33e-01
MNPGLTHKNSSRWSRQLSQPTFWREGNAGLASVSSMKGKCAESPPTFIRGKRRKNQRKPVMKHIPDSGVIFTFEEGISTSHVCPKGQQP

SEQ ID NO: 162573 - protein, 147 aa, Glycine max
  Coding DNA Sequence Number=SeqID_45795
MASRKRKATASRPREPYDTTRFISEVAWERYEQNVHSRNILPKRKVNIFVMEYDEFRKELERRQWHKALTRQPDGRINVALVKEFYTNLYDPEDKSPRAPWFWSQGSITLLTPDSVTCTQILRSSPPDFIFPGEVSFSMLREPPRSS

SEQ ID NO: 162574 - protein, 111 aa, Glycine max
  Coding DNA Sequence Number=SeqID_45796
VPGALHCCHVYNIICVCSTVSSLGASDGVAAGVIYGVSSAEVPESIGGAGMGAGGASGVGAGGAEEEGVEVSGGALRVPEKVRESGTTPLAMHKAMTSAGKPSRQELDWAI

SEQ ID NO: 162575 - protein, 341 aa, Glycine max
  Coding DNA Sequence Number=SeqID_45797
  Gene Ontology: Mol. function=RNA-directed DNA polymerase activity; Cellular component=extracellular region; Biological process=RNA -dependent DNA replication
  Homolog annotation: Hit_ID=Q1SW56; Match level="QueryCoverage=91%, HitCoverage=33%, E-value=6e-22, Identity=25%"; Hit description =Polynucleotidyl transferase, Ribonuclease H fold
MASDSSSALNTNSTVWEGIWHAEASSRCKKLVWRACSEGLPVRSLLLQKGIIKGDDTCPCCRTCKETTTHALLLCEEVKPFWLGSPLGLRVDWLHNVANITMSQWVDQCLDVLDKRGMGMLCAMVWGLWHKRNAWVIRKKKLDFAQVMAKALSVFATQEWVPPLDSKVKVNFAVSAIEDVGTGFGVIFRNSKAETMASGTYFLKDECYDSEIAATVCYKWAIEKSQELFFIDANFETDCQQLYNQWNEFTQENNTSSASYLDELLEECRTMMQGTEASLTLVAHTANKVAQCLARLAFDYGEKDWIDEVPNKALESLQSDLAAIADASADRSINVNIVLQD

SEQ ID NO: 162576 - protein, 73 aa, Glycine max
  Coding DNA Sequence Number=SeqID_45798
MGDRLEDIIRDLGQESFQNFTSLLQVVLDMLLEENTVEAKLHDDDKKLKCQSKDEFKIFKKKSRANSRLKRKS

SEQ ID NO: 162577 - protein, 150 aa, Glycine max
  Coding DNA Sequence Number=SeqID_45799
MSSSGKPLQRTYDNMLEASCNSASSSEEIQHASHIVILLSSSVIPRGPYRSCPGLKIGLISRPGHHGPKLLGGRPGERIGVLILLVHSVLGSILRKWEEIDPRDSVSYRGGGGASADFSMKALLMGMQYFSMKALLMEGRIRLVELTGTP

SEQ ID NO: 162578 - protein, 365 aa, Glycine max
  Coding DNA Sequence Number=SeqID_45800
  Gene Ontology: Mol. function=oxidoreductase activity, acting on single donors with incorporation of molecular oxygen, incorporation of two atoms of oxygen; Biological process=aromatic compound catabolic process
  Homolog annotation: Hit_ID=Q89SR6; Match level="QueryCoverage=98%, HitCoverage=97%, E-value=5e-73, Identity=53%"; Hit description =Protocatechuate 3,4-dioxygenase alpha chain
  Pfam annotation: Domain name=Dioxygenase_C; Domain location=1-149; Score=156.9; E_value=5.2e-44; Accession=PF00775.11; Description =Dioxygenase
  Pfam annotation: Domain name=Dioxygenase_C; Domain location=171-357; Score=6.4; E_value=5.9e-09; Accession=PF00775.11; Description =Dioxygenase
  Pfam module annotation: Pfam domain module=Dioxygenase_C::Dioxygenase_ C; Domain location=1-149::171-357
GYPIGDRIIVHGYVRDAFGAPVRNALVEVWQANAGGRDRHKKDQYLAPIDPNFGGCGRMLTDDNGYYCFRTIKPGPYPWRNQVSDWRPAHIHFSLSGEAFAQRLITQMYFEGDPLLVRCPILQSVGSDDAMRTLIAELDMHAAVPLDSLAYQPYPGSRVMKKYLSETASQTAGPYVHIGLAPHAAGFDIFERNFTHVLTQPETRGERIVVEGHVYDGTGTPVRDALVEVWQANAAGRYQHPADGQRDKPDDPAFRGWGRTCSDFTSGLWQFETIKPGRVMGRDGRLMAPHLNLWIVARGINIGLNTRLYFADEQAANAEDPVLNLIEWEKRRGTLLAQRRQRGDQTVYHFDIWLQGENETVFFDI

SEQ ID NO: 162579 - protein, 80 aa, Glycine max
  Coding DNA Sequence Number=SeqID_45801
MEIYVVFRADYICQALTREVRGQADIPQVIYVVLRADYLCQALTREVGGHADIPQVVIHSLYQALTREVKGQAEIPQVVI

SEQ ID NO: 162580 - protein, 285 aa, Glycine max
  Coding DNA Sequence Number=SeqID_45802
MIIDESIFFSLTQLPSQGASFEGTIVDNWKFDYSSLDARRMVCNDQANMTGRLLASSLTFDCRIMHYIIVCILLSRSSNLAQASEEDLILMWAFLTSRPIDWAHLIRYRIHKALWSNAPLPYPHLVNLFLHHFQIPLDNEPFVKVKRSFAIGAGAVTSIGYRKDIDGQWLKKDAQPTQDKHTPSPLPQRDDSSALMHEVLLELRDLRTYVGERFDSLDGRIDAIDARFGGMDTLITQLEEDISYELNYHHQKEGDCRSKDFDVLMIPKDHALLKFNSRGSYASQG

SEQ ID NO: 162581 - protein, 103 aa, Glycine max
  Coding DNA Sequence Number=SeqID_45803
MVIFSHGVAVEDKGEEHIGSSLEKQGRVPYKPKMTKIKGPKEEKNYSNICKEKWTQPWPMGSKIYQEVHENHNAFFNSSSLILVESLAHGSGDWTLPREDCII

SEQ ID NO: 162582 - protein, 184 aa, Glycine max
  Coding DNA Sequence Number=SeqID_45804
MGSSGFDPIPFRSVLLIEFCKRFRSFFGESRGLSDGCAQPNVIYVDPSQTSLQRFSKQEASGKTACYSESERLADNFQCLPGRMKKLWKLDIRIAERTACGTDFTRDVSELDCKTESRGEGVLASKTRRKTNGEFRGSEVSARSLIQRAKFLGIGPRPLSLSIDFLKDDLAVDDVPAREVNLVI

SEQ ID NO: 162583 - protein, 142 aa, Glycine max
  Coding DNA Sequence Number=SeqID_45805
MGEAHEIAHHNLADFEPCLGYTTEGQAVGAAPAMAEKGKVDHLKERLRAIEGGEDYAFANLEELFLVPNIITPPKFKVLDFDKYKGTTCPKNHLKMYYRKMEAYAKDEELLIHSFQESLTRKTVTWYTNLGTFLSPFLEGPN

SEQ ID NO: 162584 - protein, 168 aa, Glycine max
  Coding DNA Sequence Number=SeqID_45806
  Gene Ontology: Mol. function=RNA-directed DNA polymerase activity; Cellular component=chromatin; Biological process=chromatin assembly or disassembly
MENLRFSWAVQRECFLYFIQLQLVSELGLSTRDTSPLRVMVGNGQQLECTRVCEDVSVVIQSTQFTVDLHVLPIASANVVLGVQWLKSLGPVLTDYNTLCMKFFHAGNLVELKGDTVMQAPLELVGLGSSSSMDSFASWKINGSGMEKEEREETPLQGEDESRRSSPP

SEQ ID NO: 162585 - protein, 50 aa, Glycine max
  Coding DNA Sequence Number=SeqID_45807
MENIKTVGHDPAASSSRVFSFKRSLSGIAMLSWSLFWQSSFNFYIHVLHI

SEQ ID NO: 162586 - protein, 308 aa, Glycine max
  Coding DNA Sequence Number=SeqID_45808
  Gene Ontology: Mol. function=oxidoreductase activity; Cellular component=apical plasma membrane; Biological process=L-ascorbic acid biosynthetic process
  Homolog annotation: Hit_ID=Q1SVN8; Match level="QueryCoverage=96%, HitCoverage=94%, E-value=1e-130, Identity=77%"; Hit description =Aldo/keto reductase
  Pfam annotation: Domain name=Aldo_ket_red; Domain location=10-285; Score=446.9; E_value=2.6e-131; Accession=PF00248.11; Description =Aldoketo reductase family
MAKLIKFFELNTGAKIPSVGLGTWQAEPGVVAKAVTIAIQVGYRHIDCAQAYNNQAEIGSALKKLFDEGVVKREDLWITSKLWCSDHVPEDVPKALDKTLQDLKLDYLDLYLIHWPVRMKSGSVGFKKEYLDQPDIPSTWKAMEALYDSGKARAIGVSNFSSKKLQDLLDIARVPPAVNQVELQPGWQQQKLHAFCESKGIHLTGYSPLGSPGVLKSDILKNPVVIEIAEKLGKTPAQVALRWGLQTGHSVLPKSTNESRIKGNFDVFDWSIPEELLAKFSEIKQASIGGGYKVVQDRPESRIEEDVE

SEQ ID NO: 162587 - protein, 1127 aa, Glycine max
  Coding DNA Sequence Number=SeqID_45809
  Pfam annotation: Domain name=DUF789; Domain location=773-1123; Score =15.1; E_value=3.4e-17; Accession=PF05623.3; Description=Protein of unknown function (DUF789)
CAILSFHNFEPDGTWRIVALPVQCSNHVNLASGVNMDGLQLLFSPPLNRLKIDQCKGPRVPLPPYAYSAKSCTKKGFTGSNVRRRCQNKIANRASKLNELPDNSSSQSSLVCGPGLFPDSSTALNSSDKDTSHSMEDDKSSKKKSRKRARKKVKRSKKKSSDSGSPECEVLTEEYVCVSLTSETCSSNDVDKEGVGEFSTSDDRLVKSDCERNGNINVMQAPNSCNSYLDREAISKATAPIVQSSAGECTTFEPKNQLQDRGPDFEVIDRGIKDIQHVEPCCFNDVHDSLVLDSVSVGSRSDESISADDIGKPSNKANCTITSDSGDGYSLGQNLTNGIHNNCEHNEGIGHGGQNCISNDKKVKQKRTMSKSSSLNKFGGAGILHGQKGKENIHSVWQKVQKNSSDEGSGDLKKVNTTSPQFASTLEKDPSVIKECNSVSVNGVSNTEDKKHLKNKIGRKSKGIVETVSKKEHNNYSKKSFHFNRSLSNDHGKAGVQQNDVLLISSQEIDQQGLNTVSGFNSDINCLTDGVQTNEVEQVTSEIGHSANFHLEESGPQKSASHIIANTNNENIDSQDSSLVMPGGNINQSNMSEELSPDSCNLEGDEVGQTEKEVSSANYNAEILSSGTTLWKWVPVGKKDRGLEKSESNNSPPEYSDASSSNNSNSESSVEPEVASSKNQDSSLNATRACNGQIYDKVSCLDEGENHKMASQIACTLTEHRDKHEAANHMFYECENQDMLENGSYRIAQAVNDACRAQLACEAVHMATGGPVAEFERLLHFCSPVICNSLNSLSCSTCSHNHAGGVSLCRHEIPNLSLGCLWKWYEKHGSYGLEIRAQDHENPKRQGGVGDFPFHAYFVPSLSAVQLFKNHENRCVNSGDKLPNCEVSEACEMVDISEKSSTASQHLIFSVLFPWPRNQDASSQTPKETASINNGSIPSINSNCSGDLELLFEYFEFEQPQQRRPLYEKIQELVRGYIPIRSSTYGDPTKLDSINLRDLHPRSWFSVAWYPIYRIPDGNFRASFLTYHSLGHLVRRRTSSDLSTVGSCIVSPTVGLQSYNAQGECWFQLKHSALAAEMAGLDPSLLLKDRLRTLEETASLMARAVVNKGNLTCTNRHPDYEFFMSRR

SEQ ID NO: 162588 - protein, 152 aa, Glycine max
  Coding DNA Sequence Number=SeqID_45810
MANLLCLNNVATVLYVVIPVVVCNLRGETSFGNMHIRFSGIILSYSAVIFSIRALPIKWPCSTFPWPNARKMRCAPQEIGNNNPEVLEARKDSIPTIYQQQNKLTSLEDCQESSLSKINTDSRMVLRLIPKAGSVIDSVHGGREHKSMLALS

SEQ ID NO: 162589 - protein, 72 aa, Glycine max
  Coding DNA Sequence Number=SeqID_45811
  Gene Ontology: Mol. function=DNA-directed RNA polymerase activity; Cellular component=DNA-directed RNA polymerase II, core complex; Biological process=transcription
  Homolog annotation: Hit_ID=Q9FLM8; Match level="QueryCoverage=67%, HitCoverage=96%, E-value=1e-18, Identity=83%"; Hit description =Similarity to metallothionein-I gene transcription activator
  Pfam annotation: Domain name=DNA_RNApol_7kD; Domain location=10-41; Score=83.0; E_value=9.1e-22; Accession=PF03604.4; Description=DNA directed RNA polymerase, 7 kDa subunit
  Pfam annotation: Domain name=PhnA_Zn_Ribbon; Domain location=9-37; Score=10.7; E_value=0.036; Accession=PF08274.2; Description=PhnA Zinc-Ribbon
  Pfam module annotation: Pfam domain module=DNA_RNApol_7kD::PhnA_Zn _Ribbon; Domain location=10-41::9-37
MDPQPEPVSYICGDCGMENTLKPGDVIQCRECGYRILYKKRTRRTVWLEMSEFKTKSRVLVARSSSVCNSGE

SEQ ID NO: 162590 - protein, 163 aa, Glycine max
  Coding DNA Sequence Number=SeqID_45812
  Gene Ontology: Mol. function=ribonuclease H activity
  Homolog annotation: Hit_ID=Q6H5X2; Match level="QueryCoverage=73%, HitCoverage=51%, E-value=8e-29, Identity=54%"; Hit description=ABA -responsive protein-like
  Pfam annotation: Domain name=GRAM; Domain location=87-152; Score=9.6; E_value=0.025; Accession=PF02893.10; Description=GRAM domain
MKSFDTSPGRCFSSPQHDDNLLHKSISVDAYTYTNTEKEIATKGTGKSRSFTHRIHDHVKMGPNLSEILKGKLSLGARIIQEGGRGSIFKSVFGMQEKEQLLKASQCYLYTTAGPIAGILFVSTEKVAFYSERPITFSSATGELVRAPYKVGFMWYNPTLSSK

SEQ ID NO: 162591 - protein, 83 aa, Glycine max
  Coding DNA Sequence Number=SeqID_45813
  Gene Ontology: Cellular component=chloroplast
MGDKLHRREGNSPDHQLRPLNDRSVIKEMNGAKRSAEAVGCKKESVGERSALEGRTRASSAGRSGSENVGLSNANVGENPMPK

SEQ ID NO: 162592 - protein, 70 aa, Glycine max
  Coding DNA Sequence Number=SeqID_45814
  Homolog annotation: Hit_ID=Q1SXJ8; Match level="QueryCoverage=85%, HitCoverage=49%, E-value=7e-12, Identity=52%"; Hit description=LGC1, related
  Subcellular localization annotation: CTP_CleavageSite=40; ConfidenceScore=5.10e-01
MSGNSITECTLRSLSVSQSMTGVKVQGKPEWSVSITNTCPCAQRMVYLNCTDFQTSEPITPSVLTVSPNA

SEQ ID NO: 162593 - protein, 166 aa, Glycine max
  Coding DNA Sequence Number=SeqID_45815
MHFSRGTYQPQPHITQELLNFSDEFLTVKQIQQFLGILNYIIPRAAQYTSSLSKLLKKNSSPWSEEQTIAVKELKKIAQKSPSFEDSWNRPSKTIKVITSTHSFLLIFMAIWCNTVQYSIPIALKPLMTYHILTDPYKDEYFVGPCGLNNLKKDRLRMQKKQQQSI

SEQ ID NO: 162594 - protein, 46 aa, Glycine max
  Coding DNA Sequence Number=SeqID_45816
MDTSKPYTGAMRGIVHEPQTTIGTTEPYTGAMRGIVHEPQVNLGAD

SEQ ID NO: 162595 - protein, 165 aa, Glycine max
  Coding DNA Sequence Number=SeqID_45817
  Homolog annotation: Hit_ID=Q8H6Q8; Match level="QueryCoverage=71%, HitCoverage=3%, E-value=2e-16, Identity=35%"; Hit description=CTV.20
MDRNILDSLFLNIHLHGLDMKEGSIPAALIYRIQYKVMNTCASRVLLQPQKGETTLFITDMTKANVSLKRIIKWDEVTLPEKWVMEKATPSDPRPAPIIEDIKQDNSGKVEITFNRRNSFSSRIEASRSEYESARRSFSVRTRSIPIGLTRSELHNQFPTVTSKD

SEQ ID NO: 162596 - protein, 136 aa, Glycine max
  Coding DNA Sequence Number=SeqID_45818
  Homolog annotation: Hit_ID=Q1RT77; Match level="QueryCoverage=54%, HitCoverage=12%, E-value=1e-07, Identity=41%"; Hit description=Zinc finger, CCCH-type
GLHVLAFRGLHAIAFKGLHVLAFKGLHVLAFRGLHVLAFRGLHALAFRGLDVLSFRGLHALDFRGLDVLAFRGLHKVRKRGKSKPRCFRNASVSDSVEILHHSSSFFIVLHSFFVVLHSSTGKFPKSNLSIHSMHP

SEQ ID NO: 162597 - protein, 188 aa, Glycine max
  Coding DNA Sequence Number=SeqID_45819
MGHLNKCGLYVDDSPPRLVSLGRLYEGLKIVHNVPLGNNQVKDKQVAEGSMKPIDMSDPNVDPLYLMTLTIPQLFLKPLQVLWDASVFGGIALVPTYPQGFVKALDLEIISGYKACKRNDVGNNPRSSPLKPSPCMAIYQKSHLVQGKLVLTSQLLRLKGITSPKRVGCLRLKPSHGPGKPDAGLGKF

SEQ ID NO: 162598 - protein, 114 aa, Glycine max
  Coding DNA Sequence Number=SeqID_45820
  Subcellular localization annotation: CTP_CleavageSite=43; ConfidenceScore=5.26e-01
MEILVTNASSFAWRHLVVAVKKRLSFEVQKVAVGAKLSSWAKRASTAKSSFSALSAKKNMAEHQHQGRMLSVRSVRLGTLFQSAYFGKKALEAISELESECEMLRRGGGIPHLV

SEQ ID NO: 162599 - protein, 84 aa, Glycine max
  Coding DNA Sequence Number=SeqID_45821
MDLRWTHTTENAKQELRGRECILDGDRKKRQHGRDKMPPYKRRSSEPIFDEASAEPQNVALRGYGRGCNCGQGRHGRGGGMSEF

SEQ ID NO: 162600 - protein, 68 aa, Glycine max
  Coding DNA Sequence Number=SeqID_45822
MSDKENACALLGMGKLGGVDGDPVLRGTRIRDTWGYVSSVDGGQLGMVGSCLICGCGRVDLHHRPIAT

SEQ ID NO: 162601 - protein, 168 aa, Glycine max
  Coding DNA Sequence Number=SeqID_45823
MASKKLSTKRSRRDATGEGSSAAPEFDSHRFQSAEHQQRFEAIRGWLLHRERRVRLREDEYMDFQEEIAHRRWTPTAGRRLVYAILTRMSVHMAQSYEVPITPSKVIRLPITRAFIKKYSTPRQVQGDAHQAADTPSPPQQADPAGSLGVERYLQHLVRQQAANHRGQ

SEQ ID NO: 162602 - protein, 71 aa, Glycine max
  Coding DNA Sequence Number=SeqID_45824
TNYGHFAPFGHLEAAKPMTCGDKLWSFRTPFRHSETIVSDGTQRQIMVILRLVSTKRNEFGSIRMMLVVWY

SEQ ID NO: 162603 - protein, 59 aa, Glycine max
  Coding DNA Sequence Number=SeqID_45825
  Subcellular localization annotation: CTP_CleavageSite=39; ConfidenceScore=5.15e-01
MSAHTVYLRQTTSNVNNKKCGDLGHVAPLPPKKPSRSVISSSIWDSSASPGDPTGSSPA

SEQ ID NO: 162604 - protein, 955 aa, Glycine max
  Coding DNA Sequence Number=SeqID_45826
  Homolog annotation: Hit_ID=Q8LN43; Match level="QueryCoverage=45%, HitCoverage=22%, E-value=3e-97, Identity=47%"; Hit description =Putative polyamine oxidase
  Pfam annotation: Domain name=Pyr_redox; Domain location=836-915; Score=-4.6; E_value=0.035; Accession=PF00070.17; Description =Pyridine nucleotide-disulphide oxidor
  Pfam annotation: Domain name=SWIRM; Domain location=593-684; Score =64.1; E_value=4.4e-16; Accession=PF04433.7; Description=SWIRM domain
  Pfam module annotation: Pfam domain module=Pyr_redox::SWIRM; Domain location=836-915::593-684
MEGENIRSGTKKKRSKKEIGFDSDDDEPIGSMFKLKRSKKKGSGGGSSDAAVVREKEDLGGMDDNDTLASFRKRLKGPKRDQGSGVTRGGAIPALHVSDEDLVALGPKGKDEKGVAPVPLVWGDEDMQMQDCTDQQHMEDLLPVIFNKAQSSSSRKSRSQGSRQKKGIQNVDSEGFVEAVDSGVESRSGSASGSKLVGGNVESVELLPQASERVVASVVDDQKCGDDCFQEEAVKGHCDLDIPDGPSQSNNVCHGDMQQLSCVQVEDISCHSDQKVGLQESALSDALKNLSTTSHDEIVDTISLSKVGEGERGFTEAGESENRLTVEPAKVCNSASEPDVSTFAGKENVLTSCHTEPLIKSAETILNENNNMVARKVFQESSWNGALDLSGCHMEVDGGGKSETEFVSDRNFCDYSSLDTKAEVQDFVSGFSPKRNNVTVSGSLSSMVSNEANEAELTAHSNHPEKPLEGCNIPKDSTASILKCSSVLDPIQSDGSSLQSSIPDENGNSAEYRAPVSDFADNEGKISSIPRAVRKTKMRKHGDMTYEGDADWEILIDDQALNESQVMTDGDRTLRSRLKHDSSLNTGEDSENVAVVAVSAGLKARKAGPIEKIKFKEVLKRKGGLKEYLDCRNQILSLWNRDVTRILPLAECGVSDTHSEDGSPRSSLIREVYAFLDQYGYINVGIASQKENVGSNARHCYKLVKEKGFEESLAASMADSEDGVSFLVGQTKMSDTSNEINNGLTKDGDDLTLEAAEGMRHANEMKTDLSNMTQQVERKKNDYQGNDSSVPSSNFPDCRLISLVAKEKSNDSTCIKSALDARVGYHLQSDLDPRKRVIVIGAGPAGLTAARHLERQGFSVFVLEARSRIGGRVFTDHLSLSVPVDLGASIITGVEADVATERRPDPSSLICAQLGLELTVLNSDCPLYDIVTGHKVPADMDVALEAEYNSLIDDM

SEQ ID NO: 162605 - protein, 112 aa, Glycine max
  Coding DNA Sequence Number=SeqID_45827
  Gene Ontology: Biological process=response to stress
  Homolog annotation: Hit_ID=Q1SG58; Match level="QueryCoverage=88%, HitCoverage=61%, E-value=7e-35, Identity=71%"; Hit description =Universal stress protein
  Pfam annotation: Domain name=Usp; Domain location=1-106; Score=12.7; E_value=0.053; Accession=PF00582.16; Description=Universal stress protein family
MYVDINAALIPLAEFSDPVLMKRYELKPAPEVIDIVSTAAKQKNIVVLMKIYWGDARERLCEAIDHVPLDYLTLGNRGLGTLQRVIMGSVSNYVVNNATCPVTVVKSSVHNY

SEQ ID NO: 162606 - protein, 884 aa, Glycine max
  Coding DNA Sequence Number=SeqID_45828
  Gene Ontology: Mol. function=oxidoreductase activity; Biological process=electron transport
  Homolog annotation: Hit_ID=Q336Y0; Match level="QueryCoverage=99%, HitCoverage=47%, E-value=0.0, Identity=56%"; Hit description=Amine oxidase, flavin-containing family protein, expressed
  Pfam annotation: Domain name=Amino_oxidase; Domain location=1-315; Score=114.9; E_value=2.3e-31; Accession=PF01593.14; Description =Flavin containing amine oxidoreductase
SPFDSKKDSTLEKKLGEEILSPQERRVMDWHFAHLEYGCAALLKDVSLPYWNQDDVYGGFGGAHCMIKGGYSSVVESLGEGLTVHLNHVVTNVSYGIKEPGQSNKVKVSTENGNEFFGDAVLVTVPLGCLKAETIQFSPPLPQWKCSSVQRLGYGVLNKVVLEFPSVFWDDAVDYFGATAEERSSRGHCFMFWNVRRTVGAPVLIALVVGKAAIDGQSLSSSDHVNHALKVLRKLFGEDSVPDPVAYVVTDWGRDPFSYGSYSYVAVGASGEDYDIIGRPVDNCLFFAGEATCKEHPDTVGGAMMSGLREAVRMIDILSSGNDYIAEVEALEAARGQLDTERDEVRDIIKRLDALELSNIMYKNSLDGAHILTREALLREMFFNTKTTAGRLHVAKQLLTLPVGNLKSFAGSKEGLAILNSWILDSMGKDGTQLLRHCLRLLVRVSTDLLAVRLSGMGKTVKEKVCVHTSRDIRAIASQLVNVWLEVFRKGKASNGGLKISRQTSAVDLSKRKSVKDSALGKPPLGTYHGTIENKGGLLNPTSAGSNSPSTAHVKKLHSKQGRQPAAYDSRHEVSSSRSKGSIDTVVAEKEDNLCTISEEEQAAIAAAEAARAKALAAAEAYASAEARCNTLLQLPKIPSFHKFARREQPSQNDECDSRKRWPGGVYGRQDCISEIDSRNCRVRDWSVDFSAACVNLDNSRMPVDNLSQRSHSNEIASHLNFREHSGESVAGDSSIYTKAWIDTAGGIAIKDHHAIERWQSQAAAADSYFSNPSIDLKDEEDSNACSKLPSWKRDGIANESSISQVTVNKEAQKGHSRGADHIKQAVVDYVASLLMPLYKARKLDKDGYKAIMKKSETKVMEQATDAEKAMTVREFLDFKRKNK

SEQ ID NO: 162607 - protein, 464 aa, Glycine max
  Coding DNA Sequence Number=SeqID_45829
ESRQFPPKHSSFPDKERYTPRKRMDEKSLIERNCIDDFDECEFEFLNKSYRMSTVAEREQEFLDNNREEQFPHIYRDWRRSVRRGRRFDKPPLVLNNLCSGTMEVEDNCQKYTHFRTSNFKHRRQSYTDSVKNYAYGSRVNGNLGGSGRDKHARDNRDSNWSCDYTDTAEDEDFRICPVKEYQFYRSPSKFLNWTEDEIIFMRHETHATSLFTKVQSDDLPLQQHQLSMPKRDNEKYFKGSSKIMCRSKGGQAVLRCRKSVDLIHGEGKKCCVLDNKDVSFQSQVRSSRVSCNGRLENVNQGIAKKRKRASVGFDESNKNTFKFDSPKYESNLKSKKWVQNLQDQAQKESSDIEEGQIVAEEPYMEKVSVSRRDASEGPAVTDSVNKKRMSQNENSSDQYIGGYDSQRILDSLAKMEKRRERFKQPMTMKKEAEESLKLNNDSIVDTGEMKQHRPTRKRRWVGN

SEQ ID NO: 162608 - protein, 210 aa, Glycine max
  Coding DNA Sequence Number=SeqID_45830
  Gene Ontology: Mol. function=N-acetyltransferase activity; Biological process=metabolic process
  Homolog annotation: Hit_ID=Q1T0F6; Match level="QueryCoverage=51%, HitCoverage=36%, E-value=3e-35, Identity=67%"; Hit description=GCN5 -related N-acetyltransferase
MAWGTVLQRLGGVALPMIGLTDGPCGAPLDIGVALRLVTTVEEWMVRNGAEYAFLATEKNNDASKNLFTIKCNYVNLSSLVIFVQPTSSLTKQISRDIKIEKVDIDLAISLYRRTMRTKDLYPLDMDVILKEKLSLAIWGENLGELMESMWRFTSRVGEGMRDCRVVITELGFGDILLPTTFLRQILCHVSMIYGTQRDFQAMVMKILMN

SEQ ID NO: 162609 - protein, 515 aa, Glycine max
  Coding DNA Sequence Number=SeqID_45831
  Gene Ontology: Mol. function=oxidoreductase activity; Cellular component=cytoplasm; Biological process=metabolic process
  Homolog annotation: Hit_ID=Q8H5F0; Match level="QueryCoverage=99%, HitCoverage=83%, E-value=0.0, Identity=71%"; Hit description=Betaine aldehyde dehydrogenase-like
  Pfam annotation: Domain name=Aldedh; Domain location=2-456; Score =332.8; E_value=5.8e-97; Accession=PF00171.12; Description=Aldehyde dehydrogenase family
MWAKTSFKKRRHFLRILLKYIIKHQALICEISSRDTGKTMVDASLGEIMTTCEKINWLLSEGEQCLKPEYRSSGRAMLHKRSKVEFLPLGVIGAIVSWNYPFHNIFNPMLAAVFSGNGIVIKISEHASWSGCFYFRIIQSALAAIGAPEELVEVITGYSLILYPSFFLLGFNHICIYSLNWTFLTRFAETGEALVASADKVIFVGSPGVGKMIMSNAAETLIPVTLELGGKDVFIVCEDADVDHVAQVAVRAALQSSGQNCAGAERFYVHRNIYASFVSKVTKIIKSVTAGPPLAGKYDMGALCMHAHSEKLEALINDALDKGAEIIARGSFGHIGEDAVDQYFPPTVIVNVNHSMRLMQEEAFGPIMPIMKFSSDEEVVRLANDSKYGLGCNVFSGSQSRAREIASQIHCGLAAVNDFAATYMCQSLPFGGVKNSGFGRFGGVEGLRACCLVKSVVEDRWWPFIKTVIPKPIQESLVEALYGLSVWDRLQALVNVLKMLTEQNSTSGSRKKKND

SEQ ID NO: 162610 - protein, 89 aa, Glycine max
  Coding DNA Sequence Number=SeqID_45832
MGGTRLSSCQQYVDSNLYLEIKLWIVLGGLPTPTCILRSNYGCALASVNGGYKCRLWCFEIYTMKLAVCHRALLFITKELLIISIAHAV

SEQ ID NO: 162611 - protein, 347 aa, Glycine max
  Coding DNA Sequence Number=SeqID_45833
  Homolog annotation: Hit_ID=Q4R1J3; Match level="QueryCoverage=22%, HitCoverage=11%, E-value=6e-20, Identity=63%"; Hit description=SEL-1
MVVETPFLNSAFSFFHYDLRRHHLKTALECFKTKTVLGTPWRLNFFMSHTLSLSGDVRIVDLYTDTQNIAESGHPAVQLVLGFLWEMGLFREQIKGKAFRYHHFTAEGGNMQSKMELVYNYTRSDHSCPPATEVVSADFLRGLSWGIGMLCVSTDCAVLWNNPSGKLVQIEHALTVVGSGQMSLGIKVYSSVLGFPIKLSGIEVAEGAGHLEVEGEKTTVRLAGDASHVIKENMCKLQRPKKGHAWGASDGIGKFARQGHSSHTILFIVKRGRTSKSHEGRGVVVIVRKGGVATMVVGVGCGVAQRRVRAAGGVRWRWVGGRGGSTCGSGLEEYGGAHGPCGDERSE

SEQ ID NO: 162612 - protein, 574 aa, Glycine max
  Coding DNA Sequence Number=SeqID_45834
  Homolog annotation: Hit_ID=Q9FGU0; Match level="QueryCoverage=22%, HitCoverage=12%, E-value=7e-17, Identity=39%"; Hit description =Arabidopsis thaliana genomic DNA, chromosome 5, TAC clone:K21L19
  Pfam annotation: Domain name=Fip1; Domain location=177-238; Score =81.0; E_value=3.6e-21; Accession=PF05182.4; Description=Fip1 motif
MEGFDDDDFGELYAVDIEVPNAISEEEEEEKLDVNSNILNLDKDMDNNKVNEDCAAESDSDDDDDDLKIVLNDEDIPVGADACDDDGDGDNGDDNNGSRFFHPKSGRSRGLAILNNTKANASMGMGSYISSLNKGRRNGDTYIQNLALSSSRVCLAENPMAVQCGYGLALPWYWGIFDVNIDTLTEKPWKVPGVDITDYFNFGFNESSWKLYRASLEQLWRTSLQTGISVDDSTNWNQEAMREQTDQVVSGNAFFPSSDCGLPKGRAIQVEDSMVERKPTMDVRRPRNRDFNVIEIKLLDSSDDCSGSGNSTVMDASLEGESMAGSKRNALNSSAELNEVLSEDQLEDVKKAEDSSLQRRSGPIPGVDGDEHRDQADQHSEDTAEVPEGETEAEEGGGIDTCSSYPCWTESELSLGDQEHSLTSYTDGDSEATDNSVHVDNDKSLSPLKRKSLNCVTEMKESLALYWKNSKNNSINKKAVSAAYNSRTRGQFRKEWRNQSGGYEPHSYDMNKHTENDNDVSILKSSARNLSLLAHRPVDYGRHKDQLQVFGSHKRRDLSCNRETKQSYYYGGDQ

SEQ ID NO: 162613 - protein, 139 aa, Glycine max
  Coding DNA Sequence Number=SeqID_45835
MRIKLIRVKPMDQVDSQQATTYADHLTQMRIIYTLRYLYAITDADQVYAYEDQLEETHRMEKQTTGEWLTSTMLRAKEEEHKCTTGRELKKQTNTPRRHTRNQLGQEASRNRKERRRRRSCALGEEERKKECEKRGERS

SEQ ID NO: 162614 - protein, 68 aa, Glycine max
  Coding DNA Sequence Number=SeqID_45836
  Subcellular localization annotation: CTP_CleavageSite=35; ConfidenceScore=5.10e-01
MAFAGHTFSQGREQSAGQSSGSNSVQKTLLQRLLIASNGMPFHVFNMMVDIRDDHIFIVTWHSTFDNP

SEQ ID NO: 162615 - protein, 165 aa, Glycine max
  Coding DNA Sequence Number=SeqID_45837
  Homolog annotation: Hit_ID=Q7V9W0; Match level="QueryCoverage=36%, HitCoverage=24%, E-value=5e-09, Identity=43%"; Hit description=Fe-S cluster containing protein
  Subcellular localization annotation: CTP_CleavageSite=52; ConfidenceScore=5.69e-01
MALRYLCATNISIQHYHHHVAKTLVSSSVSLTSSRMQSSTPAARNSKNKFITAKNVKSLVNTIVIPSISSTPLESLHRGNWPKLICVDCIDCAADASFVSAVNEGIEAAKDIVCLRRPWVMISVNDDKDLHFRKAGLEYVSNNSQVEEVYFGERLIYFNIDEVTV

SEQ ID NO: 162616 - protein, 77 aa, Glycine max
  Coding DNA Sequence Number=SeqID_45838
  Gene Ontology: Mol. function=inositol or phosphatidylinositol phosphatase activity; Biological process=abscisic acid mediated signaling
  Homolog annotation: Hit_ID=Q1S8F3; Match level="QueryCoverage=51%, HitCoverage=7%, E-value=2e-11, Identity=73%"; Hit description =Inositol-1,4,5-trisphosphate 5-phosphatase (EC 3.1.3.56) [imported]- Arabidopsis thaliana
MDIAFSSSSQKSSGQNWLRETSKNILLIRELKYNVFGGWSEGVLNFPPTYKYEVNSDKYYGEDPKVGKRSPAWYAFF

SEQ ID NO: 162617 - protein, 111 aa, Glycine max
  Coding DNA Sequence Number=SeqID_45839
  Homolog annotation: Hit_ID=Q1S1N3; Match level="QueryCoverage=51%, HitCoverage=18%, E-value=2e-09, Identity=51%"; Hit description =Calcineurin-like phosphoesterase family protein, related
  Pfam annotation: Domain name=DUF1723; Domain location=64-109; Score =28.6; E_value=2.2e-05; Accession=PF08330.1; Description=Protein of unknown function (DUF1723)
MKARELGNFCKHGKHSYYDLIIVQHVTNDVIQSYAQAMPSPDPRIKYLLVQVVFLDVAKLGQVKVDDVLVTALVERWRLGSHAFHLPVEECTITLEDVTNPTYYDWEQMCT

SEQ ID NO: 162618 - protein, 117 aa, Glycine max
  Coding DNA Sequence Number=SeqID_45840
MESVSALVYCNSGMIPTDEGIVFECPIDPKVITISEDMSLATLGKTIFDANGGYEILIDGFYHQPNYIGDGCVAYDYKEFKHNDDVGKMYSSIQNLVPKIKSLPSYANQGNQERLMT

SEQ ID NO: 162619 - protein, 731 aa, Glycine max
  Coding DNA Sequence Number=SeqID_45841
  Gene Ontology: Mol. function=protein-methionine-S-oxide reductase activity; Cellular component=nucleus; Biological process=regulation of transcription
  Homolog annotation: Hit_ID=O80933; Match level="QueryCoverage=99%, HitCoverage=99%, E-value=0.0, Identity=49%"; Hit description =Putative SCARECROW gene regulator
  Pfam annotation: Domain name=GRAS; Domain location=333-638; Score =435.9; E_value=5.2e-128; Accession=PF03514.5; Description=GRAS family transcription factor
MDPRLLGFSGSPNEIQLGNQRFENGFFDQSREFGYLQSNLLPIDTPSSSSVWTHEEPSPEDCEFSDGILSYISQILMEEDMEDKTCMLQDSLDLQIAERSFYEVIGEKYPSSPLGHPSSVDPDDGGGVDNFSENYGTCSYNDGDLSSIFTNNSLRRNLGELPNQNFRGNSISRSSYSSPNSVISSVEGPVDSPSSILQVPDLNSETQSILQFQKGVEEASKFLPSGNGLFANLGVANFSKLEPRVGSDELPVKVEKDEGESFPAGSKIRKHHHREEGGVEENRSSKQAAIFSEPTLRSSMIDIILLHSLGDGKKHFMARREALQTKNEKIVVSNGKSKASNGGKGRSKKQNGKKEVVDLRTLLVLCAQAVAADDYKGANELLKQIRQHSNPFGDGNQRLAHIFADGLEARLSGTGSQIYKGLVSKRTSAADFLKAYHLYLAACPFRKMTAFISNVTIRKSSANSPRLHIIDFGILYGFQWPTLIQRLSLAGGAPKLRITGIDSPQPGFRPAERIVETGRRLAAYAESFKVEFEYNAIAKKWETIQLEELKIDRDEYLVVTCFYRGKNVLDESVVVDSPRNKFLSLIRKINPNIFIHGITNGAFNAPFFVTRFREALFHYSSLFDMLEAIVSREEWERMLIEKEIFGREALNVIACEGCERVERPETYRQWQARILRAGFLQQPFEREIVKRAIEKVTTSYHKDFVIDEDSQWLLQGWKGRIIYALSCWKPA

SEQ ID NO: 162620 - protein, 99 aa, Glycine max
  Coding DNA Sequence Number=SeqID_45842
  Gene Ontology: Mol. function=isomerase activity; Cellular component =chloroplast; Biological process=cellular metabolic process
  Homolog annotation: Hit_ID=Q94HJ5; Match level="QueryCoverage=95%, HitCoverage=34%, E-value=2e-32, Identity=69%"; Hit description =Putative 3-beta hydroxysteroid dehydrogenase/isomerase protein
MVDKVKQIVLVESMGGTNVNHPVNKMLKGKAEQYLADSSIPYTIIRYGGFENKEGGLRELIVGKDDELLKTETKTIPRADVAEAYIQALNYEEAKFKAF

SEQ ID NO: 162621 - protein, 89 aa, Glycine max
  Coding DNA Sequence Number=SeqID_45843
MDAVANLYLKQHPNMFIKVVVLRVWVNKSSDHGFGFMVVISLLWGEWACDGSKAIRGVWVYGGNEVVVGVWVGKGGDGGHEHIGTSRLS

SEQ ID NO: 162622 - protein, 49 aa, Glycine max
  Coding DNA Sequence Number=SeqID_45844
MEEFQTAIRMTHSLNDVEAIHATPESICNPTNYDIGCDDVVNNQKNEAK

SEQ ID NO: 162623 - protein, 121 aa, Glycine max
  Coding DNA Sequence Number=SeqID_45845
  Gene Ontology: Mol. function=RNA-directed DNA polymerase activity; Cellular component=extracellular region; Biological process=RNA -dependent DNA replication
MDLLGSDIANEEVKNAIFTMGSFKAPGEDVGIKPLNKTLVTFIPKVEEVNLFSQLRPISLSNVFYKDFTKVLASRLITVMEKLVSRTQCNFVPQRQSRDNIIIAQEVIHSMRNKKKGEKDG

SEQ ID NO: 162624 - protein, 124 aa, Glycine max
  Coding DNA Sequence Number=SeqID_45846
  Gene Ontology: Mol. function=structural molecule activity; Cellular component=protein complex; Biological process=microtubule-based movement
  Homolog annotation: Hit_ID=Q1SSB3; Match level="QueryCoverage=72%, HitCoverage=20%, E-value=2e-36, Identity=84%"; Hit description=Cell division protein FtsZ; Peptidase S26A, signal peptidase I
  Pfam annotation: Domain name=Tubulin; Domain location=1-116; Score =14.6; E_value=3.6e-09; Accession=PF00091.15; Description=TubulinFtsZ family, GTPase domain
MGFQVCHSLGGGTGSGMGTLLISKIREEYPDRMMLTFSVFPSPKVSDTVVEPYNATLSVHQLVENADECMVLDNEALYDICFRTLKLTTPSCKYHSLLDLDFSMHSHVQQLENVDKVFSHNQLP

SEQ ID NO: 162625 - protein, 314 aa, Glycine max
  Coding DNA Sequence Number=SeqID_45847
  Gene Ontology: Mol. function=catalytic activity; Cellular component =cytoplasm; Biological process=metabolic process
  Homolog annotation: Hit_ID=Q9M4H5; Match level="QueryCoverage=98%, HitCoverage=96%, E-value=1e-128, Identity=74%"; Hit description =Putative ripening-related protein
  Pfam annotation: Domain name=Hydrolase; Domain location=10-268; Score= 28.0; E_value=3.4e-05; Accession=PF00702.16; Description=haloacid dehalogenase-like hydrolase
MEYMNQRPKYDCLLFDLDDTLYPLSTGLAKACGQNIKVFYSFVGGADTSGSIDLDYMVEKLGIDKSKIDDLSNLLYKNYGTTMAGLRAIGYDFEYDEYHSYVHGRLPYENLKPDPVLRNLLLSLPYRKLIFTNSDKVHAVKALSKLGLEDCFEGIICFETLNPIHKSSVSDDEDDIEFVGGSGTTIPAPKKDVNSFQIFDLISHFAKPNPNTVLPKTPIICKPSENAIELALKIANLNPQRTLFFEDSVRNIQAGKRVGLHTVLVGKSQRIKGADYALESIHNLREAVPELWEGDIKSEVAYPGKHSVETSVTA

SEQ ID NO: 162626 - protein, 246 aa, Glycine max
  Coding DNA Sequence Number=SeqID_45848
  Gene Ontology: Mol. function=RNA-directed DNA polymerase activity; Biological process=RNA-dependent DNA replication
  Homolog annotation: Hit_ID=Q2HUG4; Match level="QueryCoverage=56%, HitCoverage=25%, E-value=8e-22, Identity=31%"; Hit description=RNA -directed DNA polymerase
MSPMKIQAPGERKLLSCGISFLVDNNLLLPMAGTKGVDTSTHASGQLASSKKCNFFCGAMNHRGAMNHRRAEEIRIIHGYRPIADRIKSKLVTQKGALLSIMGRVQLIKSVINGTLLYSFHMYSWPRALLKEVDCFIRNFIWSGTSGATILKLCWSFVYSGDQWVGVLRARFLRNHCQYGGYKKYSLLSSLKQHLPTIFRNKAWVMAPKSTFGIMLGAWRLLLLNLLGSLCAFAAFSHLQSWTLEL

SEQ ID NO: 162627 - protein, 828 aa, Glycine max
  Coding DNA Sequence Number=SeqID_45849
  Gene Ontology: Mol. function=heat shock protein binding; Cellular component=integral to membrane; Biological process=protein folding
  Homolog annotation: Hit_ID=Q7XAR9; Match level="QueryCoverage=94%, HitCoverage=95%, E-value=0.0, Identity=52%"; Hit description =Division protein
  Subcellular localization annotation: CTP_CleavageSite=42; ConfidenceScore=5.62e-01
METVLPRAGLAFCTPHPTTTLQRFTKPNKLLRSSSRGGASLSATSKWAERLIADFQFLGDAATSTVTLSPSSVPPSLDPPERYVSIPLDLYRVLGAELHFLGDGIRRAYEAKFSKPPQYAFSNDALISRRQILQAACETLADPASRREYNQGLVDDHEDAAILTQIPFDKVPGALCVLQEAGETELVLEIGQGLLRERLPKTFKQDVVLAMALAFVDVSRDAMALSPPDFIAACEMLERALKLLLEEGATSLAPDLQAQIDETLEEITPHCVLELLALPLDDEHRARRGEGLLGVRNILWAVGGGGAAAFAGGFTREDFMNESFLHMTAAEQVELFVATPSNIPAESFEAYGVALALVAQAFVGKKPHLIQDADNLFQQLQQTKITAVRNAPSVYIPKEIREIDFALERGLCALLVGELDQCRSWLGLDTDSSPYRNPSIIEFIMENEKGDEDSDLPGLCKLLETWLMEVVFPRFRDTKETRFKLGDYYDDSTVLRYLERLEGGSHSPLAAAAAIVKIGAEATAVISQVQASVMNALKKVFPVGSEDQIVKHQVNGVNEDFGFSESENPVILSDQDSSVNAEVSGIKNTTETSEGEFITEEIKNASVQIMCAGVFLPSRNGLPMLCKTTGSAMASDTINLGSLGDEEKVEQLPKMDARVAEALVRKWQSVKSEAFGPDHCMGRLHEAMLLEFWKAGIVSSWVPAPSIATFACSLTGNSLDMRQLCSELSYFCVLDGEMLKIWTDRAGEIAERGWSYDYTLEDLNIDSVTISQNGRRAVVETTLKESIHLNAIGHPQHDASNSRTYTTRYEMSFTGPGWKIVEGAVLES

SEQ ID NO: 162628 - protein, 92 aa, Glycine max
  Coding DNA Sequence Number=SeqID_45850
  Homolog annotation: Hit_ID=Q69T79; Match level="QueryCoverage=64%, HitCoverage=25%, E-value=7e-12, Identity=55%"; Hit description =Putative glycine-rich cell wall structural protein
GGGGGGGGGSGWGWGGGGGGWWKWGCRREARHGKGKQRVRHYHTSNNEDYRMGEYAQCMARTRCRGLRLDCPLHCGGPCFYDCHHMCKAHCR

SEQ ID NO: 162629 - protein, 379 aa, Glycine max
  Coding DNA Sequence Number=SeqID_45851
  Gene Ontology: Mol. function=RNA-directed DNA polymerase activity; Cellular component=chromatin; Biological process=chromatin assembly or disassembly
MSPHPRIQTLINQFGALFQPSSSLPLARETDHHIHLLPQSAPVNVRPYHYPHYQKHEIELQVESMLQKGLILPSTSPFSSPVLLIRKQDGSWRFCVDYRALNAVTVRERFSIPTIDELLDELVRACWFSKLDLLHGYHQIRMHLEDIAKTAFRIHHGHYEFKVIPFGLCNAPSSFQAIMNVIFRPYLRHFIIVFFDDILIYSLTFDDHVAHLKQTFRVLLDNQFVLKLSKCSFAQPQVEHLGHLVSQRGVELVASKVNAFRQWPVSQSTKALRSFLGLAGFYRRFIKVNATIAAPLVSATIVDPFQWTTSAQIAFERLKQALSEAPVLALPGFQLPFIVETEVQEVTSSESSEVINKGVQLEEKAKRTITKPSYLKDYV

SEQ ID NO: 162630 - protein, 127 aa, Glycine max
  Coding DNA Sequence Number=SeqID_45852
MVRSEASLEDLDEHRIRSELTITGHPLELGKCSAIHVERNNERQGRKTKKQLIKFLSHRLDCFSEGHLVIGELENCGFEVIRGPRGTGGVGHGDESTKMIGKASTSFEDQFLLEEGNLEDKYFIHNL

SEQ ID NO: 162631 - protein, 326 aa, Glycine max
  Coding DNA Sequence Number=SeqID_45853
  Homolog annotation: Hit_ID=Q9XGX0; Match level="QueryCoverage=65%, HitCoverage=64%, E-value=1e-44, Identity=46%"; Hit description =Putative zinc finger protein SHI
  Pfam annotation: Domain name=DUF702; Domain location=106-264; Score =302.4; E_value=8.6e-88; Accession=PF05142.3; Description=Domain of unknown function (DUF702)
MAGFFSLGRQNKAEEQEEDQREDNCQFLFRNNVNEEIYNKGFEIWPQSSYHHHHQNLTNFYSFGVGPSRRNNNNSSSNNNVNDEVSVSFSDESNRFGFTVMRSGGGGVGGGGMNCQDCGNQAKKDCQHLRCRTCCKSRGFQCQTHVKSTWVPAAKRRERQQQLSALQHQQQNQQPQFRGDHSKRHRENIEGAAAGSLACVPVPITTTGLELGQFPPELNSPAVFRCVKVSAMDAPDERYAYQTAVNIGGHVFKGILYDQGTDGPYAGAGCEGSSGGGGEAQPLSLMAAATTTTAATTSGNPFEASLYTAPMNAYMAGTHFFPPPRS

SEQ ID NO: 162632 - protein, 41 aa, Glycine max
  Coding DNA Sequence Number=SeqID_45854
MATATKSISLKPLGRDGTARRHLVEEILIVVPRYAVKPLAT

SEQ ID NO: 162633 - protein, 276 aa, Glycine max
  Coding DNA Sequence Number=SeqID_45855
  Gene Ontology: Mol. function=molecular_function; Cellular component =membrane; Biological process=auxin mediated signaling pathway
  Homolog annotation: Hit_ID=Q94AP3; Match level="QueryCoverage=96%, HitCoverage=68%, E-value=5e-93, Identity=63%"; Hit description =Putative nodulin protein
  Pfam annotation: Domain name=DUF6; Domain location=104-233; Score =56.1; E_value=1.1e-13; Accession=PF00892.11; Description=Integral membrane protein DUF6
  Pfam annotation: Domain name=TPT; Domain location=95-233; Score= -37.2; E_value=0.084; Accession=PF03151.7; Description=Triose -phosphate Transporter family
  Pfam module annotation: Pfam domain module=DUF6::TPT; Domain location= 104-233::95-233
MTLNFVGQFFLLALVGIEQVRLNRKDGLAKVAGTVLCVAGATVITLYKGPTIYSPTTRVNNSMIMNRSNTTVITPMFDFGSLSLGDAKGKNWTLGCLYLIGHCLSWSGWLVLQAPVLKKYPARLSVTSYTCFFGILQFLVIALLLERDAQAWLFHSAGEVFTILYAGVVASGIAFAVQIWCIDRGGPVFVAVYQPVQTFVVAIMASIALGEEFYLGGIIGAVLIVAGLYFVLWGKSEERKFAMEQLAMASTEHNSIASHVKASLAQPLLSSSTENV

SEQ ID NO: 162634 - protein, 116 aa, Glycine max
  Coding DNA Sequence Number=SeqID_45856
  Gene Ontology: Mol. function=transferase activity, transferring phosphorus-containing groups; Cellular component=intracellular; Biological process=tRNA splicing
  Homolog annotation: Hit_ID=Q1RSQ9; Match level="QueryCoverage=86%, HitCoverage=34%, E-value=5e-47, Identity=88%"; Hit description =Phosphotransferase KptA/Tpt1
  Pfam annotation: Domain name=PTS_2-RNA; Domain location=3-98; Score =10.6; E_value=3.5e-07; Accession=PF01885.7; Description=RNA 2' -phosphotransferase, Tpt1  KptA family
MEWNSLFYLVPRWNQICVHGTYRKNLESILGSGLKRMKRLHVHFSCGLPTDGEVISGMRQDVNVLIFLDVRKALEECMKLYISDNKVILTEGFDGVVPPKYFEKIESWPGKQPIPF

SEQ ID NO: 162635 - protein, 134 aa, Glycine max
  Coding DNA Sequence Number=SeqID_45857
MECNIYGVKIKSDGPTNIGARSGIYVGVGGITRAEEGTGVVEEEGAGVSGGAEMSCDQDRESKSGCVMLFNQRDLVGDEIKHKYIHHLKLSKIWEFCKIHSVIQSKGVQCGGFSHMYTFIKFLYNRSTHIKTKE

SEQ ID NO: 162636 - protein, 67 aa, Glycine max
  Coding DNA Sequence Number=SeqID_45858
MYALGVLDKEGQILKTVLIAMIKGFKGTIFLECFALGGSFSVNMGMVGGEFWKEVQWKICFRNALDG

SEQ ID NO: 162637 - protein, 505 aa, Glycine max
  Coding DNA Sequence Number=SeqID_45859
  Gene Ontology: Mol. function=GTP binding; Cellular component =intracellular; Biological process=small GTPase mediated signal transduction
  Homolog annotation: Hit_ID=Q10C01; Match level="QueryCoverage=54%, HitCoverage=73%, E-value=1e-103, Identity=68%"; Hit description =GTP1/OBG family protein, expressed
  Pfam annotation: Domain name=Arf; Domain location=274-489; Score= -97.0; E_value=0.028; Accession=PF00025.11; Description=ADP -ribosylation factor family
  Pfam annotation: Domain name=GTP1_OBG; Domain location=85-278; Score=- 5.8; E_value=1.9e-09; Accession=PF01018.12; Description=GTP1OBG family
  Pfam annotation: Domain name=MMR_HSR1; Domain location=280-410; Score= 144.3; E_value=3.2e-40; Accession=PF01926.13; Description=GTPase of unknown function
  Pfam annotation: Domain name=Miro; Domain location=282-410; Score= -12.2; E_value=0.083; Accession=PF08477.3; Description=Miro-like protein
  Pfam module annotation: Pfam domain module=Arf::GTP1_OBG::MMR _HSR1::Miro; Domain location=274-489::85-278::280-410::282-410
  Subcellular localization annotation: CTP_CleavageSite=62; ConfidenceScore=5.23e-01
MGFLERISYSHSVGSSCTEIRIMVSLISTSPPSSSFNIHPFFSPRGVQFRHNCVNYKRKTVRCAVTSADASPPPSTSLAKEPHKYFDHVIITVRAGDGGHGAVLNQQQQQQQQQQQGKTKLKKGKGSLKRDFDGSLILPMGGHGGDVVLYADESKDTLLEFHNKGRYHAKRGGNVDAMGVLTSMLRDGLAAPTLRIAVPVGTVVKSKRGKMLADLAQPWDEVLVARGGQGGISLLEMPQHKRKKMMALTTNVMRDDSDKVLIHGQPGEEVKLELILRVVADVGLIGLPNAGKSTLLAAITLAKPDIADYPFTTLMPNLGRLGGDPSLGAGMYSSEATLADLPGLIEGAHLGKGLGRNFLRHLRRTRLLVHVVDAATENPINDYRTVREELRMYNPEYLDRPYVVILNKIDLPEAKDKLPSLTQEIMRIGNDGAASDPKPSPEVLDPLSDETDRKEKRLEDYPRPLSVVGVSVLKGIRINEMLKEIRSALRKCSDSKEALSFSVPP

SEQ ID NO: 162638 - protein, 497 aa, Glycine max
  Coding DNA Sequence Number=SeqID_45860
  Gene Ontology: Mol. function=transporter activity; Cellular component= integral to membrane; Biological process=transport
  Homolog annotation: Hit_ID=Q69HW2; Match level="QueryCoverage=99%, HitCoverage=47%, E-value=0.0, Identity=80%"; Hit description=OqxB
  Pfam annotation: Domain name=ACR_tran; Domain location=2-497; Score= -181.9; E_value=9.7e-09; Accession=PF00873.9; Description =AcrBAcrDAcrF family
MVGKTLRRRGAVFGVYVLLLAGAGFMFHTVPGGFIPTQDKLYLIGGVKMPEGSSLARTDEVIRKMSEIGMNTEGVAYSVAFPGLNALQFTNTPNTGTVFFGLKPFSERSRTAAEINAEINAKISKIQQGFGFSIMPPPILGLGQGSGYSLYVQDRAGLGYGALQTAINTLSGAVMQTPGMMFPISSYQANVPQLDVQVDRDKAKAQGVSLTDLFTTLQVYLGSSYVNDFNKFGRTWRVMAQADGDFRDSVQDIANLRTRNDRGEMVPIGSMVNITTTYGPDPVIRYNGYPAADLIGDADPRVLSSAQAMEKLEAMSSQVLPNGMNIEWTDLSYQQATQGNTAFIVFPVAVLLAFLVLAALYESWTLPLAVILIVPVTMLSALVGVWLTGGDNNVFVQVGLVVLMGLACKNAILIVEFARELEMQGKGIVESALEACRLRLRPIVMTSIAFIAGTVPLILGEGAGAEVRGVTGITVFSGMLGVTLFGLFLTPVFYVTL

SEQ ID NO: 162639 - protein, 128 aa, Glycine max
  Coding DNA Sequence Number=SeqID_45861
MADTSSSNFTPQFDYITEDYNMGFPPREKVITPVDLTLGDNIKSKGKRLPIDPTFNMPSLLLNIGSIDPQLLPNYIEQWTSAVIRDYRVNHESHASNSQDMIARAETYLGDIARACWESFKQTFPEQI

SEQ ID NO: 162640 - protein, 297 aa, Glycine max
  Coding DNA Sequence Number=SeqID_45862
  Gene Ontology: Mol. function=DNA binding; Biological process =regulation of transcription
  Homolog annotation: Hit_ID=Q9ZQ85; Match level="QueryCoverage=97%, HitCoverage=58%, E-value=2e-18, Identity=29%"; Hit description =Expressed protein
MGSVPAELSLDLRPTFIPKTITDFLRHLSDNNNPPATLHDFLARLEDELRKIHAFKRELPLSMLLLNDAISVLKAESQKCRVARDSAPVLEEFIPLKKERGDQSEEEEEEEENDDDDDNECRDKRNWMSSVQLWNNNTTTATTNNNNPSDRKQLLHKLQTKKSEEGQSVVEDPFQTCSNINEGRRAFMPFSRYSSSSSSVPVTTVGLGAAASKEEKEESVMNRLSLLTPSSVKEGCGSRGSRSSSNRAVSSSSPPMVQPSLRATSLQQTARKQRRCWSPELHRRFVNALQKLGGSQG

SEQ ID NO: 162641 - protein, 75 aa, Glycine max
  Coding DNA Sequence Number=SeqID_45863
MDRDTLGYSGHRGLRNLGELASGDYSTFGALIWRRSGGLTPTTNNFKVLTMPSTRGFYRLWSCTVTWTKCYICHT

SEQ ID NO: 162642 - protein, 158 aa, Glycine max
  Coding DNA Sequence Number=SeqID_45864
MGEFLDRLRSLQVLSSLPEWSMYDYVKGHTWVNLSKSENLRKVESVFGIDDQWPDDDDLDFHFRAILEATHLMHEEGQLIVLLLARLCSHSCHILDKSIDVEKAQCPVVVDNSCAVLPEWQQQRSCTVGGDDGGHDNDHGGNDGDNNGNNIHVDSGSD

SEQ ID NO: 162643 - protein, 183 aa, Glycine max
  Coding DNA Sequence Number=SeqID_45865
  Gene Ontology: Mol. function=sequence-specific DNA binding; Cellular component=nucleus; Biological process=regulation of transcription, DNA-dependent
  Homolog annotation: Hit_ID=Q5JM93; Match level="QueryCoverage=28%, HitCoverage=12%, E-value=5e-15, Identity=66%"; Hit description =Putative WRKY DNA-binding protein 49
  Pfam annotation: Domain name=WRKY; Domain location=3-58; Score=41.2; E_value=3.5e-09; Accession=PF03106.6; Description=WRKY DNA -binding domain
MMNYRSYQKIFTNLSLGGLKSYYRCTNPRCSAKKQVERSNEDPDTLIITYEGLHLHFAYPYFLMGQLQQSNSHPPIKKSKPISPQAQAQAHREDYVQEAQSNATWGMMSSTSLDSTLDMAQENLGSQGLLEDMVPFMVRNPSNNVNSAHTKFSCSSYSSPPTSPLWTSTYSTTCYTVGLNSST

SEQ ID NO: 162644 - protein, 46 aa, Glycine max
  Coding DNA Sequence Number=SeqID_45866
MKSNIEGGSAKEEDPYCGDEVVDAKRVEDRATCAIVEGALRGGALW

SEQ ID NO: 162645 - protein, 80 aa, Glycine max
  Coding DNA Sequence Number=SeqID_45867
MQRLLNCNIEEIYGRIEGLENQLNQNAGRHYGGNRWGNDGSWQNRMEGQNRIEGVKLNVPPFKGKSDPDTYLDLEMKIEH

SEQ ID NO: 162646 - protein, 473 aa, Glycine max
  Coding DNA Sequence Number=SeqID_45868
  Gene Ontology: Mol. function=DNA-directed DNA polymerase activity; Cellular component=intracellular; Biological process=DNA replication
  Homolog annotation: Hit_ID=Q8ZH30; Match level="QueryCoverage=31%, HitCoverage=95%, E-value=2e-73, Identity=85%"; Hit description =Ribonuclease HI
  Pfam annotation: Domain name=RnaseH; Domain location=139-279; Score =230.3; E_value=4.3e-66; Accession=PF00075.14; Description=RNase H
RIQAVALAREHFTRHRQAIGDLTEGFCLTDVALQHGKFVIHKADVERSVMDHQLRAANIIEEFVGDLRKGRFIGEEFIGNTVYAERFRIHQPIGLEIHMEVVAGQATVDHLNRTDFNDAMSFVMHPDHVHAGGFGIEDDLAVEIFTDGSCLGNPGPGGYGAILRYRQHEKLFSAGYRLTTNNRMELMAAIVALEALTQPCDVVLSTDSQYVRQGITSWIHNWKKRGWKTAEKKPVKNVDLWQRLDAALSTHQIQWEWVKGHAGHPENERCDELARSAAGNPSLDDIGYQREGALTRNHDIQTAQRRQVRADHLAALAVPRHHLKARTIHHFIAFTDAQQAKRIEAADNHPAVINQYTIHFAQYAVRILAPGQRVRQQTGIYRFGFKRQLRCAGDDVQPIALIAHINLMRYGTLSGIDFCAEAANFKHMKAVQLAEIRLQLLEVFMNLTSIPALQDNYIWTLSDEQGHCLIVDP

SEQ ID NO: 162647 - protein, 160 aa, Glycine max
  Coding DNA Sequence Number=SeqID_45869
  Gene Ontology: Mol. function=protein dimerization activity; Cellular component=nucleus; Biological process=regulation of transcription, DNA-dependent
  Homolog annotation: Hit_ID=Q8GT89; Match level="QueryCoverage=70%, HitCoverage=11%, E-value=4e-41, Identity=73%"; Hit description =Hypothetical transcription factor
MASVEEKIKTGGVGGGMVVGGQTLVAEMKLLKEMQEHSGVRKTLNSELWHACAGPLVSLPQVGSLVFYFPQGHSEQVAASTRRTTTSQIPNYPNLPYQLLCQVQNVTLHADKETGRMLIVIKHLIFLDVKNHKPEGQEVSAAGVNIDNHMNSGNGWINST

SEQ ID NO: 162648 - protein, 1065 aa, Glycine max
  Coding DNA Sequence Number=SeqID_45870
  Gene Ontology: Mol. function=ATP-dependent helicase activity; Cellular component=nucleus; Biological process=mRNA processing
  Homolog annotation: Hit_ID=Q38953; Match level="QueryCoverage=88%, HitCoverage=79%, E-value=0.0, Identity=86%"; Hit description =Probable pre-mRNA-splicing factor ATP-dependent RNA helicase
  Pfam annotation: Domain name=DEAD; Domain location=394-551; Score= -13.0; E_value=7.1e-05; Accession=PF00270.19; Description=DEADDEAH box helicase
  Pfam annotation: Domain name=DUF1605; Domain location=906-1027; Score= 99.9; E_value=7.6e-27; Accession=PF07717.6; Description=Domain of unknown function (DUF1605)
  Pfam annotation: Domain name=HA2; Domain location=782-872; Score =119.4; E_value=1e-32; Accession=PF04408.13; Description=Helicase associated domain (HA2)
  Pfam annotation: Domain name=Helicase_C; Domain location=627-721; Score=54.8; E_value=2.8e-13; Accession=PF00271.21; Description =Helicase conserved C-terminal domain
  Pfam annotation: Domain name=S1; Domain location=93-161; Score=7.3; E_ value=0.046; Accession=PF00575.13; Description=S1 RNA binding domain
  Pfam module annotation: Pfam domain module=DEAD::DUF1605::HA2::Helicas e_C::S1; Domain location=394-551::906-1027::782-872::627-721::93-161
NPRPEKSRSQKLRKMMMGTETGIEEIGAEIGMKMIEGIMAEEAEIEMMKMIEGIMAEEEEIEMMKMIEGITAEEEEINMTGIEIDMRGAGEMNMKKSMGVEGRMGIEMVIGRVYSTVLGLVHVSQMATRRITNAKDVVKRDQEVYVKVISVSGQKLSLSMRDVDQHTGKDLLPLKKSSEDDALRMNPQDSKDGPVARTGLSGIRIVEEGDVGSSRRPLKRMSSPERWEAKQLIASGVLSVSEYPTYDDEGDGLLYQEEGAEEELEIELNEDEPAFLQGQSRYSMDMSPVKIFKNPEGSLGRAAALQSALIKERREVREQQQRTMLDSIPKDLNRPWEDPMPESGERHLAQELRGVGLSAYDMPEWKKDAYGKTITFGQRSKLSIQEQRQSLPIYKLKKELIQAVHDNQVLVVIGETGSGKTTQVTQYLAEAGYTTRGKIGCTQPRRVAAMSVAKRVAEEFGCRLGEEVGYAIRFEDCTGPDTVIKYMTDGMLLREILVDENLSQYSVIMLDEAHERTIHTDVLFGLLKQLVKRRPELRLIVTSATLDAEKFSGYFFNCNIFTIPGRTFPVEILYTKQPESDYLDAALITVLQIHLTEPEGDILLFLTGQEEIDFACQSLYERMKGLGKNVPELIILPVYSALPSEMQSRIFDPAPPGKRKVVVATNIAEASLTIDGIFYVIDPGFAKQNVYNPKQGLDSLVITPISQASAKQRAGRAGRTGPGKCYRLYTESAYRNEMSPTTIPEIQRINLGMTTLNMKAMGINDLLSFDFMDPPSPQALISAMEQLYSLGALDEEGLLTKLGRKMAEFPLDPPLSKMLLASVDLGCSDEILTIIAMIQTGNIFYRPREKQAQADQKRAKFFQPEGDHLTLLAVYEAWKAKNFSGPWCFENFVQSRSLRRAQDVRKQLLTIMDKYPKYFDFGLPVLVIVISILLWYKLDVVSAGKNFTKVRKAITAGFFFHASRKDPQEGYRTLVENQPVYIHPSSALFQRQPDWVIYHELVMTTKEYMREVTVIDPKWLVELAPRYFKVADPTKMSKRKRQERIEPLYDRYHEPNSWRLSKRRA

SEQ ID NO: 162649 - protein, 38 aa, Glycine max
  Coding DNA Sequence Number=SeqID_45871
MVEKGKPLILELMWVLGMINFSLVEIGSSIKRVKRFKE

SEQ ID NO: 162650 - protein, 242 aa, Glycine max
  Coding DNA Sequence Number=SeqID_45872
  Subcellular localization annotation: CTP_CleavageSite=79; ConfidenceScore=5.20e-01
MNPKGNTLRPASIIQLVLDAVLLGTQQRGKCFFFLFSLVLLLPLFSGDGACSSSFVRQCFFFLFSPWVVGWFVVVLGCCCGAFVFFVAVVPLVFLIAFETAYFKSGIHPLPGAQMTLQKLSRFCSLSVVTSRQNAIKDHIIEWLEKNYPGLFHDIHFGNHFALDGVSRPKSEICRSLNAKVLIDDNPRYAIECADVGIRVLLFDYENSYPWCKNESVDQHPLVTRVKNWEEVERQLMSLIAS

SEQ ID NO: 162651 - protein, 51 aa, Glycine max
  Coding DNA Sequence Number=SeqID_45873
MTRWRLWCDGVTLTATQEMRKPIRAVVWQRGKCKWGRGRRRIGKHHNDSGG

SEQ ID NO: 162652 - protein, 82 aa, Glycine max
  Coding DNA Sequence Number=SeqID_45874
  Pfam annotation: Domain name=Nodulin_late; Domain location=1-62; Score=8.3; E_value=0.0013; Accession=PF07127.2; Description=Late nodulin protein
MATPQKSTMKFAILLLFIIFASDVYMKLEARRDIVTLRCRIDENCYNLCPDCDCKCINTWCKCFPTQGDLLSFTNNNYTQAP

SEQ ID NO: 162653 - protein, 74 aa, Glycine max
  Coding DNA Sequence Number=SeqID_45875
  Gene Ontology: Mol. function=prephenate dehydratase activity; Biological process=L-phenylalanine biosynthetic process
  Homolog annotation: Hit_ID=Q6JJ29; Match level="QueryCoverage=72%, HitCoverage=12%, E-value=3e-11, Identity=67%"; Hit description =Prephenate dehydratase
MVYVRNDRLSRQHHESCDVARIILDFVRHHVQAIELRRLCAHNGGVRAVGGTDVLPDLLLMELIAPSRKHDEKE

SEQ ID NO: 162654 - protein, 135 aa, Glycine max
  Coding DNA Sequence Number=SeqID_45876
MAHQYIHLVVQREQGRDSIDEEDPRPTSSTWSYIKQGAKGPMKLADRPDPDVNPLYLMTLTIPQLFLKPLQVSWDAIVFGVYNDNFPLYIKHEYFSEIAHNGQCHNISVIRLWILHMSETSMRVGNASVYGFLEP

SEQ ID NO: 162655 - protein, 79 aa, Glycine max
  Coding DNA Sequence Number=SeqID_45877
PVAYTEAIIIFEVTVIVEVADALDIAVKFVRYTRGSFIFRYNHKPLFAGGFDTESIEALEELRSRIHAPPGEDNNQKHS

SEQ ID NO: 162656 - protein, 154 aa, Glycine max
  Coding DNA Sequence Number=SeqID_45878
  Homolog annotation: Hit_ID=Q9FM71; Match level="QueryCoverage=29%, HitCoverage=6%, E-value=4e-07, Identity=53%"; Hit description =Arabidopsis thaliana genomic DNA, chromosome 5, P1 clone:MDF20
MGTTKHFKYLFYVDFEASMTEVRAVEKCEMKRVGKTLGGKLERLQGIGFQRRIRFSPCINRPPPSLKNNKLVHLLKWIQKWTKGREGLVRVAMRLSWARKKMMITRAYTTTSTFVEGSFNCCTRMMIWGSETVTLKKRSLCYYRKRFRMPLGFH

SEQ ID NO: 162657 - protein, 216 aa, Glycine max
  Coding DNA Sequence Number=SeqID_45879
  Gene Ontology: Mol. function=protein serine/threonine kinase activity; Cellular component=integral to membrane; Biological process=protein amino acid phosphorylation
  Homolog annotation: Hit_ID=Q5VQM7; Match level="QueryCoverage=74%, HitCoverage=14%, E-value=2e-18, Identity=38%"; Hit description =Putative receptor-like protein kinase INRPK1
MPKTNKHDRRDISHNVLRGNLQYLAGLQNLVVLNISYNKFTGRVPDMLFFVKLPLSVLAGNPELCFSGNECSGRGKSEQRARVVRVAMVVLLCTMFVLLMAMLYMVVAAKRRGDRQNDVELDGKDNNADMAPPWEKILPKLGLHIEGNAVQRENGRRRIRKSILGLGGDGASATTVLGANFSTGFVAGTLASAVPAKKRQKFGPNIIRKSNNPVFL

SEQ ID NO: 162658 - protein, 158 aa, Glycine max
  Coding DNA Sequence Number=SeqID_45880
  Gene Ontology: Mol. function=hydrolase activity, acting on glycosyl bonds; Cellular component=intracellular; Biological process =metabolic process
  Homolog annotation: Hit_ID=Q9FLA9; Match level="QueryCoverage=84%, HitCoverage=24%, E-value=2e-42, Identity=54%"; Hit description =Similarity to endo-beta-N-acetylglucosaminidase
  Pfam annotation: Domain name=Glyco_hydro_85; Domain location=1-157; Score=-25.1; E_value=4.9e-10; Accession=PF03644.4; Description =Glycosyl hydrolase family 85
MEALKDTGMPIQDQVIGTKVLGTFITKWDEGKVVCDTLFSTKETAHMYAECLVELAVDLGFDGWLVNCWPALPEHKMLLMYDSVTLDGKLNWQDQVNEHNKPFFDICDGIFVNYTWKEDYPRLSTAVAGNWKFDVYMGIDKFVHGMIEGIQKITTLNG

SEQ ID NO: 162659 - protein, 393 aa, Glycine max
  Coding DNA Sequence Number=SeqID_45881
  Homolog annotation: Hit_ID=UPI00005F7F8E; Match level="QueryCoverage =47%, HitCoverage=49%, E-value=3e-44, Identity=55%"; Hit description =COG1055: Na+/H+ antiporter NhaD and related arsenite permeases
  Pfam annotation: Domain name=ArsB; Domain location=1-268; Score=49.0; E_value=4e-13; Accession=PF02040.6; Description=Arsenical pump membrane protein
  Pfam annotation: Domain name=ArsC; Domain location=238-348; Score =160.1; E_value=5.8e-45; Accession=PF03960.6; Description=ArsC family
  Pfam module annotation: Pfam domain module=ArsB::ArsC; Domain location=1-268::238-348
MVPVTLAAVLATLLMLHLFFRKELPLSYDRARLTSPAAAIRDRATFRAGWLVLLLLLAGFFALEPLGVPVSAVAAAGALMLWLVARRGQVIDTRKVLRSAPWQIVVFSLGMYLVVYGLRNAGLTVWLTGLLNDFSSTGLWGATFATGFFSALLSSIMNNMPTVLVGALAIDASTAQGSGNAAMAARTGAKRDSHQLGLLFSRRHHPDVTGAGRDAGSSGAAPFPLTVKRLTMTNITIYHNPDCGTSRNTLALIRNSGVEPTIVLYLVTPPTRETLQQLIDAMGIGLRALVRQNTDAWQALGPVRETLSDEQLLDAMLAQPILINRPIVVTPLGTRLCRPSEQVLDILPDAQRGPARQSLVGQKSSGIICFNRVYLVITAKQAIAIAGNQVVDQ

SEQ ID NO: 162660 - protein, 99 aa, Glycine max
  Coding DNA Sequence Number=SeqID_45882
MSIANNIKSALPKTESAKEFMKSVEEHSQTADKSLAGTLMSTLTTMKFDGSHTMHEHGVRKKVNKKHGKEKGPLKIVESSTKIQKKNDKCHFCGKSGHF

SEQ ID NO: 162661 - protein, 216 aa, Glycine max
  Coding DNA Sequence Number=SeqID_45883
APAEPQAPDPDLSLPLLDDNARRAELNERGGFLHFGDLSDQQKDKVLNAQVKIERAIEKALLSDGYSRDELSQRNKRDEIRGFLFYPGVSSNNNEARPRNGAGKEKWACGSPSLDYLGSPFFGIGRISWFWKTDPCQAFDSTLGNATSKEKESERSLNSRKDGSQNIAIVTVSGLRETGLDAALYVPPLAFSSPGPLLDQGKIPKKCAEQNSSIML

SEQ ID NO: 162662 - protein, 125 aa, Glycine max
  Coding DNA Sequence Number=SeqID_45884
  Gene Ontology: Mol. function=DNA binding; Biological process=DNA integration
  Homolog annotation: Hit_ID=Q0ZCB6; Match level="QueryCoverage=54%, HitCoverage=18%, E-value=2e-09, Identity=41%"; Hit description =Integrase
MEFLVVKKSIIENTIEIFMDDCSIFSQSFDVSFTSIEVDPAKEKLLKELLVNAPVIVSPDWSLAFELKCDKFDLEIKDKKGSNNLVANHLSHLDPFMRLTVDDEAIHETFPDEHLLVVAALLRAH

SEQ ID NO: 162663 - protein, 80 aa, Glycine max
  Coding DNA Sequence Number=SeqID_45885
MNIRTYQREKEKWSRGCERGNAVVARWAHNDTVGNTVVAMWAHNDVVGNRVRNSVDEIVRSRGRVTEGERELQHREEESE

SEQ ID NO: 162664 - protein, 60 aa, Glycine max
  Coding DNA Sequence Number=SeqID_45886
MAPKPVANTIVDDIPSVLGQFTTSLSDSDLTLTTYAIFVTPSLDPQLAALDPMEGALKLV

SEQ ID NO: 162665 - protein, 78 aa, Glycine max
  Coding DNA Sequence Number=SeqID_45887
MTEVLDSGQGDLTQPAISQQGWKTLECRAPKWRGRMRKSPQRVISLPGATGARPGSARPPWGWRWHDGGSAIEVWECE

SEQ ID NO: 162666 - protein, 171 aa, Glycine max
  Coding DNA Sequence Number=SeqID_45888
MAPEDLDMQSQFQMHMQSQGLTLSLELKVGPSTTHVITKESWFDPSRHNPNTGESKKYGLYVDENPPCLGAEGSTKPTDRLNPDVDPLYLMTFTIPQLFLKSLQVMWDAIVFGVYNDNFPMYIKHEDLFEITYSGQCLNIFAIQLWILHMTETSMRAGNADVYGFLESQSI

SEQ ID NO: 162667 - protein, 142 aa, Glycine max
  Coding DNA Sequence Number=SeqID_45889
MLQHTQRLAKSRTLSCEPFTGGYQGSGLQENTLATSSWVLSLSCLSLIDPVLWPSATSAKRTMHMSSGLYGYLDEMRAGIYTHFDQMENYIQSHHATKETHLDNMQERIDTYQAIVQTRLDAYDAKLDGYFQHQFHGGAPSS

SEQ ID NO: 162668 - protein, 157 aa, Glycine max
  Coding DNA Sequence Number=SeqID_45890
MSSNVIREEEVDNVHANRNDHDEGELINITRKVTRLRSLATRPIGAERPLVHVDPATGKADNPHKKKLRTYLGIVTHDKVDVTYENWKQVPATHKDLIWEDIQAEFDIPEASNLRTKKKILQNMARRALMILYVKSMTLARRRGTGFVRAVETLRER

SEQ ID NO: 162669 - protein, 104 aa, Glycine max
  Coding DNA Sequence Number=SeqID_45891
MERKQDKEKADAAATAMRTTTKYKNKHKYLTETSQVTVEEDRDTQSGVAEGAETEKKITREDRARVHTFLNLSSTSVFTKKTDVNQLMLTYHYLTSIFERSMLT

SEQ ID NO: 162670 - protein, 59 aa, Glycine max
  Coding DNA Sequence Number=SeqID_45892
MKDFLKKSWYIDSRCSKLMTGDASKFTLISPKKSGHVTYGDNYKVNMMILGYGLEELFI

SEQ ID NO: 162671 - protein, 112 aa, Glycine max
  Coding DNA Sequence Number=SeqID_45893
  Gene Ontology: Mol. function=acylphosphatase activity
  Homolog annotation: Hit_ID=Q7CQS9; Match level="QueryCoverage=72%, HitCoverage=88%, E-value=5e-24, Identity=65%"; Hit description =Putative phosphohydrolase
  Pfam annotation: Domain name=Acylphosphatase; Domain location=20-111; Score=55.5; E_value=1.8e-13; Accession=PF00708.8; Description =Acylphosphatase
MRRHFPVDGGKMQRTKGEIAMATTGYKIWVHGRVQGVGFRYYTQAQANALGVTGYAHNLADGSVEVLAAGEPQQVESLIAWLKAGGPPSARVDKVLVEPHQLAERPTRFTTG

SEQ ID NO: 162672 - protein, 505 aa, Glycine max
  Coding DNA Sequence Number=SeqID_45894
  Gene Ontology: Mol. function=ATP-dependent DNA helicase activity; Cellular component=intracellular; Biological process=DNA recombination
  Homolog annotation: Hit_ID=Q66FY3; Match level="QueryCoverage=84%, HitCoverage=70%, E-value=0.0, Identity=87%"; Hit description=ATP -dependent DNA helicase
MQPGHLLQDQMQPHQRHAGPYHDAERNADHAHHRLAARAAGSGLRHEKEVRPRAHQRNQMHQRHGEKQHQHDLSPSVFVIVEMVADHRHKGRAETLQFALADAVDAQQIAGLDRHLFGHFQQRGVVEHHIRRNVLFIGDRFAQFSQLGEQLAIVIAAVGFLVGATARLQARDTRHRQLQRHFAAQHRTRRLGQLQRRVHGDVLGDKAQVDQLAQHAGPVFGGLIAADAVHRQFIVAVFANALVVGAAQHFHDVPQAEALADAVHAGQRLARILQPVIALRRIEADVAVAAVLVLAFAKVVEQHQTAAGLRLGERAHGVQLVAFDIQLLSGGFFLQTAAQPGHVGRIVQQDGFGRQAVAPGAAGLLIIGFDIARNVEMHHEAHVGFVDAHAEGDGGHHHLQIVALERFLHLRTAIVVQPGVVGADAQPATLQTRGGVFHLGAAVAIDNAALAALILHEAPQLIERLEFFHQRVADVRPVKAANLYQRILQRQQAHESPRVDSSAVA

SEQ ID NO: 162673 - protein, 97 aa, Glycine max
  Coding DNA Sequence Number=SeqID_45895
MHSISFLLCQYLLAKVCDIHPRIELANGQNKYAKYSHSKSIQMPKLCRITLWKAPVADDKSDEQNDGDNDKVYFVEAFGKRRHRQAPFGGGDSNCGA

SEQ ID NO: 162674 - protein, 89 aa, Glycine max
  Coding DNA Sequence Number=SeqID_45896
  Homolog annotation: Hit_ID=Q9FMX9; Match level="QueryCoverage=43%, HitCoverage=7%, E-value=1e-12, Identity=79%"; Hit description=Serine carboxypeptidase II-like protein
MTSAASGEVQQYGGYITVNETPGRALFYWFFEATHKPKQKPVLLWLNGCTFFFTNPALHNHEPESQEVSAAGVNIDNHMNEGSGYINSA

SEQ ID NO: 162675 - protein, 167 aa, Glycine max
  Coding DNA Sequence Number=SeqID_45897
  Gene Ontology: Mol. function=RNA-directed DNA polymerase activity
  Homolog annotation: Hit_ID=Q1S1X7; Match level="QueryCoverage=42%, HitCoverage=5%, E-value=5e-15, Identity=53%"; Hit description =Integrase, catalytic region; Zinc finger, CCHC-type; Peptidase aspartic, catalytic
FEELANLVSFALFTSARDPSTFQEVMNNHEKDNMGIDYDEISSSIVRHTSIKAVLASVANRDMHLEQMDVKITFLDNDVEQQIYMKQPERFSKGGLDRLICKLKRCGVKDTYVVAQGSLVQISLMLTASVFTKIGIRVNVGPCMEARKQVLHVLWQHKVLEHVGGNG

SEQ ID NO: 162676 - protein, 483 aa, Glycine max
  Coding DNA Sequence Number=SeqID_45898
  Gene Ontology: Mol. function=monooxygenase activity
  Homolog annotation: Hit_ID=Q8Z3I3; Match level="QueryCoverage=51%, HitCoverage=82%, E-value=1e-94, Identity=67%"; Hit description =Possible monooxygenase
  Pfam annotation: Domain name=Bac_luciferase; Domain location=228-479; Score=8.9; E_value=1.3e-08; Accession=PF00296.11; Description =Luciferase-like monooxygenase
  Pfam annotation: Domain name=Peptidase_U32; Domain location=5-217; Score=-18.6; E_value=4.3e-06; Accession=PF01136.9; Description =Peptidase family U32
  Pfam module annotation: Pfam domain module=Bac_luciferase::Peptidase _U32; Domain location=228-479::5-217
SRSEVKELRRYVENGEFLLEANDIGTVNMAAERKLPFVAGPTLNVYNAQTLQMLLQEGMTRWCMPVEMSRDWMIQLLQQCHDAGLRDRFEVEVLGYGHLPLALSARCFTARSENRAKDDCQICCIDYPTGRRVLSQEGQQVFVLNGIQTMSGYCYNLGNDLAGMHGWIDIVRLSPQDESTLAQVDRFRANEAATVTGAAWPEWRWIAAVYLSPAPSFAGVPMSEKKTVRLSVLDLAPIPQGSSARDAFHNSLALARQAEALGFHRYWLAEHHNMTGIASAATSVLIGYLAANTETLRLGSGGIMLPNHAPLVIAEQFGTLESLYPGRIDLGLGRAPGSDQRTMLALRRHLSSAQADSFPEDVADLIRWFDAEKGEHPPVQPVPGLGLKIPVWLLGSSLYSAQLAAQLGLPFAFASHFAPDLLLQALHLDRDARFLFTSMQQHFINLRRVKPGPLPAPVETCITCGLRPNNMGCTGADHVGGGR

SEQ ID NO: 162677 - protein, 132 aa, Glycine max
  Coding DNA Sequence Number=SeqID_45899
MTLLEVVEVALKEIVEIVLGCMDLDLALRTERPISTPETSNEMSSQVSKHVTEQESGQDLFESKREKSLLKGIPRFKEVFAKYKARTGKRASNHWAIRVGVWSSRSQGSKIFGLSTISDKASQSQFDFEQCG

SEQ ID NO: 162678 - protein, 783 aa, Glycine max
  Coding DNA Sequence Number=SeqID_45900
  Gene Ontology: Mol. function=protein binding; Cellular component =membrane; Biological process=defense response
  Homolog annotation: Hit_ID=Q1SW19; Match level="QueryCoverage=97%, HitCoverage=84%, E-value=1e-166, Identity=43%"; Hit description =Disease resistance protein
  Pfam annotation: Domain name=LRR_1; Domain location=445-466; Score =6.9; E_value=15; Accession=PF00560.23; Description=Leucine Rich Repeat
  Pfam annotation: Domain name=LRR_1; Domain location=468-489; Score =8.4; E_value=7.6; Accession=PF00560.23; Description=Leucine Rich Repeat
  Pfam annotation: Domain name=LRR_1; Domain location=491-512; Score =13.3; E_value=0.89; Accession=PF00560.23; Description=Leucine Rich Repeat
  Pfam annotation: Domain name=LRR_1; Domain location=633-655; Score =6.3; E_value=19; Accession=PF00560.23; Description=Leucine Rich Repeat
  Pfam annotation: Domain name=LRR_1; Domain location=657-683; Score =7.2; E_value=13; Accession=PF00560.23; Description=Leucine Rich Repeat
  Pfam annotation: Domain name=LRR_1; Domain location=706-728; Score =4.9; E_value=35; Accession=PF00560.23; Description=Leucine Rich Repeat
  Pfam annotation: Domain name=NACHT; Domain location=57-209; Score= -32.0; E_value=0.018; Accession=PF05729.3; Description=NACHT domain
  Pfam annotation: Domain name=NB-ARC; Domain location=24-330; Score =240.1; E_value=4.7e-69; Accession=PF00931.13; Description=NB-ARC domain
  Pfam module annotation: Pfam domain module=LRR_1::LRR_1::LRR_1::LRR _1::LRR_1::LRR_1::NACHT::NB-ARC; Domain location=445-466::468 -489::491-512::633-655::657-683::706-728::57-209::24-330
SPSSAYKIQDVKSLIRAERDGFQSHFPLEQRQTSSRGNQDITSQKLRRDPLFIEEDEVVGLDGPRGVGKTTLAKQVYDQVRNNFECHALITVSQSFSAEGLLRHMLNELCKEKKEDPPKDVSTIESLTEEVRNRLRNKRYVVLFDDIWNEKFWDHIESAVIDNKNGSRILITTRDEKVAEYCRKSSFVEVHKLEKPLTEEESLKLFCMKAFQYSSDGDCPEELKDVSLEIVRKCKGLPLAIVAIGCLLSQKDESAPEWKQFSENLCLDQLERNSELNSITKILGLSYDDLPINLRSCLLYFGMYPEDYEIKSDRLIRQWIAEGFVKHETGKTLEEVGQQYLSGLVRRSLVQVSSFKIHGKVKRCHVHDLIHDMILRKVKDTGFCQYIDGPDQSVSSKIVRRLTIATDDFSGSIGSSPIRSILIMTGKYEKLSQDLVNKFPTNYMVLKVLDFEGSGLRYVPENLGNLCYLKYLSFRYTWITSLPKSIGKLQNLETLDIRDTSVSEMPEEISKLKKLRHLLADYRCSIQWKDIGGMTSLEEIPPVFIDDDGVVIREVGKLKQLRELWVVKFRGKPEKTLCSVINEMPLLEKLHIYTADWREVIDLYITSPMSTLWQLVLWGTLTRLPNWILQFPNLVQLSLVSSRLTNDPLNSLKNMPRLLFLDLSNNAYEGETLNFQSGGFQKLKRLELRYLDQLKCILIDRGALCSVEEIVLQDLSQLKTVPSGIQHLEKLKDLYINYMPTELVQRIAPDGGEDHWIIQDVPHVRIWSRGAEEPSHIFGRSHH

SEQ ID NO: 162679 - protein, 88 aa, Glycine max
  Coding DNA Sequence Number=SeqID_45901
MRSGGCNICGGAYELGSCMVQDNTTNKVGNPIKEITSTKESTMSHYMSTDVAIRNLEVHISQLAKQIDEWPTGTFGVNIEMNLKEECK

SEQ ID NO: 162680 - protein, 70 aa, Glycine max
  Coding DNA Sequence Number=SeqID_45902
MTAYKFVNLDPMNYAPMLFTLQHILLVYENSFGLLPHESMWQEYERDQWGPYPRRKRTTKSLPVSTRIPT

SEQ ID NO: 162681 - protein, 87 aa, Glycine max
  Coding DNA Sequence Number=SeqID_45903
DRTFTETILGFCGKGKGYNAKDISLSLNRISKFQTVRMLRIWAAKVVLKFHHDPTVNDSEIVVFLRQIRWPAGKKRGFWEKREETKL

SEQ ID NO: 162682 - protein, 82 aa, Glycine max
  Coding DNA Sequence Number=SeqID_45904
  Gene Ontology: Mol. function=unspecific monooxygenase activity
  Homolog annotation: Hit_ID=O04892; Match level="QueryCoverage=88%, HitCoverage=19%, E-value=7e-12, Identity=44%"; Hit description =Cytochrome P450 like_TBP
  Subcellular localization annotation: CTP_CleavageSite=22; ConfidenceScore=5.17e-01
LAVRVVHGGHSLEPVGCRWTARAASAARSGRRVPVGGRIGNGPFGASSPGVEQSTQNCALNVKVKKFNQARVNVGSNYDFLK

SEQ ID NO: 162683 - protein, 124 aa, Glycine max
  Coding DNA Sequence Number=SeqID_45905
MLPPKSPRASSLPRSDKEVPWKYAPQKPDGRKDEFAEDDLSSAKVTNISGISHVTCSGRIFVAPDSLVWLKDTKGKAKVGTKENDKASLILDEEIPARRFAKGEEDFGRKKISNKKENEFLRII

SEQ ID NO: 162684 - protein, 375 aa, Glycine max
  Coding DNA Sequence Number=SeqID_45906
  Gene Ontology: Mol. function=intramolecular transferase activity, phosphotransferases; Cellular component=cytoplasm; Biological process=carbohydrate metabolic process
  Homolog annotation: Hit_ID=Q9SM60; Match level="QueryCoverage=50%, HitCoverage=32%, E-value=2e-98, Identity=91%"; Hit description =Phosphoglucomutase, cytoplasmic
  Pfam annotation: Domain name=PGM_PMM_II; Domain location=143-238; Score=19.8; E_value=2.5e-05; Accession=PF02879.6; Description =Phosphoglucomutasephosphomannomutase, alphabetaalpha domain II
  Pfam annotation: Domain name=PGM_PMM_III; Domain location=240-363; Score=116.7; E_value=6.7e-32; Accession=PF02880.6; Description =Phosphoglucomutasephosphomannomutase, alphabetaalpha domain III
  Pfam module annotation: Pfam domain module=PGM_PMM_II::PGM_PMM_III; Domain location=143-238::240-363
MTMSVARLKKDEIQRLKKEIDSLRCPTVELHESETSAAAEEPPQRERKNGDIPRDERNSTTITIAAVIQTLTLLTLTLNLLCSSFLVGSPSTASSRSSRILPPASLTFSSFPKMEEALLRLLVFSVLRYVKLIIMITSGPAVGDIRSRCLRLSDQSTIEALAVRNLLGHRLPLDPLQAKSEWLEDFGGGHPDPNLTYAKELVARMGLGKSEPQDEPPEFGAASDGDADRNMVLGKRFFVTPLDSVAIIAANPVEAIPYFSAGLKGVARSMPTSAALDVVAKHLNLKFFEVPTGWKFFGNLMDARLCSVCGEESFGTGSGRIREKDGIWEVLAWLSILAYKNKDKLEDKLVTVEDIVRQHWATYGRHYYNQYDYEV

SEQ ID NO: 162685 - protein, 54 aa, Glycine max
  Coding DNA Sequence Number=SeqID_45907
MAWVTKEVSGDPLGPPFLKNQNLNMYKDPQYHDQRSKQEERRPTLKDIVMDDNC

SEQ ID NO: 162686 - protein, 187 aa, Glycine max
  Coding DNA Sequence Number=SeqID_45908
  Homolog annotation: Hit_ID=UPI00005F8869; Match level="QueryCoverage =97%, HitCoverage=77%, E-value=5e-36, Identity=42%"; Hit description =COG2200: FOG: EAL domain
  Pfam annotation: Domain name=EAL; Domain location=1-187; Score=-99.5; E_value=0.00048; Accession=PF00563.11; Description=EAL domain
MEGGLLAVEMLSRFNSLDGDLAMPAEIGINLLAPEQRIELFNEQLKLAVQHAAWFTGNNVQLTINIEETIVELILSDSALCQRIGQYPFIAFEVSESFPNLSAGKNNPSVRRLSEMFTLWLDDFGSGKATLTALYDGLFDYVKIDKRFYWQLFTHQGYDVVIDSLLKNINLLCKGVIVGGIEKKSIL

SEQ ID NO: 162687 - protein, 95 aa, Glycine max
  Coding DNA Sequence Number=SeqID_45909
MKYKTLEFIYRLLKLQTLDQTLVRREKHQLCKEMQRDQSKDQGIEVMESVGMLGTYLRKFLLKNGIILFAWGQAKYKNWRCNKQKRQKIEEKKKI

SEQ ID NO: 162688 - protein, 160 aa, Glycine max
  Coding DNA Sequence Number=SeqID_45910
MGEVEEIQEKMKADMEAIKEKMATMMEAMMSVKKIMEANAVAIAATSVVAKVNLMSPSGINQMNHPTSDMPWLGYATEGQAVGGIPFENTLEGPQFRPQPQPLHFAVGRAPPAMAEKGEVDHLKERLRAIEGGEDYAFANLEKLFPIPKHGHSQVQGAGL

SEQ ID NO: 162689 - protein, 154 aa, Glycine max
  Coding DNA Sequence Number=SeqID_45911
  Pfam annotation: Domain name=zf-CCHC; Domain location=81-98; Score =27.8; E_value=2.6e-05; Accession=PF00098.13; Description=Zinc knuckle
MDLTKMAKDEVKKKKSKGLALKSSIPFSDESDQENTEGSESENLTLLVINFKKFLNKKNSKGRSFQHKKNIKKNDSSSPKVTCFECGKSGHIKSECSMFLMKQQGGEKKAKGHKKKKKAYLAWEKNASSTSSNEEEANLCLMVDGEVKSDVCSQ

SEQ ID NO: 162690 - protein, 66 aa, Glycine max
  Coding DNA Sequence Number=SeqID_45912
  Homolog annotation: Hit_ID=Q0PEL6; Match level="QueryCoverage=97%, HitCoverage=4%, E-value=3e-08, Identity=43%"; Hit description =Putative integrase
MAKETWDLIQVTSEGTLKVRRARKNYLIQEYENFWMQQGETIGDVQKRFTHIVNHLKGSGNEFEEE

SEQ ID NO: 162691 - protein, 181 aa, Glycine max
  Coding DNA Sequence Number=SeqID_45913
MYNTTITNIGLHCSVHWQMFAILLKENLVVWFCSLHNRPNNYLKGIINSALKGLDDTPQPKSKAGARWIVVICNRQKGNTECGYYVMHWMSTMILGSFRNNWETTIGSREIEGASHPVGTVLSQTPSGACRPWIFFINGVFCFLKINGSRTEKEKDDSRCNFNEKMSQEEAHHHRKPWIRA

SEQ ID NO: 162692 - protein, 180 aa, Glycine max
  Coding DNA Sequence Number=SeqID_45914
SDLTLKWVLVADKDNLDDTVCEKYGISKEKWAQFCQCRRDPSWEDVRKKSQAIQKQNTAPHVLARGGYEYLERKLMAEKIEKKLEEVAESESTKAVIDPPSPIRWHVKWKMARTKKTGHMTSEAAKEIAKKIDVLTTAIGRPEHPGRVCAAGANVTIKQYFGSAPRISHTSSSMAPEELE

SEQ ID NO: 162693 - protein, 114 aa, Glycine max
  Coding DNA Sequence Number=SeqID_45915
MGSSQKPSLKKRFYQVKIKSLEVTSLRKLGQLMGQLQRQAFRKAYGIRPPKASRKWGGRNTEKIFGGKSKNLGRKRRVDPIHRYSHTVDFRGRPLSKCGWVGGPGSDRRFSRLS

SEQ ID NO: 162694 - protein, 65 aa, Glycine max
  Coding DNA Sequence Number=SeqID_45916
MSAYSPFAKRKPRAKRISVHALSHESRALSAQPLHLRLIHSAKLAKAKLSLIEFDLSSAKRQPNR

SEQ ID NO: 162695 - protein, 81 aa, Glycine max
  Coding DNA Sequence Number=SeqID_45917
MWIVASGNRLPKIVMAAQLIRDRVEMECLEGVWETLEGNTRCRFRGTIRFTATSLVHPDEPARTLQRTVEWTAPWISFVYF

SEQ ID NO: 162696 - protein, 84 aa, Glycine max
  Coding DNA Sequence Number=SeqID_45918
MGAKHLTRTKEWSHVIEQRSPDEIRPQLPHSSLVDRAWNYGCTTDNSCTTLFASQVECVICIDQNSNDQAFLVVMISKKSIDRC

SEQ ID NO: 162697 - protein, 102 aa, Glycine max
  Coding DNA Sequence Number=SeqID_45919
  Gene Ontology: Mol. function=RNA-directed DNA polymerase activity; Biological process=RNA-dependent DNA replication
MKIQGLQAPHGATSWSDDCKIALEKIKQYLMNPLVLAPLVLGRPFIFYMTVLDESIGQLKGTLIDYMAQQPIDDYQPMHPEFPNEDIMALFHEESKDEDKDK

SEQ ID NO: 162698 - protein, 156 aa, Glycine max
  Coding DNA Sequence Number=SeqID_45920
MGVKRLKVTNQGKVVKISAQELDQVKQNRNGVVGLPRKHLEEKAEALADQGEWTSFIDILTLLVFGTILFPNVNGLVDLAAIDAFLAYHHNKESLIIAILVDAYDTFNLRCEKSGARIKAVASGGSNPARLGELSSPGRAELAWASWAATTSPILL

SEQ ID NO: 162699 - protein, 384 aa, Glycine max
  Coding DNA Sequence Number=SeqID_45921
  Gene Ontology: Mol. function=receptor activity; Cellular component =outer membrane-bounded periplasmic space; Biological process =glycolysis
  Homolog annotation: Hit_ID=Q0JYW8; Match level="QueryCoverage=84%, HitCoverage=100%, E-value=1e-100, Identity=56%"; Hit description =Probable extra-cytoplasmic solute receptor precursor
RRTAGCVHRRCGPPHGWPPACRIASCRAFRLDAGVLDDAGPARDLALDHGIGLGGRGDQRIEALAAHAFGQLGRLQRLRQPGVERVHHRLRRAGGRADHEPGGEGVAGQAGLGDGGHVRQQRRTRGAGDAQRLELLAVDLRLGRGQHGEAHLHLAADGVHHGRTAALVGHVQDLRAGHRLEQFGGHVEGAAGAGRTEAQLIGGTRADVVEQFLDIVHRQRRRYRQHVLRGAHRADRTQVARGVERHVAKQRRVDRQRHGVDGQRVAVRLGAGHRGHADIAGRAGAVLDDHALAQGLAPGVGNQAGGDIDAAAGRERHDQGDRTLREGVGGSGWRHPTGRRGGQRAHRAQQMGGFHGSGLLMGGRVRRLCYRSAQCISPFHSYNW

SEQ ID NO: 162700 - protein, 112 aa, Glycine max
  Coding DNA Sequence Number=SeqID_45922
MSLHVLYLYAFSRFPPRDFRSVVSLVTIFQRDEHGFEAFSPHGQDHLGLPSGVETKHERQKPIKVLKDERKGGWGHDRPIVALLCAKQAENVAARQPRILCILQLSFTFCLF

SEQ ID NO: 162701 - protein, 353 aa, Glycine max
  Coding DNA Sequence Number=SeqID_45923
  Homolog annotation: Hit_ID=Q2P1W1; Match level="QueryCoverage=42%, HitCoverage=18%, E-value=4e-40, Identity=65%"; Hit description =Chemotaxis protein
  Pfam annotation: Domain name=MCPsignal; Domain location=1-152; Score =162.9; E_value=8.3e-46; Accession=PF00015.11; Description=Methyl -accepting chemotaxis protein (MCP) signaling domain
  Pfam annotation: Domain name=Rick_17kDa_Anti; Domain location=289 -332; Score=54.5; E_value=3.4e-13; Accession=PF05433.5; Description =Rickettsia 17 kDa surface antigen
  Pfam module annotation: Pfam domain module=MCPsignal::Rick_17kDa _Anti; Domain location=1-152::289-332
VIDGIAFQTNILALNAAVEAARAGEQGRGFAVVASEVRTLAQRSAGAAKEIKGLIEDSVGKVADGSALVRQAGTTMGEIVASVQRVTDIMADISAASQEQSSGIEQVNQAVVQMDETTQQNAALVEEASAAARSMEEQANLLAEAVSVFRTGAVTAAAAVRPALAAVAASVAPSSSRGQCRQGDGAHRDGWSRWARIFFLNVRWPMKWRTRAFHFRLPTAGGHWCHTGTQEMAMKTSTRLLVLGTLLAASSVAGAQTYGPRDEGRKFNDGSRVVCKNVEVQRNSRDPNRIAGTATGAVIGGLLGNQVGGGNGKKLATVAGAVAGGAAGRQIQGNSQQKNGDRVVERRCERVYR

SEQ ID NO: 162702 - protein, 47 aa, Glycine max
  Coding DNA Sequence Number=SeqID_45924
MKVLFAADRRRIAVLGSDGRPQANAGVIGNCGEEGRVKFGGEGKVLK

SEQ ID NO: 162703 - protein, 212 aa, Glycine max
  Coding DNA Sequence Number=SeqID_45925
  Gene Ontology: Mol. function=DNA binding
  Homolog annotation: Hit_ID=Q1SFS3; Match level="QueryCoverage=96%, HitCoverage=40%, E-value=4e-79, Identity=70%"; Hit description =Lambda repressor-like, DNA-binding
  Pfam annotation: Domain name=DUF1723; Domain location=48-97; Score =11.5; E_value=0.022; Accession=PF08330.1; Description=Protein of unknown function (DUF1723)
MDIPLRSTRKYLFKKTDLLRLRELASLVSDPVDFQAHHGKLLRILRVDVEEGCLETLVQFYDPLYHCFTFPDYQLVPTLEEYSYLVGLPVPDKIPFHGFEPTPKPSDIAAALHLKTSIIQANLTSKGGLQGLPTHFLYQQASIFAEAASTLAFHSVLALLIYGLLLFPNIDNFIDINAIKILLTKNPVPTLLADTYHSIHDRTQAGRGTISC

SEQ ID NO: 162704 - protein, 87 aa, Glycine max
  Coding DNA Sequence Number=SeqID_45926
GTWRYVAGVRRPWGRQGDRALVTDYQLGVIDYTVLPATEVPIPWHNSTHCYFISTSGGTRTHTSVASGVDTTYTYSISTSGASSSDR

SEQ ID NO: 162705 - protein, 76 aa, Glycine max
  Coding DNA Sequence Number=SeqID_45927
MEEAPTHASSHVEQPRHAMACQAITERLEQLLNLRIVTEGTKAYNVMEDCLRIIRGVTADCNIYVRSRQRQRMEDA

SEQ ID NO: 162706 - protein, 72 aa, Glycine max
  Coding DNA Sequence Number=SeqID_45928
  Subcellular localization annotation: CTP_CleavageSite=34; ConfidenceScore=5.36e-01
MCSAEGSGGTAHLSPSQPIPPLLLAVSPLSSACPANANSGTPYPAIVTGGSSFPPVSIATPTSRSDPPWNFF

SEQ ID NO: 162707 - protein, 101 aa, Glycine max
  Coding DNA Sequence Number=SeqID_45929
RTKIDVYAGTLSMEFGDIVVNFNILDAMKHPSEDHSIFRVEIIDQIVDDYMFDFDFFFMSEFEFKSGSDFLGVVPLDVDFLELECTNHVVGSTYTSDLLYE

SEQ ID NO: 162708 - protein, 204 aa, Glycine max
  Coding DNA Sequence Number=SeqID_45930
  Homolog annotation: Hit_ID=Q1SS72; Match level="QueryCoverage=47%, HitCoverage=7%, E-value=2e-16, Identity=41%"; Hit description =Integrase, catalytic region
MSTLKTIGLADLKEGLFHLIVGKDKSPSTNNITATNTNTSKLWHFRLGHLSDPISHTLPTPPQFTPSTPITTNTEPTIPQPNGSPSLFPNPSTPPTIDTPNPNIIDQHIQEPPTNHALPRHSNRDTHPPSYLSDYQFQIPSLKSAQSSSTCTYPIQSFLSYTHVSPSHRHFLMTLSSEHEPTSFHEAVKHQCWRDAMKCEIKAL

SEQ ID NO: 162709 - protein, 245 aa, Glycine max
  Coding DNA Sequence Number=SeqID_45931
  Gene Ontology: Mol. function=DNA binding; Cellular component=beta -galactosidase complex; Biological process=DNA integration
  Homolog annotation: Hit_ID=Q1SLU3; Match level="QueryCoverage=99%, HitCoverage=18%, E-value=7e-79, Identity=57%"; Hit description =Integrase, catalytic region
MDSSLRLHYDSFGFLDDLLSYRRLVGRLVYLTSTCPDIAFATRQLSQFMSKPTKAYHVAVVRVLRYLKGCPGKGSLFPRTCSPYLLGFSDADWATCNSLVSWKTKKQTTVSHSSSEAEYRELAFATCELQWLSYLLRDLRIPLSKTLALYCDNDSALHIAINPVFHERTKHLDIDYHLVREKFQARLMLLLLVPSSNQLVDIFTKALPPQSFNTNLSKLQLQNIFAPPACGGLIEETYNPSLNAT

SEQ ID NO: 162710 - protein, 293 aa, Glycine max
  Coding DNA Sequence Number=SeqID_45932
  Gene Ontology: Mol. function=ferric iron binding; Biological process =aromatic compound metabolic process
  Homolog annotation: Hit_ID=Q7F761; Match level="QueryCoverage=96%, HitCoverage=47%, E-value=8e-70, Identity=48%"; Hit description =Putative transcription factor
  Pfam annotation: Domain name=XH; Domain location=155-293; Score =221.2; E_value=2.3e-63; Accession=PF03469.5; Description=XH domain
NATKNSSLQMAALEQKKADENVMKLAEDQQRQKELLHAKIIQLQKQLDMKQELELEIQQLKGSLSVLKHMEDDEDAEVLKKVDTLQKDLRDKEQSLEELDALNQALIVKERESNDELQEARKALVDHLNEIHSSVTILSHGSWDGMKELSSHSNIRLKRMGEIDTIPFLDAMKKRYNEEEAEERASELCSLWEEYLKNPDWHPFKVIMVEGKEKEIVRDDDEKLNELKNDLGEGAYKAVVQALSEINEHNPSGRYLTSVVWNYKEGRRASLKEGVQFLLNHWKGEWCEAITRS

SEQ ID NO: 162711 - protein, 495 aa, Glycine max
  Coding DNA Sequence Number=SeqID_45933
  Gene Ontology: Mol. function=nucleoside-triphosphatase activity; Cellular component=membrane; Biological process=cell division
  Homolog annotation: Hit_ID=Q9FN75; Match level="QueryCoverage=89%, HitCoverage=89%, E-value=1e-135, Identity=53%"; Hit description=AAA -type ATPase-like protein
  Pfam annotation: Domain name=AAA; Domain location=248-433; Score =60.0; E_value=8e-15; Accession=PF00004.19; Description=ATPase family associated with various cellular activities (AAA)
  Subcellular localization annotation: CTP_CleavageSite=50; ConfidenceScore=5.22e-01
MAMASPSSIFSVYASMTASIMLLRSVTNDLIPQPFRGYLTNAFRYFFKARCKVLTLTIEEYCSGIARNHVYDAAEVYLSTKITPENERLNISKSPKEKKLTIRLEKGEELVDWFNGIKLNWKLICSESEKSNSSNDHSRNNPTRTEKKYFELSFEKKHKEMVLGSYLPFILEKDKEMKDEERVLKMHTLNTSYGYGGFKWDSINLDHPSTFETLALEAEQKSAIMEDLNRFVRRREYYRKVGRAWKRGYLLYGPPGTGKSSLIAAMANYLKFDIYDLQLDNLVTDSDLRKLLLATANRSILVIEDIDCSVDLPGRRHGDGRKQPDVQLSLCGLLNFIDGLWSSCGDERIIILTTNHKERLDPALLRPGRMDMHIHMSYCSYHGFKVLASNYLDIAPDHRLVGEIEGLIEDMQITPAQVAEELMKSEDADTALEGFLKLLKRKKMEGDVCENDGSDKTELHQSKRSKVGCKQKRPVCISKRKNGVGTQRRTRGRPL

SEQ ID NO: 162712 - protein, 240 aa, Glycine max
  Coding DNA Sequence Number=SeqID_45934
  Gene Ontology: Mol. function=RNA-directed DNA polymerase activity; Biological process=RNA-dependent DNA replication
MDMRPWKASGPDDFPVGFYQQAYNCIGVNVDLAKAYDKMRWSYIDHILHEVVFPQNLISLIMHCISSIQSNMIWTGYKASPLTPQRGLWTPTRASKDDPQVFHLMFADDVLLFGEASIQQIKCVPKGHGNTRRSHVVGWPSIMLPKSNGGMTMSNLVAMNKTCLMKLAWALNSGLWSQVLQGGFAKKLENVSTFVVELWEIFEGMQLVKEKGWYPLIIQSNLQVVVKSLIGSGAGCATGL

SEQ ID NO: 162713 - protein, 58 aa, Glycine max
  Coding DNA Sequence Number=SeqID_45935
MVVAIQDAVVVAEVIYLMYMVPSSQYAQPVQYVAQPQYAYIQPSPQVIQAPKQPTNSP

SEQ ID NO: 162714 - protein, 185 aa, Glycine max
  Coding DNA Sequence Number=SeqID_45936
  Gene Ontology: Mol. function=GTPase activity; Cellular component =mitochondrion; Biological process=defense response to fungus
  Homolog annotation: Hit_ID=Q8S7E5; Match level="QueryCoverage=99%, HitCoverage=29%, E-value=9e-76, Identity=75%"; Hit description =Putative phragmoplastin
  Pfam annotation: Domain name=GED; Domain location=88-181; Score =118.6; E_value=1.8e-32; Accession=PF02212.8; Description=Dynamin GTPase effector domain
VHFVLKELVRKSIAETQELRRFPTLQAEIAAATNEALERFREESKKTAMRLVDMEASYLTVEFFRKLPQEMEKAGNPANQATPNVDRYGEGHYRRIGSNVSSYISMISDTLRNTIPKAVVYCQVREAKLSLLNHFYIQIGKKEAKQLSQLLDEDPALTGRRQQCAKRLELYKAARDEIDSVSWAR

SEQ ID NO: 162715 - protein, 273 aa, Glycine max
  Coding DNA Sequence Number=SeqID_45937
MEQGESLPSYSKFVRLRPDPQGLVARLCIPGRGFVLNVKGLPWKLLRKDLTTLAQTWSVLSHSNLAPTSHTFDLNLDRAKLVYGLVMKMNMNLGSLISGVTLDSLTFESLSPAINLAYIKKNCWNLDEPSVTFPGTQKSRARRSEASIYFCFSVTTSSSSSSRSLRLEVKAFCVYVAEPASGPTPDHAEFAGCGPATTSYEHGGVSVEAQEPQPDQEDDILEASEPTPPESFIFKTDPVAATPQVTPEPSTVVLDMSSSQPESSAPVPDLTLP

SEQ ID NO: 162716 - protein, 72 aa, Glycine max
  Coding DNA Sequence Number=SeqID_45938
MTHLELLSIFVDVVDLTIKSIVFLNDVFVLLKNKPDLGEMFSGVLGIGFISYEGREWVQGEGENVWVVQGEK

SEQ ID NO: 162717 - protein, 63 aa, Glycine max
  Coding DNA Sequence Number=SeqID_45939
MSSAWPKDPPRVLPVQQYDIFVEPDVHQQPVAATTPDETDADAHHLGHADGHRSRRRRRTDGH

SEQ ID NO: 162718 - protein, 35 aa, Glycine max
  Coding DNA Sequence Number=SeqID_45940
MGKLGGVCVIVTATMHALFGHEGLGDHDFPAKEAV

SEQ ID NO: 162719 - protein, 72 aa, Glycine max
  Coding DNA Sequence Number=SeqID_45941
MERRHEEELTKVKADHDQLETRVRRSQGDEQSTHTLPECTQGESHPNAYALSEALSSRVVMRAEHATGAKRA

SEQ ID NO: 162720 - protein, 245 aa, Glycine max
  Coding DNA Sequence Number=SeqID_45942
  Gene Ontology: Mol. function=phosphotransferase activity, phosphate group as acceptor; Cellular component=cytoplasm; Biological process =nucleobase, nucleoside, nucleotide and nucleic acid metabolic process
  Homolog annotation: Hit_ID=O04905; Match level="QueryCoverage=91%, HitCoverage=98%, E-value=7e-89, Identity=76%"; Hit description =Uridylate kinase
  Pfam annotation: Domain name=ADK; Domain location=47-197; Score =228.8; E_value=1.2e-65; Accession=PF00406.12; Description=Adenylate kinase
  Pfam annotation: Domain name=Thymidylate_kin; Domain location=49-214; Score=-45.2; E_value=0.031; Accession=PF02223.8; Description =Thymidylate kinase
  Pfam module annotation: Pfam domain module=ADK::Thymidylate_kin; Domain location=47-197::49-214
MGTVEAANKDANGSLLEKNPTVVFVLGYLQKTVYLLDKKLADEFGSGPGSGKGTQCANIVENFGYTHLSAGDLLRAEIKSGSENGTMIQNMIKEGKIVPSEVTIKLLQKAMQESGNDKFLIDGFPRNEENRAAFEKVTGIEPAFVLFFECPEEEMERRLLSRNQGREDDNIETIRKRFKVFLESSLPVINYYDAKGKVRKIDAARPIEEVFETVKGIFGPKNEKSLHQCNDCFFALETREELPRS

SEQ ID NO: 162721 - protein, 413 aa, Glycine max
  Coding DNA Sequence Number=SeqID_45943
  Gene Ontology: Mol. function=RNA-directed DNA polymerase activity; Biological process=RNA-dependent DNA replication
HVGGAPVLMIGEFPTELCALPEFRSELQLHELFDGFQVSIRGVVSWIYVEFITLACLVDGQGLNLRPFVHTHDLSAFSCCGMRHDRFLGGRICYYLQALCITLLCLLLISDGESPGKLALTEGGHQVHVASGLDSLAYKVEEWIGMRMDGVRGDLKSLEGFPIQDISGTALIDKDLRHHEVCNDDGDNHGVILVDGVDALEVPICKDGVHMTFSGLDGLSSRGKSSRNGVDYISDLLGLAPAWWLSGLLTNRTKYPACCVLVELLSGLVDYILESGHFFHLDVALGSLAQLVHAIGVKISDLDDFMPKSFHEFSEGLVVHFSQTGQGDRGHAVRPTGNVLCIKLFNEGVEAVYRPRWESTVPGIQMLVWICCPIVLLEVEWFPPQEYVCLHNTVDKRMLEDGPPCWTVYVGEI

SEQ ID NO: 162722 - protein, 66 aa, Glycine max
  Coding DNA Sequence Number=SeqID_45944
MEHSSKLENGGHMNENAIHGAPEKGENGGLPLGSKLKSGGHMNENAIHGAPEKGLAGPNGPPGFST

SEQ ID NO: 162723 - protein, 388 aa, Glycine max
  Coding DNA Sequence Number=SeqID_45945
  Homolog annotation: Hit_ID=Q9LHB1; Match level="QueryCoverage=83%, HitCoverage=52%, E-value=2e-78, Identity=47%"; Hit description =Transcription factor X1-like protein
  Pfam annotation: Domain name=XS; Domain location=116-232; Score =203.8; E_value=4.1e-58; Accession=PF03468.5; Description=XS domain
  Pfam annotation: Domain name=zf-XS; Domain location=44-87; Score =85.3; E_value=1.9e-22; Accession=PF03470.5; Description=XS zinc finger domain
  Pfam module annotation: Pfam domain module=XS::zf-XS; Domain location= 116-232::44-87
MANGSSDEDTDISESEISEYEDKSYEELNNGSQNVKTSDETFTCPYCPKKRKRDYLYNELLQHASGVGQNSSQMTKARDKANHLALVKYLEKDLMTVDVPSKDSKPVDENEPSVNSDEQFVWPWIGIVVNIPTRWIDGHYVGESGTKLRDEYRSRGFNPVRVTPLWNFRGHSGIALVEFKKDWPGLDNALAFERTYELDHHGKKDWFANSEQKSGLYAWVARADDYKVNNIYGEQLQKMGDLKTIPERMEEEARKQDILVSNLTNIIQVKNQHLKEIEVRCHETTNKMNLAMNEKDKLIRTYNAEIKKMQSSASDHLKRIFTDHEKLKFQLESQKNELELRKIDLEKREAHNESERKKLAEEIEEEVIMSLVMSQIHMRQLRLDGNDI

SEQ ID NO: 162724 - protein, 42 aa, Glycine max
  Coding DNA Sequence Number=SeqID_45946
METEKTLYIWVVLYCVRLTAHGSRLTAHEFMVILILQNMAEH

SEQ ID NO: 162725 - protein, 76 aa, Glycine max
  Coding DNA Sequence Number=SeqID_45947
MKMLTLPFRDEPMKEWLTLEVGVRFHIGPLVTIMKEILKKMVEGVLCNVEAAPHGTRDRFWQWPEVPIHKPRPQCV

SEQ ID NO: 162726 - protein, 97 aa, Glycine max
  Coding DNA Sequence Number=SeqID_45948
MDLLTSSICLSVYRWKTTSTVKQATRDGTENLDGYPIKSAYLTTVVLALEEVREGSVVWSDYTCSVGRQGTGTQKLASQDIPTNEEVVRTSVGLGPE

SEQ ID NO: 162727 - protein, 386 aa, Glycine max
  Coding DNA Sequence Number=SeqID_45949
  Gene Ontology: Mol. function=transcription regulator activity; Cellular component=nucleus; Biological process=regulation of transcription
  Homolog annotation: Hit_ID=UPI0000162EED; Match level="QueryCoverage =31%, HitCoverage=27%, E-value=8e-29, Identity=56%"; Hit description =transcription factor
  Pfam annotation: Domain name=HLH; Domain location=277-328; Score=4.9; E_value=0.044; Accession=PF00010.16; Description=Helix-loop-helix DNA- binding domain
MEFASFHLQQHQLQEESAQFSIISTTPPPDSKPSTTITNQSWIPSNMYNGYNSGFLTDQSFTNSRELQHKHAMTDSLRISTRQAFGFNNGKSLITQHPVGDNNSLFPARIFKGEMIDNTFMKAMEESSLVPIHHEPRYSSPSFLSSIGVTVGEEFYPNDKPIDGGTPSKRYNNSFGDVALISNLPTLDMASSLVSCSLGLNPKMFDLHTSYGGSCGIQPGYDTFGINESISLSHSYEHGRENSPSNSTSKISSFVSEVATTKRPSNCSPPKESEAKAKKSRPSCPPLKVRKEKLGDRIQTLQRLVAPFGKTSTASVLSEAIGYIHFLHQQIQTLSIPYMKSAQSKPSRVVQLDSNKVDRREFKPDLRSRGLCLVPLSYASFIHRCV

SEQ ID NO: 162728 - protein, 555 aa, Glycine max
  Coding DNA Sequence Number=SeqID_45950
  Gene Ontology: Mol. function=transporter activity; Cellular component= intracellular; Biological process=transport
  Homolog annotation: Hit_ID=Q94FN3; Match level="QueryCoverage=99%, HitCoverage=99%, E-value=0.0, Identity=80%"; Hit description =Phosphatidylinositol transfer-like protein II
  Pfam annotation: Domain name=CRAL_TRIO; Domain location=129-315; Score=149.4; E_value=9.3e-42; Accession=PF00650.10; Description =CRALTRIO domain
  Pfam annotation: Domain name=CRAL_TRIO_N; Domain location=43-112; Score=57.3; E_value=5e-14; Accession=PF03765.5; Description=CRALTRIO, N-terminus
  Pfam module annotation: Pfam domain module=CRAL_TRIO::CRAL_TRIO_N; Domain location=129-315::43-112
  Subcellular localization annotation: CTP_CleavageSite=48; ConfidenceScore=5.22e-01
MSGPLSPKTSLEKSDRVGSLKKMLRNSLTRSKRRSSSKVMSVEIEDIRDAEESKAVDEFRQALVLDELLPEKHDDYHMLLRFLKARKFDLEKSKQMWSDMLQWRKEFGADTITEDFEFKELDEVLQYYPQGHHGVDKDGRPIYIERLGQVDATKLMQVTTMDRYIKYHVKEFERTFDVKFAACTIAAKKHIDQSTTILDVQGVGLKNFNKHARELITRLQKIDGDNYPETLNRMFIINAGSGFRMLWNTVKSFLDPKTTSKIHVLGNKYQSKLLEIIDESELPEFLGGACTCADQGGCMRSDKGPWKDADIMKMVQNGEHKCSRKCEVPVMEEKTTSEEHETPKLEANLAAQLSSVFAEVPASKAYNYEDFVPEADKTAWNKKMEENEKFAVSKAGAVDAYAMVDSFKIHEKVNSQIFTGVMAFVMGIVTMVRMTKNMPKKLTDANFYSNFGGEYKGQAPNTEEMTTMPNISAQEFMTVMKRMAELEDRMVNMNNQTTCMPPEKEEMLNAAISRADALEQELLATKKALEDSLSKQEELSAYIEKKKKKKKLFAW

SEQ ID NO: 162729 - protein, 89 aa, Glycine max
  Coding DNA Sequence Number=SeqID_45951
  Gene Ontology: Mol. function=RNA-directed DNA polymerase activity; Cellular component=mitochondrion; Biological process=DNA integration
  Homolog annotation: Hit_ID=Q1SS72; Match level="QueryCoverage=97%, HitCoverage=5%, E-value=1e-21, Identity=58%"; Hit description =Integrase, catalytic region
MDAARHILKYIKGCPGKGLFCSSASDFKLRGFSDLDWAACPETRESITGFSIFFGSSLVSWKSKKQPTVSRSSLEAKYRALTITVCELQ

SEQ ID NO: 162730 - protein, 238 aa, Glycine max
  Coding DNA Sequence Number=SeqID_45952
MALPNFHRTSRKELFPNDKTLNPSLLCNDLDVNLHSSHSSLSLRVPLPVDHSVLSALDTSQTPPPDPLVSQPGQTRVVLSMTAVASLSSLVQKPSSKVLPDKGLEVGLSGSAGEGKLPTTLSPSMLIVDWRCMVRWPVIPHMKLISQSQLRGRLNKYGDYANDYKQDPGGGRTRGWAIFGVLSCIFFVSSTLFCCGGFIYKTKVERQRGIDALPGMTILSACLETVSSKLLTNFYWNF

SEQ ID NO: 162731 - protein, 62 aa, Glycine max
  Coding DNA Sequence Number=SeqID_45953
MVYSLSISRSDNKLRALWWTDSINRMRLVELNKATHGQKTSIVHLAVKPLWERPPGPSQGAA

SEQ ID NO: 162732 - protein, 136 aa, Glycine max
  Coding DNA Sequence Number=SeqID_45954
  Gene Ontology: Mol. function=oxidoreductase activity; Cellular component=vacuole; Biological process=response to oxidative stress
  Homolog annotation: Hit_ID=Q0ZA68; Match level="QueryCoverage=87%, HitCoverage=36%, E-value=7e-46, Identity=75%"; Hit description =Peroxidase
  Pfam annotation: Domain name=peroxidase; Domain location=1-133; Score= 92.8; E_value=1.1e-24; Accession=PF00141.13; Description=Peroxidase
GCDGSLLLDSSESIVSEKESDPNRDSARGFIVIDAIKLAIERACPSTVSCADILTIAARDSVVLTGGPSWEVPLGRRDSRDASISGSNNNIPAPNSIFPTLQTKFEQQGLNLTDLVTLSGILLKFVCFKFFLDKFF

SEQ ID NO: 162733 - protein, 93 aa, Glycine max
  Coding DNA Sequence Number=SeqID_45955
MSNEELKLQDPRCRIQCPDILPENTGVAAQCISQDKMSNEALKLQDPRCRIRYFQENDRSHPAQAVAAQKRTLLYKHEGCTSSVPSPGLKSYF

SEQ ID NO: 162734 - protein, 133 aa, Glycine max
  Coding DNA Sequence Number=SeqID_45956
  Subcellular localization annotation: CTP_CleavageSite=94; ConfidenceScore=5.52e-01
VRACSPQKVRACSPLKARTCSPLMATTCSPLKARTCSPQKVRMYSPLKAIGTSTQGSTLMRKQEINSWRGPGHAMLNGMPRGSSMISTHCVRFVSSEKWRLRKPSRGYGYHCSIKFVLKVVFSIGCVEGGFRG

SEQ ID NO: 162735 - protein, 299 aa, Glycine max
  Coding DNA Sequence Number=SeqID_45957
VGKITKSEREQSLHGNGNHDSERSLNVLGIQILNGNESRDSQEAEERIKNYLGFPIHTTNEALQMSDPSPRNNKREWQVYSRNRRCQKQMGQASPNGIWPAIVTKAITKGQQQPNVDLNKARNGHNDNNVLMEGPSKQNEAEKQMGQASSNDIWPAIVTKAFTKGQQQHNVDLNKARNGHSGSNVLMEGPSKKNETEKVTTDNYIVNNVQLEEAEAQWNMAKEMGATCGSQQGKIIDKIRAMEERDRKEAERLGNRETKKEQIEKTTCQALWGDPECGKVQIGKEGHRQWIHPAERAVD

SEQ ID NO: 162736 - protein, 167 aa, Glycine max
  Coding DNA Sequence Number=SeqID_45958
MYCTARQAQVGDPQAPDVPPPPPQADPAGSFDTERYLRHLVRQQAANHRAHVQTHECLYQLSLSLQSQGFPPFPCPTPDQFRAEVAWPGDWPEAQAGEAPVEAPIEAPGKADEARMDEEMTDLLDFLGAKPHDWEIPRSIFSFYVSSIICYVSFYFCLTEGLTFVSF

SEQ ID NO: 162737 - protein, 196 aa, Glycine max
  Coding DNA Sequence Number=SeqID_45959
MHGLILRQAYDYGRINQVASVNDQALPRALPALANKSSSIALTKQARQASSETTDLRNNVGALDHPRSLHAPHPRERGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 162738 - protein, 187 aa, Glycine max
  Coding DNA Sequence Number=SeqID_45960
MTDPDLHTKRPGTVARIMYSVGRSFRREIELERRNWHKELTNFADGSIDVAVVKEFYANLYDLEDTSPKQVRVRGHLIKFDVDALNTFFYISTVIEEGESLLAYSRFARLRLDLEELVVRVCIPGRGFELNADGLPLKILRKNLTTLAQTWSVLSFSNLAPTSHTSDITLDRARLIYGIIQKMDMNL

SEQ ID NO: 162739 - protein, 74 aa, Glycine max
  Coding DNA Sequence Number=SeqID_45961
MLTHKCSKIVELCEDFSQQRRSIPLWWRRWGGNNTDTNGERPFNLDIWLIIQRNIEMMKKKSNKVGVRERCMCP

SEQ ID NO: 162740 - protein, 167 aa, Glycine max
  Coding DNA Sequence Number=SeqID_45962
MFKIESRTLQGSRGNLISRIKNQESKFKVQASKKQDQDSRIKRRLNQDKYEKGASTRFKENKGGYIPCGSLLVKGFLQASAKRNSPGLSARKTLEEDELYRPELEAGAGLKACDEFVSDCEILEASWYGKLNPLLDLPCSGNWSDSKVLDSTGLSCRTIMRNRGAIA

SEQ ID NO: 162741 - protein, 256 aa, Glycine max
  Coding DNA Sequence Number=SeqID_45963
  Homolog annotation: Hit_ID=Q1SDS1; Match level="QueryCoverage=35%, HitCoverage=18%, E-value=4e-10, Identity=39%"; Hit description=IMP dehydrogenase/GMP reductase
GRTGILISCGKFPNVPLMGTRGSINYNPILAIRQLGYPMRGAPSEEGLIPFLTRGFNSTNAGVLQRVHKAWEMSQRKDKELRWSSNGPIGGYRRWLKAYTQDLDWLPSLRTTKGIEIETPEEDEEENAKLRYVNIATTKALEQETKMARREEHGQNKFRGALWGSNSELMLRREERDQSRVDAHEHKVANEYARVYAEKEARGRVIDSLHQEATMWMNRFALTLNESQELPRLLEKAKAMADTYFAPEEIHGLLRY

SEQ ID NO: 162742 - protein, 44 aa, Glycine max
  Coding DNA Sequence Number=SeqID_45964
MNSLSKHAALSEFINTHCILALIRAFLGQARLVAVSAKLSELHC

SEQ ID NO: 162743 - protein, 65 aa, Glycine max
  Coding DNA Sequence Number=SeqID_45965
MRKMQGSCVSEHEKGMQFVEQKCPTCTVKKVIWTFRLPVTKDETNIQCMLEIKCGSNLVCINLLK

SEQ ID NO: 162744 - protein, 65 aa, Glycine max
  Coding DNA Sequence Number=SeqID_45966
MSGEALKLSAGARLWCRPSIDENDKKLQEEMKLSSLRLKGITRGLIRAVKEMDKEVVEADIIVAV

SEQ ID NO: 162745 - protein, 115 aa, Glycine max
  Coding DNA Sequence Number=SeqID_45967
MSVDCYEGDFEVHIYSDVQVASGSTQDFGSTIGACCRQTPTTEGHAPVQTHPEYSFRAYDRWMHYSNHFAPAGLGSSSSMDFFASCKMNGSGMEKEEKEEMPLQGEDESRRSSPP

SEQ ID NO: 162746 - protein, 204 aa, Glycine max
  Coding DNA Sequence Number=SeqID_45968
AATSLDLTQPDLDNSGGDANGNDNGGGGGGGGGGEGGGDNSKGKEGSDGDKRKMPLLMSQKFILAYAALAGVCERKKNGVKAIIGKENSVREGVENTNKSQNGHLSEGIGQEDPNNHEGECRYEGRINKIPTHYTSAKKEAETDMTPVGEDAYLDGQRWQCNEHGSAMNTDEHGSAQCNSSMWSKHGQTWQCNEHGSETTRTTT

SEQ ID NO: 162747 - protein, 101 aa, Glycine max
  Coding DNA Sequence Number=SeqID_45969
MTMRSSLETLARFEDLGSKMRTIRKRGLCTVYAVPMMRTMIQREWREELGFPVAQNAVDSDSKCHSASSMVLPFEKLFRDFNRFKRKGLKKDEVWALWGVI

SEQ ID NO: 162748 - protein, 132 aa, Glycine max
  Coding DNA Sequence Number=SeqID_45970
MGSKIYHEVHENPRAFFSSSSPILLEYSIQYPWGETTKKKKEISGDESDDEKPQQCKGSRRKTSKKSKSNLVIKTAKATSSATKAKRIISNVAKPSLHNKSASMTSGLKQSTSASNPPTKDTYPTKDTTSSK

SEQ ID NO: 162749 - protein, 100 aa, Glycine max
  Coding DNA Sequence Number=SeqID_45971
MLNIVSTVAMPFYSNTDVVENIRLESIPQFQTMPKLGAGPSYQGGLMTNNKYSDIPINVTIVLNPLVQTTNVHPSSADSTWKFYTKPCSTWGHHQMIKTM

SEQ ID NO: 162750 - protein, 82 aa, Glycine max
  Coding DNA Sequence Number=SeqID_45972
SKSLAFVDRTAFYYHDPRVGSPRRHLTVIRTSSVIDKQRPIWSSAPFPEIGGGPDDTRRYLTVIRTLVSSRGGGPDDMQRLT

SEQ ID NO: 162751 - protein, 105 aa, Glycine max
  Coding DNA Sequence Number=SeqID_45973
MEVADGVRSKTWKCWWIALTWTIWHHRNKVVFQDTTFHGIKLLEDALFLLWSWIKAMDKDFTLHFNQWSSNLKEGLDQTYLREVAKEKKHRLLTMLECDEHDARP

SEQ ID NO: 162752 - protein, 90 aa, Glycine max
  Coding DNA Sequence Number=SeqID_45974
MALRSTNKHNSSFFQILPHAQPRSVALSGWLAKPVDWLCERSYSSTNSDPEDVEDAFLIAGSGRASATLLPDLPPLPEELVALGSISVSL

SEQ ID NO: 162753 - protein, 160 aa, Glycine max
  Coding DNA Sequence Number=SeqID_45975
  Gene Ontology: Mol. function=transcription regulator activity; Cellular component=nucleus; Biological process=regulation of transcription
  Homolog annotation: Hit_ID=Q1PF17; Match level="QueryCoverage=85%, HitCoverage=46%, E-value=4e-27, Identity=44%"; Hit description=Basic helix-loop-helix family protein
MDKAHVLREAINYVKQLQERIEELEEDIRKNGVESAITIIRSHLCIDDDSNTDEECYGPNEALPEVEARVLGKEVLIKIYCGKQKGILLKIMSQLERLHLYISTSNVLPFGNTLDITITAQMGDKYNLVVNDLVKELRQVAMMNDLGVYGKLKEMSPFLM

SEQ ID NO: 162754 - protein, 250 aa, Glycine max
  Coding DNA Sequence Number=SeqID_45976
  Gene Ontology: Mol. function=metal ion binding; Cellular component =cytosol; Biological process=ubiquitin cycle
  Homolog annotation: Hit_ID=Q6H890; Match level="QueryCoverage=31%, HitCoverage=24%, E-value=4e-22, Identity=64%"; Hit description=BRAP2- like protein
  Pfam annotation: Domain name=zf-UBP; Domain location=1-49; Score =26.0; E_value=0.00014; Accession=PF02148.9; Description=Zn-finger in ubiquitin-hydrolases and other protein
YKGGHAIIHWKETHHCYSLEVETKPVWDYVGDNYVHRLIQSKTDGKLVELNTRCAHADNECGSCSCEDNAMNEAILNNCRKINLVVCSIPRFILSMSRMNCLLLNLSVLHLSFTVNLPTLSFESLLQEVKEESERKISKAVQKAISLKQQKIQSKIDRCKKEKKFLDDLNENLVKNEDIWKTKILAIEERELGDLMVCLEGGKTVEQLPVSDEITEGIVLVKSKESSTTSGSDLIYRNYTRGFTVDMFSL

SEQ ID NO: 162755 - protein, 466 aa, Glycine max
  Coding DNA Sequence Number=SeqID_45977
  Gene Ontology: Mol. function=metal ion transporter activity; Cellular component=membrane; Biological process=metal ion transport
  Homolog annotation: Hit_ID=Q1RW15; Match level="QueryCoverage=89%, HitCoverage=87%, E-value=1e-110, Identity=54%"; Hit description=Mg2+ transporter protein, CorA-like
  Pfam annotation: Domain name=CorA; Domain location=9-439; Score =299.5; E_value=6.4e-87; Accession=PF01544.9; Description=CorA-like Mg2+ transporter protein
MRRKGVGTTGVKSWMVVSETGHARLEDVGKHSIMRRTGLPARDLRVLDPVLSYPSSILGRERAIVVNLEHVKAIITASEVLLINSSNPFFLSFLQDLHIRLSNLNPSSMSNDMDGGYEEKPLANDSRNGSPVRIPEDSDADFLVRADSLKSSAETGTGTGTGTPAPKPLPFEFKVLEACIESACRCLESESLCICKGKTAYNIPPPYLPSPIPSHSEEPLDNGTSTLEVEAYPALDELTSQLSTLNLERVRQIKSRLVALSGRVQKVADELEHLLDDDNDMAEMYLTDKLNARLCDQTSLKEGYNSEFEDNDQSDESNSEKYDRFLCPKLDVEELEMLLEAYFEQTNGILQRLTSLSEYVDDTEDYINIMLDDKQNELLQAAIIFDTINMILNAGIVVVGLFGMNIQIDLFNGQPRQFWATTGGTFGGCLLLFLISLITFGIPAINGENRNHLQPACYKLLITQGF

SEQ ID NO: 162756 - protein, 85 aa, Glycine max
  Coding DNA Sequence Number=SeqID_45978
MKKTKGKITYDSIGGIVAATTSPSRFDAASDDLSASWFLWKVVSAEKREGGGFGKKFRHQSADKNQTRSDKELRGHEWLQASLQQ

SEQ ID NO: 162757 - protein, 99 aa, Glycine max
  Coding DNA Sequence Number=SeqID_45979
  Gene Ontology: Biological process=response to desiccation
  Homolog annotation: Hit_ID=O81366; Match level="QueryCoverage=51%, HitCoverage=19%, E-value=6e-13, Identity=71%"; Hit description=Late embryogenesis-like protein
MVREVPTSTFVACSIMRPKDFCSALWHMIRGRGKGYTMKGHIHVDTTFGAMKLPISKEGDVVPLELLNGEEEELRRCATLKEKMSQEKAHHHRKPWIRA

SEQ ID NO: 162758 - protein, 97 aa, Glycine max
  Coding DNA Sequence Number=SeqID_45980
MGSPSAGYVLGQLIGARDESKGLDEGGDTGLGQYCCCWCNKGNRGNNLGWEFCGQSSIVLSRRREERAGFKPFVGEVPRCLPQFFNWSLYNMLCNFT

SEQ ID NO: 162759 - protein, 170 aa, Glycine max
  Coding DNA Sequence Number=SeqID_45981
MDGLSKKLFKKIEFQLLWSMHKNAMELDLVELTLSRGSIVEATKLDQVELTLPRGSTFEATKLDQVELTLPRGSTAEATKIKRHAFFGPLTSNQLFYGPTKLVSVESVQLFYGPLLLTPILKPPTSSPKVSPSASPTLVISPKISELYEIPRPPSSFPSNSRLLGSPNWR

SEQ ID NO: 162760 - protein, 161 aa, Glycine max
  Coding DNA Sequence Number=SeqID_45982
MLGLYTHFSSKMIENCVNMVPNALLTRKGWFFGRLIGGARADEGRHGGHERVDDHNVEALMSIGRMMEVNTTTVVAASTATEVDPTHPPGFNQVNHLASHMVQNKHSFPPCGLPPNYTPPNVVHAPDENVGNSAPIPIESQQPPSDHAYVSQPTEETHEVP

SEQ ID NO: 162761 - protein, 135 aa, Glycine max
  Coding DNA Sequence Number=SeqID_45983
MDEWSSTLGHGSVYGFLEPQSIHNAKDRRVECQHYIETWVKESQRKVYLGAYLNHQESLNVLVKKKSYKGREQKGHFVDFSRPRLAHASIWLAWATKSLQPRWGRALRVQQVWDRGKNVGRGREEEKRSQGTVKS

SEQ ID NO: 162762 - protein, 172 aa, Glycine max
  Coding DNA Sequence Number=SeqID_45984
  Homolog annotation: Hit_ID=Q1S0J3; Match level="QueryCoverage=28%, HitCoverage=29%, E-value=4e-07, Identity=43%"; Hit description =Dihydrodipicolinate reductase
MEHCLRVSKFSKCLVIGKRHVEWEHGCEASSQPYDAILPRKGPVTRAMGKRLQEDWARAAEEGPRALMNLRESIDEEDPRPTSSNGAYITLSLLLKILLWVFRGDFPKLGHGDHSDLLVDHPVVINGATKEMGKAAVVAVTKACRMEVAGAAVGIVVDFTNPSFVYDNVKQV

SEQ ID NO: 162763 - protein, 53 aa, Glycine max
  Coding DNA Sequence Number=SeqID_45985
MTTKIGQMSVTKGIAGMGWYRHTWSSWKNVKGPKMSRVLVRHRRLKTSRTAYV

SEQ ID NO: 162764 - protein, 137 aa, Glycine max
  Coding DNA Sequence Number=SeqID_45986
MVEREKFDHIGERLRVIEGGRNYAFADMVELCLVPDVVIPLKFKVPDFDKYKGTTCPKNYLKMYCRKMGAYAKDEKLLMHFFLECLIGVAITWYTNLESSQVHSWKDLMVVFIRQYQYNSDMALDRMQLQNMCKREH

SEQ ID NO: 162765 - protein, 150 aa, Glycine max
  Coding DNA Sequence Number=SeqID_45987
MYQSCLTQSQASKHSNTKSRCPKPLNLMDFLGLRSEIEDEHSPSFLISPKRHFELGLTHSNLQIPQNPDLTFQPSRSHSFSTHNTILSPSNPRNLARLPIISPKTPYPRKSKEKEVHPNLKFRSPTRRDELHDSENALLSRFGAEMGTKG

SEQ ID NO: 162766 - protein, 370 aa, Glycine max
  Coding DNA Sequence Number=SeqID_45988
  Pfam annotation: Domain name=zf-CCHC; Domain location=335-352; Score =10.6; E_value=0.018; Accession=PF00098.13; Description=Zinc knuckle
MGYVGVRELSWRWATGDGGFMRALWMWKTRCAPSPDRHLVPHVMEWYLEICRGGQETLGTSGGVLLPKTKLDQSRPNPGIVSQSEPVMYLNRRAPGSQQIKGTKTTKQGGLLENEVVEASGNRLPVCVIDYTEEWVTGNRLPGMKSLEIPLLLACSGHETHCVAVGDGVPRGSLGDPRRQHERTVEWILPTPTPYRLVEPVQVIEVTSSEEDPEEDPEELPPEPAVYALDFLEGDEDPLPEVDSPEEVMSGSEADSTEDSGPREMATREEHVVDVDYGVVCARVSAEKVYDGDAQVQLPMKPDIHFKAAINNAMKTLKTTLDGKTDQAAPQWIMDKCFLCDQAAHFASHCQVEDLDSPDDSLIHINKYEV

SEQ ID NO: 162767 - protein, 177 aa, Glycine max
  Coding DNA Sequence Number=SeqID_45989
  Gene Ontology: Mol. function=transition metal ion binding; Cellular component=cytoplasm; Biological process=DNA integration
MTIVFHTELVDVDIRHDIEDIIHNLGQNDFQQAHATLYEKIENDSKKPLYSGCITFTRLLRVLALVNLKARFGWSIKSFTELLVLLKKVLPENNMLLKNHYEAKKILCPIGMKYQKIYACTNDYILYRNQFIKMRKCPTCGVSHYKVKDKKCSDDATTNNSRPVKLVQDSKEMILMT

SEQ ID NO: 162768 - protein, 606 aa, Glycine max
  Coding DNA Sequence Number=SeqID_45990
  Gene Ontology: Mol. function=magnesium ion binding; Cellular component=chloroplast; Biological process=metabolic process
  Homolog annotation: Hit_ID=Q6EJ97; Match level="QueryCoverage=99%, HitCoverage=99%, E-value=0.0, Identity=80%"; Hit description =Isoprene synthase
  Pfam annotation: Domain name=Terpene_synth; Domain location=75-272; Score=219.4; E_value=8.3e-63; Accession=PF01397.11; Description =Terpene synthase, N-terminal domain
  Pfam annotation: Domain name=Terpene_synth_C; Domain location=277 -550; Score=403.6; E_value=2.8e-118; Accession=PF03936.6; Description= Terpene synthase family, metal binding domain
  Pfam module annotation: Pfam domain module=Terpene_synth::Terpene _synth_C; Domain location=75-272::277-550
  Subcellular localization annotation: CTP_CleavageSite=66; ConfidenceScore=5.67e-01
MATNLILCLSRYNQFLSPTPTLISSTRFPQSKNFPQKTSLANLKPQRLICAVSSQFTQITDDDSRRSANYQPNLWNFEFLPPSLENDHKVEKLEERAKKVEEEVRKVINGIDTKPLLLELIDDVQHLGLTYKFEKDIIKALEKIVSLDENEEHKSELYYTALSFRLLRQHGFEVSQDVFKRFKDKEGGFSGELKGDVQGLLSLYEASYLGFEGDNLLDEARAFSTTHLKNNLKQGINTKEAEQVNHALELPYHRRLQRLEARWYLEKYEPKEPHHQLLLELAKLDFNMVQLLHQKELQELSRWWSEMGLASKLEFARDRLMEVYFWALGMAPDPQFRECRKAVTKMFGLVTIIDDVYDIYGTLDELQLFTDAVERWDVNVVNTLPDYMKLCYLALYNTVNDTAYSILKEKGRNNLSYLKKSWCELCKAFLQEAKWSNNKIVPAFSKYLENASVSSSGVALLAPSYFSVCQEQDISFSDKTLHYLTNFGGLVRSSCTIFRLCNDLTTSAAELERGETTNSIMSYMHENGTSEEHACEELRNLIDIEWKKMNRQRVSDSTLPKAFREIAMNMARVSHNTYQYGDGLGRPDYNIENRIKFLLIDPVPIN

SEQ ID NO: 162769 - protein, 82 aa, Glycine max
  Coding DNA Sequence Number=SeqID_45991
MDEFDAQPSLFGGGGASAAQELKPEEPTTTEGEVELTPPEHFYFDAGVHMTQEEETSTDQLPKPSQVPIPNDAIPSAPTSEL

SEQ ID NO: 162770 - protein, 172 aa, Glycine max
  Coding DNA Sequence Number=SeqID_45992
  Subcellular localization annotation: CTP_CleavageSite=39; ConfidenceScore=5.05e-01
MRVHCNQASRRPSMITDSPPLLMFSRTRVYGPFFQLTVCANSVGVCVHQMNKYLPHAYILKHTKSIKRVYVHKKIRKKDKEKEQKGSHGKQSTLIDWPNSLTIVPSGVTNCRNLPFGGRATRDSRMRLPQKENARSRHQRLFEENVGKTGKRRGLRTLSERFGSCIYARGRY

SEQ ID NO: 162771 - protein, 60 aa, Glycine max
  Coding DNA Sequence Number=SeqID_45993
MERDGLESLIIHGQCIDGARVSYIFLIRRNTCTWGHVTRFGTPSRLRLITVEGGGVACAQ

SEQ ID NO: 162772 - protein, 162 aa, Glycine max
  Coding DNA Sequence Number=SeqID_45994
  Pfam annotation: Domain name=Transposase_23; Domain location=1-71; Score=2.5; E_value=0.00061; Accession=PF03017.5; Description =TNP1ENSPM transposase
MGDSEKCRLNVEENPPRLVSLGRLYEGSRIVHNIPLGNDQLKVGVEEVRDADAHIPIPTQEVQLVGQTLNTFIAWLTHLVKRFSEQGVVGPVKPADRSDHDVDDPLYLMTLTISQLFLKSLQVMWDAIVFGLFDDNFPLHMIETSLRAGNSDVYGFLEPQSI

SEQ ID NO: 162773 - protein, 82 aa, Glycine max
  Coding DNA Sequence Number=SeqID_45995
  Gene Ontology: Mol. function=oxidoreductase activity; Cellular component=proton-transporting two-sector ATPase complex; Biological process=ATP synthesis coupled proton transport
  Homolog annotation: Hit_ID=Q1S835; Match level="QueryCoverage=90%, HitCoverage=20%, E-value=1e-19, Identity=56%"; Hit description=2OG -Fe(II) oxygenase
  Pfam annotation: Domain name=2OG-FeII_Oxy; Domain location=5-76; Score=39.0; E_value=1.6e-08; Accession=PF03171.10; Description=2OG -Fe(II) oxygenase superfamily
MDCAKGHLFFYHCYPLCPEAELTIGTRSHTDPDFLSILLQDHVGGLEVLVHNHWIDMPPISGALVVNIGGLPQFIPLCTVGA

SEQ ID NO: 162774 - protein, 148 aa, Glycine max
  Coding DNA Sequence Number=SeqID_45996
MHPIIDYTPLSTTLGTILINTEEYKISHLRTSTVHHRRVLSHQYLNAKHLLGLSSLIWKSNFSSCRWKRLSMVLNCTYGRGILNIVGNCNSRINNCGVEGCLQDAVYESNTVSLFQHPVQGSHCYASIGSSIKDFLVKNRNSEFQHTL

SEQ ID NO: 162775 - protein, 185 aa, Glycine max
  Coding DNA Sequence Number=SeqID_45997
  Homolog annotation: Hit_ID=Q42777; Match level="QueryCoverage=17%, HitCoverage=4%, E-value=1e-07, Identity=87%"; Hit description =Methylcrotonoyl-CoA carboxylase subunit alpha, mitochondrial precursor
MTPFPPMHALSRMSRCMPFRGGVDGGRARQRDDSDGDHDDDNWEGMESTKLDEAFSVATALVDAAATVDRLSQKVGCSLCFIGNFQETIGARIINNLLLNVAMSEYVPAGVDGKRCLENVVNEAVLLVAHREAKEVRIYNGGFHCAYQVDHHVTEMIVGQDLVEWQILVAIGEDLPLSQSHTFIR

SEQ ID NO: 162776 - protein, 80 aa, Glycine max
  Coding DNA Sequence Number=SeqID_45998
MDEGSLVQALAVYQASLDDKFDVDPSDDASDRGAKPIEELIKLQLEHKPDNPFDILRIHPTIICHKCGVPKIMTGLIVMV

SEQ ID NO: 162777 - protein, 198 aa, Glycine max
  Coding DNA Sequence Number=SeqID_45999
  Gene Ontology: Mol. function=RNA-directed DNA polymerase activity; Biological process=RNA-dependent DNA replication
MSTKGWSFVGVSMENGGEGKSNAPECHHGQKGQRQMVRSTKLPRHLLRMHAPNEEKMTFITEDANFCYRIGQNIEVYVDDMVIKFQSITQHVADLEEVFKELCKYDMFLPKLVEKAKPFYKLLKKIEPFPWDETCEQAFLVLKKTIATSPVLSRPRLGVPLLLYLSVADKVVSLALVQEKWKHQFPIYFTSRILHDAK

SEQ ID NO: 162778 - protein, 123 aa, Glycine max
  Coding DNA Sequence Number=SeqID_46000
MLVWLAVERVVQNEFWLVRFECCFAWMLWKLERIDGDPVLRETRIWATWEYVSSDGGGQQGMSGTWRYVVGVRRPWGRQASSWQSTDKRKTRPQSKEACGGWPAEAKMVSGNRLPRGVIDYQA

SEQ ID NO: 162779 - protein, 40 aa, Glycine max
  Coding DNA Sequence Number=SeqID_46001
MNQNGASMRTGGNGGGVRATRRHGRGVRLMEAVLACKLYF

SEQ ID NO: 162780 - protein, 96 aa, Glycine max
  Coding DNA Sequence Number=SeqID_46002
MEGKKAIQIKRRISFNALKKKLEIRFLVSGKYVAFQICDDEDVETILESFQQQDQMSDMELYIEKDVAGGSMFHSANSLTSCGNNLSNNEAQPPRN

SEQ ID NO: 162781 - protein, 490 aa, Glycine max
  Coding DNA Sequence Number=SeqID_46003
  Gene Ontology: Mol. function=transporter activity; Cellular component= outer membrane; Biological process=transport
  Homolog annotation: Hit_ID=Q7NZA3; Match level="QueryCoverage=50%, HitCoverage=26%, E-value=7e-61, Identity=47%"; Hit description =Probable TonB-dependent receptor
ESAKSYGFGVVWSPLSGLDFSADYYDIRIDNEVTSLDTSRILRDEADCRLGRTLGGEARDIGSPLCQDALSRVIRNPSNATVQPDQVTRVLINPINAASESVRGLDLKGNWRFDAGRYGRFTTRLAYTVVLEHKYRQFSDDPERDIRNSLDDYQWRSKANGSITWNQGDWTTTLYGNRFGSLPKTDGSGRIAPYMTYNASVFRQFGENLSVGVIVNNLRDSRPPADKNGGGWPFYPVGNYDPYGRQYWANERPGIAGLFFVQCTGAAAARVACCGDTRRMMRMDARVWSVIAVLAIAGCSSKQAASVDDAAEAASAAPVPSLSNAVTDAGSARVPTASTRATAGQGPADLEGHFLEGERLLLTEGALSAEKSDVILGSDNAFAQAISQFEQDAAGHPEVQDLTRLYRTAATRLIGSDGTLVSFACGYSLCVGEIRSRTDEDFSAWSEAIGMDKASPVYSLTTAPMTWGRDQHGGRFVFSVDPAANAITGR

SEQ ID NO: 162782 - protein, 171 aa, Glycine max
  Coding DNA Sequence Number=SeqID_46004
  Gene Ontology: Mol. function=sequence-specific DNA binding; Cellular component=intracellular; Biological process=regulation of transcription, DNA-dependent
  Homolog annotation: Hit_ID=Q7MZK9; Match level="QueryCoverage=100%, HitCoverage=77%, E-value=7e-55, Identity=61%"; Hit description =Similar to monoamine regulon transcriptional regulator MoaR
MGFHRGQRNTQLQGDALIAGAFAHQVDDLLLFGGQHLRLAVGQQIARRQLDQRQHRAQAAALHFGKRRIADQRYPGDDALALADEDLRHVAHVVRQHKVVVIAAVAGDRRRAHADHGDVLAMEIGRLQRVYLLEVVQILLMRFIGHAIQDVVIRPQVAIDQIKHPGGHRDQ

SEQ ID NO: 162783 - protein, 52 aa, Glycine max
  Coding DNA Sequence Number=SeqID_46005
MVIFSHGVIAKDKREEHNGSFLGKLGEESFLEKLEGATHTSPIAKLTPCQDA

SEQ ID NO: 162784 - protein, 124 aa, Glycine max
  Coding DNA Sequence Number=SeqID_46006
MESEKAPERTLLNSTGEREMEKSKTRGKREGSRTLPDSTGARKEGRMKDRRVVRFRGESTRLRCTQRCRNVPFCGRAKARLTGALSKGGKMRGVATNVYLWKTSEKPKETGQNENSKFESCIYV

SEQ ID NO: 162785 - protein, 215 aa, Glycine max
  Coding DNA Sequence Number=SeqID_46007
  Gene Ontology: Mol. function=binding; Cellular component=cytoplasm
  Homolog annotation: Hit_ID=Q10PS3; Match level="QueryCoverage=90%, HitCoverage=32%, E-value=2e-45, Identity=48%"; Hit description=HEAT repeat family protein, expressed
HGALIVRRLCVLLNAERVYRELSTILEGETDLDFASIMVQALNLILLTSSELSEIRDLLKQSLVNPAGKDLYVSLYASWCHSPMAIISLCFLAQLLEPGRYIWLFKALYGLLMLLPQQSAAFKILKTRLKAVPSYSFNGEQLKRMPSGDSYQFHNVPDGFRTIQDGDIAEDGGSSRNGINFAARLQQFRQIQHQHRLLSKTGKIVQFFHFIVKGC

SEQ ID NO: 162786 - protein, 550 aa, Glycine max
  Coding DNA Sequence Number=SeqID_46008
  Gene Ontology: Mol. function=transporter activity; Cellular component= integral to membrane; Biological process=transport
  Homolog annotation: Hit_ID=Q9ZU96; Match level="QueryCoverage=98%, HitCoverage=99%, E-value=0.0, Identity=63%"; Hit description =Expressed protein
  Pfam annotation: Domain name=Ank; Domain location=119-149; Score=4.5; E_value=7; Accession=PF00023.20; Description=Ankyrin repeat
  Pfam annotation: Domain name=Ank; Domain location=153-186; Score =19.2; E_value=0.015; Accession=PF00023.20; Description=Ankyrin repeat
  Pfam annotation: Domain name=Ank; Domain location=187-217; Score =26.9; E_value=7.3e-05; Accession=PF00023.20; Description=Ankyrin repeat
  Pfam annotation: Domain name=Ank; Domain location=221-279; Score=9.8; E_value=1.2; Accession=PF00023.20; Description=Ankyrin repeat
  Pfam annotation: Domain name=Ank; Domain location=50-81; Score=3.4; E_ value=10; Accession=PF00023.20; Description=Ankyrin repeat
  Pfam annotation: Domain name=Ank; Domain location=85-117; Score=15.3; E_value=0.19; Accession=PF00023.20; Description=Ankyrin repeat
  Pfam module annotation: Pfam domain module=Ank::Ank::Ank::Ank::Ank::An k; Domain location=119-149::153-186::187-217::221-279::50-81::85-117
MDSNSKAMCFVTHQAIFNAVRCGDLEGLKQQLKNKGAEGVSEVMSMQNDAGETILYIAAEIGLREVFSFLLGLCDMEVLKIRAKSDLNPLHVAAKGGHFDIVREILSTWPEVCKLCNSSNTSPLYFAAVQDHLDVVNAILDVDVSSMMIVRKNGKTALHNAARYGILRIVKALIARDPGIVCIKDRKGQTALHMAVKGQSTSVVEEILQADLTILNERDKKGNTALHMATRKCRPQTVSLSSPPLPTGFKGTGFYFYCIAMIVSLLLTYTALNVNAINNQKETALDLADKLRYGDSALEIKEALTECGAKHARHIGKVDETMELKRAVSDIRHEVQSQLIQNEKTRKRVSGIAKELKKIHREAVQNTINSVTVVAVLFGSIAFMALFSLPGQYRKKQPDAGEANIANDAAFSAFCLLNATALFLSLAVVVAQITLVAWDTRSQRQVVSVINKLMWAACACTCGTFLAISFVVVGDETWLAISVTLLGAPILLGTLAYLCYFVFRRRFGHCSDSQRLVKRPSGSKSFSWSYSVNISDVDDYDSDPMKIYAL

SEQ ID NO: 162787 - protein, 72 aa, Glycine max
  Coding DNA Sequence Number=SeqID_46009
MRTTKGKGRRCLPPSSPRRARLLRPEATAFWRNILDGPSGPERATMPSLTSGMSRNFTNCLMMGAKYLEVVK

SEQ ID NO: 162788 - protein, 93 aa, Glycine max
  Coding DNA Sequence Number=SeqID_46010
MFIPAFALVDGMFIHSVSSLLRASQQWLWVFYYSATHSDEAEPHYRLLLFDTILFSSVAEASLILEPIQGLTKLTWLQLPSEIYMPIMLVHII

SEQ ID NO: 162789 - protein, 432 aa, Glycine max
  Coding DNA Sequence Number=SeqID_46011
  Gene Ontology: Mol. function=1-deoxy-D-xylulose-5-phosphate synthase activity; Cellular component=type II protein secretion system complex; Biological process=terpenoid biosynthetic process
  Homolog annotation: Hit_ID=Q8L692; Match level="QueryCoverage=99%, HitCoverage=60%, E-value=0.0, Identity=84%"; Hit description=1-deoxy- D-xylulose 5-phosphate synthase 2 precursor
  Pfam annotation: Domain name=Transket_pyr; Domain location=110-276; Score=226.4; E_value=6.2e-65; Accession=PF02779.14; Description =Transketolase, pyrimidine binding dom
  Pfam annotation: Domain name=Transketolase_C; Domain location=291 -414; Score=145.1; E_value=1.9e-40; Accession=PF02780.10; Description= Transketolase, C-terminal domain
  Pfam module annotation: Pfam domain module=Transket_pyr::Transketolase _C; Domain location=110-276::291-414
KSITEQIGIRTHQVAAKVDEYARGIISGSACTFVEELGLYYIGPVDGHKIEDLVTIFEKVKAMPAPGPVLIHCVTEKGKGYPPAEKASDKMHGVVKFDPKTGEQFKAKSSTLSYTQYFAESLIKEAENDKKIVAIHAAMGGGTGLNYFHKRFPERCFDVGIAEQHAVTFAAGLAAEGLKPFCAIYSSFLQRGYDQVVHDVDLQKLPVRFALDRAGLVGADGPTHCGAFDITYMACLPNMVVMAPSDEAELMHMVATAAAIDDRPSCFRFPRGNGIGATLPLNNKGTPLEIGKGRILVEGSRIAILGYGSVVQQCRQASEMLKELGVDVTVADARFCKPLDTGLIRLLAKEHEILITVEEGSIGGFGSHVSQFLSLSGILDGPLKWRAMMLPDRYIEHGSPQAQVEDAGLSSKHIAATVLSLMERPKQALLFK

SEQ ID NO: 162790 - protein, 272 aa, Glycine max
  Coding DNA Sequence Number=SeqID_46012
  Gene Ontology: Mol. function=protein transporter activity; Cellular component=type II protein secretion system complex; Biological process=protein secretion by the type II secretion system
  Homolog annotation: Hit_ID=Q5H2I2; Match level="QueryCoverage=100%, HitCoverage=55%, E-value=1e-114, Identity=75%"; Hit description =Fimbrial assembly protein
  Pfam annotation: Domain name=GSPII_F; Domain location=84-207; Score =73.8; E_value=5.5e-19; Accession=PF00482.13; Description=Bacterial type II secretion system protein F domain
MSVSRSAIKKEPVARSTMELQPFVWEGTDKRGIKMKGEQLAKNANMLRAELRRQGINPGQVKPKPKPLFGAAGKAVTSKDVAFFSRQMATMMKSGVPIVSALEIIGSGHKNPRMKKMVDGIRTDIEGGSSLHEAISKHPVQFDELYRNLVRAGEGAGVLETVLDTVASYKENIETLKGKIKKAMFYPAMVLVVALLVSSILLIWVVPQFEEVFKSFGADLPAFTQMVVNLSRFMVSWWWLMLIALIGAIVGTFMFYKRSPKMQHTVDRLILK

SEQ ID NO: 162791 - protein, 384 aa, Glycine max
  Coding DNA Sequence Number=SeqID_46013
  Gene Ontology: Mol. function=glycine hydroxymethyltransferase activity; Cellular component=mitochondrion; Biological process=L -serine metabolic process
  Homolog annotation: Hit_ID=Q45FE6; Match level="QueryCoverage=90%, HitCoverage=65%, E-value=1e-161, Identity=82%"; Hit description =Serine hydroxymethyltransferase
  Pfam annotation: Domain name=SHMT; Domain location=1-320; Score =461.8; E_value=8.5e-136; Accession=PF00464.10; Description=Serine hydroxymethyltransferase
  Subcellular localization annotation: CTP_CleavageSite=32; ConfidenceScore=5.09e-01
MNNFLTAQYHHKTPYLTSNNHSLAIPLALFFNCSNTDTKKISAVSIFFETMPYRLNESTGYIDYDQVGEEEVVGEDWGHQAMWTCMKGVWSLEKSAVLFRPKLIVAGASAYARLYDYARVRKVCDKQKAVLLADMAHISGLVAADVVTTTTHKSLRGPRGAMIFFRKGVKEINKQGKEVLYDYEDRINQAVFPGLQGGPHNHTISGLAVALKQAMTPEFKNYQKQVLSNCSAFAQSLLEKGYELVSGGTDNHLVLVNLRNKGIDGSRVEKVLEAVHIAANKNTVPGDVSAMVPGGIRMGTPALTSRGFVEEDFEKVAEYFDAAVKLALQIKENTNGTKLKDFVAAMQSDEQVQSKIANLRHEVEDYAKQFPTIGFDIETMKYGK

SEQ ID NO: 162792 - protein, 213 aa, Glycine max
  Coding DNA Sequence Number=SeqID_46014
VHNVSIVIDQSLFFSLTKLPSERVPFEGTLVDDWKFDYSSHDARRMVCNDQADMTGKLLVGSLTFDCRIMHYIIVRILLPRSSNLAQAFEEDLILMWAFLTGRQIDWAHLIRYRMHKALRANAPLPYPHLVTLFLHHFKIALEDEPFVQVKRSFAIGVGAVISFSYRKDDDGQWVRKQDLPQPIHDERTLSPPPQRVDSSSLLNDVLSEFHNL

SEQ ID NO: 162793 - protein, 328 aa, Glycine max
  Coding DNA Sequence Number=SeqID_46015
  Gene Ontology: Mol. function=transferase activity; Cellular component= mitochondrion; Biological process=metabolic process
  Homolog annotation: Hit_ID=Q6Z7E0; Match level="QueryCoverage=96%, HitCoverage=83%, E-value=5e-44, Identity=32%"; Hit description =Putative pentatricopeptide (PPR) repeat-containing protein
  Pfam annotation: Domain name=PPR; Domain location=157-191; Score =34.2; E_value=4.6e-07; Accession=PF01535.11; Description=PPR repeat
  Pfam annotation: Domain name=PPR; Domain location=195-229; Score =38.8; E_value=1.9e-08; Accession=PF01535.11; Description=PPR repeat
  Pfam annotation: Domain name=PPR; Domain location=230-264; Score =39.7; E_value=9.9e-09; Accession=PF01535.11; Description=PPR repeat
  Pfam annotation: Domain name=PPR; Domain location=24-58; Score=35.4; E_value=1.9e-07; Accession=PF01535.11; Description=PPR repeat
  Pfam annotation: Domain name=PPR; Domain location=265-299; Score=6.9; E_value=1.1; Accession=PF01535.11; Description=PPR repeat
  Pfam annotation: Domain name=PPR; Domain location=59-93; Score=34.7; E_value=3.2e-07; Accession=PF01535.11; Description=PPR repeat
  Pfam annotation: Domain name=PPR; Domain location=94-128; Score=12.7; E_value=0.23; Accession=PF01535.11; Description=PPR repeat
  Pfam module annotation: Pfam domain module=PPR::PPR::PPR::PPR::PPR::PP R::PPR; Domain location=157-191::195-229::230-264::24-58::265-299::59- 93::94-128
VGKAELAVELLEEMCYKGLKPDLITCTSVVGGLSREGKVHEAIKFFHYLKGFGIKPNAFIYNSIMMGLCKAQQTSLAIDFLVDMVANGCKPTEASYTTLIKGITYEGLAEEASKLSNELYSRGLVKKSLIVKGESKLKQGVVVLDRQLQSKCYPDVVTCTELIDAACKESGVGQAMKLLIEMMSKGCKPNVLDVISYTIILHSLCSGGKWMDAMKLLASMLRNGFSPNVVTFNTLINFLCLKGLLGKALNVLEMMPKHGCTPNFRSYNPLIEGFCNEKSADRTIEYSRIMVGKTVHVVVLFEEMCRKGLELDIITYSVIIDVQQGSEA

SEQ ID NO: 162794 - protein, 83 aa, Glycine max
  Coding DNA Sequence Number=SeqID_46016
MEKSSSTRRTSLLSCWGCLKLKLPWTRRTSTYKPVGGFGYDPLSYAQNFDEGCMDDEEDEPTSRRRFSDRFAAPVSSSTKTLK

SEQ ID NO: 162795 - protein, 204 aa, Glycine max
  Coding DNA Sequence Number=SeqID_46017
DGIIYSEVHNVSIVIDQSLFFSLTKLPSERVPFEGTLVDDWKFDYSSHDARRMVCNDQADMTGKLLVGSLTFDCRIMHYIIVRILLPRSSNLAQAFEEDLILMWAFLTGRQIDWAHLIRYRMHKALRANAPLPYPHLVTLFLHHFKIALEDEPFVQVKRSFAIGAGAVISFSYRKDDDGQWVRKQDLPQPIPDEHTLSPPPEGG

SEQ ID NO: 162796 - protein, 92 aa, Glycine max
  Coding DNA Sequence Number=SeqID_46018
MRQANSETCSNCLNDSQNLSIHDNNTTPRANFHIVTSLEGKSGESEGFTYPVGEEVALRQRLCVSLGRQQRVQCSYIAPSLSGIGFRSSASV

SEQ ID NO: 162797 - protein, 407 aa, Glycine max
  Coding DNA Sequence Number=SeqID_46019
  Gene Ontology: Mol. function=helicase activity; Cellular component =mitochondrion; Biological process=metabolic process
  Homolog annotation: Hit_ID=Q6Z7E0; Match level="QueryCoverage=85%, HitCoverage=89%, E-value=2e-94, Identity=34%"; Hit description =Putative pentatricopeptide (PPR) repeat-containing protein
  Pfam annotation: Domain name=PPR; Domain location=105-139; Score =18.5; E_value=0.024; Accession=PF01535.11; Description=PPR repeat
  Pfam annotation: Domain name=PPR; Domain location=172-206; Score =19.3; E_value=0.014; Accession=PF01535.11; Description=PPR repeat
  Pfam annotation: Domain name=PPR; Domain location=207-241; Score =42.2; E_value=1.8e-09; Accession=PF01535.11; Description=PPR repeat
  Pfam annotation: Domain name=PPR; Domain location=242-276; Score =42.0; E_value=2e-09; Accession=PF01535.11; Description=PPR repeat
  Pfam annotation: Domain name=PPR; Domain location=277-311; Score =30.7; E_value=5.3e-06; Accession=PF01535.11; Description=PPR repeat
  Pfam annotation: Domain name=PPR; Domain location=312-346; Score =41.2; E_value=3.5e-09; Accession=PF01535.11; Description=PPR repeat
  Pfam annotation: Domain name=PPR; Domain location=347-381; Score =29.6; E_value=1.1e-05; Accession=PF01535.11; Description=PPR repeat
  Pfam module annotation: Pfam domain module=PPR::PPR::PPR::PPR::PPR::PP R::PPR; Domain location=105-139::172-206::207-241::242-276::277 -311::312-346::347-381
MACKSHVFGLSGGVIDFRKPKGTWSRKHLGNCVFAVSKYENSGLKGNLQHSERFSKGALNGVNTSLNFEESEIHHLCRLIRNGELEEGSRFLEYMTNKGKIPDVVACTALIREFCKIGRTKNATRIMGILEESGAVIDANSYNVLINAYCKSGEIEEALRVLDHTSVAPNAATYDAVLCSLCDRGKLKQAMQVLDRQLQSKCYPDVVTCTVLIDATCKESGVGQAMKLFNEMRGKGCKPDVVTYNVLIKGFCKEGRLDEAIIFLKKLPSYGCQSDVISHNMILRSLCSGGRWMDAMKLLATMLRKGCFPSVVTFNILINFLCQKGLLGKALNVLEMMPKHGHTPNSRSFNPLIQGFCNRKGIDRAIEHLEIMVSRGCYPDIVTYNILLTALCKDGKVDDAVVILSQL

SEQ ID NO: 162798 - protein, 43 aa, Glycine max
  Coding DNA Sequence Number=SeqID_46020
MQSHLWGWCKGRGCLHLDGGYNLFIGGGTEDMATCIGEVIRVA

SEQ ID NO: 162799 - protein, 191 aa, Glycine max
  Coding DNA Sequence Number=SeqID_46021
  Gene Ontology: Mol. function=nucleic acid binding; Cellular component= contractile ring; Biological process=protein amino acid autophosphorylation
  Homolog annotation: Hit_ID=Q9FNZ1; Match level="QueryCoverage=87%, HitCoverage=43%, E-value=2e-36, Identity=43%"; Hit description=Zfwd2 protein
  Pfam annotation: Domain name=WD40; Domain location=17-53; Score=36.3; E_value=1e-07; Accession=PF00400.22; Description=WD domain, G-beta repeat
  Pfam annotation: Domain name=WD40; Domain location=57-93; Score=31.9; E_value=2.3e-06; Accession=PF00400.22; Description=WD domain, G-beta repeat
  Pfam module annotation: Pfam domain module=WD40::WD40; Domain location=17-53::57-93
DGVIFAWRGSSKADSPFELVVSLTGHTKAVVCLAVGCKMLYSGSMDQSIKVWDMDTLQCTMTLNDHTDVVTSLICWDQYLLSSSSDRTIKVWACIEAGSLEKDVALIELCPGGLFFTGDESGLLMVWKWLEKDVALIELGPGGLFFTGDESGLLMVWKWLEKDVALIELGPGGLFFTGDESGLLMVWKWLE

SEQ ID NO: 162800 - protein, 276 aa, Glycine max
  Coding DNA Sequence Number=SeqID_46022
  Subcellular localization annotation: CTP_CleavageSite=65; ConfidenceScore=5.14e-01
MAWVTGDPLGFISEFTAQTNKSSLSPSASRGNRWDNTTPMLKGNTCQEDATLGTSNHFHTISKPLSSPVKKRPPGPNSINATSFFDNDRKNLKTDFITNHVTYNMNLLLRQINSSLSPSASRGNRWDNTTPMLKGNTCQEDATLGTSNHFHTISKPLSSPVKKRPPGPNSINATSFFDNDRKNLKTDFITNHVTYNMNLLLRQINSSLSPSASRGNRWDNTTPMLKGNTCQEDATLGTSNHFHTISKPLSSPVKKRPPGHNSINATSFLANKRPKK

SEQ ID NO: 162801 - protein, 144 aa, Glycine max
  Coding DNA Sequence Number=SeqID_46023
  Gene Ontology: Mol. function=sequence-specific DNA binding; Cellular component=nucleus; Biological process=regulation of transcription, DNA-dependent
  Homolog annotation: Hit_ID=O04061; Match level="QueryCoverage=71%, HitCoverage=44%, E-value=6e-32, Identity=68%"; Hit description=MADS -box protein
  Pfam annotation: Domain name=K-box; Domain location=6-88; Score=47.4; E_value=4.8e-11; Accession=PF01486.8; Description=K-box region
  Pfam annotation: Domain name=Rho_N; Domain location=30-73; Score=6.5; E_value=0.086; Accession=PF07498.2; Description=Rho termination factor, N-terminal doma
  Pfam module annotation: Pfam domain module=K-box::Rho_N; Domain location=6-88::30-73
MTTGDGGGRTAVVTRSDAKLILNMKMMGEELSGLTVKELQNLENQLEISLHGVRMKKDQLLMGEIQELNRKGNLIHQENVELYKKVYGTQDDNETNRDSVLTNGLGIGEDLQVPVNLQLSQPQQQQQHYKASSGTTKLGRLQLH

SEQ ID NO: 162802 - protein, 232 aa, Glycine max
  Coding DNA Sequence Number=SeqID_46024
  Homolog annotation: Hit_ID=Q6D9F8; Match level="QueryCoverage=39%, HitCoverage=57%, E-value=9e-22, Identity=52%"; Hit description =Putative exported protein
  Pfam annotation: Domain name=LTXXQ; Domain location=135-157; Score =24.3; E_value=0.00042; Accession=PF07813.3; Description=LTXXQ motif
  Pfam annotation: Domain name=LTXXQ; Domain location=208-230; Score =23.7; E_value=0.00067; Accession=PF07813.3; Description=LTXXQ motif
  Pfam module annotation: Pfam domain module=LTXXQ::LTXXQ; Domain location=135-157::208-230
GSGARPFEAGGDAGQATDFRRFHGAERHRDVGFAFNGGQLQGIAVKRQPPVGALGAEVGVKKLRALVCGHDDSSKEHGRPAERENIGSCDAGTDFPRYRKTVDARLPCRRVNYSDTTAPAADAAPMKMMHHKGEGKGGPFAGLNLTEQQRQQMRDIMKEWHQKRGPGMKEERQALHNLVASDSFDEAKAKAQIDAIGKAQSERMLERAKAENKMYNLLTPEQKKQYNENYQK

SEQ ID NO: 162803 - protein, 183 aa, Glycine max
  Coding DNA Sequence Number=SeqID_46025
  Gene Ontology: Mol. function=transcription factor activity; Biological process=regulation of transcription, DNA-dependent
  Homolog annotation: Hit_ID=UPI00005F8955; Match level="QueryCoverage =94%, HitCoverage=79%, E-value=1e-56, Identity=65%"; Hit description =COG1309: Transcriptional regulator
  Pfam annotation: Domain name=TetR_N; Domain location=1-40; Score =10.5; E_value=0.016; Accession=PF00440.13; Description=Bacterial regulatory proteins, tetR family
MALYDEGAFPSITELAAYAQVSRATAYRYFPTQSALISAVVAESLGPILEWRPQDDDALKRIQQLLTFAYPQMERHEGALRAALQLSLQQWAHATPGEKFVRGNRKRLLALAVEPLQGKLPPDSLQRVIHAFSLIYGSEVFLVLKDIWGLELESIQDVTQWMAKAILRQAEEDATNRKKTSAG

SEQ ID NO: 162804 - protein, 76 aa, Glycine max
  Coding DNA Sequence Number=SeqID_46026
  Gene Ontology: Mol. function=acid phosphatase activity; Cellular component=intracellular; Biological process=translation
  Homolog annotation: Hit_ID=O49855; Match level="QueryCoverage=83%, HitCoverage=24%, E-value=1e-28, Identity=93%"; Hit description=Acid phosphatase
  Pfam annotation: Domain name=Acid_phosphat_B; Domain location=1-76; Score=-54.7; E_value=0.00051; Accession=PF03767.5; Description=HAD superfamily, subfamily IIIB (Acid
MALPKAMNREKTKKTNMNTSEYHGKTAVTYKSTERKKLEEKGYKIIGNIGDQWSDLLGTNTGDRTFKLPDPMYYIS

SEQ ID NO: 162805 - protein, 66 aa, Glycine max
  Coding DNA Sequence Number=SeqID_46027
MEKSDKRNFKEKKEKKAYITWEDNDMDSSSDSKKEIINLGLMAKNCESREEILYLKNKDVFLIRLN

SEQ ID NO: 162806 - protein, 92 aa, Glycine max
  Coding DNA Sequence Number=SeqID_46028
MKIKTNHEDKLFEIVCSSKRQVMNHQKLIGFDQLHKDGYQRFFDKERKDIATTVVIFPRLRRSHKYLYINMSHKGMTTNYKEKVYVRTYTVM

SEQ ID NO: 162807 - protein, 75 aa, Glycine max
  Coding DNA Sequence Number=SeqID_46029
MSLLSLIIVFPLLLPKTLSFSRSPQNLSQKNDDLGLIHCWIIVKFEYHICNPIPSIATVGNLKIMSELREKPFAL

SEQ ID NO: 162808 - protein, 83 aa, Glycine max
  Coding DNA Sequence Number=SeqID_46030
MTLCSEQMHSSSFFQILPRAQLRSVALNGWLAKSEDWLSERMKISTSQTFLINLKLRGNDEINGDVEKEEEVVLDFTIHDSNV

SEQ ID NO: 162809 - protein, 164 aa, Glycine max
  Coding DNA Sequence Number=SeqID_46031
  Gene Ontology: Mol. function=nucleic acid binding; Cellular component= intracellular; Biological process=chromatin modification
  Homolog annotation: Hit_ID=Q39261; Match level="QueryCoverage=73%, HitCoverage=68%, E-value=5e-18, Identity=45%"; Hit description=Zinc finger protein 2
  Pfam annotation: Domain name=zf-C2H2; Domain location=48-70; Score =20.4; E_value=0.0063; Accession=PF00096.16; Description=Zinc finger, C2H2 type
MNFHNPNYSLHLRQPDDENHLNLDLLLEPSSSSSSSPSPISPVEPRIFSCNYCQRKFYSSQALGGHQNAHKLERTLAKKSRELSSNMQSYGSPEQRSNFGASHHLGRALGVVDNQGQSYARLGGRKEFSYGSKEGVGVASSWSRGYTSEHVQEDMGQLDLSLRL

SEQ ID NO: 162810 - protein, 94 aa, Glycine max
  Coding DNA Sequence Number=SeqID_46032
MVSSALPKADPPIFTNYVYVWIIRGAIRMLEKQQYPCFYGEAASEFVLLQVYQRTEHTLCPCPKISMGKLDGANYDTWASHIKLWLKGEGYVDH

SEQ ID NO: 162811 - protein, 99 aa, Glycine max
  Coding DNA Sequence Number=SeqID_46033
MRRPPGLMRGAEKDTKFTIVVEEMQGMCVKNEQRRLQKQKKLAEYSKKIPGTMKGKGHVSLFIWRDGKGRLLNKESTGHDPVKNPDISMPFVRESDTSV

SEQ ID NO: 162812 - protein, 87 aa, Glycine max
  Coding DNA Sequence Number=SeqID_46034
  Gene Ontology: Mol. function=sequence-specific DNA binding; Cellular component=nucleus; Biological process=regulation of transcription, DNA-dependent
  Homolog annotation: Hit_ID=O49351; Match level="QueryCoverage=70%, HitCoverage=26%, E-value=5e-24, Identity=90%"; Hit description=ANR1 , MADS-box protein
  Pfam annotation: Domain name=SRF-TF; Domain location=9-59; Score =100.8; E_value=4.1e-27; Accession=PF00319.9; Description=SRF-type transcription factor (DNA-binding and dimerisation domain)
MGRGKIVIRRIDNSTSRQVTFSKRRNGLLKKAKELAILCDAEVGVMIFSSTGKLYDFASSRSGVFFKDAVALEIRTVVLDEKNRCVE

SEQ ID NO: 162813 - protein, 91 aa, Glycine max
  Coding DNA Sequence Number=SeqID_46035
  Subcellular localization annotation: CTP_CleavageSite=52; ConfidenceScore=5.79e-01
MRFTLLSRAPVPFLSAAFLKFKPVAPSTATFTRVSCMAASPSSAAVRDGAPSASSAIDFLSICHRLKVLLRKPALYFEVMYLFVSQKCRRS

SEQ ID NO: 162814 - protein, 107 aa, Glycine max
  Coding DNA Sequence Number=SeqID_46036
MPSKKMKVEVDADGYNFITRLKNLPIINETIYERDFQDHVISVMLKRQLLKKAQAEVAAKDVDNNIVNEVIIDLTNTGVLDEDPEVSKAVKDDGVMHTSEKKEPTSK

SEQ ID NO: 162815 - protein, 61 aa, Glycine max
  Coding DNA Sequence Number=SeqID_46037
MALGVMAARLGELLLQPEVTLLAQASSRGYVGGGEDGDGGVGSTGAAGTLIDGGWSIASGC

SEQ ID NO: 162816 - protein, 119 aa, Glycine max
  Coding DNA Sequence Number=SeqID_46038
  Gene Ontology: Mol. function=nucleic acid binding; Cellular component= intracellular
  Homolog annotation: Hit_ID=Q8L7A5; Match level="QueryCoverage=55%, HitCoverage=34%, E-value=9e-20, Identity=60%"; Hit description =Expressed protein
MEAVSDQDTSICTHCDRAIPAANIDLHYAHCSRKLEKCKVCGDMVPRKNAEDHYLRTHAPSGILNCLILMSSSKIKFVGNSSREKLQIVAFRFFLAIDVKQTPDAHMQVTANTVSDAVS

SEQ ID NO: 162817 - protein, 141 aa, Glycine max
  Coding DNA Sequence Number=SeqID_46039
MVTKGWSFVGASMVEEEEGMATTCHLSHFEWNKKGPPFSLDVTYAQPQEEGKNLTFEMLKSCLGLRAISLVPVPRVSLHPSGPVSENRQYVYQNAQNETPSVVQRMSHMGSKSTLRLMRTLGPSLGSLAQSTWSLLSNALA

SEQ ID NO: 162818 - protein, 89 aa, Glycine max
  Coding DNA Sequence Number=SeqID_46040
MASKLLCDFGMEMLSLIIPVPATKAGSFISMALNVREAEREQGARRRPPLPPQNDFSTKRLLFTIAITGIAVILGSFFLQKKAESSDVH

SEQ ID NO: 162819 - protein, 434 aa, Glycine max
  Coding DNA Sequence Number=SeqID_46041
  Homolog annotation: Hit_ID=UPI00005DC1AF; Match level="QueryCoverage =36%, HitCoverage=36%, E-value=8e-49, Identity=55%"; Hit description =lyase
  Pfam annotation: Domain name=Rhamnogal_lyase; Domain location=210 -397; Score=176.0; E_value=9.1e-50; Accession=PF06045.2; Description =Rhamnogalacturonate lyase family
MIQTCKLTLEGAGGKFSHDMKAIQHQVSEDQKLLREKLLHLSGVAGIDRMEYALSETRSTYFGVKDDGSPVGSPMILSMPTSPTPLSTTASSSETNISYESNDRASRVVRSLFKETNTSPGESNFSSPRTSSDSQLGTSSEKLLVENEVLVNEFLHEHHYSVIDEFDVSDHIQNNVEGKIKQTMEKAFWDGIMENEAGVVGLASFSSHDMGTVAWVEYVLYIICNIGVSRELSIYRCGQRALDFQRRWLQRRVMTNVERYWDVVWSEARSIGTIETFERIVGTSFNVVSENEEQVEISFTRKWNPSLKGKRAPLNIDKRYAMLRNSTGFYSYAIFEHLKEWPAFNIPQIRIVYKLRKDKYGIYASPNDRSRKRGKKQVPPEAVLLVNPVEPEFKGEVDDKYQYSSEIKDLMVHGWISSQSETDPAMVLGNHTQQ

SEQ ID NO: 162820 - protein, 98 aa, Glycine max
  Coding DNA Sequence Number=SeqID_46042
MSPLSLPSPFHYHSSSKKQRNLLMKKILGLQAPMELTSLPLVLHFSRLIGDGGNYLFLCHRCCSIYSGFLRSRRCLLLSISLPLPWNKWDILIILNLT

SEQ ID NO: 162821 - protein, 71 aa, Glycine max
  Coding DNA Sequence Number=SeqID_46043
MPNIVNLMCFNFSFSEACALSKNHALSEALSPLSELGESGGEHEKHLHTQHVFSSLNEAFVSSCAKCAQLA

SEQ ID NO: 162822 - protein, 66 aa, Glycine max
  Coding DNA Sequence Number=SeqID_46044
  Gene Ontology: Mol. function=RNA polymerase II transcription factor activity; Cellular component=transcription factor TFIIA complex; Biological process=transcription initiation from RNA polymerase II promoter
  Homolog annotation: Hit_ID=Q39236; Match level="QueryCoverage=89%, HitCoverage=56%, E-value=3e-24, Identity=95%"; Hit description =Transcription initiation factor IIA gamma chain
  Pfam annotation: Domain name=TFIIA_gamma_N; Domain location=2-50; Score=129.4; E_value=1e-35; Accession=PF02268.7; Description =Transcription initiation factor IIA, ga
MATFELYRRSTIGMCLTETLDEMVQNGTLSPELAIQVLVQFDKSMTEALETQVKSKVSIKLGLEVT

SEQ ID NO: 162823 - protein, 129 aa, Glycine max
  Coding DNA Sequence Number=SeqID_46045
  Homolog annotation: Hit_ID=Q39236; Match level="QueryCoverage=26%, HitCoverage=32%, E-value=3e-11, Identity=85%"; Hit description =Transcription initiation factor IIA gamma chain
  Pfam annotation: Domain name=TFIIA_gamma_C; Domain location=2-48; Score=47.9; E_value=3.3e-11; Accession=PF02751.5; Description =Transcription initiation factor IIA, gamma subunit, beta-barrel domain
MGHLHTYRFCDNVWTFILQDALFKNEDSQENVGRVINDAILRIPLGNWMSLLSSFKCILFYSSVSTSYASLKFLMHPASTYNHQTPLLQPPNVTSTPHQTHHCVATQPPQSPCDPRPCARSHHSHIVTN

SEQ ID NO: 162824 - protein, 110 aa, Glycine max
  Coding DNA Sequence Number=SeqID_46046
MTHADIQSSNNLLRFPFLVKILYKQRATKDVPSLVLFEQPSKCTLYLKQTTKDVPSLVFTITTKKLVASYTEFSDGRRKEEEEEKNRRIAQFLFLQNFPFFKEILNKNLE

SEQ ID NO: 162825 - protein, 52 aa, Glycine max
  Coding DNA Sequence Number=SeqID_46047
MGTWGKGNLPRRAGASPGELEIKVRTLSPVKEKGEDFESCESKSKDFESCER

SEQ ID NO: 162826 - protein, 92 aa, Glycine max
  Coding DNA Sequence Number=SeqID_46048
MTPTHDVLLYYNGRWNMPRQHDFVGCTINGLKDVIKQVAPQGIPPYGIHESQMARRFFLQPGHYEYSDKVIKFKIIDLKTDDDMLKVLVRSN

SEQ ID NO: 162827 - protein, 79 aa, Glycine max
  Coding DNA Sequence Number=SeqID_46049
ASCMRGNSSAGDLAPLDLEIEATCWRNNAERRRKALQERTVQPSAEGTHSSESSSAFPADLRESEVGASEAHIMADEPP

SEQ ID NO: 162828 - protein, 100 aa, Glycine max
  Coding DNA Sequence Number=SeqID_46050
MEKELRMLEMVLEERRRRNDIFPKLLGLQGSKHTSEKCSREWKLRAYSRHLLKDPNDPTVNEGWEAFLSRQLHVASLRSFIKRLPRGFFEKLSQETSLRS

SEQ ID NO: 162829 - protein, 194 aa, Glycine max
  Coding DNA Sequence Number=SeqID_46051
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=100%, E-value=1e-29, Identity=28%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GGPLGTSTLTLRGLHALAIRGLHVLTFRGLHVLVFRGLHALTFRGLHILTFRGLHVVVFKGLFALAFRGLHALTFRGLHVLPFRGLHALAFRGLHVLTFKGLHALAISGLHGLTFRGLHVLTFRGLHALAFRGLHALAFKGRHVLNFRGLHALAFRGLHTLTFKGRHVLNFRGLHALAFRGLCSSLSVGSISTP

SEQ ID NO: 162830 - protein, 470 aa, Glycine max
  Coding DNA Sequence Number=SeqID_46052
  Homolog annotation: Hit_ID=Q1S2L0; Match level="QueryCoverage=33%, HitCoverage=54%, E-value=2e-16, Identity=35%"; Hit description =Ribonuclease H
  Pfam annotation: Domain name=RnaseH; Domain location=312-439; Score= -7.6; E_value=0.00029; Accession=PF00075.14; Description=RNase H
  Pfam annotation: Domain name=TB2_DP1_HVA22; Domain location=7-105; Score=26.6; E_value=1e-07; Accession=PF03134.9; Description=TB2DP1, HVA22 family
  Pfam module annotation: Pfam domain module=RnaseH::TB2_DP1_HVA22; Domain location=312-439::7-105
  Subcellular localization annotation: CTP_CleavageSite=34; ConfidenceScore=5.25e-01
MGWIEAIYTLLTKSFTVLSWPPVSFLCPLLVSVRAMESDSRSSNQRCLAFWVLFSLCMIVEGELSVLFNCLPWWPHVKSIATILLLIPYVGAAPYVYKFLTRHYCTWSLFTRTSNIYSEKSTHLESDEDSKLVDVSDQKTSQIQEKKLEAYQILVSSFYRSIFMPLQQITVNFSEKSRHLESDEDSKLFDVSDQTITTSQIEEKKLEAYQETDDTTGCGKTESSYTSLTSKNLIQKEWSCALCQISTTNENFLRAHLKGRKHKDKENELRVELSSTQKRIKGMVLLTNLNQIANILDPVSRSIRWCEWTKPEFGWTKLNTDGSIHSNTASFGGLLRDYRGEPICAFVSKAPQGDIFLAELWAMWRGLVLSLGLGIKAIWVESDSMSVVKTVNRKQFCPKAVGYLKQIWKLLKKFDKYQISHTWRQTNRAADHLAKMDLLANDVVLWPVDFPPSLCSIIKDDAKGTKYLRR

SEQ ID NO: 162831 - protein, 37 aa, Glycine max
  Coding DNA Sequence Number=SeqID_46053
MVIQIVMWELDKLKGDELMRDDLTSIVMGTTVETRRV

SEQ ID NO: 162832 - protein, 67 aa, Glycine max
  Coding DNA Sequence Number=SeqID_46054
MKTAHKCGSRRKQILFSNEYDSNPKRVSPTLAADAGTVHRRGRATGASGVFLKKAVSDEAIRFLEMN

SEQ ID NO: 162833 - protein, 90 aa, Glycine max
  Coding DNA Sequence Number=SeqID_46055
MEDILIRRLVKHGRDAICERFTDVTSDSVKLTRDTIDIRDRQQEECISPLQIAKYIVPIVMCIICIVSLLDEIQIAKYIVPIVSLLDEIP

SEQ ID NO: 162834 - protein, 1585 aa, Glycine max
  Coding DNA Sequence Number=SeqID_46056
  Homolog annotation: Hit_ID=Q6IMT1; Match level="QueryCoverage=97%, HitCoverage=55%, E-value=0.0, Identity=52%"; Hit description=SAB
MGTTVHTELGELNLNLANENEECLKERIFGAESKSGYILHITKVSLDWGKKDLKSSEEGAPKCVLGLSVNMTSMGVYLTFKRVESFISTAISFQVLFKSLSASKKKTTQTRARSSKSSGKGTQMLKFNVEQCSVYVLGETGIENAVVPDPKRVNFGSQGGRVIINVSADGTPRTANIISTVSDDYRKLKYCISLEIFHFKLSVNKEKRSKQVELGRARSIYQEYMDENRPVSKVALFNMQTIKFVQRLGGLKENAACSLFSATEITMRWEPDVHLSLIELVLQLKLVVHNTKLQEHGNDEHVEDMSNVKDTNRKNEATVESGHSEKKKESVFAVDVEMLNISAGLGDGVDAMVQVQSIFSENARIGVLLEGLMFYFNGARIIKSSRMQISRIPSKSAASASDAKGPVATIWDWVIQGLDIHICLPFRLQLRAIDDALEDMLRALKLIVAAKTNMIFPVKKDSSKAKKPSSVKFGCVKLFVRKLTFDIEEEPIQGWLDEHYHLLKKEAGELAVRLNFLDEFISKAKQDPKPTDDTNNSPQEKKVYFNDVEVDVNNPSTIESMREEIYKKSFRSYYQACQNLVLSEGSGACIDDDFQAGFKPSTSRTSLLSISALDLDVSLTKIDGGDDGMIEVLRKLDPVCLECDIPFSRLYGSNILLNTGSLVAQIRDYTYPLFAGSSGKCEGRLVMAQQATSFQPQMLQDVYVGAWRKVCMLRSATGTTPPMKTYTDLSLHFQKGEVSFGVSYEPVFADISYAFTVLLRRANLSVINPGPLIVPPKKEKSLPWWDDMRNYIHGRISLLFSETRWHILASTDPYEKLDKLILLTRSMEIHQSDGRILLSAKDFNIFLSSLESMAKKRGSKIPPGVSSAFFEVPLFTLEVAMDWDCDSGKPLNHYLFSLPDEGKPREFVFDPFRSTALSLRWNLSFRSLPPSSEKQCPPSVARDSIEGYATVSQPPHTSQNVSPASPTIKLGAHDLAWITKFWNLMYLPPHKLRMFSRWPRFGVPRIIRSGNLALDKVMTEFMIRIDSTPICIKNMPLHDDDPARGLTFMMTKLKIELCFGRGKQKFTFESYRGLLDLVYQGIDLHMPKVFLSKEDCCSVSKLISMATKSSQSASKDNVPSEKGCMTQKNPDDGFILSCDYFSIRKQSAKADPDTLGAWREEGKINPEKTTCVQFERGKQSETNEHTQSDPSDDDDGYNVLLWNIENRNAVCFWVAALSKAAAPAKPSPSRQYAQRKLHEDNKKDDAAETNQDDDACQTHQDDGAKIQQDDEAESHRDDGAETCQDEGAETHKDEVSTSLNTNSISDSPSSQAAKNPELPSSPPHLDNADNLPSTKNENADDTEEGIRHFMVNIIEPQFNLHSEDANDITQLHKTGLLEENSPSLISTSYAISSLSLSGQPSIAIPFQDPTTNSSRPQLRRVRVTTIKGRFLLAAVSGRILAQSFHSVLHVGYEMIEQALSTTDVNGSEYQPEIAWKRWELSVMLEHVQAHVAPTDVDPGAGVQWLPKILRGSPKVMRTGALLERVFMPCDMYFQFTRHKGGTPEMKTLSIEDDEMVEEEADEVVPDGVEEVELEKINLEKKEREL

SEQ ID NO: 162835 - protein, 450 aa, Glycine max
  Coding DNA Sequence Number=SeqID_46057
  Homolog annotation: Hit_ID=Q6IMT1; Match level="QueryCoverage=94%, HitCoverage=16%, E-value=2e-88, Identity=42%"; Hit description=SAB
MHPNNFSRINFQSTSGPIEYVSIGEIKLSLRLSLLEHGVGFSTWDPKLQLIVCNLEVVTRPSNKSSEKKKKTRKSSGRSSGKGKWKTISNIARYLSVCMTNLVLKTPKATVEIGKLNVDISKVGGSESDLLVRVHILPIVVSEPQVSCNQLSDLSGGECSASSQASIATIKKAPALFICEKFCVSCEFGHDREVGILIKSVDISIGEVTVNLNEGLLVKKKSSVESSSGSEKSVGSNVDSMSAKEPPKKREKIIGYISKFPQKVSFNLPKLNVSFVHRERGLSVENNIMGIQFKSIKSRPSKDAGESTRLHFQLEFSEIHLLREAGSSILEILRVNLVTFVYVPVQTIMPIRADIEFKLGGLQCNIVISRLKPWLLLHSSKKKKMVIREEAPVVKPKPTTDSSKIIVWTCNFSAPKMTIILFNMADSPLYHWYCRVYNLAASNTLRKSKM

SEQ ID NO: 162836 - protein, 65 aa, Glycine max
  Coding DNA Sequence Number=SeqID_46058
  Homolog annotation: Hit_ID=Q6IMT1; Match level="QueryCoverage=80%, HitCoverage=2%, E-value=3e-18, Identity=84%"; Hit description=SAB
MAMQKAAQQRLMEKEKNKSPSYAMRISMQINKVVWSMLLDGKSFAEIEINDMLIQSPEKSVSDKV

SEQ ID NO: 162837 - protein, 414 aa, Glycine max
  Coding DNA Sequence Number=SeqID_46059
  Homolog annotation: Hit_ID=Q6IMT1; Match level="QueryCoverage=95%, HitCoverage=15%, E-value=1e-106, Identity=52%"; Hit description=SAB
MLQVDARQGAPKDGSSPFELFKVEIYPLKIHLTETMYRMMWGYFFPEEKKESQRRQEVWKVSTTAGARRLKKGSSVNEASASSATKESEAPSKSTITAMLFPSSNQSSAQVDSAQASKTQNVKANPGTGITPELKKASSFDKTEEDTVAESVADELVSQDEASKNKLKDCKGAMPSEEKKSRPQKIMEFHNIKISQVELCITYEGSRFVVSDMKLLMDQFHRVEFTGTWRRLFSRIKKHIIWGVLKSVTGMQGKKFKDKGQIQLPSAGAPEMDLTLSDNEGQAGKSDKLPPAWPKRPNEGAGDGFVTSIKGIFSNQRRKAKALVHKTKKGEAENETQGDSGENDGDQIAPFARQLTITQAKKLIRKHTKKLQSKAQKGSSSQQAEALPSSKEETITFDSDSSSGSSSDDEAFHE

SEQ ID NO: 162838 - protein, 174 aa, Glycine max
  Coding DNA Sequence Number=SeqID_46060
MVLKEELAACSRSKRSLVQHLEATEQSMLAIIGQYKEELNQSLTHEQKLVEDFAQAYTEKEARGRVIDALHQEATMWMDRELTITKKAQRHPYNTRSRSKMDNEEGVQEQMKADLSALKDQMASITEAMLKIQKTIEDNATAAASNTARGSGTDATARNKLGPRQKRDGFQSEV

SEQ ID NO: 162839 - protein, 150 aa, Glycine max
  Coding DNA Sequence Number=SeqID_46061
MTRMSVHVAQLIADAIYKSNRALGFPALITGLCQSFGVPVIPSKVIRPPITRAFIEKYCTQRQAQGDSPQAAGAHPPPHQADPAGSFDTEQYLRHVVRQQAANHRAHVQTHECLYQLSLSMQIQGFAPFMCPTPDQFRAEVAWLGDWPKA

SEQ ID NO: 162840 - protein, 236 aa, Glycine max
  Coding DNA Sequence Number=SeqID_46062
MIMRGQDIYSSQDEATASPSFSESEEAKGEEFSEEIYPQEEGQPLMVKDACKEVSVSSKRLAKKESHFEIKTNIKETCSLRQPPHILLCKKTLASIGTPLELDIIPQVKKLLDEGLFRKSLNPYDLLVPKLEISNKRLSLPLQDSNFQHQEGIFRRETECFKRLLNVSNFEGSLSVICLLSARFPNALSRLSASLSRCHSLSEHGSLSETPVASLVFKWPETEVDSLLVHKIGNIY

SEQ ID NO: 162841 - protein, 61 aa, Glycine max
  Coding DNA Sequence Number=SeqID_46063
MAFELETIMNTMLATRSLPATRSSTICLRTIVEEGDGHGEDIEAAMENDGSDSGTAGVKEG

SEQ ID NO: 162842 - protein, 1256 aa, Glycine max
  Coding DNA Sequence Number=SeqID_46064
  Gene Ontology: Mol. function=RNA-directed DNA polymerase activity; Cellular component=chromatin; Biological process=chromatin assembly or disassembly
  Pfam annotation: Domain name=Chromo; Domain location=1187-1233; Score= 25.2; E_value=0.00024; Accession=PF00385.14; Description='chromo' (CHRromatin Organisation MOdifier
  Pfam annotation: Domain name=RVP_2; Domain location=375-499; Score= -51.1; E_value=0.0095; Accession=PF08284.2; Description=Retroviral aspartyl protease
  Pfam annotation: Domain name=rve; Domain location=918-1074; Score =95.0; E_value=2.2e-25; Accession=PF00665.16; Description=Integrase core domain
  Pfam annotation: Domain name=zf-CCHC; Domain location=314-331; Score =5.9; E_value=0.1; Accession=PF00098.13; Description=Zinc knuckle
  Pfam module annotation: Pfam domain module=Chromo::RVP_2::RVT _1::Retrotrans_gag::rve::zf-CCHC; Domain location=1187-1233::375 -499::573-774::169-259::918-1074::314-331
MTDDSMENAEEEVNEVTENPSTQANTGESSIQADTGESNTKVQIASAGTLENQFCYFIPYHLGALVDSSMADSPLTLEEAIRKLTTHQISLAETLQTMALKLDELLHRLPPVLPDPVASSSPTPVAPPAITYKIKLDVPRFDGTDPMGWIFKITQFFEYHQTPENERLTVASFYMDGRALSWFQWMNGNRQFTSWQGFLQALQTRFALSQYEDPTGTLFKLTQRGTVAEYLAAFEDLANRMIGLPPPFLLSSFFSGLTPEIRREVQAHQPLTLVQAAGLARLQEEKIMDAPPRPIPPAVKRLTPEEIATRRERGLCFNCDERYHWGHRCSSHIFLLISEDDDPSSVQIPQPNPQPEPETPTPDPIDPYPAQISFNSLAGNVTPETLRFMGTIGNRHVVLLVDGGSTHNFIQHQLVSQLSLIPRTTTPLCVMVGNEQQLECTSVCESVPVTIQATEFIVDLHVLPIAGANVVLGVQWLKSLGPVLMDYNSLCMKFFHAGTFVELQGGTETTLNSLSSSQFHRLLHNQPESLYFHVDVLHDDNSMVNSDIDPVIQELINRFHPLFQAHEKLPPARPTDHRIHLVPNATPVNVRPYRYPHFQKQEIETQVKLMLQKGLIQPSNSPFSSPILLVKKHDVKDRFLLPTIDELLDELGGARCFSKLDLLQGYHQIKMHPNDIPKTAFRTHHGHYEFRVMPFGLCNALSSFQATMNSLFRPYLHRFIIVFFDDILIYSTTFAEHLTHLEVAFQVLLSHQFVLKLSKCFFAQAQVEYLGHMVSFAGVQPVPSKISAIQQWPIPQTTRAVRSFLGLAGFYRCFIKGYASLAAPLVALTTLDKFQWSAEAQAAFDNLKCALSEAPVLALLDFSLPFTDLGTPRISDDTHFDHEGLRDDVTRFVSQCLPCQQTKYETKRSAGLLCSLPVPHRPWEDLSLDFIAGLPLYHGNTMILVVVDRFSKGIHLGMLPLSHKAHTVATFFMDLVGKIHGLPQSLVSDRDPLFVSQFWQELFRYNGTQLRMSSAYHPQSDGQTEIMNRVIEQYLRAFVHNKPRTWGKLLLWVEWCHNTAWNAAIGSTPYEITFGRKPFNFPDYLMGSSKIDAVEDMSKEREETFRALRKKLLKAQGAMKKSADNKRREVIERIGPVAYHLKLPEQARIHPVFHCSLLKPFHGDPTSPGTNEATQLPSQYFQNQPLIIPLAILSHRRNPQTGEWEVLVQWEGLSPDETSWEDWNSLRQEYHLEDKVQIASKFKRKVMRPAYLKDFV

SEQ ID NO: 162843 - protein, 136 aa, Glycine max
  Coding DNA Sequence Number=SeqID_46065
  Gene Ontology: Mol. function=RNA-directed DNA polymerase activity; Cellular component=nucleus; Biological process=RNA-dependent DNA replication
MDVGGKRDGNCSAFWDQNCYFMWLWRNKHEHKDDFIRPLKPWEVILKACDEYSNGVVVHVMASGNTSSEVMIVNTDGAARGQGRWATSGGPIRVNDGRWICGFAKKIGSTTAYVAELWEVSEGLRLAHSRGVKFIN

SEQ ID NO: 162844 - protein, 143 aa, Glycine max
  Coding DNA Sequence Number=SeqID_46066
  Homolog annotation: Hit_ID=Q1T3I2; Match level="QueryCoverage=46%, HitCoverage=6%, E-value=2e-19, Identity=61%"; Hit description=AAA ATPase
MHVFISGWNLFDKYVIVDLLAELARREKEAGIFPEAELDLFMKILGLDICKDTIVGDEMQRGVSGGQNKRVTTVRTLHFDTCGTAKSTWIRYTHLAVRIILTTDNDPLGQALAEELARCLRRERLYILSLIFYVKQSGIEAAR

SEQ ID NO: 162845 - protein, 188 aa, Glycine max
  Coding DNA Sequence Number=SeqID_46067
  Homolog annotation: Hit_ID=Q0ZCD5; Match level="QueryCoverage=26%, HitCoverage=8%, E-value=2e-10, Identity=60%"; Hit description =Integrase
MLLPFHHPPCHRSTKILALLLLLTPLEICTFTNAILDLGASINVMPTSVYRSLHLGDLKPTGVVIHLANRSDVIPLGVIEDVLVAGSDPPISLPQSFNLTFSFHHSATVATCPFAGERRRGSRVRFPKEERCAESPPTFICGKRRENRRKPVKTKILSSGVVFTLEEGRQKWGFCSYVPSIEEEIRPT

SEQ ID NO: 162846 - protein, 115 aa, Glycine max
  Coding DNA Sequence Number=SeqID_46068
MLKALKNLESMSLEELVGLRRKNSLALSSLKNKKEPLTREQVRRSSSKALKVNDSSDDEFEEDSDKDELTFISRKIHKMWRNKNGSKWRSSSRRMPWDKKDKDKSSIVWLWVQRA

SEQ ID NO: 162847 - protein, 214 aa, Glycine max
  Coding DNA Sequence Number=SeqID_46069
  Gene Ontology: Mol. function=protein kinase activity; Cellular component=integral to membrane; Biological process=protein amino acid phosphorylation
  Homolog annotation: Hit_ID=Q1SI44; Match level="QueryCoverage=97%, HitCoverage=30%, E-value=6e-92, Identity=78%"; Hit description =Leucine Rich Repeat, putative
  Pfam annotation: Domain name=Pkinase; Domain location=1-209; Score= -42.9; E_value=5.2e-06; Accession=PF00069.15; Description=Protein kinase domain
  Pfam annotation: Domain name=Pkinase_Tyr; Domain location=2-209; Score=-93.1; E_value=9.3e-07; Accession=PF07714.7; Description =Protein tyrosine kinase
  Pfam module annotation: Pfam domain module=Pkinase::Pkinase_Tyr; Domain location=1-209::2-209
MYERRNGQPSTNLSWSTRLRIAKGTARGLAYLHECSPRKFVHGDIKPSNILLDNDFQPYISDFGLNRLISITGNNPSTGGFMGGALPYMNSSQKERTNNYKAPEARVPGCRTTQKWDVYSFGVVLLEILTGRSPESSPTTSTSMEVPDLVRWVRKGFDQESPLSEMVDPSLLQEVRVKKEVLAVFHVALSCTEEDPEARPRMKTVCENLDKIGT

SEQ ID NO: 162848 - protein, 62 aa, Glycine max
  Coding DNA Sequence Number=SeqID_46070
MAEINQGKTMTGHDWLHSICLLLAGSSGQTLTHKEGGDMVNVPLKKKWQVSSPGRATPAPKL

SEQ ID NO: 162849 - protein, 118 aa, Glycine max
  Coding DNA Sequence Number=SeqID_46071
MKGSEEELREGEGQDSNLIQEKGKLKSDQVDVFKVSMLLHIKSLPLPTIVGNHLGNSINPPPSSLVRKRMREQLSHAFLLQLLCALFLSPCLSPLFSPKSLHHFLIIGGLLLSTVAAN

SEQ ID NO: 162850 - protein, 99 aa, Glycine max
  Coding DNA Sequence Number=SeqID_46072
MPFLTSGMLWNFTDYLMMGVKYLEAVKRRLHATKQWSPDEIRAKGPSGEGRRPKWRRTKAQVEKDKAPEWRRMKAQVEKDKGPEAETLSRLLIVVEGPD

SEQ ID NO: 162851 - protein, 77 aa, Glycine max
  Coding DNA Sequence Number=SeqID_46073
MAITLEIDLNTTMRKEFQTRNKNCRKMRKSAPHLPISVLNCMTKSNALFSIYYQTTLPSNFSPLTPIPYQIDLCQMS

SEQ ID NO: 162852 - protein, 105 aa, Glycine max
  Coding DNA Sequence Number=SeqID_46074
MTMLNAIRKKIPPTKTRDKQRRKGVGQLEAKSANLNYRFLSISSHGLRGHSPRRATDERAEVMRGRGMLHVDSGADTCPPDFGVDAVGLQWRHEGELKYREEIEI

SEQ ID NO: 162853 - protein, 71 aa, Glycine max
  Coding DNA Sequence Number=SeqID_46075
MNLTALRRHWLTMNRVRRLKAELFGIFNGLKIAKSADFCTVIYETDSQIALQINMHQSSLLFSPFLTTTGI

SEQ ID NO: 162854 - protein, 72 aa, Glycine max
  Coding DNA Sequence Number=SeqID_46076
  Gene Ontology: Mol. function=cytokine activity; Cellular component =chloroplast
  Homolog annotation: Hit_ID=P51240; Match level="QueryCoverage=99%, HitCoverage=14%, E-value=4e-20, Identity=62%"; Hit description =UPF0051 protein ycf24
MAEHAIVEDCGVQRDEVVVAVGHDLSYVLPNQVGVQFDSLGDGAKDDPDLFKGFFKGGGDGDAVEDAAYGKV

SEQ ID NO: 162855 - protein, 142 aa, Glycine max
  Coding DNA Sequence Number=SeqID_46077
  Gene Ontology: Mol. function=cytokine activity; Cellular component =chloroplast; Biological process=intein-mediated protein splicing
  Homolog annotation: Hit_ID=Q58IU5; Match level="QueryCoverage=99%, HitCoverage=24%, E-value=8e-31, Identity=52%"; Hit description=Non -intrinsic ABC protein
MMHKGNNTRSRTVAKGICAGSSKNYYKGLVQVHSKVKNLTNSLQCDSAYWGQCNCQYLSLHPEERSLVVKNPTARIEHMHDTTTSKLGQDQLFYFQQRGIDSEAGLTAVIKGFCHAVLDELHNKLKSEAAEIVKSKLVWSVG

SEQ ID NO: 162856 - protein, 184 aa, Glycine max
  Coding DNA Sequence Number=SeqID_46078
MSSHSSHQTTMDRLEEAVYHLTQNLSTMTTKILEMNAKLDVILDRLSAFTPTPFPPKSPPPVETIIMEPQNIDINLSRLSFDFTTTTFHVDNTSLQPVDTMKSPPTDDSRRSPKASATPTAREKDVRWQLEGDLNATIQNVFQYKISANASCVSRLELDCDPLLQRIWHGSLPIPDLCFSNLTP

SEQ ID NO: 162857 - protein, 177 aa, Glycine max
  Coding DNA Sequence Number=SeqID_46079
  Subcellular localization annotation: CTP_CleavageSite=35; ConfidenceScore=5.04e-01
MFFSIQPESETLILQTATLPPVPTSTPQPPEFKVRAHHNPVTTSIASTEVSHKVSFRNNAPSWKHHILEAKTPLLQTSLRARPPKVKTSLELEQEELKKIPNVKARPLNKKDFERNLALVYKEGAEHITTNIETFEERDRKQSGRNKGMRGEGEKHSFLQKAFMKRIGQSHSTDKRK

SEQ ID NO: 162858 - protein, 61 aa, Glycine max
  Coding DNA Sequence Number=SeqID_46080
MNGQAKISEYLNIKSGTMAFRHCCWRDRDSSTLVHVARISPIEAMKPAWISPIEPAKPAWN

SEQ ID NO: 162859 - protein, 49 aa, Glycine max
  Coding DNA Sequence Number=SeqID_46081
MVEEEENLIEARMKEEEVQCEEAPDLNGTQFNKLDELLTQTKLIAVGLT

SEQ ID NO: 162860 - protein, 141 aa, Glycine max
  Coding DNA Sequence Number=SeqID_46082
  Pfam annotation: Domain name=zf-CCHC; Domain location=105-122; Score =21.8; E_value=0.00025; Accession=PF00098.13; Description=Zinc knuckle
MDIDYVIRKDEPPTITDESSPADVALYKQWERSNRLNVMFIKIKISAGIRGSIDQHEKEEERLVMEMGESALLTTAYGKNKATKAQANQKGNGKIPPQVDIKKVAKCFFCKKKGHMKKNCTGFQKWLEKKGYEKPKETSRK

SEQ ID NO: 162861 - protein, 147 aa, Glycine max
  Coding DNA Sequence Number=SeqID_46083
MLFVEKRGDSAKVFSVLSWSRYSKSPPSTKDGAEFSGRREPCKPRAHCATLKKLYAAEKKLFKALKEEEGVVALEFDRKSMLLRKQEDENLYMAKIDKMRSSVDKLESDLISLRQCISDTTSSILEMIHEELLPQLVALTVGYISQN

SEQ ID NO: 162862 - protein, 168 aa, Glycine max
  Coding DNA Sequence Number=SeqID_46084
  Homolog annotation: Hit_ID=Q2KB04; Match level="QueryCoverage=72%, HitCoverage=78%, E-value=1e-28, Identity=45%"; Hit description =Hypothetical conserved protein
MRIGHCRLLWRVWRVFRQAPAAGRGGTFVQIKSRRALRLAPELRCHEGLECAVRLPDAAGETAVIVIMQHQHVVIGRGATGTVESGAFRFQRQGLAVLFQPALVDPEMRHHRPYPGADKIALGRIEADRYDGRHPVAVRHPAGAFADDPQPADGADGLRKTLVRIIRI

SEQ ID NO: 162863 - protein, 236 aa, Glycine max
  Coding DNA Sequence Number=SeqID_46085
  Gene Ontology: Mol. function=oxidoreductase activity, acting on single donors with incorporation of molecular oxygen, incorporation of two atoms of oxygen
  Homolog annotation: Hit_ID=Q1MJQ7; Match level="QueryCoverage=87%, HitCoverage=100%, E-value=6e-61, Identity=47%"; Hit description =Putative glyoxylase
  Pfam annotation: Domain name=Glyoxalase; Domain location=115-227; Score=32.1; E_value=1.9e-06; Accession=PF00903.15; Description =GlyoxalaseBleomycin resistance proteinDioxygenase superfamily
MSLAGRPRISARRKCPISCWKPTAGHGRRHGTDRRAQGPGHSAELDGLCRCRRCGRDGKRFAEKGGAIRRPPQDIPEIGRFAVVADPYGAVLCIMTPQPMETGGFPEDMQAKQGHVGWYELFTDNVDEAMAFYGDVFGWTKDHDFDMGEMGPYRIFAHNGKAVGGIMKRMPHVPVCHWGYYFNVDGIDDAITRVSTGGGQVVNGPMEVPGDSWIVNCVDPQGAYFSLVSQNKSVCC

SEQ ID NO: 162864 - protein, 62 aa, Glycine max
  Coding DNA Sequence Number=SeqID_46086
MSSWHSSTECTSSPARSSGLLLTELSSRSVAPPGRHRARHHGGGQQMQRHHLQSPSAHPQKG

SEQ ID NO: 162865 - protein, 87 aa, Glycine max
  Coding DNA Sequence Number=SeqID_46087
MDMNLGSFISSQITFIAQCHNLPFSGRATRDSWVHLPRKENVRSRHQSLFEENVGKIGKGVGVSLAPTYSSIVIRKSDLRSSFRTER

SEQ ID NO: 162866 - protein, 115 aa, Glycine max
  Coding DNA Sequence Number=SeqID_46088
  Homolog annotation: Hit_ID=Q5W7C9; Match level="QueryCoverage=49%, HitCoverage=21%, E-value=6e-13, Identity=66%"; Hit description =Unknow protein
LFLDGGKGYNSAVECHLDVVEVISSSLIIPKPNRTPVEYEAPGYKLCLGMEENSESALSTNKEAISNATRNLMESSILAQDETLAACLYTCKVGREVVFPVGGRAGGAKGGIRPR

SEQ ID NO: 162867 - protein, 58 aa, Glycine max
  Coding DNA Sequence Number=SeqID_46089
MKDISQVWRSLLYGSASSKEALESVFVKACVGLWGRTRTLFNGALPGLLRGELLRSQF

SEQ ID NO: 162868 - protein, 45 aa, Glycine max
  Coding DNA Sequence Number=SeqID_46090
MDSGGGGGASVTSWKFLPGIFGNDCICIYVLGRNRSSGGKIRGLG

SEQ ID NO: 162869 - protein, 371 aa, Glycine max
  Coding DNA Sequence Number=SeqID_46091
  Homolog annotation: Hit_ID=Q47I47; Match level="QueryCoverage=49%, HitCoverage=24%, E-value=2e-11, Identity=29%"; Hit description =Histidine kinase, HAMP region:Bacterial chemotaxis sensory transducer precursor
  Pfam annotation: Domain name=HAMP; Domain location=179-249; Score =42.5; E_value=1.5e-09; Accession=PF00672.15; Description=HAMP domain
  Pfam annotation: Domain name=PAS; Domain location=262-358; Score =14.0; E_value=0.02; Accession=PF00989.14; Description=PAS domain
  Pfam module annotation: Pfam domain module=HAMP::PAS; Domain location= 179-249::262-358
MDTGRRKALQALTEAADAFSQGVAALFERVDEMGRGDAGLAAQLQQAADTLQVQVDALQRPSLALSLQKMRRQEALLLLDGDSTHADRASEEKLPFDLALAGLPADAQDTLRTGMEAYQAALLGYTAARVGLDVEAQSLLDTAAGVAPALAAFQQAQVAALATAQARQQAGARTMSVLFALTLLLVAGVLITSLMLVLRAVRQPIQDTLRFASDIADDRLDTTLRVYNANDEIGQLAQRLVDMQQRLRARIETERAVARGNTRVRQALDSAQTGLMVIDAEGQVAYANPALLEQLDLQVEDLVASDAVRLHPALASLAGVRQREEREIGHAGVRYQLIANAIIDEGHFLGVAVEWRSRALETLLETEVAAL

SEQ ID NO: 162870 - protein, 149 aa, Glycine max
  Coding DNA Sequence Number=SeqID_46092
  Gene Ontology: Mol. function=unspecific monooxygenase activity
  Homolog annotation: Hit_ID=O04892; Match level="QueryCoverage=62%, HitCoverage=17%, E-value=3e-28, Identity=79%"; Hit description =Cytochrome P450 like_TBP
LTACPPLKRLSEVGSSGWKSTARRVVSGAPPAALENPEDRVPPRPVVLITASGLQGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 162871 - protein, 93 aa, Glycine max
  Coding DNA Sequence Number=SeqID_46093
  Subcellular localization annotation: CTP_CleavageSite=26; ConfidenceScore=5.41e-01
MASVCTHLRLGMCSCTFSCAPSFGSSSSTKKRKLSNKANVGSRNKKFKNDDDDEVWKIKKVLEKSNIGTMSRLILRREMEEEFVLPVLGDDAD

SEQ ID NO: 162872 - protein, 115 aa, Glycine max
  Coding DNA Sequence Number=SeqID_46094
GVSSLSSLSIPLPFIFKEAKESIDEEDPRPTSSNGAYITHPTCQVNSKFPGRCNNGVTICCNLPHNGTMKKIREGEKKMSGSFHQRLFEENISKTKKKRSVNFENNSAGEVYAWG

SEQ ID NO: 162873 - protein, 150 aa, Glycine max
  Coding DNA Sequence Number=SeqID_46095
  Gene Ontology: Mol. function=unspecific monooxygenase activity
  Homolog annotation: Hit_ID=O04892; Match level="QueryCoverage=53%, HitCoverage=15%, E-value=1e-19, Identity=65%"; Hit description =Cytochrome P450 like_TBP
MSRRARRSLQNPGREPGRSGRRCRSWCLPTLETAQPEVGSSGWKSTARRVVSGAPPAALENPEDRVPPTPGKGSRQNGSVTSGKGLALRAGHGGPSPEPVGCRWTARAASAARAGRRVPSGTDWNGPFGPLPRASNSQLRTGTDKGNPTV

SEQ ID NO: 162874 - protein, 70 aa, Glycine max
  Coding DNA Sequence Number=SeqID_46096
  Subcellular localization annotation: CTP_CleavageSite=26; ConfidenceScore=5.60e-01
MASPPASPPPPPPSRPPPPPPPSNASASLSAVKWTLLDFPCSCFLFHFFFVQIYSREIRFVGKCTGSSSI

SEQ ID NO: 162875 - protein, 82 aa, Glycine max
  Coding DNA Sequence Number=SeqID_46097
MERYLQHLIRQQVANHRGQLQIHECLYQLSLNQFRAEVAWPRDWPEAQAGEAPTEAPGDANEACMDEEMTDLLGFLGGSGAT

SEQ ID NO: 162876 - protein, 98 aa, Glycine max
  Coding DNA Sequence Number=SeqID_46098
MSKFKDYFRGQELMLAVCVLNSNYIKGATVNNTKSNYEELKAIGNWHRIEETISKSILSVTPDLRTLGARETKLRSESFFQSSTYKDASLDLIAPRTT

SEQ ID NO: 162877 - protein, 97 aa, Glycine max
  Coding DNA Sequence Number=SeqID_46099
  Gene Ontology: Mol. function=zinc ion binding; Cellular component =integral to membrane
  Homolog annotation: Hit_ID=A0FK64; Match level="QueryCoverage=76%, HitCoverage=29%, E-value=2e-24, Identity=72%"; Hit description=PHD4
MNPNMHLVIVRMSNDIALDKDNLCLYGHPNEAWEVTLPAEEVPPELPEPALGINFARDGMNRRDWLSLVAVHSDSWLVSVAFYLGARLNRNERYDLV

SEQ ID NO: 162878 - protein, 81 aa, Glycine max
  Coding DNA Sequence Number=SeqID_46100
MILLQPLSAHYPCPVKILRLRITKLHCPIWSDFLDALKIHKQLISSLPTCRNLPFGGRATRDSRDACSTKAIRAESPPTFI

SEQ ID NO: 162879 - protein, 136 aa, Glycine max
  Coding DNA Sequence Number=SeqID_46101
MKLTNKIGWVSLNNVSKKLFEFDSNIFARFKDRFLKVLATDVVIDVAVAPTAIEGGQPTVEVCPIIGDSEVTLDGPSFILAKRKQDDCAGVQAVGLTPLVEASFMMMNQVDSSSFDDDKKLKRMISRLSQQVQDQD

SEQ ID NO: 162880 - protein, 99 aa, Glycine max
  Coding DNA Sequence Number=SeqID_46102
MMHERCTLSCVHSAIEVGVPSTGTTKDVRSNVLRKSSQAGRIKRILRLCLIEFFDKGEGRHQRIQAISPLFFWKREKGDTKRIQAVSPWRILFGKGRRE

SEQ ID NO: 162881 - protein, 67 aa, Glycine max
  Coding DNA Sequence Number=SeqID_46103
MVIFSHGVAAEARKVASFGSKEESFLEKLEVSYSHPSNSEAHPMPKYIKIQKCPYYKDYSKCPEIQG

SEQ ID NO: 162882 - protein, 229 aa, Glycine max
  Coding DNA Sequence Number=SeqID_46104
  Gene Ontology: Mol. function=RNA-directed DNA polymerase activity; Biological process=RNA-dependent DNA replication
  Homolog annotation: Hit_ID=Q1SUI8; Match level="QueryCoverage=53%, HitCoverage=46%, E-value=9e-14, Identity=34%"; Hit description=Beta tubulin
GDPQKIPKAVLHQLCQKSGWEAPKFDKILGRGKIFSYTVSILRKASGRGKNRKAGGLVTLQLPDQNETVESAEAGSTAAFVWLSSVPLWRRPLFDSEIEMLVAFIQEVEGHKIRSDIEDQWVWAAESSGSYLARSAYRVIREGIPEEEQDREFKELWKLKVPMKVTMFAWRLLKDILPTRDNLRRKRVELHEYVCPLCRSMDESASTIFISIVMKFIKDCRGIDGNGGG

SEQ ID NO: 162883 - protein, 114 aa, Glycine max
  Coding DNA Sequence Number=SeqID_46105
MRQRSLDFTRKVQKCNERLMSKKKGVEPNPRVERNKSTSKTLKVLTQYNPQTLFEKKNPRFALAHLRRKLIRLGAHGKCPKTIVTDQSMSLSFSGINRPNGNTGAFITCLLQGM

SEQ ID NO: 162884 - protein, 37 aa, Glycine max
  Coding DNA Sequence Number=SeqID_46106
VKNVIEKPHNDHLPLIEASRCPDFLLKTSQTNVQANG

SEQ ID NO: 162885 - protein, 195 aa, Glycine max
  Coding DNA Sequence Number=SeqID_46107
  Subcellular localization annotation: CTP_CleavageSite=83; ConfidenceScore=5.32e-01
MVLNVSKASLLLAACKVSTPSATNYGLYKMHAVAPAGGLSPQASPSPALAQGNTTSTLSPISVGSLLRAGGYRRTGLICPCPRCTVLAYLCPSCTCIVHCPIIDLVAVRRVRSGQELSFWQDIVLQQANNINKKRKLKLRYAEGVSVKGAYIHTFVEESCSWRGKLECHKPLSCTAPCLPAPSSLKDSVRMPPRD

SEQ ID NO: 162886 - protein, 59 aa, Glycine max
  Coding DNA Sequence Number=SeqID_46108
MDNTSATGTKIGEDSASGTRTDEASSPIASRTLKASAGDGEACGERPPAGATACILYNP

SEQ ID NO: 162887 - protein, 142 aa, Glycine max
  Coding DNA Sequence Number=SeqID_46109
MEREMITMIVDTLSVFYYAKMVGYIPSSFADLVFVGEMIEVVLNANYNAKQMIIKCFDEECEKYPKRGKRVFSLVFLDPSSPRLASSSPRPPNSFMVKKPTHLGELITSALSFSSPGRAATTPNDPLPINRHPRGVLRGSKG

SEQ ID NO: 162888 - protein, 250 aa, Glycine max
  Coding DNA Sequence Number=SeqID_46110
  Gene Ontology: Mol. function=thiopurine S-methyltransferase activity; Cellular component=cytoplasm; Biological process=metabolic process
MDWIGFVKNIKKRKKAEQRGRWKKKKEEGMSATVTLTLNLCRSSIVASCPHYSHKPNPNFNAFFSFSLSLSLSHHRRIVIYKKPFPSRRTWLYGYMNRDRDYELENGLALFGSDEELATQIPTQAQSLVEGSGSIRIAEFKPVPDVDYLQELLAIQQQGPRAIGFFGTRNMGFMHQELIEILSYAMVITKNHIYTSGASGTNAAVIRGALRAEKPELLTVILPQSLSKQPPESQELLSKILFSARGLFDS

SEQ ID NO: 162889 - protein, 118 aa, Glycine max
  Coding DNA Sequence Number=SeqID_46111
  Gene Ontology: Mol. function=ion channel activity; Cellular component= viral envelope; Biological process=cation transport
  Homolog annotation: Hit_ID=Q4LDF9; Match level="QueryCoverage=96%, HitCoverage=25%, E-value=7e-38, Identity=66%"; Hit description=Outer envelope protein
MYSYWYNCDSNYWSAVYKRTYGKDFKFKAGYDSEIRLGWASLWVELHTSNGSFLALSLIPHAANHHDRDHNSFTQVGDEGGKAKTAPMQMKVQFMLQVPQDDIKSSALMFRIKKRWDF

SEQ ID NO: 162890 - protein, 66 aa, Glycine max
  Coding DNA Sequence Number=SeqID_46112
MVRGRRVVGILASRLVGVSHAPRGTLNPEFAGKSGGRSGGWRPAVAGDGGDFGDNQNGTVPALIPC

SEQ ID NO: 162891 - protein, 741 aa, Glycine max
  Coding DNA Sequence Number=SeqID_46113
  Gene Ontology: Mol. function=inositol or phosphatidylinositol phosphatase activity; Cellular component=intracellular; Biological process=vascular tissue development (sensu Tracheophyta)
  Homolog annotation: Hit_ID=Q1S015; Match level="QueryCoverage=61%, HitCoverage=42%, E-value=0.0, Identity=79%"; Hit description =Inositol polyphosphate related phosphatase; PapD-like; WD40-like
  Pfam annotation: Domain name=Exo_endo_phos; Domain location=188-520; Score=122.7; E_value=1e-33; Accession=PF03372.13; Description =EndonucleaseExonucleasephosphatase family
MVKLQRWFLWGGDVDQKKIAWISWESACLSKEKEGLGIKDLTKFNRALLGERRWNLFHRHGELWARMLDSKYGGWRNLDENRRNSAEFVWWKDLSSICHSPGEESWFKARIKWSMGFGSKVRFWEEGWKDNGILLMVKFPRLYLNSNQKNHYIQQLGSNSGGEWEWSLQWRLLFEAEIPMVANFLEEIQGLNINAHQQDKWVWLSDPTGLYTVRSAYKLLDRDSRDKNIDGVGLEGSAMGQWWLDTIGKALQEGKAFERMGSRQLAGLLVSLWVRKNLRTHVGDIDAGAVPCGFGRAIGNKGGVGLRIRVYDRIMCFVNCHLAAHLEAVNRRNADFDHIYRNMVFTRSSNLLNTAAAGVSTSVHVLRGTNVMGVISEEPKPDLSEADMVVFFGDFNYRLFGISYDEARDFVSQRCFDWLREKDQLRAEMKAGKVFQGMREALIKFPPTYKFERHQPGLGGYDSGEKKRIPAWCDRIIYRDTRSAPVSECNLDCPVVSSILQYDACMDVTDSDHKPVRCKFNVKISHVDRSVRRKEFGVVMTSSEKIRSILEDLCYVPEATVSPNSLVLQNLDTSMLLITNRSTKDKAIYKITCEGQSIVKNDGQAPDYSPRGGFGFPRWLEVTPAAGIIKPEQSVEVSVRHEDLHPSEESANGIPQNWWNEDTRDKEVILVVHVQGSSSVQTSCQQIHDFPYASLFEVEDLEAREVVSNGDNNHSVEGFQLGKVGERDDEDKFDVGRKGSW

SEQ ID NO: 162892 - protein, 262 aa, Glycine max
  Coding DNA Sequence Number=SeqID_46114
  Gene Ontology: Mol. function=ion channel activity; Cellular component= viral envelope; Biological process=cation transport
  Homolog annotation: Hit_ID=Q4LDF9; Match level="QueryCoverage=88%, HitCoverage=74%, E-value=1e-90, Identity=69%"; Hit description=Outer envelope protein
MESAAENPNYPAVDYKRPSILSFPRRPALRVTSEFDSESAVFFHKISCKLLDSLAKFKFSFNHSGKGGDISEPQFSFVSKHLSLHYDLEDHNALVKTSIDLAPSLQLTASHDLKAQQGEVTVLANLADPAYSLQLSTPLPSVGLPKATFRFPLGELSLQEKQEEEVNNLLSVDGVLKGQLFNGLCSAHYKDEELKLRYGYKDDEISFLPILSLPSNALSFAFKRRFGPSDKLSRFLTNGFHLSDPYIITWDNIFTNTERCGI

SEQ ID NO: 162893 - protein, 78 aa, Glycine max
  Coding DNA Sequence Number=SeqID_46115
MGDFISRLSFPACWHFSEENTETFSSLTSYPELRRSEFLIGGYVGARASLLSTTPPFVAMTQELVARGDTLRLSATRV

SEQ ID NO: 162894 - protein, 232 aa, Glycine max
  Coding DNA Sequence Number=SeqID_46116
  Gene Ontology: Mol. function=ubiquitin-protein ligase activity; Cellular component=ubiquitin ligase complex; Biological process =protein ubiquitination
  Homolog annotation: Hit_ID=Q5VRH9; Match level="QueryCoverage=87%, HitCoverage=35%, E-value=1e-21, Identity=29%"; Hit description =Putative cell death-related protein SPL11
  Pfam annotation: Domain name=U-box; Domain location=27-101; Score =51.6; E_value=2.6e-12; Accession=PF04564.6; Description=U-box domain
MERKYDNANIEAGVDLKVMIEEMESIHVPSVFICPISHEPMQDPVTLCTGQTYDRSNILKWFSLGHKTCPTTMQELWDDVVTPNSTLSHLILTWFSQKYLAMKKKLEDVQGRALEILNTLKKVKGQARVRALQDLRQLVSSHVNARKTLEENGGVALVFNFLGPFTSHAVGSEAIGIIVCMDLSSEVKRSLMHPAEISLLVDIMNEGTIETKMNCAKLIEMLLMEGNNEVVS

SEQ ID NO: 162895 - protein, 302 aa, Glycine max
  Coding DNA Sequence Number=SeqID_46117
  Gene Ontology: Mol. function=transporter activity; Cellular component= integral to membrane; Biological process=transport
  Homolog annotation: Hit_ID=Q6D950; Match level="QueryCoverage=93%, HitCoverage=67%, E-value=1e-126, Identity=76%"; Hit description =Probable transporter
MGRRRPAGDGERAGQKARAVRLLPAVGRADRLLLRQRHLPAALLAAERPAVYGLGLARAVHPLRGAGADRPVRSGRQTGESAARHAAEQASESHYPRHLHHAGDLHAVLSDDGVFDDLRHRAAAAGPRLLPQQLPVDADGGGDRLRRDGADRRPAGGCVRPPQDHDRHYPADDRLRVPVPAPAGFRQSGAGDGLSAVRPEHHGADLWPDGRAAAGAVPDRSALYRRVVLLQRRVDPRRVRGALYRHLAGGPLRAVLRRHVPGGDGRVDAAGPAVDERNPPPVAVIPCGPLTAGAARVVRLLS

SEQ ID NO: 162896 - protein, 107 aa, Glycine max
  Coding DNA Sequence Number=SeqID_46118
  Subcellular localization annotation: CTP_CleavageSite=54; ConfidenceScore=5.38e-01
MELSAFSSFKAVSDASLFPFSSNQLWCRCSLPLRRRDYGLCWSPKSKPCFRIRMCSEKASSSNGYGGIDCGETTNSDFVEVIVIGSRKDAVFDFCLNSPFQLPSPRF

SEQ ID NO: 162897 - protein, 513 aa, Glycine max
  Coding DNA Sequence Number=SeqID_46119
  Gene Ontology: Mol. function=inositol or phosphatidylinositol phosphatase activity; Biological process=vascular tissue development (sensu Tracheophyta)
  Homolog annotation: Hit_ID=Q1S015; Match level="QueryCoverage=74%, HitCoverage=33%, E-value=0.0, Identity=81%"; Hit description =Inositol polyphosphate related phosphatase; PapD-like; WD40-like
PVLAIVFSSYGDLWSGSEGGIIKIWPWESVAESLSLSPEERHMAALLVERSFIDLRAQVTVNGVCSISSQEVKSLLCDHVRGRVWCAGPLSFSLWDAHTKELLKVFNIEGQVEDRVDMSSVQHQDQAIEDEMKVKFVSTSKKEKSQGTSFLQRSRNAIMGAADAVRRVATKGAGAFVEDTKRTEALVQTGDGMIWSGCSNGLLVQWDGTGTRVQDFNRHPCAVQCFCTFGTRLYVGYVSGIIQVLDLEGNLVAAWVAHNGPVIKLAVGCDYVFSLATHGGLRGWIIASPGPVDNIIRSELATKEFIYTRLHNVRILIGTWNVGQGRASQGSLSSWLGSIASDVGIIVVGLQEVEMGAGFLAMSAAKETEREGLGVWDLLKFNYALVGKWWWNLFHHHEDLWAQGDPGGEYTVGSAYRALNQFIIEEDDERAFSILWKLKIPSKVSHFAWRLVRDRLPTRMNLRSRHIVMVKSAARFAKTTTRMQKGQKNTFSSILNAFRVVFLNIDGRFGGPL

SEQ ID NO: 162898 - protein, 75 aa, Glycine max
  Coding DNA Sequence Number=SeqID_46120
MCLGTTKRLPLATMNQRKQALHLWVKKFKECTGQEEHKWVKWKVINSREENGIPEAEIPPVPGKIKMGANKLFQF

SEQ ID NO: 162899 - protein, 118 aa, Glycine max
  Coding DNA Sequence Number=SeqID_46121
MTRVVKSGSFRSSKIPNLVFILFRREGDDIEGEGDDKWDEVGGASGNNKGRRREWREGRLKKRKEQLTFFGGFSRQYLYLINDITFECTLLEGGKLMAQSRPNAKWRGESKRFDLQVY

SEQ ID NO: 162900 - protein, 624 aa, Glycine max
  Coding DNA Sequence Number=SeqID_46122
  Homolog annotation: Hit_ID=Q2R820; Match level="QueryCoverage=96%, HitCoverage=96%, E-value=0.0, Identity=63%"; Hit description =Expressed protein
MDETEVENPIFMEIKSEDKRNENQGFASEKGEGSSVVFSREAPLMRKESRMSTPYCCNAKKLKSRDVTTDCELGSNEKFGLEKKLCRQDRIELGRLFQSAVSSHDWELAESLILVADPQTLNDALCITLDSIWFLSTELELNGIMGFIKKIIANGAYDFTRAALRTSFLASCVSACQSRTMSLADTVTVMAQRLHERLQECNGDEVLKAEAGAKVQKFTEWALKCIGIHSRLQDDRENVIHSSAVEIQLRLSAFKTFLDLAGSRLTGKDFSEAFDAACFPLTLFSSSFDPGWAFGLSATVIQGLLGMLVEGGADNVNQCFLEASRFGSTELVRILLQSAENFWFIFVYHAVNQTMQIAQRNSLDVDVDLALGFASHYGKIGTMECLVEEGNAIAFLGPLMRAAERGCMQVVEWFVQRGCRDMELCLALTAATSSCQVHIAAYLLPHVPQQVLAALSVEILKAAGERSGGSLDGVAFLLQSDFLGDPAATYAVADIIAKSEDEAVAPELKTFLKEHWSEGAYKEGLRLGQEHYMNLVRIIRWGESPICLRDLPAPLTVAIAYLPLYRECVKTGGFLFSQRLRGQLVEAARRLGNRVLDEVIHGRELVVVLEQHLPHFLLHPTRIA

SEQ ID NO: 162901 - protein, 40 aa, Glycine max
  Coding DNA Sequence Number=SeqID_46123
MREMRERRRGILQAYGQESMFPFSITRQRIEWDHPKHSQR

SEQ ID NO: 162902 - protein, 68 aa, Glycine max
  Coding DNA Sequence Number=SeqID_46124
MLVQLSLVATLRGEWVLVTVCTNKGLRTLTHRQKCILGEANVALHDDDNKVVLGQHELNDGVEVGINK

SEQ ID NO: 162903 - protein, 107 aa, Glycine max
  Coding DNA Sequence Number=SeqID_46125
  Gene Ontology: Mol. function=metabotropic glutamate, GABA-B-like receptor activity; Cellular component=membrane; Biological process =ion transport
  Homolog annotation: Hit_ID=Q1T013; Match level="QueryCoverage=50%, HitCoverage=10%, E-value=7e-12, Identity=62%"; Hit description =Ionotropic glutamate receptor; Extracellular ligand-binding receptor
MIEAESPSFYLVAMRSKALNLVHVLDSAAAATTTAPVVVSPMRLWIHVLHEIQQKSLMDGFSQITGVQYKFILFGDGDKNPSYCDLVNMITSDVFDAAVGDIAIVSV

SEQ ID NO: 162904 - protein, 61 aa, Glycine max
  Coding DNA Sequence Number=SeqID_46126
MDKDDILWADLVGDDNNEGEKEETNIETKSNCFRCSSFRIDVIDQNEVVTTIMEYPQSEEA

SEQ ID NO: 162905 - protein, 126 aa, Glycine max
  Coding DNA Sequence Number=SeqID_46127
  Homolog annotation: Hit_ID=Q1S726; Match level="QueryCoverage=42%, HitCoverage=10%, E-value=1e-15, Identity=75%"; Hit description =Phosphofructokinase, putative
MDEDRPETHDGRPKRSTKRLEKPSELKPNVSLSSVKVVTDLVVVFDDVEPCLIGSVLFLGTKFVDSDSDVLVIDKSFGFDTAVEEAQGAINFAHVEAESTENGIDIVKLMGRYSGKYHLHYGSLQF

SEQ ID NO: 162906 - protein, 46 aa, Glycine max
  Coding DNA Sequence Number=SeqID_46128
MRAEDAEGHGAASEEADGERPYKKPMDVEELTVITGTHNESLVSCV

SEQ ID NO: 162907 - protein, 67 aa, Glycine max
  Coding DNA Sequence Number=SeqID_46129
MAADILESNKLFLYLKNRQEEQESKAAEGVKIGMAGMFGCSCHWQWAEAKSMGMGCWFYTHPCSEAF

SEQ ID NO: 162908 - protein, 130 aa, Glycine max
  Coding DNA Sequence Number=SeqID_46130
MEITKSLVSNNNNKKNKCTPSRLVGPDGVGLLVLPRKVELKDDSSLLVATYQPLPAAFTKQSSYYTKANSFYITCSKLKYSNQNWRNNVGLGWKRMKERLRDRKMQRVQRPTKHEQVFGCWKLERAKCRE

SEQ ID NO: 162909 - protein, 104 aa, Glycine max
  Coding DNA Sequence Number=SeqID_46131
MQSLQDRALQRPIITVELFIEKVSWPGAQPSLVREGGGPTAQVPQQVEDASFEATVPEPFFYEAGGTQTRQEAATPEKTPQVTADPPSPVVDLSHPQQAADLPT

SEQ ID NO: 162910 - protein, 174 aa, Glycine max
  Coding DNA Sequence Number=SeqID_46132
  Gene Ontology: Mol. function=transmembrane receptor activity; Cellular component=membrane; Biological process=defense response
  Homolog annotation: Hit_ID=Q1SI47; Match level="QueryCoverage=98%, HitCoverage=25%, E-value=1e-50, Identity=58%"; Hit description=TIR
MPNIDIYNAMRLSYDDLDHKEQKILLDLACFFMGLNMKVDHIKVLLKDSEKDDSVAVGLERLKDKALITISEDNVISMHDIKQEKASEIVRLESIVDPGNRSRLMHPDDTYEVLKYNKGTEAIRSIRADFKYNQDGFPLLPCSLQSFPVELRYLAWMHYPLKSLAENFSVENLA

SEQ ID NO: 162911 - protein, 404 aa, Glycine max
  Coding DNA Sequence Number=SeqID_46133
  Gene Ontology: Mol. function=nucleoside-triphosphatase activity; Cellular component=integral to membrane; Biological process=transport
  Homolog annotation: Hit_ID=Q1SCH7; Match level="QueryCoverage=94%, HitCoverage=43%, E-value=1e-113, Identity=54%"; Hit description=ABC transporter, putative
MSPFILCLLLVLLQSLVENQLDKAENKCGCVCVRRQGDTCLEEECGVEHSDLDQVATLPAPQYRAVRTDYFPFSDFPNSSCRRNGSCPVTMFFTGTNQSFGEIISRNMIPSNLSSINSSDITASLASNVVGSDSEPENTNFLEPAFFSDLPIYYLQNQCTQNSTFSVSLQIAGISKQQELGVGRGGGEVICAQGLRLWRNSSSEVNNELYKGYRRSNTERQINEIAAGYDFLNSNRSIFNVSIWYNSTYKNDTGFNQIALARIPRSVNLVSNAYLQFLLGPGTKMFFEFVKEMPKPETPIKFDLASLLGGLFFTWVILQLFPIALTSLVYEKQQNLRIMMKMHGLGDGPYWMISYGYFLAISIVYMLCFVIFGSVIVLAYIGVFGTGLLAGFLFQFFVQDTSFP

SEQ ID NO: 162912 - protein, 38 aa, Glycine max
  Coding DNA Sequence Number=SeqID_46134
MAPYRILGCLAATFSACPAPGRDDDLSVVTLSSICIRP

SEQ ID NO: 162913 - protein, 70 aa, Glycine max
  Coding DNA Sequence Number=SeqID_46135
MARSVFASCPYLRDLQGRELTRLLAIIPKVVISLLMVSRGIIPFEEHIVAVGTTSNNRFSKRKAPDEGSL

SEQ ID NO: 162914 - protein, 330 aa, Glycine max
  Coding DNA Sequence Number=SeqID_46136
  Gene Ontology: Mol. function=protein binding; Cellular component =integral to membrane; Biological process=defense response to fungus
  Homolog annotation: Hit_ID=Q1SWI7; Match level="QueryCoverage=99%, HitCoverage=85%, E-value=5e-55, Identity=34%"; Hit description =Leucine-rich repeat
  Pfam annotation: Domain name=LRR_1; Domain location=119-141; Score =0.6; E_value=2.2e+02; Accession=PF00560.23; Description=Leucine Rich Repeat
  Pfam annotation: Domain name=LRR_1; Domain location=148-170; Score =1.6; E_value=1.4e+02; Accession=PF00560.23; Description=Leucine Rich Repeat
  Pfam annotation: Domain name=LRR_1; Domain location=172-194; Score =12.3; E_value=1.4; Accession=PF00560.23; Description=Leucine Rich Repeat
  Pfam annotation: Domain name=LRR_1; Domain location=196-218; Score =10.4; E_value=3.2; Accession=PF00560.23; Description=Leucine Rich Repeat
  Pfam annotation: Domain name=LRR_1; Domain location=220-243; Score =8.2; E_value=8.3; Accession=PF00560.23; Description=Leucine Rich Repeat
  Pfam annotation: Domain name=LRR_1; Domain location=23-45; Score =20.3; E_value=0.0068; Accession=PF00560.23; Description=Leucine Rich Repeat
  Pfam annotation: Domain name=LRR_1; Domain location=245-267; Score =0.7; E_value=2.1e+02; Accession=PF00560.23; Description=Leucine Rich Repeat
  Pfam annotation: Domain name=LRR_1; Domain location=293-315; Score =8.3; E_value=7.8; Accession=PF00560.23; Description=Leucine Rich Repeat
  Pfam annotation: Domain name=LRR_1; Domain location=47-69; Score =22.1; E_value=0.002; Accession=PF00560.23; Description=Leucine Rich Repeat
  Pfam annotation: Domain name=LRR_1; Domain location=71-93; Score =15.3; E_value=0.23; Accession=PF00560.23; Description=Leucine Rich Repeat
  Pfam annotation: Domain name=LRR_1; Domain location=95-117; Score =14.7; E_value=0.34; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =119-141::148-170::172-194::196-218::220-243::23-45::245-267::293 -315::47-69::71-93::95-117
MYLDLSYNNLLGTISDALGNLTSLVELDLSRNQLEGTIPTSLGNLTSLVELYLSNNQLEGTIPPSLGNLTSLIRLDLSYSQLEGNIPTSLGNLTSLVELDLSYSQLEGNIPTSLGNVCNLRVIRLSYLKLNQQVNELLEILAPCISHGLTRLAVQSSQLSGNLTDHIGAFENIVLLDFSNNSIGGALPRSFGKLSSLRFLNLSINKFSGNPFESLGSLSKLSSLYIDGNLFHGVVKEDDLANLTSLTEFGASGNNFTLKVGPNWRPNFRLSYLDVTSWQLSPNFPSWIQSQNKLQYVGLSNTGISDSIPTWFWETPSQISYLNLSYNHIH

SEQ ID NO: 162915 - protein, 56 aa, Glycine max
  Coding DNA Sequence Number=SeqID_46137
MEGPVSFGFSNVFLSINVGGDSMHFPPMEDAPVSLALLARRRVGCDSWRLHWGLFL

SEQ ID NO: 162916 - protein, 281 aa, Glycine max
  Coding DNA Sequence Number=SeqID_46138
MQIGQDHPSIGVPLQDIVCLLEKILSHGRNDTRQTFLPTRSWPEKKFAQQATTASKERLRKRFQPPQQVQPPQQAQPPQQAPLAPPRPQKFLHQSSKACFRELLLRKFHPKREVKLKPGEFQEFQDEIEERKWTKFLSFPVKYNEELLREFYANALPRHETGSFRTSWVRGAMVRYDFVAIKEFLKTDFQDPEVQLCTYFESKDLDDFDPNKLPKVLSIPRKCYVKSKENSKAYKFKRDALRTISPIWMSFVFSNIAPTLHTSNLSRVCFSHLLHFDLSPY

SEQ ID NO: 162917 - protein, 123 aa, Glycine max
  Coding DNA Sequence Number=SeqID_46139
MGGMGRGLRINAPSDRTGGVGLDAMRWVNRVGPLPIEPMYHFLQFSHWNTKRSADKRWEVLWIALSLTIWNHRNNLVFNNQLFNPEKVMDEALFHTWSWLRWMEKGFQTHFNLWSTNLKDELS

SEQ ID NO: 162918 - protein, 217 aa, Glycine max
  Coding DNA Sequence Number=SeqID_46140
  Gene Ontology: Mol. function=nucleic acid binding; Biological process= DNA integration
MNCEITCCFEIITLLLELSRLDLNQEGETLTDSSESKPWGESDLTYPLCGVSCYVLLTPCESSPKFEEELGRNKLCRQKKSLYGLKQSPRAWFEQFGTMEDDTILTGYDSLELKGLKEKLAKAFEIKEHDPLKYFLGIEFARSKEAVETPMKSNIKLQPVETENMVDKGRPISRHLNERITQETLQQHNQQVVHGRYLQASLRGNVDRVPKEDKISI

SEQ ID NO: 162919 - protein, 80 aa, Glycine max
  Coding DNA Sequence Number=SeqID_46141
VRAVMQVGSATFIIRVIKHSGICSGDSKILQVASRFQDVTTSHVTSAFCSPCLHAPTAVKQFTAAFCKLQVVSRMSRHLT

SEQ ID NO: 162920 - protein, 230 aa, Glycine max
  Coding DNA Sequence Number=SeqID_46142
MASTNRVKLQFGLQQDIPVDPMNLDLVHHIDMRGNHYTDWMEYHAEWINIWKNKHNDILAGQWVEGIVTHTPTYMEWYRKNTTLFLSIEQQLHDPRTTITQNVARSGVEQTHFEIPHPQSMYSTPSPVHQTFGHTGESVTATTHEWMTDLFGVDFNTPNSATSYLATLQQFDAPHSLGEQGESSSAATTNIENTNIEQQHDHDVEEPVILERRNPRRNRRPPPCGTGHRL

SEQ ID NO: 162921 - protein, 328 aa, Glycine max
  Coding DNA Sequence Number=SeqID_46143
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-42, Identity=31%"; Hit description= UPI00006A17C9 related cluster
YSHLRGLHALAFRGLHALTFRGLRVLAFRGLHVLAFRGLHVLTFTGLHALAFKGLHVLTFRGPHALAFKGLHALAFRGLYVFAFRGLYTLTFRELHILAFRGLNVLVFRGLHVLAFRGLHVLTFRGLQVLTFGGQNALTFRGLHVLTFRELHALAFRGLHALAFRGLHTLTFRGLDALAFRGLHGFTCRGLHALTFRGLHVLTFRGLHALAVRELHILTFRGLHALAFRGLRVLGLRGLHALAFKGLLVLAFRGPHALAFRGLHVLTFKGLQVLAIRGLHVLTFRGLHALAFRGLHFLTFKGLHALAFRGLHTLAFRELHAFTFKGLH

SEQ ID NO: 162922 - protein, 222 aa, Glycine max
  Coding DNA Sequence Number=SeqID_46144
  Gene Ontology: Mol. function=ATP binding; Biological process=defense response
  Subcellular localization annotation: CTP_CleavageSite=57; ConfidenceScore=5.75e-01
MASPPASPPPPPLSPPPPDPSDTSASPSAMKRTHKASRLRSLSTRPPGAERPVVHVNPATGKTDGPHKKKLRTYLGIVARDKMDVTYENWKEVPTAQKHLIWEDIQVEFEIPEASDSRMKRKLFQTVGERWRQFKSDLTRKWALAADQDGVEDTVSEKYGISKEKWAQNCAKRHRPSRNRTLPPHGLSRGGYEYLEQKLLAEKTKKKLEEVAQSGSCTVKKR

SEQ ID NO: 162923 - protein, 89 aa, Glycine max
  Coding DNA Sequence Number=SeqID_46145
  Subcellular localization annotation: CTP_CleavageSite=29; ConfidenceScore=5.25e-01
MDPGLTHKNTPQKSRQLSQHAFLRVSKARLSGESSKGGKCAESPPTFICGKRLKSRRKPIIKNIPDLGVVFTFEEGISTSHVCPKGQQP

SEQ ID NO: 162924 - protein, 67 aa, Glycine max
  Coding DNA Sequence Number=SeqID_46146
MALAASEAHGVRKGHYNAICCWMDFINFSSLWGPASSSYSYVHYYSSLSTFCFVVKTNTVEEKQLEV

SEQ ID NO: 162925 - protein, 147 aa, Glycine max
  Coding DNA Sequence Number=SeqID_46147
MEKYLVSHKPPIEKVQPHRRSWRCQWKRGSVELNGRFERNYRHEMLDLLIRSYSETNRLIGEANGDGHLPFRKQGISAVDFDNKGIYLVSVTKSGCLTVHDFEALYCQIPELTCLKEDESKHLMHLSLNQQLDAVRWNPLNQDEVSA

SEQ ID NO: 162926 - protein, 481 aa, Glycine max
  Coding DNA Sequence Number=SeqID_46148
  Gene Ontology: Mol. function=protein binding; Biological process =defense response
  Homolog annotation: Hit_ID=Q109S4; Match level="QueryCoverage=51%, HitCoverage=18%, E-value=3e-68, Identity=52%"; Hit description=NB -ARC domain containing protein, expressed
MDRLSQSSSDSSSTRGDPKVLSIECLKGSSKADEWTGDMLQTGDIVEELRIGNSPNALIRFQSPFKNGKSGVSRILQDSYKKKETSILVRVRRGPHEFAELQACIVPNDSSGKKHYVLRSITDPNYVVGFLDRTETKCFQLQASRTSRMVNALTRTRLQDGYVSYPWERRMQELLSVPNSSNFLSILLLPKVSDRIASRYNDVEDTLARANTWLNATQASGVPIVFMNVQTESLLTKISGETASSTVNAGSLSDVSNLANASLYGFEDYHGVDIGVVRAVRLWYAPIGGEISIEIKLKEDDTKLGFAISRTEEGFIFIQTVIEDDQENVPATRSGLSNLYKAAKDASKLLVVSNLSNQRVLPWMVSSTGAIRCYDTVSLSQKLSLHRHTKVPILLHVFLWDRKLASSVESTRLSNLSPSVLPLPLPPEVQLARHPNENQIQPLPHEGSDAGDGSQPMQLERDTAGDLSFRFNNFSVSNNWV

SEQ ID NO: 162927 - protein, 230 aa, Glycine max
  Coding DNA Sequence Number=SeqID_46149
  Homolog annotation: Hit_ID=Q019D3; Match level="QueryCoverage=93%, HitCoverage=33%, E-value=1e-12, Identity=27%"; Hit description =Homology to unknown gene
VLRTRQTTTVNGSSIHKGLSDVAFTKNDTRILASDTHGAINVWDRRVNTLPCLELASASCGTLNSIQLNADNQIIFGAGKHGLVYVWDIRGGRASATFQSLKEICHPPVTSVKLATLLEKIGSLKFGVLVRVVFTSGFSPDYTVCNKMSGFHHLAQANIVPKEIHSIDIDPSCPYQLAFHLVDGWSGVLDTNNFQVTHIHCPPPAWLNDSYIPADLSYLRKPSWLSTGSA

SEQ ID NO: 162928 - protein, 398 aa, Glycine max
  Coding DNA Sequence Number=SeqID_46150
  Gene Ontology: Mol. function=acyltransferase activity; Biological process=response to oxidative stress
  Homolog annotation: Hit_ID=Q1RYZ2; Match level="QueryCoverage=37%, HitCoverage=10%, E-value=4e-47, Identity=65%"; Hit description=NAD -binding site; Serine/threonine dehydratase, pyridoxal-phosphate- binding site; ...
  Homolog annotation: Hit description=AMP-dependent synthetase and ligase
MPLPLKSPSTRWIFVKWLALYKAQGISSTVLAVHLRGTVFLNYWFEILGARIGSSVLLDTVDITDPSLVSIGDEVVIAEGVLVQIHEVKNGILSFHPIRIGKCSSIGPYVVIQKGSVIEEGAENENYLLSAKLNVISSTTLWESILLAFSAPLLQSLPTYYIFGSPSNLHHPSTSPLFAYMVPSIGYRLQSLHMLPCFLKSRQIPSPLPFHLPAPTCFMLLSGTEAFCIYLCLLGAKIGEHCSIRAINPVSNPELMSIGAGVHLGDFSRVITGFHSSSGYVGGKIEVQDNLVSGSQSLILPGSLVQKNVILGALSVAPMNSTFREGGVYIGSQSQVVIRNSVKNSYDEGKEETDMVSKIRVGNLAAALHKNESHKVTLTRTWYQTFFTQPLLQTVQDF

SEQ ID NO: 162929 - protein, 588 aa, Glycine max
  Coding DNA Sequence Number=SeqID_46151
  Gene Ontology: Mol. function=carboxypeptidase activity
  Homolog annotation: Hit_ID=Q1SIS3; Match level="QueryCoverage=69%, HitCoverage=85%, E-value=2e-67, Identity=36%"; Hit description =Peptidase M14, carboxypeptidase A
  Pfam annotation: Domain name=DUF827; Domain location=216-379; Score= -109.0; E_value=0.025; Accession=PF05701.2; Description=Plant protein of unknown function (DUF827)
MAATTATSAQVFKDYKDSNNGNPEITRHEIQAAIAKAVELRALHAALMRGNSPANARFPSPSPASRPVAHFSAQDYPVFTPSYEDDPLVGYNQNSMKSLTVSESWDGSMLEGGNNIDNIVADYKERSSSRKGLYAGFANLESHICPTEDTKSVTGSSANQITVLQTSPPKDYFKCRRRNSMEDFKSVSSCNKCNPATLTSEFENARNSKSSNIVVQVTDSRSSLQSQTKNKGVISWLFPRLKKKHKNENSPNRAESEDVSQVLKDLGIMSIETLKKELVEANENRDMALMEVSEMRNSLGELKQKLEYLESYCKELKKALKQAVQPRDFQLCDQLSSLPQSRKSFEGNGENLMPVSEEVMVEGFLQIVSESRLSVKQFCKTLINHIEETDHSLTENLNFLLQPYKLSLNSKYSKAVLYHFEAFINQSLYQDFENCVFQKNGCSKFLNPQQDRQTQFSSFVALRNLSWNEVLRKGTKYYSEEFSKFCDQKMYCINTSLKWTRPWPEQLLQAFFVAAKCMWLLHLLAFSFNPPLGILRVEENKTFDPQYMEDMCPRSQGPRRVKIMVMPGFYVQDRVLRCKVLCRYKSAA

SEQ ID NO: 162930 - protein, 954 aa, Glycine max
  Coding DNA Sequence Number=SeqID_46152
  Gene Ontology: Mol. function=oxidoreductase activity; Cellular component=nucleus; Biological process=electron transport
  Homolog annotation: Hit_ID=Q1RYZ2; Match level="QueryCoverage=97%, HitCoverage=77%, E-value=0.0, Identity=68%"; Hit description=NAD -binding site; Serine/threonine dehydratase, pyridoxal-phosphate- binding site; ...
  Homolog annotation: Hit description=AMP-dependent synthetase and ligase
  Pfam annotation: Domain name=AMP-binding; Domain location=368-764; Score=160.9; E_value=3.3e-45; Accession=PF00501.18; Description=AMP -binding enzyme
  Pfam annotation: Domain name=PP-binding; Domain location=867-933; Score=42.7; E_value=1.2e-09; Accession=PF00550.15; Description =Phosphopantetheine attachment site
  Pfam module annotation: Pfam domain module=AMP-binding::PP-binding; Domain location=368-764::867-933
WCWSTWLISSLCTARLGYKNITVLEKHHTVSGMCESVEIEGKVYDLDGQVLAATSTPIIFRLARETGSALEELDSHKLAVIDPSSGEYQDTKVADDYVSIVSLTLEIQEKVKNCDRIGVHAVSDIASDLTPEYLEHHGLKSVPKSVAYDGYTSLWQKIAELLPLKLHCSTEVLANRRNSDGVTVNIKSLNQFETLEFDKIIISECETEVMDASDLEKDLFSKVETNDYYTTVLKIKGLEHLPVGFYYFSEYMKDPSTIGHPVAMQRFYADTNIFLLWSYGNSVDIKGPTVMELAIKTIEAIGGENLFPLQAECQKKNPRELGELPEVQFPDLPTLNSYFKHWGTHLITQNRNLYTWINEEGTPVCQRTYGELYFNSSCIAHNLLTSQKPVIKPADKVLMVYAPGLDFIDAFIGCLRAKVIPVPILPPDPMQRNGQALIQIENIAKSCNIVAILSTVAYHSAVRAGSTSDAKGVMIAHGGLIHNVKFMRTRYKSTSRTILVSWLPQYHDMGLIGGLFTSLVSGGSAVLFSPMTFIKKPLLWLETISKYQATHSARPNFAFELLIRRLESDKDKLRNLDLSSLTFLMVAAEPVRQKTLKRFIELTSPFGLSEKVMAPGYGLAEDCVFVSCAFGERKPIIVDWQRRICCGYVNHEDADVEIRIVDPETCEELQEDGKEGEIWISNPSAGIGYWGREELSQKTFRNELHNHPRRSYARTRDLGRIIDQKLFITGKIKDLIIVAGRNIYSADVEKIVETSSEFLRPGCCAIIGVPEEILSAKGISIPDGSDQPRTISKTTSGKIKGFECVKQFTDETLNLVPQGSKTILTKKSLLRSFTTRTWGEEKTPGPQQVRGSILAPRKRINKNEIVELLKGLISEQTGIPVNDISITDNLTSYGIDSIGVVKATQKLSDFLGTPVAAIDVFTASCILELANFSKDLLSKSQPSLSSNPSNVPEA

SEQ ID NO: 162931 - protein, 278 aa, Glycine max
  Coding DNA Sequence Number=SeqID_46153
MATMMEATMSMKKIMEANAVAIAASSTVAKVNSMPPSGLNQMNHPTSAMVGKDLGSTGGPHYAQIQNEHAFPPYGLPPNYTPPNVAYTPNENTHEIPHHNLADFEPCLGYSTEGQAVGGIPLQNTLEGPQYHPQPFPSHSTAIKNPHAMAEMGKLDHLEERLRAIEGGKDYAFANLEELFLVPNIITPPKFKDLMVAYVRQYQYNYDMVPDRMQLQNMCKKGHESFKEYTQRWRDLAAQVAPPMMGREMVIVMVDTLPVFYYENGGLHTFKLCGYGLH

SEQ ID NO: 162932 - protein, 78 aa, Glycine max
  Coding DNA Sequence Number=SeqID_46154
MALYLASIQMYILQNKDLDMTCTNGHWRKHVKATYIMLVLLEGTDMRHRHRRPRSPVAPLVHEKTETSTGLHEHVLFF

SEQ ID NO: 162933 - protein, 72 aa, Glycine max
  Coding DNA Sequence Number=SeqID_46155
ITPARHLVDPKKSNRVLGFPALITGPCQFYGVPVDPNKFIRLLLIGLSLRSTVPPGKRRARHHSSLGMAGSG

SEQ ID NO: 162934 - protein, 95 aa, Glycine max
  Coding DNA Sequence Number=SeqID_46156
MASKKRKAPSTPSQIRFDRSRFHSQEAWKLLPERNVVVYYTKFDEFKEELERRHKDEEFTDFTDDNINVAIVKEFYTNLYDPEDKSPKQVCTLEA

SEQ ID NO: 162935 - protein, 211 aa, Glycine max
  Coding DNA Sequence Number=SeqID_46157
  Gene Ontology: Mol. function=transporter activity; Cellular component= integral to membrane; Biological process=auxin mediated signaling pathway
  Homolog annotation: Hit_ID=Q05G09; Match level="QueryCoverage=98%, HitCoverage=39%, E-value=7e-68, Identity=69%"; Hit description=Auxin efflux carrier
  Pfam annotation: Domain name=Mem_trans; Domain location=1-211; Score=- 46.3; E_value=1.7e-05; Accession=PF03547.8; Description=Membrane transport protein
GLEAVLGVEDFKFPVNGEEQVGEEKEGLNNGLNKLGSSSTVELQPKATVAGEASAGKHMPPANVMTRLILIMVWRKLIRNPNTYSSLIGVVWSLVAFSNNQSDLVFTLLGIMPPDTWGPGYKLGHFAEDNGSGLFMALQPKIIACGNSVATFAMAIRFLTGPAVMAAASIAVGLRGTLLHVAIVQAALPQGIVPFVFAKEYNVHPAILSTA

SEQ ID NO: 162936 - protein, 129 aa, Glycine max
  Coding DNA Sequence Number=SeqID_46158
MEESIHVSFDESNAIPPRKDIAESLEQMHIHGQDSKGKGEGSNEDSQVDETKTNDDLPKEWKASRDHPLNNIIGDILKGARLTGALSKEGKMHGVATNEGISTSYVDKSGALAPTYPPSKRKSDLRSSS

SEQ ID NO: 162937 - protein, 341 aa, Glycine max
  Coding DNA Sequence Number=SeqID_46159
  Gene Ontology: Mol. function=nucleic acid binding; Cellular component= chromatin; Biological process=DNA integration
MARTMLNGNSTKVQEKVEESTERIKRSNHHEIQIIGDPVDRVQSRSSLKIEGHTALISEMKPKHIDDAMQDDNSIKAVQEELDQFQRNDVWKLVELPKGKKPFGGIWIFCNKLDENGFESETLPQYGFKLNKALYGLKQAPRAWYEKISSFILKNGFEQGKFEMSMMGELKFFLRLQIKQTPKGICIYQTKYVKELLKKFNMNDAKEIKTPMHPMTYLGLDEESTKVDGTRYRAMFGALLCPIAFRPNIMFSVCLCSRFQKEPREFHLTAVKLIIKYLIETSNLGLLFKRKERFKFTSLCDVDYAGGKVERKKHNWKLSLYWWKLSDVDMQEPRLNYIVHC

SEQ ID NO: 162938 - protein, 487 aa, Glycine max
  Coding DNA Sequence Number=SeqID_46160
  Gene Ontology: Mol. function=RNA-directed DNA polymerase activity; Biological process=RNA-dependent DNA replication
METMMSMKKILEVNATVVAATNAIAEVDSTPPSGLNQIIHPTSDMVGQGGKELGSTGAPHFVRVQNKHPFLPYGLPPNYAPPNVAHAPDENVNNYSPILIESQQPQADHSHVSQPMGETHEIPHHNLADFEPRLGYATEGQAVVGKVPPAMMEKGKLDHIEEMLRAIEGGGDYAFVDMAELCLVPDIVIPPKFKVSNFDKYKGTTCPKNHLKVYCRKMGAYTKDDKLLMHFFQESLTGTTVTLYTNLEPSRVHSWKDLMIDFIMQYRYNFDMALDGMQLQNMCKKEHEYFKGYAQRFNLADERIEVGLRRGKFDHPALTNKKPGENRENEKEEGTHVVTTIPTWPNSPPAQQYHYSANISPSHYPPSNQLQRPPLNHPMPNTTFNTNQNTNQGRNFPAKKSIEFTQIPMSYANLLSYLLDNSMVAITPAKRPTLLSLTFKPVVATCPLAGKRGEAHGCAFQRRKDARSRHQHLFVENVGKTEGNRSK

SEQ ID NO: 162939 - protein, 80 aa, Glycine max
  Coding DNA Sequence Number=SeqID_46161
MANEELKLQDPRCRIQCPDILLENTGVAIQCKIKIFQKKIDLLQHQGVAAQNRTRLYNHGGCTSSVPSPGLKSYFVSFGT

SEQ ID NO: 162940 - protein, 715 aa, Glycine max
  Coding DNA Sequence Number=SeqID_46162
  Gene Ontology: Mol. function=transferase activity, transferring glycosyl groups; Cellular component=integral to membrane; Biological process=response to oxidative stress
  Homolog annotation: Hit_ID=Q9LXU2; Match level="QueryCoverage=97%, HitCoverage=89%, E-value=0.0, Identity=78%"; Hit description =Anthranilate phosphoribosyltransferase-like protein
  Pfam annotation: Domain name=C2; Domain location=205-287; Score=80.3; E_value=5.9e-21; Accession=PF00168.20; Description=C2 domain
  Pfam annotation: Domain name=C2; Domain location=366-459; Score=83.5; E_value=6.7e-22; Accession=PF00168.20; Description=C2 domain
  Pfam annotation: Domain name=C2; Domain location=44-124; Score=98.2; E_value=2.5e-26; Accession=PF00168.20; Description=C2 domain
  Pfam annotation: Domain name=PRT_C; Domain location=622-714; Score =149.7; E_value=7.9e-42; Accession=PF08372.1; Description=Plant phosphoribosyltransferase C-terminal
  Pfam module annotation: Pfam domain module=C2::C2::C2::PRT_C; Domain location=205-287::366-459::44-124::622-714
MQKAPLAHSNEFALKETSPKIGAGAVTRDKLSCTYDLVEQMQYLYVRVVKAKDLPSKDVTGSLDPYVEVKLGNYKGLTKHFEKKSNPEWNQVFAFSKDRIQASVLEVIVKDKDVISDDFVGRMWFDLNEIPKRVPPDSPLAPQWYRLEDRKGEKVKGEIMLAVWMGTQADEAFPDSWHSDAAMVGSEAVSNIRSKVYLSPKLWYVRVNVIEAQDLIPGDKTRFPEVYVKINLGNQFLRTRVSQSKTMNPMWNEDLMLVAAEPFEEPLILSVEDRLGPNKDEVLGRCVIPLQIVQRRLDHKPVNTRWFNLEKHVVVEGEKKEIKFASRIHLRMCLDGGFHVLDESTHYSSDLRPTAKQLWKPNIGILEVGIISAQGLMPMKTRDGRGTTDAYCVAKYGQKWIRTRTLVDSFTPKWNEQYTWEVFDPCTVITIGVFDNGHIQGGGEKGGGGSKDSRIGKVRIRLSTLEADRVYTHSYPLLALHTSGVKKTGELQLAVRFTNSSFINMLYLYSQPLLPKMHYIHPLSVIQLDSLRHQAMQIVSMRLSRAEPPLSKEVVEYMLDVDSHMWSMRRSKANFFRIMKVLSGLVAFGRWFDQICNWKNPITTILIHVLFIILVLYPELILPTIFLYLFLIGIWNFRWRPRHPPHMDTRLSHADAAHPDELDEEFDTFPTSRSSDIVRMRYDRLRSIAGRVQSVVGDLGTQGERLCHFSLASLC

SEQ ID NO: 162941 - protein, 91 aa, Glycine max
  Coding DNA Sequence Number=SeqID_46163
CALSEYVLLSEAPARSARHRNLEENLPCKHALNTFSLTKRVVRHLPGKDFHIKPENTELEESLECVDPEATEHTKGGILKSFERVFLRDCE

SEQ ID NO: 162942 - protein, 119 aa, Glycine max
  Coding DNA Sequence Number=SeqID_46164
  Subcellular localization annotation: CTP_CleavageSite=6; ConfidenceScore=5.40e-01
MSVSTSSASVSRGRVSLLLQALLQSSLGLRSHGPETGPRPRQGRSPQDPPVRQRRPGQGFAPFASPTPEQFGAEVTWARDWPEAQAGEEPAGSPGEAEEARMDEEMTDLLDFLGGSEAT

SEQ ID NO: 162943 - protein, 74 aa, Glycine max
  Coding DNA Sequence Number=SeqID_46165
MTTLTQIWVMLLLGNILPNDHNTDLLPLRKVPVPPARSYHRDIGIAPARHPVDSEKSNRALVLDQGAPSGCTLH

SEQ ID NO: 162944 - protein, 201 aa, Glycine max
  Coding DNA Sequence Number=SeqID_46166
  Homolog annotation: Hit_ID=Q9AVH2; Match level="QueryCoverage=23%, HitCoverage=16%, E-value=6e-20, Identity=97%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 162945 - protein, 194 aa, Glycine max
  Coding DNA Sequence Number=SeqID_46167
  Gene Ontology: Mol. function=phosphoenolpyruvate carboxykinase (ATP) activity; Cellular component=cytosol; Biological process =gluconeogenesis
  Homolog annotation: Hit_ID=Q94LX9; Match level="QueryCoverage=93%, HitCoverage=27%, E-value=3e-67, Identity=68%"; Hit description =Phosphoenolpyruvate carboxykinase
  Pfam annotation: Domain name=PEPCK_ATP; Domain location=91-193; Score= -350.3; E_value=0.013; Accession=PF01293.11; Description =Phosphoenolpyruvate carboxykinase
IDELHSLQKKKSAPTTPVTGFQAPFATLTEEERHKQQLQSISASLASLTRETGPNLVKGDPARKSDTQKVTHVHHHHVSTPTIAVSDSALKFTHVLYNLSPAELYEQAIKYEKGSFISSTGALATLSGAKTGRSPRDKRVVKDDLTKNDLWWGKGSPNIEMDEHSFMVNRERAVDYLNSLDKLKNYTVNQSEIT

SEQ ID NO: 162946 - protein, 79 aa, Glycine max
  Coding DNA Sequence Number=SeqID_46168
MGTLFFFHSPIPRFSLPSMPKPIALPPLSCLRNNGDVNKIVDMPQSMYDDNQNVKQDNIWQLSKEAQQNILKQTTPWGH

SEQ ID NO: 162947 - protein, 81 aa, Glycine max
  Coding DNA Sequence Number=SeqID_46169
  Subcellular localization annotation: CTP_CleavageSite=61; ConfidenceScore=5.44e-01
MPWVLQLQHPDFVVWFSQGSYQLVSKSSPSCLSAANEWCGWSLALQCSPGTSQRASAQPTRVDSRTAKCGGMLGFNSRYRT

SEQ ID NO: 162948 - protein, 77 aa, Glycine max
  Coding DNA Sequence Number=SeqID_46170
  Homolog annotation: Hit_ID=Q1KVP6; Match level="QueryCoverage=91%, HitCoverage=7%, E-value=1e-12, Identity=46%"; Hit description=Starch synthase IV
MTPLVPRGSVASYVTGISRALHRKGHLVELILPKYASLNLDGVQGLHEVNVEVTSYFNGQLHGNRIWTGLVWLSLSV

SEQ ID NO: 162949 - protein, 321 aa, Glycine max
  Coding DNA Sequence Number=SeqID_46171
  Gene Ontology: Mol. function=phosphoenolpyruvate carboxykinase (ATP) activity; Cellular component=cytosol; Biological process =gluconeogenesis
  Homolog annotation: Hit_ID=Q94LX9; Match level="QueryCoverage=99%, HitCoverage=42%, E-value=1e-140, Identity=84%"; Hit description =Phosphoenolpyruvate carboxykinase
  Pfam annotation: Domain name=PEPCK_ATP; Domain location=1-250; Score =89.7; E_value=8.4e-25; Accession=PF01293.11; Description =Phosphoenolpyruvate carboxykinase
  Subcellular localization annotation: CTP_CleavageSite=48; ConfidenceScore=5.20e-01
MMNTVGVTMVSPTLKVVAMPNALTSHGRKSQIFGMQSGLAQCWKMWCLMSMIEKLITLTSQLQLSSYLQDLIEKQQLTYFIMQENTRAAYPIEYIPNAKLPCVGPHPKNVILLACDAFGVLPPVSKLNLAQTMYHFISGYTALVAGTEEGIKEPQATFSACFGAAFIMLHPTKYAAMLAEKMQKHGATGWLVNTGWSAGSYGNGSRIKLQYTRKIIDAIHSGSLLNAEYKKTEIFGLEIPTEVEGVPSEILDPMNTVSYPRALYLFFFLSFDMWSNKKAYKETLLKLAGLFKNNFETFTNYKIGKGNNNLTEEILAAGPIF

SEQ ID NO: 162950 - protein, 153 aa, Glycine max
  Coding DNA Sequence Number=SeqID_46172
  Gene Ontology: Mol. function=protein transporter activity; Cellular component=integral to membrane; Biological process=intracellular protein transport
  Homolog annotation: Hit_ID=Q9ZSD5; Match level="QueryCoverage=54%, HitCoverage=32%, E-value=4e-28, Identity=62%"; Hit description =Syntaxin-related protein Nt-syr1
  Pfam annotation: Domain name=SNARE; Domain location=48-97; Score =26.2; E_value=0.00012; Accession=PF05739.9; Description=SNARE domain
MQSCISSKFKSVNVKHFWVQCESETFLQKVVQEQGRGRIMDTINEIQEKHDVVKEIQKNLKELHQVFLDMTMLVQHQAPSFVRTGAEQLQTAWKHQKNTRKWTCYCIMLLLVIILFVVLSIVKPWENTSSGRNRGGQPAPTQTPPSPSPLVNA

SEQ ID NO: 162951 - protein, 297 aa, Glycine max
  Coding DNA Sequence Number=SeqID_46173
VEGRIGRVSVERVEELKGLLEVVVVCVKGDDGVPNDDVSGGGEEGEVEGSAGLEGKGEELTQSRCRHPKQWKLLGMEITYSNPSRLKRPINTLNWFELNQIVKEALEKQNNPRRFGVTKDLWGVDRREGGQCRVNPKVIGRFSSTGCQWNCLVDKDTGHHEVCYDDEDNHRIVLVDALEVPVHKAGLSSIGKTTNDGIDYTSYVLGKFQLWRRSSLTLLFLPSSLQCCDQYCGDTSNDRLRLTLAWEVSFGVAAWVPPDFILESGHFFHLDVALGSFAQFIHATEWFFAEVVYELAR

SEQ ID NO: 162952 - protein, 61 aa, Glycine max
  Coding DNA Sequence Number=SeqID_46174
MISIRSSLRRETPLIDSHPRPIAMANTYTLQQLQNRITEMERCHEEESTKLKDDHDQLEAR

SEQ ID NO: 162953 - protein, 226 aa, Glycine max
  Coding DNA Sequence Number=SeqID_46175
  Homolog annotation: Hit_ID=Q9FMZ6; Match level="QueryCoverage=84%, HitCoverage=80%, E-value=1e-36, Identity=39%"; Hit description =Arabidopsis thaliana genomic DNA, chromosome 5, P1 clone:MJB21
  Pfam annotation: Domain name=DUF617; Domain location=66-226; Score =312.0; E_value=1e-90; Accession=PF04759.4; Description=Protein of unknown function, DUF617
  Subcellular localization annotation: CTP_CleavageSite=44; ConfidenceScore=5.20e-01
MHDIPLCIHSLQPAITKSKPGSKYNKLFQRFQSIFRCFPIIMPSCKMPTMNIGNRGNEVYIHGGMRITGTLFGHRKARINLAFQENPNCQPFLLLELAIPTGKLLQDMGMGLNRIALECEKPSNNDKIRIIDEPIWSLFCNGKKMGYGVKREATDDDLNVMQLLHAVSVAIGVLPNEMSDPHDGELSYMRVYFERVVGSKDSETYYMMMPDGNNNGPELSVFFVRV

SEQ ID NO: 162954 - protein, 62 aa, Glycine max
  Coding DNA Sequence Number=SeqID_46176
MEKLFTSQGYLYVPSSDRVWGKKMVTRTSFDVAPCGACRPWIFFINEVLCFLKINGSEMEKE

SEQ ID NO: 162955 - protein, 73 aa, Glycine max
  Coding DNA Sequence Number=SeqID_46177
  Subcellular localization annotation: CTP_CleavageSite=43; ConfidenceScore=5.16e-01
MGVANGSCNLHSNRKLQLQLPFRPAVGQLATTSGVFRATWLCPANSPLGVAVCYIIHAKGSITRAMPKILQED

SEQ ID NO: 162956 - protein, 127 aa, Glycine max
  Coding DNA Sequence Number=SeqID_46178
  Subcellular localization annotation: CTP_CleavageSite=61; ConfidenceScore=5.08e-01
GGGDKDYKEVPPPPLFKPAGGHINQAVTFNRSYYKNTFMSTTVLYRDRSSINTVSYDGRPQQNTVVVIGPFYDGSQETTVVEQDYVYDGVVPMAVVVFRYFYDGADTTVVEQDYVYDGVVPMSVVVS

SEQ ID NO: 162957 - protein, 401 aa, Glycine max
  Coding DNA Sequence Number=SeqID_46179
DSLEEQSRQGSIVPSGRDDILNMAIGRPEHPGRVRGAGIGVTIMQYFGPASRRSTTSSNITVEQLADIIGNLKEEWQRQVEQENIKREEVWMRRVEEEKQRTMDTFKGQIQEAIKLELSQIASQHSAPLQPNDIQVLAARVSTKGSCAATETNALAKKPSKLNGDNVGLHVTAENSNKLVAVGKQCDSFGTIHNVPYADDVVPVSMVEVIFGDAEEAEKDVSSPLKTVEEEKVAEVIDPLGELVKNLFDIYQRPVEVSWDGAKFGINNVKDGFFIIHADVSEIILGDKCLNISILLLWLMFIHDWSASIGYGALYGFLEPQCIHNASSRRQECENYIGRWLKEAGKQIYIAPYLNQAHWQLVVLCPGDNLVVWFCSLRKKPDVAIKGAVNRLVCLYRASMT

SEQ ID NO: 162958 - protein, 409 aa, Glycine max
  Coding DNA Sequence Number=SeqID_46180
  Gene Ontology: Mol. function=RNA-directed DNA polymerase activity; Cellular component=nucleus; Biological process=RNA-dependent DNA replication
MGFCEGWIGWIRSCVETASMSVLVNESPTVTGIRQGDPLAPFLFILVAEGLGGMMREATRKDLFEEVSICDIGVSILQFSDDTLFLGKPTVRNILTLKSILRSFELVEGLNVNFHKIKIGGVALESQHLQSLVAILNCRIMEVRIQDEERHGIRSSMCGEGVGKDTTELLWGGLGEERKTAWDHVWVGESFPRLYAVSLQKEAHIRELGQLVNNRWCWSFSWRRNPFEWEKESLVQLLGSIQSFRGGGEPGGSMEMKRWHRKFISRERSLSELMCSVRAPSKALAYTWRIMQDRIQSRGNLLRRNIAVLEGNYNCPICNSELQTTSHALFECTMVYDIWMQCGNCGGGEMMEVETVVELIKVNAWRWIKARQRFHGAAWSVVSGTILAKLSMQLCRGRVEDNTYYCFLV

SEQ ID NO: 162959 - protein, 297 aa, Glycine max
  Coding DNA Sequence Number=SeqID_46181
  Gene Ontology: Mol. function=binding; Cellular component=integral to membrane; Biological process=transport
  Homolog annotation: Hit_ID=Q9AYL3; Match level="QueryCoverage=99%, HitCoverage=100%, E-value=1e-118, Identity=70%"; Hit description =Putative carnitine/acylcarnitine translocase
  Pfam annotation: Domain name=Mito_carr; Domain location=103-203; Score=94.3; E_value=3.7e-25; Accession=PF00153.17; Description =Mitochondrial carrier protein
  Pfam annotation: Domain name=Mito_carr; Domain location=211-297; Score=95.2; E_value=1.9e-25; Accession=PF00153.17; Description =Mitochondrial carrier protein
  Pfam annotation: Domain name=Mito_carr; Domain location=3-98; Score =89.3; E_value=1.2e-23; Accession=PF00153.17; Description =Mitochondrial carrier protein
  Pfam module annotation: Pfam domain module=Mito_carr::Mito_carr::Mito_ carr; Domain location=103-203::211-297::3-98
MGDVAKDLTAGTVGGAAQLIVGHPFDTIKVKLQSQPTPLPGQFPRYSGAIDAVKQTVAAEGPRGLYKGMGAPLATVAAFNAALFTVRGQMEALLMSHPGATLTINQQVVCGAGAGVAVSFLACPTELIKCRLQAQSVLAGTGTAAVAVKYGGPMDVARQVLRSEGGVKGLFKGLVPTMAREVPGNAAMFGVYEALKRLLAGGTDTSGLGRGSLMLSGGLAGAAFWLAVYPTDVVKSVIQVDDYKNPKFSGSIDAFRRISASEGIKGLYKGFGPAMARSVPANAACFLAYEMTRSALG

SEQ ID NO: 162960 - protein, 250 aa, Glycine max
  Coding DNA Sequence Number=SeqID_46182
  Gene Ontology: Mol. function=transporter activity; Cellular component= integral to membrane; Biological process=transport
  Homolog annotation: Hit_ID=Q1T3F8; Match level="QueryCoverage=84%, HitCoverage=42%, E-value=2e-70, Identity=61%"; Hit description=Major facilitator superfamily MFS_1
MTRLLKIKPCSKDPIHAMQFWHYYRLIALSGVRSQESGYIAYNFVIGAYSYWGPKAGYSIYHMNNADLLFGGITIVCGIVGTLAGGLFLDRISSTISNAFKLLSGATFLGAIFCLIAFLFKSLSGFIVFFSMGELLIFVTQAPVNYVSLRCVKPSLRPLSMAISTVSIHVFGDVPSSPLVGVLQDHINDWRKTALCLTSIFFLAAVIWFIGIFLKSDVYDKDDEEQSATTRGGKLTPLLDGSSDTTSSQV

SEQ ID NO: 162961 - protein, 77 aa, Glycine max
  Coding DNA Sequence Number=SeqID_46183
MDDPKLPSHGSSISLIARLDHLEFIMKYLERKQRYGSNVPADKDKQSLDLSTKEAFFKGTLLDRVASLEHRLFKVKN

SEQ ID NO: 162962 - protein, 235 aa, Glycine max
  Coding DNA Sequence Number=SeqID_46184
  Gene Ontology: Biological process=response to biotic stimulus
  Homolog annotation: Hit_ID=Q25BJ6; Match level="QueryCoverage=79%, HitCoverage=66%, E-value=2e-68, Identity=69%"; Hit description =Streptomyces cyclase/dehydrase family protein
MGEKGKRFVHGIKSSRKSLLASSPRVWLTVTVAVGSFGDGRELLEVELDDGVGEETRVLFGVAVGDVDNVGFEDDGVDLAVGGGVVVVEGVDGGDGAVVTEAVFATDDAEAGDAADVVEEVEALGTRGCGEAGDDIDVASDADGHVEGLFDGAALDEVLVGLGLVEASDEGPDGVWRRVDALGEEGGALAGADEVGVVLGDGGDEGGELERGEAGGRVEVVVRRVAVVVVVGVWL

SEQ ID NO: 162963 - protein, 660 aa, Glycine max
  Coding DNA Sequence Number=SeqID_46185
  Gene Ontology: Mol. function=transcription regulator activity; Cellular component=nucleus; Biological process=regulation of transcription
  Homolog annotation: Hit_ID=Q41102; Match level="QueryCoverage=93%, HitCoverage=100%, E-value=0.0, Identity=68%"; Hit description =Phaseolin G-box binding protein PG2
  Pfam annotation: Domain name=HLH; Domain location=475-524; Score =49.0; E_value=1.6e-11; Accession=PF00010.16; Description=Helix-loop -helix DNA-binding domain
QRMNLWTDENSSVMEAFMPSSDLSSIWPPPAPPQPQSTAVFNQDTLQHRLQALIEGARETWTYAIFWQSSYDYSGSTLLGWGDGYYKGDDDKAKAKAKSKATSAAEQDHRKKVLRELNSLISGSSSASASDDVDEEVTDTEWFFLVSMTQSFVNGGGLPGQAFFNSTPVWVTGSDRLSASPCERARQGHMFGLQTLVCIPSANGVVELGSTELIFQNSDLMNKVKVLFNFSNNNFDMGSSWPATSADQGENDPSSLWLSDPEVRDSVNTAAATPSVMVPAQTQGISISKTMQLESSIQTPGSSTLTETPSSIHAIPQNQSVFSRELNFSEYGFDPKSGNNQNHHSLKPESGEILSFGESRRTSYGGVNGNTNTNTNSNSHFFSGQSPFVAAVDENKKNNMSNNGKKRSPNSRGSNDDGMLSFTSGVIIPATNLKSGGGGDSDHSDLEASVVKDPVVEPEKRPRKRGRKPANGREEPLNHVEAERQRREKLNQRFYALRAVVPNVSKMDKASLLGDAISYITELKSKLQTLESDKDVLHKQLEGVKKELEKTTDNVSSNHACNNNNNNKLSSNQPALIDLVEMDVKIIGWDAMITITCSKKNHPAATLMTALMELDLDVHYATVTLVNDLMIQQATVKMGSRFYTQEQLRAALSAKVGDVR

SEQ ID NO: 162964 - protein, 76 aa, Glycine max
  Coding DNA Sequence Number=SeqID_46186
MNGSINGKKQGIEYYFSPKLSVYEAHQRQMCSMLCSANIVHGHNYRKRSSLKGIDKNGPRPRRISRRPSGWEEFIH

SEQ ID NO: 162965 - protein, 459 aa, Glycine max
  Coding DNA Sequence Number=SeqID_46187
  Gene Ontology: Mol. function=nucleobase transporter activity; Cellular component=membrane; Biological process=nucleobase, nucleoside, nucleotide and nucleic acid transport
  Homolog annotation: Hit_ID=Q1Z624; Match level="QueryCoverage=85%, HitCoverage=83%, E-value=1e-126, Identity=60%"; Hit description =Cytosine/purines, uracil, thiamine, allantoin permease family protein
  Subcellular localization annotation: CTP_CleavageSite=46; ConfidenceScore=5.41e-01
MPLITGVSRRTSARATLNAQPPICRACGWASISSPLVGRRGSVITRSPTAPPITRTGVTASHSLIDTHRERHKQPQAGIGEQAFGQRAVDKTGFGDQQAAQGAEEPAEQRGFAHAAVLAMQAVQSVAIIPVAAAQAQVIEQENRLPGRQEDAAEHQEGDERPHEITGDEQHIQGDTQHHHRVDRYRQPLLDLHADGQQVKAGGIQAEHRDGDDAGGSGQQIRNGHPGGQHRAYQRDGVGGAGQIGQLHGKQDAGQHQQHQRQTGAAHHRGENAFARRARALIAAVIGAGDRPTDAGAGGDHRYRRQEAGQPAAGRQRQHLAPLGVEQDIEHHDQRHGAEDAAEPALHPDHGILPQQADDDSEPAEQQQAERGQQVAATQPEGLEQRRQRQGAGDHVDCFPAHQVDPTEQGGRHVALQAENHPRERQRRGAPALAGEAGEADQHEAGDADQRGEYRLQEG

SEQ ID NO: 162966 - protein, 272 aa, Glycine max
  Coding DNA Sequence Number=SeqID_46188
  Gene Ontology: Mol. function=oxidoreductase activity; Cellular component=periplasmic space; Biological process=cell division
  Homolog annotation: Hit_ID=Q7CGI0; Match level="QueryCoverage=99%, HitCoverage=56%, E-value=1e-120, Identity=76%"; Hit description =Suppressor of ftsI
  Pfam annotation: Domain name=Cu-oxidase; Domain location=121-248; Score=-28.3; E_value=0.034; Accession=PF00394.12; Description =Multicopper oxidase
  Pfam annotation: Domain name=Cu-oxidase_3; Domain location=1-109; Score=95.9; E_value=1.2e-25; Accession=PF07732.5; Description =Multicopper oxidase
  Pfam module annotation: Pfam domain module=Cu-oxidase::Cu-oxidase_3; Domain location=121-248::1-109
MDSRKAAVWGINGMYLGPTVRVYSGDDVKLIYSNRLQEPVAMTVSGLQVPGTLMGGAPRMMSPNVDWSPVLPIRQAAATCWYHANTPNRMAPHVYNGLAGLWLVEDAVSKALPLPNHYGVDDFPLIIQDKRFDNFGTPQYDAPSQGGFVGDTLLVNGVQNPYVEVSRGWVRLRLLNASNARRYTLQLSDGRPFNVIASDQGFLPAPVAVQQLSLAPGERREVLIDMSKGEEVTITAGEAAGIMDRLRGLFEPSSILVSTLVLTLRPTSLLPL

SEQ ID NO: 162967 - protein, 224 aa, Glycine max
  Coding DNA Sequence Number=SeqID_46189
METNLGQLQGIKFITELTAYAQKIRQEWITEGAVNQNPHITNTMRTMCIRCRREIWIVKGCKLVIRMTTPPPSPTQAEIPSDGTSRKTRQATRLRRLTTRTLEQARATVNVNPATGTGSGPHKDQFHSYLGVVARDKIPIVHASWNDVPETLKNMIWDNILAKFDIPEGDNAKKKVMSTVATRWRQFKLALTTKYVYGNTDGQAKDEPLVKYGINEKDWAELQK

SEQ ID NO: 162968 - protein, 420 aa, Glycine max
  Coding DNA Sequence Number=SeqID_46190
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=98%, HitCoverage=51%, E-value=1e-139, Identity=57%"; Hit description =Receptor-protein kinase-like protein
  Pfam annotation: Domain name=Pkinase; Domain location=214-420; Score =48.5; E_value=1.9e-11; Accession=PF00069.15; Description=Protein kinase domain
  Pfam annotation: Domain name=Pkinase_Tyr; Domain location=214-418; Score=56.0; E_value=6.6e-16; Accession=PF07714.7; Description =Protein tyrosine kinase
  Pfam module annotation: Pfam domain module=Pkinase::Pkinase_Tyr; Domain location=214-420::214-418
MPQNIAPPNVYSTSRSMGNNKDVNMGFNLTWIFQVDPSSMYLTRLHFCDYFYSKVNEIVFKIFINNQTAEAEADVIGWTGGKGVPTYTDYVIYVKDEAGDDQLWLALHPALETKPEFYDSLLNGVEVFKLNDTDLSGFALVAAILVVVQHQKKKKAPGSYNTSSWLPIYRNSHTAGTKASGSGKSVGSANISAMAQGLCRYFSLQEMKQATKNFDESNVIGVRGFGKVYKGVIDNGFKVAIKRSNPQSEQGVNEFQTEIEMLSKLRHKHLVSLIGFCEEGNEMCLVYDYMAHDTMREHLYKRNKPLDTLSWKQTLEICIGAARGLHYLHTGAKYTIIHRDVKTTNILLDENWVAKVSDFGLSKTGPNMNQGHVSTPLKGSFGYLDPEYFRRHQLTEKSDVYSFGVVLFEALYLRKVALDT

SEQ ID NO: 162969 - protein, 67 aa, Glycine max
  Coding DNA Sequence Number=SeqID_46191
MNKTIPYIPEEKKVRIKRHKNKRNQRNFCKKIKTVGVLQVATDPEMCDLRSKKNLFTYLSHSIGLSS

SEQ ID NO: 162970 - protein, 322 aa, Glycine max
  Coding DNA Sequence Number=SeqID_46192
  Gene Ontology: Mol. function=phospholipase C activity; Cellular component=membrane; Biological process=intracellular signaling cascade
  Homolog annotation: Hit_ID=Q1SH97; Match level="QueryCoverage=96%, HitCoverage=77%, E-value=1e-143, Identity=75%"; Hit description =Phosphatidylinositol-specific phospholipase C, X region
MRRWTQLPNMSCQWKYPTKMFADTTFEPHLQGLAFNRYSWLTTHNSYALAGARSATGSVIVAPMNQEDKVDEQLKNGVRGFMLDMYDFQNDIWLCHSFQSKCFNFTAFQPAINVLKDMRTFLDGNPSEIITIFIEDYVTAPQGLTKVLRDSGLSKYMFPVSRMPKNGEDWPTVDDMVQKNQRLVVFTSKSAKEASEGIAYQWTYVVENQYGDDGMKAGSCPSRAESPAMNTKSRSLVLVNYFHSAPNRSQACADNSAPLLDMMKTCHEAAGNRWANFIAVDYYQRSDGGGAPLAVDEANGHLTCGCDNIAYCKVWFLPPYAL

SEQ ID NO: 162971 - protein, 178 aa, Glycine max
  Coding DNA Sequence Number=SeqID_46193
  Homolog annotation: Hit_ID=P24629; Match level="QueryCoverage=30%, HitCoverage=8%, E-value=2e-10, Identity=66%"; Hit description=Heat shock cognate 70 kDa protein 1
YYASAKVERIILSHSQNNKSRASSTKTFKHNPQEPFGRDENRKDGEEEGVVEPCVLDHDDVTYQTFSESEVRQRGSITLVSGDDFGTMVLPHPDTEVGGTRINFDSGTVSFSSHGQQIQQGEFQEDDIELGVHGSFGRGEAKLSGNEFGHGGLEAIQASGGRFNFHRWRTIGQTNCYE

SEQ ID NO: 162972 - protein, 314 aa, Glycine max
  Coding DNA Sequence Number=SeqID_46194
  Homolog annotation: Hit_ID=Q9FLV7; Match level="QueryCoverage=34%, HitCoverage=32%, E-value=5e-10, Identity=33%"; Hit description =Arabidopsis thaliana genomic DNA, chromosome 5, P1 clone:MZF18
  Pfam annotation: Domain name=DUF313; Domain location=187-292; Score =26.3; E_value=5.5e-07; Accession=PF03754.4; Description=Domain of unknown function (DUF313)
MKDLKTLKELVASITDWKSLEKMSCKPFKPSILHLAISKDAPQLYREEELIQLKNFSKLLSSVESKPKTNNTGQRMTRKRQIEEMPKEERVTPAMIKKPRRIILVQNGPSPDLPAEFKDRVSELSGHDLKFLMHKRLFCSDVKSNSNRMSMPINEIKCEFLTEAEITKLDERDGPNGKGRLVGVENSRIESELSGYDLKFLMHKRLFYSDVKSNSNRMSMPINEINCEFLTEAEITKMDVRDGPNGKGRLVGVETTVLDPCLREFTLPLKKWSMQRTDTYNLVTNWNSIVSVNKFEDQELQIWSFRLITSYIFY

SEQ ID NO: 162973 - protein, 76 aa, Glycine max
  Coding DNA Sequence Number=SeqID_46195
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=72%, HitCoverage=29%, E-value=1e-20, Identity=85%"; Hit description =Anaphase-promoting complex subunit 10
  Pfam annotation: Domain name=APC10; Domain location=4-76; Score= -73.7; E_value=0.0055; Accession=PF03256.7; Description=Anaphase -promoting complex, subunit 10 (APC10)
TALGTVVGAPSSKLSTLPVNKLIVLYVVFKLDESYTPSKVSILAGDGFHNLKEIKTVELVKPTGWVYLSLSGADPR

SEQ ID NO: 162974 - protein, 87 aa, Glycine max
  Coding DNA Sequence Number=SeqID_46196
MSIWIENSKMEVGITITRINPITFKERLERTLFYQKNGPHFMSVGNYDAIFPRKGPVTRAMSKRFQEDWARADEEGPRVLMNLRIDF

SEQ ID NO: 162975 - protein, 352 aa, Glycine max
  Coding DNA Sequence Number=SeqID_46197
  Gene Ontology: Mol. function=protein serine/threonine kinase activity; Cellular component=intracellular; Biological process =protein amino acid phosphorylation
  Homolog annotation: Hit_ID=Q1SH95; Match level="QueryCoverage=93%, HitCoverage=98%, E-value=1e-115, Identity=67%"; Hit description =Protein kinase
  Pfam annotation: Domain name=Pkinase; Domain location=3-262; Score =214.5; E_value=2.5e-61; Accession=PF00069.15; Description=Protein kinase domain
  Pfam annotation: Domain name=Pkinase_Tyr; Domain location=3-262; Score=11.7; E_value=3.5e-13; Accession=PF07714.7; Description =Protein tyrosine kinase
  Pfam module annotation: Pfam domain module=Pkinase::Pkinase_Tyr; Domain location=3-262::3-262
  Subcellular localization annotation: CTP_CleavageSite=31; ConfidenceScore=5.30e-01
MNWVRGEPLGSGSFATVNIAIPTNTSTQFLSSTAVKSSYVHTSSMLKNEKEILDCLGASPYVINCFGDDHTVENGEEYYNIFLEYAAGGSLADQVKKHGGRLPESYVRRCTRSLVEGLKHIHDNGYVHCDVKLQNILVFQNGDVKIADFGLAKEKGEKQGKLECRGTPLFMSPESVNDNEYESPADIWALGCAVVEMLTGKPAWDVRGSNIWSLLIRIGAGEELPKIPEELSEEGKDFLLKCFVKDPMKRWSAEMLLNHPFVNGETVSFQKVNEPLPLPSPSPRTHFDLTHWASTVTALLPSSPDSDEWRMWESGRRRIGQNRMAGQALGEVLGSAALIVPWSSDLTAHIRS

SEQ ID NO: 162976 - protein, 151 aa, Glycine max
  Coding DNA Sequence Number=SeqID_46198
MLLLESNDIGKAILDLSSILNITKIVIEINKLPYTRHKNKLSKGEFVKKHAPSSSEVTLIYNDEVLVSDPYMDGLVSYGLASQNKIHSKNFIQCMYFCCMGEAPRGACRPWIFFINGVLYFLKINCSGMDKEERLETPLQVEDELRTSSPP

SEQ ID NO: 162977 - protein, 45 aa, Glycine max
  Coding DNA Sequence Number=SeqID_46199
MKRQSKTERWEYDKECVRGGYNALYRRWQGAEIMHMLIARCPVVL

SEQ ID NO: 162978 - protein, 66 aa, Glycine max
  Coding DNA Sequence Number=SeqID_46200
  Subcellular localization annotation: CTP_CleavageSite=26; ConfidenceScore=5.42e-01
MARSTGQFSLSVIPSWVGIVLSAPFSLSETSEVVVFKIPMVRLCNNSLGSSTQNLKIIQRLTNLGS

SEQ ID NO: 162979 - protein, 72 aa, Glycine max
  Coding DNA Sequence Number=SeqID_46201
MRLHYITSLQIGACLVARLGPEDSTYENWDDMQQAYNLEDKVILPAGGVDSNNTTRANRPRKPPTTHFNDYV

SEQ ID NO: 162980 - protein, 191 aa, Glycine max
  Coding DNA Sequence Number=SeqID_46202
  Gene Ontology: Mol. function=triacylglycerol lipase activity; Biological process=lipid metabolic process
  Homolog annotation: Hit_ID=Q1SH82; Match level="QueryCoverage=98%, HitCoverage=43%, E-value=1e-93, Identity=80%"; Hit description =Lipase, class 3
  Pfam annotation: Domain name=Lipase_3; Domain location=26-172; Score =108.3; E_value=2.3e-29; Accession=PF01764.16; Description=Lipase (class 3)
MPDFQEKPTTQVLVVLDKHEDRDTYVVAFRGTEPFDADAWCTDLDISWYGIPGIGKMHGGFMKALGLQKNVGWPKEIQRDENLPPFAYYVIRDILRKGLSENPNAKLIITGHSLGGALAILYPTIVFLHDEKLLMERLEGIYTFGQPRVGDEAYAQFVYCNDIVPRLPYDNDLLFKHFGICLFFNRRYELR

SEQ ID NO: 162981 - protein, 174 aa, Glycine max
  Coding DNA Sequence Number=SeqID_46203
MEEQFQQLIHSCLKCRGSAAEAEWHYLELNGPVALGRPWEGNKIEHRGDGHKVCLPIIWPRRWPAKGTWVVGPGLHGATREGWTFNVEGDDSEMLCIRILAIKPRNLKSHIDARVGTRRRGFERGKGDCNCSKLFQYGINFAIESFMGLGEGSMVLSEDMLVLREAVYGFFQAV

SEQ ID NO: 162982 - protein, 91 aa, Glycine max
  Coding DNA Sequence Number=SeqID_46204
MNWYRANSKICLTQFATHPKIAATSRSAPNMETEQHPQQQSPPVIASMHDEGLQPHAQSYEFTPEPQCLRPGVTCYYGCVNLIGKCTESCK

SEQ ID NO: 162983 - protein, 96 aa, Glycine max
  Coding DNA Sequence Number=SeqID_46205
MGCSYENPRAFFNNSSPILLEPLAHGSGNWSLPREDCIKTTKLEELLVQFMQRTESHQKSTDAAIKNLEVQIGQLAKLVAERPTETFGVNTKMKPK

SEQ ID NO: 162984 - protein, 150 aa, Glycine max
  Coding DNA Sequence Number=SeqID_46206
MSQTNAMNYSPRNSIPTRDKEVNWFRESPDIFDKLFQWLFGVIAFKTTPMREALYIAHPNVMMAMVLMIFLYFSLWLLGTMLPQRSGTFLIIILVCIMMVIARSCHGVGIFALSAYYCYQVLYALVVRAISDTIKQLIDGNRTQSTRLPV

SEQ ID NO: 162985 - protein, 698 aa, Glycine max
  Coding DNA Sequence Number=SeqID_46207
  Gene Ontology: Mol. function=nucleic acid binding; Cellular component= ribonucleoprotein complex; Biological process=mRNA catabolic process, nonsense-mediated decay
  Homolog annotation: Hit_ID=Q1SH80; Match level="QueryCoverage=52%, HitCoverage=100%, E-value=1e-178, Identity=79%"; Hit description=RNA- binding region RNP-1
  Pfam annotation: Domain name=RRM_1; Domain location=337-406; Score =82.2; E_value=1.6e-21; Accession=PF00076.12; Description=RNA recognition motif. (a.k.a. RRM, R
  Pfam annotation: Domain name=RRM_1; Domain location=425-494; Score =59.5; E_value=1.1e-14; Accession=PF00076.12; Description=RNA recognition motif. (a.k.a. RRM, R
  Pfam annotation: Domain name=RRM_1; Domain location=566-635; Score =74.8; E_value=2.7e-19; Accession=PF00076.12; Description=RNA recognition motif. (a.k.a. RRM, R
  Pfam module annotation: Pfam domain module=RRM_1::RRM_1::RRM_1; Domain location=337-406::425-494::566-635
MPSFSTLKPLSGEINSLKIDDVWCTDEDVLKREAINFFRKLFQDQSHCNPNGIEFDNFKIRDVDNPTSLNDFRPIRLCNILLKVISKIIVSRIRPFQSSFIPDRGTGDNALIAQEIVHNMHKKKDYLAKTGAGQVSQLVILESCPAVLKPKLLADALGTYFVTPALVRKSSRVIAGASLPLALTTLVETTLLMGSCGDDLAIATMVWDGGEDDAVVVSEGMKKSSAWTWNDAAVATGGGKAKKGGGDATVMETEEVRSRFKAKPGNGSGAKKRHERERKEEKRDRESERERKIFDLGFSISYSARSIPLPQEKEEEEKRSVPFHCDLLTFLMEQRKLVVLGIPWDVDTEGLREYMSKFGELEDCIVMKERSTGRSRGFGYVTFASVDDAKEVLSSEHIIGNRTLEVKVATPKEEMRAPVKKVTRIFVARIPQSVTEATFRSHFEKYGEITDLYMPKDQGSKMHRGIGFITFASADSVENLMSETHELGGSAVVVDRATPKARDDDFKPMGRMPPPPPPPPQGGGYGAYNAYISAATRYAALGAPTLYDHPGPIYGRGDARRTSKKIFVGRLPPEATSDDLRQYFGRFGRILDVYVPRDPKRAGHRGFGFVTFAEDGAADRVSRRSHEICGHPVAIDSATPVDDAGPSGNFMMNSMESFGGYGGPVRSYGRMYGSLDFDDWGYGIGRPSRAADWRYRPY

SEQ ID NO: 162986 - protein, 51 aa, Glycine max
  Coding DNA Sequence Number=SeqID_46208
MRTNVSSFSLSHGLGRPKEPKPAENVYYRAESIMIHGKYKKPLTIIRIQAQ

SEQ ID NO: 162987 - protein, 66 aa, Glycine max
  Coding DNA Sequence Number=SeqID_46209
MSWVRFRDGQAHGFGLLGPGLAQVWREILRWPIGPGFIFWASYRVKVTRSASSESEKEGTKLYQKV

SEQ ID NO: 162988 - protein, 436 aa, Glycine max
  Coding DNA Sequence Number=SeqID_46210
  Homolog annotation: Hit_ID=Q10K55; Match level="QueryCoverage=77%, HitCoverage=62%, E-value=2e-64, Identity=45%"; Hit description =Expressed protein
  Pfam annotation: Domain name=DUF1777; Domain location=316-433; Score=- 83.5; E_value=0.015; Accession=PF08648.2; Description=Protein of unknown function (DUF1777)
MEAKAAAPFTSDRSNLLQPAASKGSYSQVRFSYDGNGKEETHISDDEDNDNEEDEDDEDDEDFNSDDSNDEGMEIIAKEYGVKRYGWLVYMDKKAKEEEKRQKELIKGDPAIRKLSRKERRKASQIEREREREATRISGTRVLHHDPYRETRQSPTYEAYSRSRRSRSRSRSYSPSHSRRYSCSGHSDDIHRSKPRTPKIEYITEFGGSGAAADEPRPEGFSPPRSPTSQVDLLNRPTSSCILEALHVDPASGVSIDKDKGTKVLKPSVSGSSALAKLKTGGSGGPLKQQGEKKETPQERLKRIMNKQLNKQIKKDTAAELAKKREQERQRQEKLAETSRLSRYRHHSRSRSRSFSRSPPRRYRRSRSPSSRGSRRYYSSSRSPSRPRSRSRSRSPYSRSPSLIQKMTFQDKKSIKALMECCIRVERLTKFCAICL

SEQ ID NO: 162989 - protein, 93 aa, Glycine max
  Coding DNA Sequence Number=SeqID_46211
MCPKVSLQRQCRRRRGVVVGGASDLKKKNKYRGNEGSLGSGGSHSKCSTYQFGQSFDTAWLNGGRRGDSSGAKMDDAKCPIVGSLKRIVKKCV

SEQ ID NO: 162990 - protein, 172 aa, Glycine max
  Coding DNA Sequence Number=SeqID_46212
  Homolog annotation: Hit_ID=Q8H6Q8; Match level="QueryCoverage=72%, HitCoverage=4%, E-value=2e-15, Identity=35%"; Hit description=CTV.20
MSLMDRNILDSLFLNIHFHGLDMKEGSIPIALIYRIQYKVMNTCASRVLLKPQRGETTLFITDMTKANVSLPKTMKWDEVTLLEKRVMDKATSLVPRPAPTIEQIKQDNSGKVEITFNRRNSFSSRIEALRSEYESARRYFLVRTRSIPVGLTRSESQSVSCCKPPRIGYNL

SEQ ID NO: 162991 - protein, 121 aa, Glycine max
  Coding DNA Sequence Number=SeqID_46213
  Gene Ontology: Mol. function=RNA-directed DNA polymerase activity; Biological process=DNA integration
MAAISSLPLDPHGPFFIHHADHPSHSITPLNGDNFGSWRRAVVIALESKNKMGFIDGLILQPQDPTKLSLWKRNNSIVRSWLLNSVNKEIATSVIYSSTTAILWDDLNSRIDNITGLEFSN

SEQ ID NO: 162992 - protein, 364 aa, Glycine max
  Coding DNA Sequence Number=SeqID_46214
  Gene Ontology: Mol. function=transcription factor activity; Cellular component=nucleus; Biological process=regulation of transcription, DNA-dependent
  Homolog annotation: Hit_ID=Q9CA27; Match level="QueryCoverage=89%, HitCoverage=83%, E-value=1e-25, Identity=34%"; Hit description =Putative AP2 domain transcription factor; 68130-67156
  Pfam annotation: Domain name=AP2; Domain location=107-162; Score =72.0; E_value=1.9e-18; Accession=PF00847.10; Description=AP2 domain
MVEPLNQSTPRTKKMKHKRNPIHDSKMTRKLRIICNDPDATDSSSDEDEYFGNVRKMKRTVLEIALPPVPVNPVVADETSTESTNNDELNQTKRVMAKTPSVKRQSCGKYKGVRMRKWGKWAAEIRDPFKGTRIWLGTFSTAEEASQAYETRRLEFEVMAKALSDEKSNNGSSNNNVVASAETETVAAPENNSSNYYVSSAAGSVSDSKSAFMDESESVLSHTSPSSVLELDTSASNLIGSGKVSSNEIVETKGLEAEVAETKSLAAEFAELEIQDLSMLNVPSPSAVAAATSEYELDLLAFDSFKYGFDYEHGFDDDFAALEDIHICSFDDNEPSELPDYDFDDFGADEFAGWIEEPLNIPCV

SEQ ID NO: 162993 - protein, 267 aa, Glycine max
  Coding DNA Sequence Number=SeqID_46215
  Subcellular localization annotation: CTP_CleavageSite=81; ConfidenceScore=5.71e-01
MLPKATGTSLRGGRSTGKGFKLALPEPTIKKSSSTSSGSPTQVGSSTQKSKIEGSSTQIVTIKPESSTQETPKPATAKQTKADYVWSVQTLQGLQEMGLAKLPKLTKKTWADIASESNDDSEIDLQSMIQNSKQSKTLINPKGKQVLSQQKPPPPKNANSYIYKNKFSTVLQMEPKFWDKNPFKAAPDQVKIWFQAHLKFLKVADPETSLFLNQKSQLATFLASSRLKESLAQNLKEVLQILQQQEEEGPSSKKEDNNSSEEEEDPF

SEQ ID NO: 162994 - protein, 165 aa, Glycine max
  Coding DNA Sequence Number=SeqID_46216
MEIQQTVIELVARRPCFLIVVCCSTRNDLDSLCSPLPFVFCSALSQTHFLPRNLHALQCFPNSLLFPPFPFPTCQYSDLGEDERAFILKKFRQGKAAYNIPPPYLRIAKSLWAMGVHGIVINMVVGGEVVTLKSIEESSTIVMQEMPMQILDFMKTILLLAFVNG

SEQ ID NO: 162995 - protein, 239 aa, Glycine max
  Coding DNA Sequence Number=SeqID_46217
MKSVRIPKFLDLEWFSQQGFNLPNLLEAQGLSKFVQVKGTFYPELLIVLLPIWKAVARLDMGGVCKFEESTDGYNKMQTYKGMLLEPTRNMRNRLVVGGLTVEDRMLVYLITYIVTPRSSNHAQMVDNDLQIVYGLKSGIQMNWVLLIEDIMLKSCRATATAIMDQMEEEAEDEAQQEPAHQCSPFESLMIQKMDAMLHLHQEHSVDVNSTLENITTRLENIETRITLSNLLNSDKDEA

SEQ ID NO: 162996 - protein, 67 aa, Glycine max
  Coding DNA Sequence Number=SeqID_46218
MTGVNARVMEFLMRCPRGVLKGSKVQKWRELRELRKKKKKEEETKPRRCRIMTMINLYIVPCSVFFV

SEQ ID NO: 162997 - protein, 205 aa, Glycine max
  Coding DNA Sequence Number=SeqID_46219
MACLEMYNNSEHNKNNKGDNHHHHHQCAPMSPRISFSNDFVDVQQAMKLQEQRGGSSRSDTPVSSDFEFSVANYTMMSADELFFKGRLMSSTYVNTDNNNQQRATTTLKEELLINDDEYDHNFSLRPPKPSSTRWKGLLGLRKSHIGSKKPHKSTEASSSEASRSAFVNEGPPTSITFSDLECLLCRLRYGGAKPNTYSPQKQGM

SEQ ID NO: 162998 - protein, 45 aa, Glycine max
  Coding DNA Sequence Number=SeqID_46220
MQEAIGGAENNSAEQMVSLQKGYMGLLALWNMKLDIDKKYGLTGK

SEQ ID NO: 162999 - protein, 73 aa, Glycine max
  Coding DNA Sequence Number=SeqID_46221
MHLGGLNPKSNVQSGGFECGYYVMHWMWCIVTAGLKDDWHKWFSDGSSLDVEAITIVRQKWATYFLSFRKNSC

SEQ ID NO: 163000 - protein, 84 aa, Glycine max
  Coding DNA Sequence Number=SeqID_46222
  Homolog annotation: Hit_ID=Q1T1F5; Match level="QueryCoverage=54%, HitCoverage=30%, E-value=2e-07, Identity=67%"; Hit description =Calmodulin-binding, plant
MAWLHPWWCTINATSHLKENKDAIELVQKAFDEILLPEPEDLFSDDQFKFEGIDSDEVHLEKSVSASNLITKTQIHNKHNHKET

SEQ ID NO: 163001 - protein, 201 aa, Glycine max
  Coding DNA Sequence Number=SeqID_46223
  Gene Ontology: Mol. function=binding
  Homolog annotation: Hit_ID=A0EFD6; Match level="QueryCoverage=83%, HitCoverage=6%, E-value=1e-14, Identity=31%"; Hit description =Chromosome undetermined scaffold_93, whole genome shotgun sequence
MLEPTELKSYPNFSDSKHNLLCSKLKQLYVAITRTRQRLWICENTEEYSRPMFDYWRKKGLVQFKELDDSLAQAMKVASSPEEWRSRGKKLYYQNNYEMATMCFERARDSYWERKSKASSLRANANRLCDLNPEDSNAMLREVAENFEGIGMAESAAQCFSDLGDYKRAGPDPLPVEGLTWTVGRGESGGGGDLRGVAMPA

SEQ ID NO: 163002 - protein, 98 aa, Glycine max
  Coding DNA Sequence Number=SeqID_46224
MASNGELDERPYRGSLREQLRKIFITYVQGEVISIHSKHGNIPRHLQRLEKKPWDGLCYQIHSNKIKESRRFKRRLKICKSLKKSIKWFLNVGFQTST

SEQ ID NO: 163003 - protein, 116 aa, Glycine max
  Coding DNA Sequence Number=SeqID_46225
SKSSLMMIFHYGDAAEDKGEEEFHHQESALDKKLREEDSMEEKKEREKERGEHKIEGGKEGEKLNFEPNPLRVFYPIPLGVGLLNLADSSQWKKINHLYPDFGKETRNLRLGLATD

SEQ ID NO: 163004 - protein, 334 aa, Glycine max
  Coding DNA Sequence Number=SeqID_46226
MLKVYFLIVLGVANRVSKVKDLLGNNQWLQNSNALDKNKIEAFYHFDALTTFDPPTLHYVLGVDGLFLLALLHRDAAGSNHSYFLTGKRGMLLVDAAGVEVTLDDIVRDVFVLENQIPIHVLMEISKVNINSRESGGIIEEHNLGESMLNFCRPLCPLVHTEQVSSRKAEDRAHLLDLVYHLTAPQLVPASESEQNPQPLLIHFIIIFAYMILWACLLLCIIPFYCITFFLYLLIFQVIVPLIQRVVRHVFDDITKFPGLGYFKSLVIVLGFPFLKRTLQLEDSTDSSEEVVTIPSALKLEDIGVKFIPAEGSITSYRYETTPLPMGYEMLPLP

SEQ ID NO: 163005 - protein, 122 aa, Glycine max
  Coding DNA Sequence Number=SeqID_46227
MGPIRGQPTGRSVVTTRRHIFTTDVTPYMVQHNLPLVIPATASNYLFGSKKYIPVHCGYGRHNQWQITIQDGLPSLAEPWFQYLSENNLMPGDEVVFFFKFDEHAWELLFRKEVIWDDTLSS

SEQ ID NO: 163006 - protein, 113 aa, Glycine max
  Coding DNA Sequence Number=SeqID_46228
MISRLSLSKLQTTLETPPLPPMTTNDHHELPLLAVRSPHGEELLNRSGILRVHLKDSMENKLSILSFVVPLRCSGRQRRRGKRRRHPLGNKPWKKELHHQDEPWIRSLERMLQ

SEQ ID NO: 163007 - protein, 200 aa, Glycine max
  Coding DNA Sequence Number=SeqID_46229
MSSRKRKSGGSRPTTQYDTRRFHSFEAWTRYIVKVLGRHILAERKVEIYHTELDEFKGELERRNFHKHFTNLADSSIHLVLVKEFYANLYSPKGPSPKQVRIWGHLIRIDADSLNAFLETPMVLAEGESLPAYSRYCRMPTDIREIEDALCIPGRGFILNVEGHLRKILRKDLTTLAQVWSVLSYSNLAPTSHTSDLTVD

SEQ ID NO: 163008 - protein, 197 aa, Glycine max
  Coding DNA Sequence Number=SeqID_46230
MSTLSRATIPKYVLNFFMWGPSALLVAGSTWTTGISTPGGLVDKDRRHEALRVRFTADGEAYVSEGGGGEAGGEAIILYLIGNLFLLKIKAGNKERTQTQKEKLSNEEVSATDKGNKESTETHKEKLSNEEVSATNEGSAENNIKRNYNEVSKFEDKDKEQSIQNSKMKTEGGSENNVKNKDVEDGDLKKSIQTSNV

SEQ ID NO: 163009 - protein, 418 aa, Glycine max
  Coding DNA Sequence Number=SeqID_46231
  Gene Ontology: Mol. function=nucleoside-triphosphatase activity; Cellular component=membrane; Biological process=transport
  Homolog annotation: Hit_ID=Q1SCH7; Match level="QueryCoverage=84%, HitCoverage=39%, E-value=1e-167, Identity=82%"; Hit description=ABC transporter, putative
  Pfam annotation: Domain name=ABC_tran; Domain location=163-345; Score= 152.4; E_value=1.2e-42; Accession=PF00005.17; Description=ABC transporter
MELYPGFALYRGLYEFSQYAFSGDALGSDGMRWSDLSDSTNGMKEVLIIMFVEWLLVLLFAYYIDQVLSSGSRKSPLFFLKRFQKKPHSSFRTPSIQRQKSKVFVQIEKPDVTQEREKVEQLLLEPTINQAIVCDNMRKVYPGRDGNPEKLAVRGLSLALPQGECFGMLGPNGAGKTSFINMMIGLTKPTSGTAFVQGLDIRTHMDGIYTSMGVCPQHDLLWESLTGREHLLFYGRLKNLKGSALTQAVEESLKSVNLFNGGVADKQAGKYSGGMKRRLSVAISLIGDPKVVYMDEPSTGLDPASRNNLWNVVKRAKQDRAIILTTHSMEEAEVLCDRLGIFVDGGLQCIGNPKELNWLERRTNNVKVTAFIIICEKRGRKKIKDREDFEEKRKGARRVRVKVKDNRGVEEVQILIFK

SEQ ID NO: 163010 - protein, 436 aa, Glycine max
  Coding DNA Sequence Number=SeqID_46232
  Gene Ontology: Mol. function=protein kinase activity; Cellular component=integral to membrane; Biological process=protein amino acid phosphorylation
  Homolog annotation: Hit_ID=Q9SLD0; Match level="QueryCoverage=94%, HitCoverage=63%, E-value=1e-112, Identity=52%"; Hit description =Putative receptor-like protein kinase
  Pfam annotation: Domain name=LRRNT_2; Domain location=23-64; Score =61.9; E_value=2.1e-15; Accession=PF08263.3; Description=Leucine rich repeat N-terminal domain
  Pfam annotation: Domain name=LRR_1; Domain location=115-137; Score =18.8; E_value=0.02; Accession=PF00560.23; Description=Leucine Rich Repeat
  Pfam annotation: Domain name=LRR_1; Domain location=139-161; Score =15.3; E_value=0.22; Accession=PF00560.23; Description=Leucine Rich Repeat
  Pfam annotation: Domain name=LRR_1; Domain location=164-186; Score =6.5; E_value=17; Accession=PF00560.23; Description=Leucine Rich Repeat
  Pfam annotation: Domain name=LRR_1; Domain location=188-210; Score =4.3; E_value=45; Accession=PF00560.23; Description=Leucine Rich Repeat
  Pfam annotation: Domain name=LRR_1; Domain location=91-113; Score =11.1; E_value=2.4; Accession=PF00560.23; Description=Leucine Rich Repeat
  Pfam module annotation: Pfam domain module=LRRNT_2::LRR_1::LRR_1::LRR_ 1::LRR_1::LRR_1; Domain location=23-64::115-137::139-161::164 -186::188-210::91-113
MPMHHLLISFLIFSLTPTPTTSLNSDGLSLLALKAAVDSDPTGVLSSWSETDGTPCHWPGVSCSGDKVSQVSLPNKTLSGYIPSELGFLTSLKRLSLPHNNFSNAIPPSLFNATSLIVLDLSHNSLSGSLPTELRSLKFLRHVDLSDNSLNGSLPETLSDLTSLAGTLNLSFNHFSGGIPASLGNLPVSVSLDLRNNNLTGKIPQKGSLLNQGPTAFSGNPGLCGFPLQSACPEAQKPGIFANPEDGFPQNPNALHPDGNDQRVKQHGGGSVAVLVISGLSVAVGAVSLSLWVFRRRWGGEEGKLGGPKLENEVDGGEGQEGKFVVVDEGFELELEDLLRASAYVIGKSRSGIVYKVVGVGKGSSSAAGAANVVAVRRLSEGDATWRFKEFESEVEAIARVRHPNVVPLRAYYFAHDEKLLITDFIRNGSLHTALH

SEQ ID NO: 163011 - protein, 163 aa, Glycine max
  Coding DNA Sequence Number=SeqID_46233
MAPRKLPTKRSKKDTTGEGSSAVPQDDMDFDRHRFQRETKRWLHSFKGNSLKTWEEVVEKFLKKYFLESKTAEGKAAISSFHQFPNESLSEALKGFRGGKIKLKTPEKATGLIENMSANDHAILGDRVHQPTKKSLLELSSHDTLLAHNKFLSRKLDILTETL

SEQ ID NO: 163012 - protein, 78 aa, Glycine max
  Coding DNA Sequence Number=SeqID_46234
MTISTHTLTNPSFFRCCCARCCARETRGEERKEGRSGVSCVLHRGGGPVTVNSDGESRNGKSDGAVIWPAPKRDRMNN

SEQ ID NO: 163013 - protein, 121 aa, Glycine max
  Coding DNA Sequence Number=SeqID_46235
MEEIHGEEDEEQGIKALDLLHQWSSLLLEDQWQRNGEGGKPLGPLGDLGEKQPARLGKKVASGVSHQLAWTSLAASSSPYFAINRCGKLRRKGSAPLASIFHLKLVRRRRKKEKIKAKALS

SEQ ID NO: 163014 - protein, 225 aa, Glycine max
  Coding DNA Sequence Number=SeqID_46236
  Gene Ontology: Mol. function=protein kinase activity; Cellular component=integral to membrane; Biological process=protein amino acid phosphorylation
  Homolog annotation: Hit_ID=Q9M2R4; Match level="QueryCoverage=93%, HitCoverage=32%, E-value=5e-63, Identity=58%"; Hit description =Receptor-like protein kinase
  Pfam annotation: Domain name=Pkinase; Domain location=1-220; Score= -72.4; E_value=0.0003; Accession=PF00069.15; Description=Protein kinase domain
  Pfam annotation: Domain name=Pkinase_Tyr; Domain location=1-220; Score=-90.5; E_value=6.4e-07; Accession=PF07714.7; Description =Protein tyrosine kinase
  Pfam module annotation: Pfam domain module=Pkinase::Pkinase_Tyr; Domain location=1-220::1-220
MKSQSIKFDVETNGGPSNSLPPISWAARLKIAQEAARGLMYIHEFSGRKYIHGNIKSTKILLDDELHPYVSGFGLARLGLGPTKSTTMAPKRNSLNQSSITTAISSKVAASSNHYLAPEVRFTGGKFTQKCDVYSFGIVLLELLTGRMPDFGPENDDKVLESFVRKAFKEEQPLSDIIDPALIPEVYAKKQVIAAFHIALNCTELDPELRPRMKTVSESLDHIKI

SEQ ID NO: 163015 - protein, 252 aa, Glycine max
  Coding DNA Sequence Number=SeqID_46237
  Subcellular localization annotation: CTP_CleavageSite=91; ConfidenceScore=5.56e-01
MPQSRHRRVTVVDLAASLARRRVSFIFNEAPTLRTPPRTAAFGRGRARASPRSQNIPPSTARRGRGRVPLRSVLPAWFPRTPLRDITAVVQAIERRSARLGEVEGQRIGNTDPASDRLVSEPSEPASASASASAVKSPKSVGVKLRTPFGSKVPKIFLDISELPEHDESEALTPQKKLLDNIDQVEEAVREELNKLKRTPSAKKTEREKRSHRQQSRGIIVILLWTELIQRDSVFPVRFACVFGLKLQDIIL

SEQ ID NO: 163016 - protein, 371 aa, Glycine max
  Coding DNA Sequence Number=SeqID_46238
  Gene Ontology: Mol. function=transcription regulator activity; Cellular component=nucleus; Biological process=regulation of transcription
  Homolog annotation: Hit_ID=Q1SJ81; Match level="QueryCoverage=97%, HitCoverage=99%, E-value=1e-66, Identity=45%"; Hit description =Aldehyde dehydrogenase; Helix-loop-helix DNA-binding
  Pfam annotation: Domain name=HLH; Domain location=301-344; Score =28.2; E_value=2.9e-05; Accession=PF00010.16; Description=Helix-loop -helix DNA-binding domain
MDSNSRYQVQQQHQHNSGLLRFRSAPPANLKQQGEAANNNGSAWEGSEPLLRFLNSGDTHDTTSSPTLREFVDNKVSNNSKPAKESSSPLSRMNSQQGYSTSMLPSRSTVTSAMMLGSMGKNQSAKSFDSNLLRQSSFPAGHFSNNISFQNGYDTMKGVGNYSGVNGNDGELSLSMNRMKNQISFSSISPSSSLGVLSPTSKIGTEGIRVTSTEDGRQGGSNGDARYFGPGFSYASWNEPSHHKRQRSSNDELLSDSQDGELGNQVQTLSHHLSLPRTSSDMFAMDKLREALLHILEALPKGQVRRSRISERIRKLQELVPNMDKQTSTAEMLDLAVDYIKDLQKEFKTLNDKRAKCKCINMQKSEADQVA

SEQ ID NO: 163017 - protein, 235 aa, Glycine max
  Coding DNA Sequence Number=SeqID_46239
MVSFLGLYALHKDYKVAHQSFIQHFEPTPLTIQDLGDWTSFFIGLQLRRFWVSTPSTRITRSRINPLFNTLSPHLSQFRIWAIGHRSSLGYSCVVSRSLRPPQGLQGFGRLDIVLHWATVASFLGLYALHKDYKVAHQSFIQHFEPTPLTIQDLGDWISFFIGLQLRRFWISTPSTRITRSRTNPLLNTLSPHLSQFKICAIDIVFHWAATTSFLGLYALHKNYKVAHQSFTQHR

SEQ ID NO: 163018 - protein, 263 aa, Glycine max
  Coding DNA Sequence Number=SeqID_46240
  Gene Ontology: Mol. function=phospholipase A2 activity; Biological process=lipid metabolic process
  Homolog annotation: Hit_ID=O23181; Match level="QueryCoverage=83%, HitCoverage=52%, E-value=1e-69, Identity=62%"; Hit description =Patatin-like protein
MAKEPTLDVLLSDICIATSAAPTFLPAHYFTKQDEQGKVIKEFNLIDGSVAANNPTLCAIREVTKQLIRKGNGGISINPLEYSRFLVLSIGTGSNKSEHKYNAKMVSKWGILTWLFNSGSTPILDCFSEASFDMVDYHNCVVFSALQSEDNYLRIQDNTLKGDLASVDVATKENLDNLVKVGQQLLKNTVTRVNLDTGLYEPVPDKGTNVCKITFGGKKGEKVQLTMTRRWEVNDRQLNEENNCCRYSNLNSIDSINIISIVA

SEQ ID NO: 163019 - protein, 360 aa, Glycine max
  Coding DNA Sequence Number=SeqID_46241
  Gene Ontology: Mol. function=protein binding
  Homolog annotation: Hit_ID=Q8IQI6; Match level="QueryCoverage=91%, HitCoverage=92%, E-value=5e-28, Identity=33%"; Hit description =CG32112-PA, isoform A
MVMVNLGMLHYVLDHVYGAFMHRTKMSTPFFSRGWGGTKLEMLERVIKQLFPEVEGHNWPPSMIEPVWRTVWETKMASLREGVFRTPCEEQLLGALPPESHTARVAFLMPKSVPPHKMACVVHLAGTGDHTFERRLRLGGPLMKENIATMVLESPFYGQRRPVLQRGAKLLCVSDLLLLGRATIEEARSLLHWLDSEAGFGKMGVCGLSMGGVHAAMVGSLHPTPVATLPFLSPHSAVVAFCEGILKHGTAWEALRKDLAAQKVAMTLEEVRERMRNVLSLTDVTRFPIPKNPNAVIFVAATDDGYIPKHSVLELQKAWPGSEVRWVTGGHVSSFILHNDEFRRAIKDGLDRLPWKESHL

SEQ ID NO: 163020 - protein, 359 aa, Glycine max
  Coding DNA Sequence Number=SeqID_46242
  Gene Ontology: Mol. function=dimethylallyltranstransferase activity; Cellular component=chloroplast; Biological process=isoprenoid biosynthetic process
  Homolog annotation: Hit_ID=Q1S556; Match level="QueryCoverage=96%, HitCoverage=95%, E-value=1e-106, Identity=60%"; Hit description =Polyprenyl synthetase
  Pfam annotation: Domain name=polyprenyl_synt; Domain location=90-355; Score=327.5; E_value=2.3e-95; Accession=PF00348.8; Description =Polyprenyl synthetase
  Subcellular localization annotation: CTP_CleavageSite=35; ConfidenceScore=5.56e-01
MSSVNNLGTLLARLTSMLNTRSPLIPCFHTLRTVPVSPKREWPKLFSSVNSTLPFSSAPNFDFKAYMLDKINTVNRALDAAVALREPRKLHEAMRYTLLAGGKRIRPVLCLAACSLVGGSEATAIPAACAVEMIHTMSLIHDDLPCMDNDDLRRGKPTSHKIFGEHVAVLAGDALLALAFEHVAASTEGAYAARVVRAIGELAKCIGAEGVMAGQVVDVNSEGLTLSMSDEVAVLERLEFIHVHKTAVVEGAVVMGAILGGGSDEEIERLRMFGRCIGLLGQVVDDVLDVTKSSEELGKTAKKDLVADKLTYPKVLGIHESKEFAHKLVHDANKMLAGFHPPKAAPLFALTNYIAYRQN

SEQ ID NO: 163021 - protein, 290 aa, Glycine max
  Coding DNA Sequence Number=SeqID_46243
  Gene Ontology: Mol. function=monooxygenase activity; Biological process=electron transport
  Homolog annotation: Hit_ID=Q1SJ90; Match level="QueryCoverage=83%, HitCoverage=99%, E-value=2e-37, Identity=68%"; Hit description=E -class P450, group I
MADYQGYIILFMAWLVSTIVVRAILSKKQNKTNRPPSPLALPIIGEKGFGKGLKEIRDRFDTIMERAIKEHEEERKKRKEVGNGGEGQIKDLDVFMAGTDTAALTTEWALTELINHPHVMERARQEIDSVIYRKWDPNHWENPLEFKPERFISEEGSGKGQIDVRGQHFHMIPFGSGRRGCPESSLALQVAQANLAAMIQCFEWKVKGGIGTADMEEKPGLTLSRAHPLICVPVPRLNPFPNVIVIISSSISRTLTLFCAICTQARDYSLYKEYHGSDFLNKTGSYGLTK

SEQ ID NO: 163022 - protein, 500 aa, Glycine max
  Coding DNA Sequence Number=SeqID_46244
  Gene Ontology: Mol. function=monooxygenase activity; Cellular component=membrane; Biological process=electron transport
  Homolog annotation: Hit_ID=Q1SJ88; Match level="QueryCoverage=94%, HitCoverage=94%, E-value=0.0, Identity=67%"; Hit description=E-class P450, group I
  Pfam annotation: Domain name=p450; Domain location=38-492; Score =318.3; E_value=1.3e-92; Accession=PF00067.12; Description=Cytochrome P450
MDAAGATLLCYIFFIALLIFPILFKSLVTRSTKKFRPPPSPPTLPIIGHLHLVGSVIPKSFQALARLYGPLIQLRLGASTCVVVSNDQVAKEVMKTNDLNFCYRPHFGSSEYFLYKGSDFITAPYGPYWRFIKKLCMTQLLSSSQLGRFVHVREQEINKLLKSVLVCSSEGRVIDLSFELTSLTNNILCRMAMSTSCLDRVHDAAEILDLVREFLHAGAKLSMGEVLGPLGKFDLFGYGKKLVKIVGKFDQVLERIMEEHEEKNTEVRRGETGDMMDIMLQVYKDPNAEVRLTRNHIKAFFLDIFLAGTETSSAALQWAMAEMMNKEGVLKRVKEEIDEVVGTNRLVSESDITNLRYLQAVVKEVLRLHPTAPLAIRESAENCSINGYDIKGQTRTLINVYAIMRDPEAWPNPEEFMPERFLDGINAADFSYLPFGFGRRGCPGSSLALTLIQVTLASLIQCFQWNIKAGEKLCMEEASSFSTGLAKPLLCYPITRFNPF

SEQ ID NO: 163023 - protein, 58 aa, Glycine max
  Coding DNA Sequence Number=SeqID_46245
  Homolog annotation: Hit_ID=Q52MZ2; Match level="QueryCoverage=62%, HitCoverage=7%, E-value=2e-11, Identity=86%"; Hit description=TGA10 transcription factor
MISYFFELKADNQRHQTIHRLHQILTTRQAARCFLAIAEYFHRLRALSSLWLARPRQE

SEQ ID NO: 163024 - protein, 213 aa, Glycine max
  Coding DNA Sequence Number=SeqID_46246
  Gene Ontology: Mol. function=structural constituent of ribosome; Cellular component=ribonucleoprotein complex; Biological process =translation
  Homolog annotation: Hit_ID=P49200; Match level="QueryCoverage=99%, HitCoverage=100%, E-value=2e-29, Identity=87%"; Hit description=40S ribosomal protein S20-1
  Pfam annotation: Domain name=Ribosomal_S10; Domain location=146-208; Score=24.8; E_value=6.1e-07; Accession=PF00338.12; Description =Ribosomal protein S10pS20e
  Pfam annotation: Domain name=Ribosomal_S10; Domain location=23-85; Score=42.8; E_value=1.2e-09; Accession=PF00338.12; Description =Ribosomal protein S10pS20e
  Pfam module annotation: Pfam domain module=Ribosomal_S10::Ribosomal _S10; Domain location=146-208::23-85
MATYAAMKPTKPGLEEPQEQIHKIRITLSSKHVKNLEKVCADLVRGAKDKRLRVKGPVRMPTKVLLITTRKSPCGEVLNMDALCIKSSFAIYLLLFKVWNVLNGKFGWRILKEKGRLRMNGRFCFVGNLFLWRLGTLTACLLKRGRMRLQLIGCGLVKGNHRSCSESTNTWDRFELRVHKRVIDLYSSPDVVKQITSITIEPGVEVEVTIADA

SEQ ID NO: 163025 - protein, 168 aa, Glycine max
  Coding DNA Sequence Number=SeqID_46247
  Gene Ontology: Mol. function=phospholipase A2 activity; Biological process=lipid metabolic process
  Homolog annotation: Hit_ID=Q29VI1; Match level="QueryCoverage=98%, HitCoverage=37%, E-value=5e-50, Identity=61%"; Hit description =Patatin-like protein
  Pfam annotation: Domain name=Patatin; Domain location=21-168; Score =122.8; E_value=9.5e-34; Accession=PF01734.12; Description=Patatin -like phospholipase
MENPSSPEAPAPKYENLITVLSIDGGGIRGIIPGVILDYLESQLQELDGEDARLADYFDVIAGTSTGGLVASMLAAPNPKANNRPLFAANEIVPFYLENSPQIFPQKRGGIFAPLVNIGKALTGPKYDGKHFHELIRNKLGGTKLHQTLTNVVIPTFDVKILQPTIFP

SEQ ID NO: 163026 - protein, 100 aa, Glycine max
  Coding DNA Sequence Number=SeqID_46248
  Gene Ontology: Mol. function=protein dimerization activity; Cellular component=nucleus; Biological process=regulation of transcription, DNA-dependent
  Homolog annotation: Hit_ID=Q52MZ2; Match level="QueryCoverage=82%, HitCoverage=16%, E-value=3e-25, Identity=71%"; Hit description=TGA10 transcription factor
MGRVMLHFHKAIIPLTPMIMIIVRQIEPLTEQQILGICGLQQSTQEAEEALSQGLEALNQSLSDTITSDSLSYPPNMANYMGQMAVAMNKLSTLEGFVRQ

SEQ ID NO: 163027 - protein, 199 aa, Glycine max
  Coding DNA Sequence Number=SeqID_46249
MMGRMKMIDNVIKSKRGIKKFNGNEKYARKKDCRIIELITKSRKMLYTHSTFILDQARINGVLVACHGSLFAHGRQIKPLNQHSSLLNTKPTILAPLRTSIKLIDAPIVPKFKFADVDSGDSGADHANAFRPTTPGNSPGVGHKKFEGEDKGMKVMGTLVHSPDVKASVADAGSFENDFRPTDPGHSPGVGHPRQNKIN

SEQ ID NO: 163028 - protein, 33 aa, Glycine max
  Coding DNA Sequence Number=SeqID_46250
MSQGVAPAIRKSYRIQWTIANSVNQSIFKDICK

SEQ ID NO: 163029 - protein, 136 aa, Glycine max
  Coding DNA Sequence Number=SeqID_46251
  Homolog annotation: Hit_ID=Q43243; Match level="QueryCoverage=24%, HitCoverage=3%, E-value=6e-11, Identity=94%"; Hit description=H(+) -transporting ATPase
  Pfam annotation: Domain name=Cation_ATPase_N; Domain location=50-110; Score=-13.6; E_value=0.088; Accession=PF00690.16; Description=Cation transporterATPase, N-terminus
  Subcellular localization annotation: CTP_CleavageSite=45; ConfidenceScore=5.21e-01
MVYQKITKLKKVLSILVALSKFKEKHSASSDSFFCLVRFRGVSSRATQGKNSKTEDTIIGASKSMLLFIRFIIGFYFQESKVLKFLGFMWNPLSWVMEAATIMAIALANGGTYTSANGLFSRSTQFTHTSRSSRNF

SEQ ID NO: 163030 - protein, 109 aa, Glycine max
  Coding DNA Sequence Number=SeqID_46252
MAARGGHWWSWVVEKVLGFGWEFGEGERGKNRVFHTEEHIYNLQISLSELVLLSGSPLFALSATIHAKRNSLCTNSRSVQFPLGLELRLARHQNLLYSKSKRSNCGELS

SEQ ID NO: 163031 - protein, 90 aa, Glycine max
  Coding DNA Sequence Number=SeqID_46253
MQKNYHLQTWRNQVKKKKQRGEPLQTREALQTLFEEHTLKNKEGIQRKEALINPNLRKKKQVTRRSFINTHFSAMLDSLRGTKITNNAPH

SEQ ID NO: 163032 - protein, 40 aa, Glycine max
  Coding DNA Sequence Number=SeqID_46254
MASESEETTYDHNSSPPAIGLACLWIAKRVWMTIMVFACH

SEQ ID NO: 163033 - protein, 164 aa, Glycine max
  Coding DNA Sequence Number=SeqID_46255
MVWMTLSDVRKKTQAIQKQNTAPHKLLAEKIEKKLEETAQSGSIDGVIDPPSPVRRLVQWKMAHTKKTRDITTEAAKEIVEKIDSFEEQATQGSFVPHGHQDVLTTVIGRPKHPRRVRAAGAGVTIKQYFGSAPWTSHSSSSLPPEELQQLTQQIKDQLEESIT

SEQ ID NO: 163034 - protein, 136 aa, Glycine max
  Coding DNA Sequence Number=SeqID_46256
  Gene Ontology: Mol. function=sequence-specific DNA binding; Cellular component=nucleus; Biological process=regulation of transcription, DNA-dependent
  Homolog annotation: Hit_ID=Q9FR59; Match level="QueryCoverage=66%, HitCoverage=11%, E-value=4e-38, Identity=83%"; Hit description =Homeobox 1
  Subcellular localization annotation: CTP_CleavageSite=60; ConfidenceScore=5.02e-01
MTLEVLSKGVVGNYNGALQVKKAFWLPNSRNAKWLFKVITNQEGRKSMMKLAERMVISFCAGVSASTAHTWTTLSGTSADDVRVMTRKSVYDPGRPPGIVLSAATSFWLHVPPKRVFDFLRDENSRNEVCAKIPKS

SEQ ID NO: 163035 - protein, 57 aa, Glycine max
  Coding DNA Sequence Number=SeqID_46257
MKQNGDAFVSIVGTLGSTITAKKWVPMLHEVGGSFYKSFSSLRMHFEAMGGTIHVRI

SEQ ID NO: 163036 - protein, 36 aa, Glycine max
  Coding DNA Sequence Number=SeqID_46258
MTCKAGVNFYTQIKTITQQWKDSIGGSKINLATSQK

SEQ ID NO: 163037 - protein, 203 aa, Glycine max
  Coding DNA Sequence Number=SeqID_46259
  Gene Ontology: Mol. function=methylmalonate-semialdehyde dehydrogenase (acylating) activity; Biological process=valine metabolic process
  Homolog annotation: Hit_ID=Q1SN76; Match level="QueryCoverage=29%, HitCoverage=33%, E-value=2e-16, Identity=66%"; Hit description =Transcription factor CBF/NF-Y/archaeal histone
  Pfam annotation: Domain name=CBFD_NFYB_HMF; Domain location=2-69; Score=45.1; E_value=2.4e-10; Accession=PF00808.13; Description =Histone-like transcription factor (CBFNF-Y) and archaeal histone
MNMFPMNRIRTMMKGEDPDMRVSQEAMLAINNAVEKFLEQFTQEAYAFCVRDHKKCLNYDHRGNDKLALNVTTEQGKTLKDAQGDRWWNMLVGWQLCKWGSMFPMYRMGLILTALENHLVFVLMFPMAITCGNTFVLKPSEKDPELALEGGLPKAPLELEGLGSSSSMDSFASWKMNGSGMEKEEREETPLQGDDESRRSSPP

SEQ ID NO: 163038 - protein, 149 aa, Glycine max
  Coding DNA Sequence Number=SeqID_46260
MIEGRFRHNSYPLPRIRKFGLLKPHCAQRQQSRTSLRTSWPSLPFLLGLFYSSVDLLQLYLDEKVSNRVQEATLAKTILSPMTWPGFTLACIVGLGCPLAEVPIMKFFHLWYYPQANIEIFGQPLTDTLWQGIIIRPSRSIYHTRALMT

SEQ ID NO: 163039 - protein, 259 aa, Glycine max
  Coding DNA Sequence Number=SeqID_46261
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=4e-43, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MELASLHVLAFRGLNVVAFRGLHVLAFRGLHALAFRGLHVLAFKGLHVLAFKGLHVLPFRGLHALAFRGLHVLAFRRLHALAFRGLHILAFRGLHALAFWGLHAFAFRGLHVLAFRGLHALTFKGLHVLAFRGLHALTFRGLHVLPCRGLHVLPFRGLHVLAIRGLHVLSFRRLHVLTFRGQHALTFRGLHVLTFKGPHVLPFRGLHVLTFRGLHVLTFRGLHVLPFRGLHALAFRGLHALTLIGLHIYAFRELKVLRP

SEQ ID NO: 163040 - protein, 322 aa, Glycine max
  Coding DNA Sequence Number=SeqID_46262
  Gene Ontology: Mol. function=catalytic activity; Cellular component =integral to membrane; Biological process=metabolic process
  Homolog annotation: Hit_ID=Q1RU23; Match level="QueryCoverage=98%, HitCoverage=90%, E-value=1e-146, Identity=79%"; Hit description=IMP dehydrogenase/GMP reductase
  Pfam annotation: Domain name=AMP-binding; Domain location=2-222; Score=-102.2; E_value=0.0028; Accession=PF00501.18; Description=AMP -binding enzyme
VSRKAVEELNPVRRTVFGMLYNYKLGWMKKGYKHREASRLADLLAFRKVKARLGGRVRLIISGGAALSPEVEEFLRVTTCAFVCQGYGLTETCGPTTLGFPDEMCMLGTVGAVSIYNEIKLEEVPEMGYNPLETPPCGEICVRGKTVFTAYYKNPELTKEAIKDGWFHTGDIGEMLPNGVIKIIDRKKNLVKLSQGEYIALEHLEDIWVYGNSFKSMLVAVVVPNEEFANKWAYSNGHIASFPKLCSLDQLKKYVLSELKLTAERNKLRGFEHIKGVILEPHEFDMERDLVTATLKKKRNKLLKYYQVEIDEIYQSLTGKKA

SEQ ID NO: 163041 - protein, 588 aa, Glycine max
  Coding DNA Sequence Number=SeqID_46263
  Gene Ontology: Mol. function=nucleoside-triphosphatase activity; Cellular component=nucleus; Biological process=mRNA processing
  Homolog annotation: Hit_ID=Q1RU18; Match level="QueryCoverage=96%, HitCoverage=84%, E-value=0.0, Identity=64%"; Hit description =Helicase, C-terminal
  Pfam annotation: Domain name=HA2; Domain location=326-448; Score =71.6; E_value=2.5e-18; Accession=PF04408.13; Description=Helicase associated domain (HA2)
  Pfam annotation: Domain name=Helicase_C; Domain location=135-245; Score=28.3; E_value=2.6e-05; Accession=PF00271.21; Description =Helicase conserved C-terminal domain
  Pfam module annotation: Pfam domain module=HA2::Helicase_C; Domain location=326-448::135-245
IPQFVSEALDIETPDKRRKMMIACTQPRRVAAMSVSRRVAEEMDVNIGEEAMTDPLLERYKVIILDEAHERTLATDVLFGLLKEVLRNRPDLKLVVMSATLEAENFQGYFSRAPLMKVPGRLHPAAIRTVVQIHMCELPGDILVFLTEEEEIEDACRKINKEISNMGDQPAPPPVKEGGHPGRKIMVSTKIAETSLTIDSIVYVIDPGFAKQQVYNPRIRVESLLVSPISKASAHQRSGRAGRTQPGKCFRLYTEKVSTMIFCRRPILKSLDLLSSSFNNDLLPQTYPEILRSNLAYTVLTLKKLGIDDLVPFDFMDPPAPETLMRALEVLNYLGALDDDGNLTKLGQIMSEFPLDPQMPKMLVVSPEFNCSNEILSVSAVLSGSHQQLSSLGSMPSLACTIGCRVNADADNCSFSVFSQSLEENAQNAADEAKASLGHIDGDHLTLLNVYHAYKQNNDDPSWCYDNFVNHRALKSADSVRQQLVRIMARFNLKLCITDFNSRDYYVNIRKAMLAGYFMQVAHLERTGHLLDSEKQPGGALASIKLPGPQTGVAPHYYDLSNCPQCEAKRVLERLYKKREKEKEEARS

SEQ ID NO: 163042 - protein, 239 aa, Glycine max
  Coding DNA Sequence Number=SeqID_46264
  Gene Ontology: Mol. function=DNA binding; Cellular component =chromatin; Biological process=DNA integration
MPKKMGDPGNVEVKETRMTNPTDKPFNQNSPWSGGEHASKYGQIHAAREELTFDVFQVVKHPKGQSKKEELIANKKEEKSKLGMKFLPSTLKYVFLEGEDEKPVIISSALTKVEQEKLEEVRHEMLKLLEAGMIYPISDSSWVDQTKIDVIEQLPPPRDAKIVKNFLRHIGFYRKFIKDFSNIARPFSKLLARDVPFHLNNECLKDFELLKERLVTTHIIIAPNWGQEFELMCDVVFTQ

SEQ ID NO: 163043 - protein, 101 aa, Glycine max
  Coding DNA Sequence Number=SeqID_46265
MFKLLMANTNLRIACVLLLFFILHHQDLYVEGKRHLRLRLNNRCSKDGEKFSNVVAHGVGDRGTTDGVAHQGRKGRVEFEEKDFRPTSPGHSPGVGHSINN

SEQ ID NO: 163044 - protein, 123 aa, Glycine max
  Coding DNA Sequence Number=SeqID_46266
MENPITWQNNDNDDGDDDDDDEDEGADKERKKQSTAIKRREGEREVRMAPPPTPPPPRTPVSTPVSTVRTTLGLQMVTLRLHEDVEATDEDFLHLHFTVAGVKISALALRRHHRRHWPDAGQD

SEQ ID NO: 163045 - protein, 301 aa, Glycine max
  Coding DNA Sequence Number=SeqID_46267
  Gene Ontology: Mol. function=molecular_function; Cellular component =membrane; Biological process=auxin mediated signaling pathway
  Homolog annotation: Hit_ID=Q94AP3; Match level="QueryCoverage=98%, HitCoverage=84%, E-value=1e-116, Identity=63%"; Hit description =Putative nodulin protein
  Pfam annotation: Domain name=DUF6; Domain location=176-299; Score =23.9; E_value=0.00058; Accession=PF00892.11; Description=Integral membrane protein DUF6
MADLGSASSKRMWCSVPERMQLHLAMLALQFGYAGFHVVSRAALNMGVSKLVFPVYRNIIALLLLLPFAYFLEKKDRPAMTLNFVCQFFLLALVGIEQVRLNRKDGLGKVAGTVLCVVGATVITLYKGPTIYSPTTGVNINNTRVTQVFELGSVSLGDAKGKNWTLGCLYLIGHCLSWSGWLVLQAPVLKKYPARLSVTSYTCFFGLLQFLVIALLLERDAQAWLFHSGGEAFTILYAGVVASGIAFAVQIWCIDRGGPVFVAVYQPVQTFVVAIMASIALGEEFYLGGLVPSTLINYSSP

SEQ ID NO: 163046 - protein, 180 aa, Glycine max
  Coding DNA Sequence Number=SeqID_46268
MVVIIKKGKNVNHTEESNKVASKDKHCFKINTRLFQQTKPCFKNNSRLSLASKQSVSKTSKALGACKFQRKRQQHWRLEATATRGEEIATGTGDFVPAGLATLTGELDPVGSRQMQWRHSHALVQHNRTRRLGLRASEQGVQAALRQYHWWYRWITPRPLAKTFRYIMNSVITVLYFNGR

SEQ ID NO: 163047 - protein, 241 aa, Glycine max
  Coding DNA Sequence Number=SeqID_46269
  Homolog annotation: Hit_ID=Q69T18; Match level="QueryCoverage=91%, HitCoverage=37%, E-value=2e-56, Identity=53%"; Hit description =Tubulin-specific chaperone C-like
MTEPTEPCTSSSLARDPTTVIHPRREPFEHGLLPIPRFIFSDPAQTLIPLKQKLLELSSNQRVDSAAISESLQISIEHARLVLDTLASVLHSDAEPLVAAKLDEIDSVGVDVHDLVLFLYIQSYKRLLPRTHKDSAAVTDVWPSTSAFDGYLSALSPLQLVRSNSRRGMPSQVDEEAHQLSYLQKHLANIVSLLAQPVEGEGEESLDRSGLSLKIMETVNYVFQVSGIFTGFVGWVPQPNL

SEQ ID NO: 163048 - protein, 59 aa, Glycine max
  Coding DNA Sequence Number=SeqID_46270
MKKIAYRRRNMESECDREWENPYDTALEGIFWDVLSVHTNPMSGSVKIADRLVWESPVQ

SEQ ID NO: 163049 - protein, 244 aa, Glycine max
  Coding DNA Sequence Number=SeqID_46271
  Homolog annotation: Hit_ID=Q69MD6; Match level="QueryCoverage=40%, HitCoverage=17%, E-value=1e-23, Identity=57%"; Hit description =Ternary complex factor MIP1-like protein
METRGRKAMVTAEKTVKNGRRSNRERKMALTQDVDKLKRKLRQEENVHRALERALTRPLGSLPRLPPYLPPQTLELVAEVAVLEEEVVRLEEQVVNFRQGLYQEAVYISSKRNAENLRDSMDQNSIRSSKHQRSKSLSQSELNSTTMARPQLSLARSASSRKLFSDIVVDHTGKLVNGKQLHMKQDSLSSIPEEGQRKENPLFYSSLKDKQSPEKKTAKVITPVKKSPIKKESADKCVDHLKLQ

SEQ ID NO: 163050 - protein, 189 aa, Glycine max
  Coding DNA Sequence Number=SeqID_46272
  Homolog annotation: Hit_ID=Q6H7Q8; Match level="QueryCoverage=84%, HitCoverage=27%, E-value=2e-44, Identity=56%"; Hit description =Tubulin-specific chaperone C-like protein
MDRFEHLGFLIQFGDKGSEGNSFSQSSPFFANSDPDMPAVPVPAAQVHDWLLQNIASALDYISERTSSKENGPASASDQDVAMADACTASVNKVSTSTRSASFIEGISKSSYVKHASDIKGSSVKVLNCHESAIYILAPLRYATVYGCSDATIVIGAVGKQCYQWRKAKIPPYKHAIVAYGAAIVVLPL

SEQ ID NO: 163051 - protein, 63 aa, Glycine max
  Coding DNA Sequence Number=SeqID_46273
MTGYPPSRLRVGEFTSLSQHPWHDLGSPFAHFQFVLVNVRILNGWKWNILQHSCGTDMRSYIK

SEQ ID NO: 163052 - protein, 246 aa, Glycine max
  Coding DNA Sequence Number=SeqID_46274
  Gene Ontology: Mol. function=oxidoreductase activity; Cellular component=membrane; Biological process=metabolic process
  Homolog annotation: Hit_ID=Q6ZG50; Match level="QueryCoverage=97%, HitCoverage=87%, E-value=1e-61, Identity=53%"; Hit description=Short- chain dehydrogenase/reductase family protein-like
  Pfam annotation: Domain name=adh_short; Domain location=10-168; Score= -43.3; E_value=0.0039; Accession=PF00106.15; Description=short chain dehydrogenase
MASSVSSRGNIAAIVGRLSGVAEEIAREEKAQVFAIRIDCSDSKSVRDAFEGVLSLGFVEVLVYNANHQPQSLSPNPTSFQNIPLDTFQKSLAVSAVAAFHCAQQCFDIPVLDILAVMVLTGMVEKGKGTILFTGCSASLYGIAGYSQLCCGKFALRALAQCLAKEFQPQGVHIAHVIIDGVVAPPRRRRSSSSSSVRDESISSGEDHEGTMDPDAVAQTYWHLHVQDRTTWTQEIDLRSNNATFF

SEQ ID NO: 163053 - protein, 297 aa, Glycine max
  Coding DNA Sequence Number=SeqID_46275
  Gene Ontology: Mol. function=transcriptional elongation regulator activity; Cellular component=cytoplasm; Biological process =regulation of transcription, DNA-dependent
  Homolog annotation: Hit_ID=Q45GG2; Match level="QueryCoverage=65%, HitCoverage=36%, E-value=3e-50, Identity=54%"; Hit description =Expressed protein
  Pfam annotation: Domain name=DUF547; Domain location=104-247; Score =203.4; E_value=5.5e-58; Accession=PF04784.5; Description=Protein of unknown function, DUF547
LEDEETAERLDDNVSEVDRTPNRISEDIVKCLCRIFVRIGTFKEKLGESKTPLSSTSACSKGKDHCSESKMRDIGTYNSLCEIKASNVDLNRTRYVVFLIHRLKFLLGKLASVNIKDLTHQEKLAFWINTYNSCMLNAYLENGIPESPERIVALMQKATIEVGGLQLNAITIEHFILRLPYHLMFTCPKAAKHDEMKLRSIFGLEWSEPLVTFALSCGSCSSPAGSSRPQSKGANRTISRGASRTYKGADQGKAQKESHKTKLPSRLCLRAGRELSSNPYRVMLLLEQGTSLTDLIL

SEQ ID NO: 163054 - protein, 993 aa, Glycine max
  Coding DNA Sequence Number=SeqID_46276
  Gene Ontology: Mol. function=actin binding; Biological process=actin cytoskeleton organization and biogenesis
  Homolog annotation: Hit_ID=Q1SZ88; Match level="QueryCoverage=87%, HitCoverage=50%, E-value=0.0, Identity=62%"; Hit description=IMP dehydrogenase/GMP reductase
MALFRKFFYKKPPDGLLEITERVYGIHITCGRNGVFDYCFTTDVMEEDEYRVYIGGIIGQLRGHFPDASFMVFNMREGDSQSQISNILCDYDMTVIDYPRQYEGCPLLTMEMIHHFLRSGENWLQLGQQNVVLMHCERGGWPLLAFMLAALLIYRKMFTGEQKTLDMIYKQAPRELLQLMSPLNPLPSQLRYLQYISRRNVGSEWPPLDRALTLDCVIIRLVPNMGGEGGCRPIFRIYGQDPFIPADRTPKVLFSTPKRSKLVRYYKQVADCELVKIDIHCHVQGDVVFECIHLNSDLEHEEMMFRVMFNTAFIRSNILMLNRDELDILWNAKDYFPKNFRVEVLFSDMDASSSVISIDLPHVEEKEGLTVEAFAKVKEIFSNVDWLDSKAEVASVLQQITASNIFLERLDSGISASTSGLQKESSGKSKLDSKEHSDSKNLTSTVQEKHSTSSLGSSVDVPMENKTELLQLKALSGNNVESLECLGQGDQPIPSFGPSTDSDSTKKARNDSKNLTSTVQEKVSTSSLGSSVDVPMENKTESLQSKALSGNNIESLECIGQGNQPIPSFGPSTDSDSIKKEVESLETKQSLENDTKFTASTAHENRSIPLSEPSMDANLIKKKSGSLESKEKDIESLASKALVENNTKVPTSMAHGEQSMPLIEPSKDANSMKQKMERLDSKEKDTKSLESKSLLENDTNYPPSMAHGKQSFPLIQPSTDANSVKKMGQLEQMVLPENDVKSVTSTVQRKQYGPLLEPPVDANLIKKKIEPQELQVALQLPTQSKIISPRVRSAVRSASASFFNSLQGSPVAISRYHSAPSSLGITSVLQDHAPMDIKEVTHAVKVSPPPSTLPPLDSKVPNSLEPSSTIVPPTSSPPLLPSLPLKTSVDALTAMEKTFGSIAPAAVTPPPPPPPPPPPPPPPPQSEHTSKLMQSNATQYPENATHDEGKKSLVSPPPPPPLSMPAPPTKSLSHPPAPSLPGTSLSTAKDSFK

SEQ ID NO: 163055 - protein, 319 aa, Glycine max
  Coding DNA Sequence Number=SeqID_46277
  Gene Ontology: Mol. function=nucleic acid binding
  Homolog annotation: Hit_ID=Q9FKZ6; Match level="QueryCoverage=66%, HitCoverage=30%, E-value=2e-54, Identity=50%"; Hit description =Arabidopsis thaliana genomic DNA, chromosome 5, P1 clone:MUD21
  Pfam annotation: Domain name=SAP; Domain location=77-111; Score=27.0; E_value=6.5e-05; Accession=PF02037.17; Description=SAP domain
MDHTRRGKNKVMVLSSEEEEEEEEEEEEEEDSDCDEAYESDDGDVDDSSLSDKVVALLRVPLNFYVFRLNLLEGKDIESLKLNECKAYLRNHCLRIAGNRDVCVARIKEHWRLKHGSGYTIYPRSSFTINCTGDVCMGDVVLFRQKVYEKFHKVTRHGKTLGNRTVAGRVVKESYGAAKQQHTFTVSLKLAAISWLHEKESCIAPWSFIRTNIIGLYIYSCKLSRAMAILVEVLWSSGVRKLPPLSPLLVKGRNLYKQKTYRQRWKNEADRIEVLSEKHKRGAAARSMRSLKRKKKSCSANESKVFHIIGYLLLISCNY

SEQ ID NO: 163056 - protein, 414 aa, Glycine max
  Coding DNA Sequence Number=SeqID_46278
  Gene Ontology: Mol. function=protein serine/threonine kinase activity; Cellular component=flagellin-based flagellum; Biological process=protein amino acid phosphorylation
  Homolog annotation: Hit_ID=Q2QDF4; Match level="QueryCoverage=99%, HitCoverage=67%, E-value=0.0, Identity=88%"; Hit description=CDPK -related protein kinase
  Pfam annotation: Domain name=Pkinase; Domain location=2-224; Score =245.9; E_value=8.4e-71; Accession=PF00069.15; Description=Protein kinase domain
  Pfam annotation: Domain name=Pkinase_Tyr; Domain location=1-222; Score=-55.5; E_value=4.6e-09; Accession=PF07714.7; Description =Protein tyrosine kinase
  Pfam module annotation: Pfam domain module=Pkinase::Pkinase_Tyr; Domain location=2-224::1-222
MTTAIAIEDVRREVKILKALTGHKNLVQFYDAYEDHDNVYIVMELCEGGELLDRILSRGGKYTEEDAKAVLRQILNVVAFCHLQGVVHRDLKPENFLFASKDESSKLKAIDFGLSDFVKLDERLNDIVGSAYYVAPEVLHRAYSTEADVWSIGVIAYILLCGSRPFWARTESGIFRAVLKADPIFDEPPWPSLSDEATNFVKRLLNKDPRKRMSAAQALSHPWIRNKDVKLPLDILIFKLMKAYMCSSSLRKAALRALSKTLTVDELFYLREQFALLEPSKNGTINLENIKVVLMVNATDAMKESRIPDFLASLNALQYRRMDFDEFCAAALSVHQLETLDQWEQNARCAYDFFEKDGNKAIVIDELASELGLGPSVPVHAVLHDWIRHTDGKLSFLGFVKLLHGPSRSLAKAL

SEQ ID NO: 163057 - protein, 472 aa, Glycine max
  Coding DNA Sequence Number=SeqID_46279
  Gene Ontology: Mol. function=actin binding; Cellular component=cell outer membrane; Biological process=actin cytoskeleton organization and biogenesis
  Homolog annotation: Hit_ID=Q1SZ88; Match level="QueryCoverage=94%, HitCoverage=25%, E-value=0.0, Identity=77%"; Hit description=IMP dehydrogenase/GMP reductase
  Pfam annotation: Domain name=FH2; Domain location=50-423; Score =480.0; E_value=3e-141; Accession=PF02181.13; Description=Formin Homology 2 Domain
  Subcellular localization annotation: CTP_CleavageSite=69; ConfidenceScore=5.76e-01
NSLSKNSANVPPPPPPLAANGLSKPAVPGPPSAPFGAKGRGSLLRANPKGQSQTKRSNLKPYHWLKLTRAMQGSLWAETQKLDEFCRAPEFDMSELESLFSAAAPNSNDGKGGKMTRRSSLKVDKVQLIELRRAYNCEIMLTKVKIPLPDLMCAVLALDDSVLDVDQVENLIKFSPTKEEMEMLKNYNGDKDNLGKCEQFFLELMKVPRVENKLRVFAFKMQFLTQVSELKRDLNIVNDASEQIRNSVKLKRIMQTILSLGNALNHGTARGSAVGFRLDSLLKLTDTRARNNKMTLMHYLCKVLAEKLPELLDFHKDLGSLEAATKIQLKYLAEEMQAVSKGLEKVVQELTASENDGPVSENFCQILKEFLSYAEAEVRSLAQLYANVGRNADALALYFGEDPARVPFEQVVSTLLNFVRMFIKAHEENCKQIELEKKRADKEAESEKSKLAAAKKESEQMLGTTIKSGNIK

SEQ ID NO: 163058 - protein, 154 aa, Glycine max
  Coding DNA Sequence Number=SeqID_46280
  Gene Ontology: Mol. function=sequence-specific DNA binding; Cellular component=nucleus; Biological process=regulation of transcription
  Homolog annotation: Hit_ID=Q1SZ89; Match level="QueryCoverage=86%, HitCoverage=52%, E-value=2e-49, Identity=70%"; Hit description=WRKY DNA-binding domain, putative
  Pfam annotation: Domain name=WRKY; Domain location=97-150; Score =41.1; E_value=3.7e-09; Accession=PF03106.6; Description=WRKY DNA -binding domain
MDEKVETIKAELKRVREENNTLRMMLEVLSSKYTKLETHLQEINKTQHKGMSSNQIGSVTVPPMFQTNKRPRLEFPTAKKPLQIFVKTHPKDDSLIVKDGYQWRKYGQKVTKDNASPRAYFRCYMAPICPAKKKFPSQQKLTYGYSIRDKGIGQ

SEQ ID NO: 163059 - protein, 69 aa, Glycine max
  Coding DNA Sequence Number=SeqID_46281
MEWGIGWLRGQKVIMTIKFPWYSFHHVKSMHVMDSPVLLPFSKSTATKSIRKKEMTRKENSSFGGLGNN

SEQ ID NO: 163060 - protein, 638 aa, Glycine max
  Coding DNA Sequence Number=SeqID_46282
  Gene Ontology: Mol. function=protein serine/threonine kinase activity; Biological process=protein amino acid phosphorylation
  Homolog annotation: Hit_ID=Q10EQ9; Match level="QueryCoverage=78%, HitCoverage=69%, E-value=1e-113, Identity=46%"; Hit description =Protein kinase domain containing protein, expressed
  Pfam annotation: Domain name=Pkinase; Domain location=316-577; Score =269.0; E_value=9.8e-78; Accession=PF00069.15; Description=Protein kinase domain
  Pfam annotation: Domain name=Pkinase_Tyr; Domain location=316-577; Score=144.1; E_value=3.6e-40; Accession=PF07714.7; Description =Protein tyrosine kinase
  Pfam module annotation: Pfam domain module=Pkinase::Pkinase_Tyr; Domain location=316-577::316-577
  Subcellular localization annotation: CTP_CleavageSite=56; ConfidenceScore=5.94e-01
MRWFPTLIFSHSHSQSNSSTSTSSSSSSATLKSSPSTSSASEPRKNSRSAWFFGKRSTSTRSRKLTHIADLDALVVPPLSRSPSTFDRSSTSCVQPQPLPLPRDADYRFPSPKDAAVDRPDAAAVDVTLSPGFRMRSVFARQEAVKSVEQAETSSQGDGCWFPARSAPTSPFASPKTCIKKNDDFVPYHYVSPKGNQFWSAPEMPTFDTSHPPPAFFDLSALRTDKILSPHQSPPGKSLAAPHPKSPTGPSSSLSIPPRLSLDTSIARRETNALLTVHPLPLPPWAGPGAPMLSPSSSTFSPPLAKTEPMPMKNQWQKGKLLGRGTFGTVYAATNRKTGALCAMKEAEIFSDDPKSAECIKQLEQEIKVLSHLQHPNIVQYYGSEIVEDRFYIYLEYVHPGSMNKYVREHCGAITECVVRNFTRHILSGLAYLHSKKTIHRDIKGANLLVDSAGVVKLADFGMAKHLTGHVADLSLKGSPYWMAPELFQAVVQKDNSSDLAFAVDIWSLGCTIIEMFTGKPPWSEYEGAAAMFKVMKDTPPIPETLSAEGKDFLRLCFIRNPAERPTASMLLEHRFLKNLQQPDVSSSMQLYNGTNLMWHCSALLALLLKYFLSSLSKSKNSPATLSMRFLCLCQIWQ

SEQ ID NO: 163061 - protein, 193 aa, Glycine max
  Coding DNA Sequence Number=SeqID_46283
  Homolog annotation: Hit_ID=Q1RVK7; Match level="QueryCoverage=72%, HitCoverage=21%, E-value=3e-07, Identity=30%"; Hit description=RNA -directed DNA polymerase
MVGSSTNSSLAYNGVSTNLSPDEENKYACNAYGYGDYKAYYMEWIPNDKYGFCNSLGYEICHLVEANGHARGRLFSAVDASRFMDMIDTCHLVAFLKEFVENLSRVYSYHDLILNVVYGAWGHGSPNATRCLNGVHEDATKFNMNVFGSSIHKCKREVETSLRDLYKALEERETDSLHRLEVELHKEYNDILI

SEQ ID NO: 163062 - protein, 586 aa, Glycine max
  Coding DNA Sequence Number=SeqID_46284
MVPYVYISDTQLCVRDVWRLNGLCTEIPTLRIPLAGWVTILGDTQPTRPINGFFGLVIPILTLFGKGFGMRISRRNLYSFFGSSSMKLFPPMDCPHSRELWPRMGVRSVNLLTCDNTVAWLSHILSHKLIREMQVDSLSWGAKVETWNSNCALPIHPFVKLNVDGSFISDTGLMGVGGVLRDLVEKWNVDSGDLRGGKSACILRLRNGKGGGDFVMQSYPARALDRKLQVDWARDAREGPRVLMSLRGSIMKTHLLLEAASPLSLPFSIPLPFIFQEAKESIDEEDPRPTSSNGACITLGVPCKVSDNGSSYEEGSSGLHAMIESPIALTEDQSSPIMTILPSPPWENPVIVEATGRDDGNEVRVSSSEETPRSRCCHGGNTPSPSPCINNFKWVRDDVLKYHLSIMSSLSVGFLWCQLDLTKHSDAHNMTLVACEEDKYPFLCILPLMVPIISMFTGIGPSVPVLMAISVGCRFKDRFFKVKAISVISDGLPLMYEESGSLSVEAKLHDESRLIQRCFDDNKDDNKGDDKKLKEHFKTQKEKLKKSSRFKRKVEFKNQESRFKDQTSRIKIKIQDSRIKRRLNQD

SEQ ID NO: 163063 - protein, 229 aa, Glycine max
  Coding DNA Sequence Number=SeqID_46285
MVHLLGLLTENKRGYISCGPDLVEGKMGDFEWWPLVKQVRSVDSDVSPPPFSVNEPYKGVGDPIEARVDQSSVANVVEVGGAELCKKSRDPFNLRALKQATGSVSGLSHSSSFLPGTPNLRSPTSIPSVAQTTIAMTNVSDPLAPPPSSTLVVSYASATFVFSPAVFAPISSIALPLLSAGLTTTGVVTSMPPISFIVPPSAPTVPNSRLPSSSSHPRISLDYIYTSWE

SEQ ID NO: 163064 - protein, 60 aa, Glycine max
  Coding DNA Sequence Number=SeqID_46286
MLWALSTYWNGDGDLTESETSPTSNSYMKRLTSWTKDPYAVASIYCGIVALWPCSMDHIP

SEQ ID NO: 163065 - protein, 101 aa, Glycine max
  Coding DNA Sequence Number=SeqID_46287
MSTISDSVLGMGGSEPGGSVRQPMEEREVVPFGDSSLRKKVPREVSDNGSSSFERLMNFKNMGEGSSELCTGIESPTTPTEDQPSLVTIIMPSPPGESSDH

SEQ ID NO: 163066 - protein, 149 aa, Glycine max
  Coding DNA Sequence Number=SeqID_46288
MERLTKDEPWPLEIRPGTCSSWVWQDSPRIDLGFDELLEIQLGRRLWRFDQEHVRPRLAMTLNGPSQLGPSFLARGIFLASPQTHHTRSPVSKVRGRTLVLYLLEAWSLVASSLIAAISWTSSLISRIMASIPYVRQKESPWLLFGANS

SEQ ID NO: 163067 - protein, 336 aa, Glycine max
  Coding DNA Sequence Number=SeqID_46289
MVGRGRAMMEALKRHCGGETPSHSPCITDFELLRDDVLKYHSLITSSLSVGALWHQLELTKLGDAYKMTLVACGEDEYSFMCLSINCPHYFYVYQCMFEVLHLTLPLNDFQCALLRRLNVVPSQLHPNSWAVVRAFKILCPFFNISSSVRVLIPYASATFALDPAAFAPISSIALPLLSVGLTTKSVITSMPPPSSIVPPLTLTIPNSGMPSSSSCPIVWLDHVYTSLEDNSLWSIGYRPEKRMHAGFVAPFEEKLIRSIWVQNSNNVAKVSLQRRLAILKENRRKQNEAMNIIGSFEKEVSKWRAIVRTIWRVERAKVEKAIVAFAEAVKSNHQL

SEQ ID NO: 163068 - protein, 96 aa, Glycine max
  Coding DNA Sequence Number=SeqID_46290
MVYEWPSKRILEHKGRVVPVWFRLCKRSFTKRVENLKWVVSQHTLLWASEREAHGCAFQRRKDARSRHQRLFVENVGKPKETGQNENSKFGSGIYV

SEQ ID NO: 163069 - protein, 105 aa, Glycine max
  Coding DNA Sequence Number=SeqID_46291
MTPTHDTLLYYNGRWNMSRQNEFVGYSFTGKNPKKFDIPTGCTMDELKDLIKQVAPPGIPPYGIHETQMVLIESNYWKKIGPIEILDVFSKPVPEMEDELSLLQN

SEQ ID NO: 163070 - protein, 50 aa, Glycine max
  Coding DNA Sequence Number=SeqID_46292
MDSPEATIAGNEGLISIQYPPDFNRNEGDAPGSRNPSIRNLSHLLSLLVQ

SEQ ID NO: 163071 - protein, 86 aa, Glycine max
  Coding DNA Sequence Number=SeqID_46293
MGLDPRVSCMKPLQEIVLESHKAKHTGILSLYIYSPSVLFSSKTQVTKRRNVIDDVLQSFPHPTHSEEVKAIGFDTECHLSDEDNE

SEQ ID NO: 163072 - protein, 212 aa, Glycine max
  Coding DNA Sequence Number=SeqID_46294
MSCLCMSAPAGTDRFLVRNVSRVLPFDSREKDVEFDLECGGNSSDEDVGNDLYVSDRESKGAFGWAWNGILNVDGSYKGKSGTESCSNSAKSGDVVVMDENNVELLVDKGFVQHQFSNVNGNHAKQKTKLFIPKKPPKPPLPPRGPSLDAGDQKFMEELAELALQKRARVKKMKAVRKMKASKSSSSSSTYTSLYAMVITVFFFLVIILHGK

SEQ ID NO: 163073 - protein, 69 aa, Glycine max
  Coding DNA Sequence Number=SeqID_46295
KCSGTRTFNLAATVMEKPRLSSACGIDELGLRRHGPLSVADFFSTTTVSMEEFEFRFGSNILVKTNVAK

SEQ ID NO: 163074 - protein, 561 aa, Glycine max
  Coding DNA Sequence Number=SeqID_46296
  Gene Ontology: Mol. function=transcription factor activity; Cellular component=nucleus; Biological process=regulation of transcription, DNA-dependent
  Homolog annotation: Hit_ID=Q1SG54; Match level="QueryCoverage=95%, HitCoverage=89%, E-value=1e-165, Identity=58%"; Hit description=GRAS transcription factor
  Pfam annotation: Domain name=GRAS; Domain location=193-499; Score =216.4; E_value=6.6e-62; Accession=PF03514.5; Description=GRAS family transcription factor
MDDLYYAGFSTDDNSSSSNDFFWDNEGLNDVRKFQFSGVEDHEEYGGIDSFYSNFGFFPDDPSEEGYLLSTNHQKYHQIFDDYGLLDDNLQFDMVSPPLQFDEQYRTMVPLCNSTKDMPHSTTPLASLEILKSYGKGFKRFWNEGNNTMQPIDDETLATDEVIAGRNLSTEDLMRIAGTRFIQSSSSSSDSESLPFLENHPFGFSFSGFSDEEKEDLELAESLLACAEKVGNKQFERASKLLSHCESLSSKTGNPVKRIVHYFAEALRQRIDTETGRVSSKDLQKGQPFDPEEAAKELTPAILAFVEDLPFCKVAQFTAAQAIIEDVAEAKRIHIIDLEIRKGGQWTIVMQALQLRHECPIELLKITAVESGTTRHIAEDTGQRLKDYAQGLNIPFSFNIVMVSGMLHLREDLFEIDPEETIAVYSPYCLRTKLQQSDQLETIMRVIRTISPDVMVVAEIEANHNSKSFVNRFVEALFSFSAFFDCFEACMKGDEKNRMIIESMYFSPGIRNIVAAEGAERRSRSVKIDVWRAFFSRFGMEEKELSTLSLYQAELVAKRFP

SEQ ID NO: 163075 - protein, 446 aa, Glycine max
  Coding DNA Sequence Number=SeqID_46297
  Homolog annotation: Hit_ID=Q6H7Q8; Match level="QueryCoverage=85%, HitCoverage=61%, E-value=1e-108, Identity=56%"; Hit description =Tubulin-specific chaperone C-like protein
  Pfam annotation: Domain name=TBCC; Domain location=356-445; Score= -26.8; E_value=0.0012; Accession=PF07986.2; Description=Tubulin binding cofactor C
MTEPTEPSTSSSLARDPTTVVHPRREPFEHGLLPIPRLIFSDPAQTLIPLKQKLLELSSNQRVDLAAISESLQISIEHARLVLDTLASILHSDSEPLVVANLVEIDSVGVDVHDLVLFLYIQSYKRLLPRTHKDSAAVTDVWPSTSAFDGYLSALSPLQLVRSNSRRFMPSQADEEAHQLSYLQKHLANIVSLLAEPVEGEGDESLCLGRVVKVAASNPGNNFSACGCIVAYRVLTMDRFEHLGFLIQFGDKGSEGNSFSQCSPFFANSDPDMPAVPVPAAQVHDWLLQNVAAALEYISERTSSKENGPASASDQDVAMTDASTVSVKVSTGTRGASFIEGISKSSYAKHASDIKGSSVKVLNCHESAIYILAPLRYATVYGCSDATIVLGAVGKVITSSFVPAFRKNIMILSFYASRRNNYGMCFPTKILEDDTDMMIAVKWAFK

SEQ ID NO: 163076 - protein, 395 aa, Glycine max
  Coding DNA Sequence Number=SeqID_46298
  Gene Ontology: Mol. function=pectinesterase activity; Cellular component=cell wall; Biological process=cell wall modification
  Homolog annotation: Hit_ID=Q84WQ3; Match level="QueryCoverage=89%, HitCoverage=87%, E-value=3e-91, Identity=48%"; Hit description =Putative pectinesterase family protein
  Pfam annotation: Domain name=Pectinesterase; Domain location=96-388; Score=325.9; E_value=6.8e-95; Accession=PF01095.10; Description =Pectinesterase
  Subcellular localization annotation: CTP_CleavageSite=45; ConfidenceScore=5.08e-01
MSLQSNLLSLLVALAAVFASLNLINPIPQFLNNFTYFSLTTLSPSSAYLAKPLTWNFWRDHHHKKHPDSGNTDSICDDFPPGIPPPNTNTTSYLCVDRKGCCNFTTVQAAVNAVPDFSVKRTIIWINSGMYYEKVLVPKTKPNITFQGQGYTSTAIAWNDTALSANGTFYSGSVQVFGSNFIAKNISFMNLAPMPSPGAVGAQAVAIRVSGDQSEFSGCGFFGAQDTLHDDKGRHYFKDCYIQGSIDFIFGNARSLYENCEIVSIANPVPAGQKSINGAVTAHGRVSGDENTGFAFVNSTIGGNGRIWLGRAWRPYSRVVFAFSIMSDIIAPEGWNDFNDPSRDQTIFYGEYNCSGPGANTNFRAPYVQKLNETQALAFLNTSFIDGDQWLETSK

SEQ ID NO: 163077 - protein, 507 aa, Glycine max
  Coding DNA Sequence Number=SeqID_46299
  Homolog annotation: Hit_ID=O48529; Match level="QueryCoverage=36%, HitCoverage=82%, E-value=2e-78, Identity=74%"; Hit description =Rhodanese-like family protein
  Pfam annotation: Domain name=Rhodanese; Domain location=330-456; Score=10.7; E_value=0.014; Accession=PF00581.10; Description =Rhodanese-like domain
  Pfam annotation: Domain name=Tim17; Domain location=10-139; Score =65.0; E_value=2.4e-16; Accession=PF02466.9; Description =Tim17Tim22Tim23 family
  Pfam module annotation: Pfam domain module=Rhodanese::Tim17; Domain location=330-456::10-139
MVDAAERRYLEDDDSSLMKTIKGATTGLVAGTIWGTVVATWYDVPRVERNVALPGLIRTFKMMGNYGLTFAAIGGVYIGVEQLVQNYRMKRDLVNGAVGGFVAGATILGYRGRSIKTALSAGSALAFTSAFLDFGDQTIKHDTGKEYAAYTTKKRPSMGEGCCMQPYPCICKETVSGFEPMANKSPRHNFTAAPGPRAESFYNFSHLTQVSLIPFVLKEVVFTDMNIQVVGSLELNSCYCEPLPTVILENDILGIGNALKAYFTGTDMSDKLSRTMAGTGFSTSCLSSSSNLGTCWLVLKTHNARAVPGKLPGTVRRRLSLIKAEVKYVNAEKAKELVEADGYTVLDVRDKTQFVRAHIKSCSHVPLFVENKDNDPGTIIKRQLHNNFSGLFFGLPFTKPNPEFVQSVKSQFPPESKLLVVCQEGLRSAAAASKLEEAGFENIACITSGLQTVKPGSTELENAGKAGLVTIQGKISTVLGTILVCAYIFVTFFPDQAEKLFQLAPTG

SEQ ID NO: 163078 - protein, 152 aa, Glycine max
  Coding DNA Sequence Number=SeqID_46300
MNLYMPAISILKKTVIKLLIHFETADFQKGTSVCNHDRWHIKGLTVHIHFCMNYLWLHWSDENAMSHDCFLRSSSLGSLHEFYSNRLATKSATTVATSVPPPIIHAMPPGPIRFFLCSLTLRGASFTPGRASLNLGGASFTLGVATLTLGGE

SEQ ID NO: 163079 - protein, 401 aa, Glycine max
  Coding DNA Sequence Number=SeqID_46301
  Gene Ontology: Mol. function=DNA binding; Cellular component=nucleus; Biological process=regulation of transcription, DNA-dependent
  Homolog annotation: Hit_ID=Q9SNV4; Match level="QueryCoverage=65%, HitCoverage=96%, E-value=9e-71, Identity=57%"; Hit description =Squamosa promoter binding protein-homologue 4
  Pfam annotation: Domain name=SBP; Domain location=140-218; Score =189.1; E_value=1.1e-53; Accession=PF03110.5; Description=SBP domain
GVNHIGGDDGDHGDDHIGGSSGGEGDDNDNDHGHVMVTVEINDHGSGCGGVYDSYGGNSHNMIMVMVMIAPMASDAKLSSSESLNGLKFGQKIYFEDVGLATPATSLTSSSSSSSAATVTSSSSSRKGRGGSVQPAQPPRCQVEGCKVDLSDAKAYYSRHKVCGMHSKSPSVIVAGLQQRFCQQCSRFHQLPEFDQGKRSCRRRLAGHNERRRKPPTSSLLTSRYARLSSSAFDNSGRGSNFLMELTSYPKLSLRNSLPTPRSSELAPGNQTSTLSWNGNSETSSDLFLQGSVGGTSFASPGHPPGESYIGVTDTSCALSLLSNQTWGSRNTAPSLGLSNMINFNGTPLTQLAASSHGASIHQLPNTSWFFKGIDSGNCSPEVVPDLGLGQISQPLNSQLH

SEQ ID NO: 163080 - protein, 312 aa, Glycine max
  Coding DNA Sequence Number=SeqID_46302
  Gene Ontology: Mol. function=sequence-specific DNA binding; Cellular component=nucleus; Biological process=regulation of transcription
  Homolog annotation: Hit_ID=Q1SZ92; Match level="QueryCoverage=98%, HitCoverage=97%, E-value=8e-84, Identity=57%"; Hit description=DNA -binding WRKY
  Pfam annotation: Domain name=WRKY; Domain location=135-217; Score =99.0; E_value=1.4e-26; Accession=PF03106.6; Description=WRKY DNA -binding domain
MEPTCGDTSLDLNVDPSTMHMDGALVEELRRLSCENKRLTHLCENYMALQKQLSQLINTNFDQQLDYPIESSRKRKAAESDQCCTNKFVGVSNNNAECSSIITEDSFKKYKDFNSSPKVSKFLVKTEASNNSLYVMDGYQWRKYGQKVTRDNPSPRAYFRCSFAPSCPVKKKSSQNKIKLSNFSNVSHHRMIIWVQRSLEDPTILVTTYEGEHNHGHQRAEISLVSNQSEALPPLKGSSPVSSPNTATIRSAVCPTVTLDLVKSGLVEFESAQKSSIQQFLVQQMATSLTRDPNFTTELATAISGKILEAQW

SEQ ID NO: 163081 - protein, 1538 aa, Glycine max
  Coding DNA Sequence Number=SeqID_46303
  Gene Ontology: Mol. function=RNA-directed DNA polymerase activity; Cellular component=chromatin; Biological process=chromatin assembly or disassembly
  Pfam annotation: Domain name=Chromo; Domain location=1435-1489; Score= 33.9; E_value=5.7e-07; Accession=PF00385.14; Description='chromo' (CHRromatin Organisation MOdifier
  Pfam annotation: Domain name=RVP_2; Domain location=386-519; Score= -19.0; E_value=3e-05; Accession=PF08284.2; Description=Retroviral aspartyl protease
  Pfam annotation: Domain name=RnaseH; Domain location=878-999; Score= -18.2; E_value=0.0029; Accession=PF00075.14; Description=RNase H
  Pfam annotation: Domain name=rve; Domain location=1133-1289; Score =121.9; E_value=1.8e-33; Accession=PF00665.16; Description=Integrase core domain
  Pfam annotation: Domain name=zf-H2C2; Domain location=1074-1115; Score=17.9; E_value=0.0015; Accession=PF09337.1; Description=His(2) -Cys(2) zinc finger
  Pfam module annotation: Pfam domain module=Chromo::RVP_2::RVT _1::Retrotrans_gag::RnaseH::rve::zf-H2C2; Domain location=1435 -1489::386-519::633-794::120-210::878-999::1133-1289::1074-1115
MDERIAALEGEMAGVKASLSSLEQGQATLIAMFEKSLGKRKEGGVMVDEETPETGSGPGSKPHTEASKTGPSNDEALLEFRQAVKKVELPMFDGDDPAGWISRAEVYFRVQGTRPEVKVCLAQLCMEGATIHFFNSLINDEEELTWEQLKEALLERYGGHGDGDIYEQLTELRQKGSVDDYITEFEYLTAQIPRLPEKQFQGYFLHGLKEEIKGKVRSMSVMGNLSRAKLLQVARAVERETTRDGSSSSRSNKLGYGSNRFGSSGPNKGGISDWVLVKGSKEATPRTNGPGPRGERPGQPERRNGPRDRGFTQLSYSEIMERRRKNQCFKCAGPFSSTHQCPDKNLRLLITEDGGGEESELLAVEVEEGDEEVEGEMSLMSFHQLNQTQQAKPQSIKLKGTIHEVPVVILIDSGATHNFISQQLAQKMNLVTTNTSPLNIRLGDGSLSRTMGVCENLEVDLEGLQIRVDVQLFELGGMDVVLGIEWLRTLGDMIINWKQHTMSFWFEKRWVTLQGVDGNMKGMETLLSVISKPKRSQEVWGREVGIKVDGVYLHALEVEQSRKLEHLLNLCADVFQEPKGLPPKRKKEHVITLKEREGPVNVRPYRYPHHHKNEIERQVKEMLEMGIIRPSTSSFSSPVILVKKKDGSWRMCVDYRALNKATVPDKFPIPVIEELLDELHGAKFFSKLDLKSGYHQVRVKEEDIHKTAFRTHEGHYEFMVMPFGLMNAPSTFQSLMNEVFRPWLRKFVLVFFDDILVYSGDWPTHLQHLEEVLKLLQQHGLVANKRKCLFGQRVAVDPSKVVSVTQWPTPKNVKGVRGFLGLTGYYRKFIKDYGKIAKPLTELTKKDAFVWSKEAQLAMDKLKTCLTSAPVLALPNFDKDFVIECDASGQGIGAILMQERRPIAYFSKALGVRNLTKSAYEKELMAVVLAIQHWRPYLLGRKFIVSTDQKSLKQLLQQRVVTAEQQNWAAKLLGYDFEIVYKPGSLNRGADALSRVNEDGGLCQIHTRVQWEEEELVKQEIAADQHLQQIIKDLQEDETSRPGYEWKQGVLLYEGRLVLSKHSTLIPRMLEEFHTTPQGGHSGFYRTYRRLAANLYWVGMKNTVQDFVKGCDTCQRQKYMASSPGGLLQPLPIPDRIWEDLSMDFITGLPKSKGYEAILVVVDRLSKYAHFVPLKHPYTARVIAEAFIKEVVRLHGIPLTIVSDRDPIFMSNFWQELFKLQGTKLKVSTAYHPETDGQTEVINRCLETYLRCFIADQPKTWSVWMAWAEYWFNTSFNASTGRTPYEVVYGRAPPSITRWVQGEVRVEAVQRELIDRDEALKQLREQLLKAQDRMKQLADKKRCDRSFEIGEWVFVKLRAHRQQSVVSRIHAKLAARYFGPYPIIARIGAVAYRLKLPDGSRVHPVFHVSLLKKAVGNYHEEEALPELEGEGGVLIEPEEVLASRTVQVQGERVNQVLIRWRGQMVDEATWEDKIAMKSQFPTFCLEDKTIFSGGSIDRSRTQEEGPSEALAHHHSTMGPKVWYIYSRRKKNVANPNDS

SEQ ID NO: 163082 - protein, 299 aa, Glycine max
  Coding DNA Sequence Number=SeqID_46304
  Gene Ontology: Mol. function=protein binding; Cellular component =nucleus; Biological process=chromosome segregation
  Homolog annotation: Hit_ID=Q8RXD8; Match level="QueryCoverage=87%, HitCoverage=79%, E-value=1e-125, Identity=82%"; Hit description=WD repeat protein-like
  Pfam annotation: Domain name=WD40; Domain location=111-149; Score =29.4; E_value=1.3e-05; Accession=PF00400.22; Description=WD domain, G-beta repeat
  Pfam annotation: Domain name=WD40; Domain location=196-234; Score =3.0; E_value=16; Accession=PF00400.22; Description=WD domain, G-beta repeat
  Pfam annotation: Domain name=WD40; Domain location=24-62; Score=27.9; E_value=3.5e-05; Accession=PF00400.22; Description=WD domain, G-beta repeat
  Pfam module annotation: Pfam domain module=WD40::WD40::WD40; Domain location=111-149::196-234::24-62
MGGTQVEREEKVSLELSEEILQSMEVGMSFKDYNGRISSLDFHRASSYLVTASDDESIRLYDVTGGTCLKTINSKKYGVDLVCFTSHPTTVIYSSKNGWDESLRLLSLHDNKYLRYFKGHHDRVVSLSLCSRKDCFISGSLDRTVLLWDQRAEKCQGLLHVQGRPAISYDDPGLVFAIAFGGYIRMFDARKYEKGPFEIFSVGGDISDANVVKFSNDGRLMLLTTADGHIHVLDTFRGTLLSTYNVTPVSCNSTLEASFSPEGMFIISECMRALFYSEMKRITREIQPELSSVGQVTPA

SEQ ID NO: 163083 - protein, 378 aa, Glycine max
  Coding DNA Sequence Number=SeqID_46305
  Homolog annotation: Hit_ID=Q10LZ1; Match level="QueryCoverage=41%, HitCoverage=36%, E-value=2e-24, Identity=39%"; Hit description=Myb -like DNA-binding domain, SHAQKYF class family protein, expressed
  Pfam annotation: Domain name=Myb_DNA-binding; Domain location=232 -283; Score=17.8; E_value=0.04; Accession=PF00249.21; Description=Myb- like DNA-binding domain
MYQYSSQMYGTDWESYMEISNLAKVVGSEQLSFEPTKSPFNIVTTPLQTPPGFCASATKSLVSFQAQQQHTHQHQSEVPAWCFEFPKTTTMTTTTADSHMLNIRQASGDNFTTTITIKQDPPSSQFTSSLCRPVAESFFSSSGADCRSSSEKYFKIASYSEKHSCIQPDSIQYYDLYSQEDDTLLRDDAATDEGPLEISFQRNQREKQAPHRLCGVACVASSNSASRRGKRRIKWTKDLHEPFMMIVNSLGGPEKAKPKAILDMMKSDLLSISHVKSHLQKCRSTIHMHKALQERSKEGQRTNGESELQVKIHMQIEESRQLQLEVRRNICQQLEMQRNLHTLIQQQNQQLKVMLDYQKERTKLEKTLYTEIEATVPK

SEQ ID NO: 163084 - protein, 566 aa, Glycine max
  Coding DNA Sequence Number=SeqID_46306
  Homolog annotation: Hit_ID=Q9FG25; Match level="QueryCoverage=91%, HitCoverage=92%, E-value=2e-91, Identity=38%"; Hit description =Arabidopsis thaliana genomic DNA, chromosome 5, P1 clone:MPH15
  Pfam annotation: Domain name=mTERF; Domain location=258-542; Score= -33.9; E_value=6.6e-06; Accession=PF02536.5; Description=mTERF
MEDKARALHCGVDGGDKKPPKSGTKFIGKAALKEAQAALLEYLHSTRSLNIVDAENMCRNSPSFLHDLLAKSQSQTLTRHVDNNNNNNSSSSSSTTTTTKRSISRYLRYHPINEFEPFFESAGLTPPEYAPFLPRDMIYLNDDALLMENYHALCNYGVPRTKMGRLFKLTPQLFRYKPGVLISKLRDYEKLGVARRTLACVVASSPCILVGGVDVGFVKVVEKLKGVVGKDVDWIGENLLDMLSDQGCCDWRIVLHVLCLLDRVYSEEQLGDFFIRHPSVVFEDSGGSVLSLINFLFKFGLSLDQVSLMLLEFPKIRVTKFLSNLRQCFLFLTEIEMEALEIGEILQSQCLVLGSFTLKKTITLLTNLNAGKKRLCRVVRDDPLVMKSWALGRRIQPFVNSYLEYESKEQKKKFMLKLGYVENSKKMNETIRLFRGKGAELEERLDFIVKAGLDYEVVCKMIRDSPRILNQTTDRINMKIENLVSLGYSISDLASFPSFLSYSPRRVKLRFLMYDWLKEHGAVEAGLALSTIIACSDKAFEKLYVKRHPSGLQVWQDLKAQISSKF

SEQ ID NO: 163085 - protein, 89 aa, Glycine max
  Coding DNA Sequence Number=SeqID_46307
MCAVVKNGGGREEWRIATVLFGYGSNLTGNSRSHSNPPYPPRSSCKEGFQFEITEMSLCVAWWREDTGASGDNRVDAHGTRTCAAVCSS

SEQ ID NO: 163086 - protein, 102 aa, Glycine max
  Coding DNA Sequence Number=SeqID_46308
  Gene Ontology: Mol. function=DNA binding; Biological process =regulation of transcription
  Homolog annotation: Hit_ID=Q8LEY3; Match level="QueryCoverage=72%, HitCoverage=18%, E-value=4e-15, Identity=50%"; Hit description =Transfactor, putative
MPSRSKLNLKICPVSGKSDKRTHTKDVHHLDVKTGLQIREALKLQLDAQRRLHEQLEIQRKLQLRIEEQGRELKKMFDQQQKTNNNLPNTQNSATDETTINH

SEQ ID NO: 163087 - protein, 78 aa, Glycine max
  Coding DNA Sequence Number=SeqID_46309
  Gene Ontology: Mol. function=catalytic activity; Biological process =trehalose biosynthetic process
  Homolog annotation: Hit_ID=O64897; Match level="QueryCoverage=93%, HitCoverage=17%, E-value=4e-19, Identity=76%"; Hit description =Trehalose-6-phosphate phosphatase
YENSNDVFPIYIGDDRTDEDAFKVLRSRGQGIGILVSRVAKETDASYTLQDPSEASAIYSIQLSNSCGVWWSGKDRVL

SEQ ID NO: 163088 - protein, 572 aa, Glycine max
  Coding DNA Sequence Number=SeqID_46310
  Gene Ontology: Cellular component=mitochondrion
  Homolog annotation: Hit_ID=Q0WMY3; Match level="QueryCoverage=97%, HitCoverage=97%, E-value=1e-175, Identity=57%"; Hit description =Tubulin-like protein
MKEIVTVQVGDFANFVGSHFWNFQDELLGLAEDPFADSFFKNQDLNMDVLYRTGETQQGIPSYTPRLLSINLRGSLGSMSSRGTLYTEVASTTLDVVTWTGGVSTQASEPYKRNLFLQSLYEEEENLNMINEIRGSNNGSQSEYEDKDITECLENGVQFWTDYSKVHYHPRSLYELNGVWADVEEFDNYGIGRDSFAWAAQGEEISDRLRFFVEECDHIQGFQFVVDDSGGFSAVAAEFLENIVDEYTNIPVLLYAVQGSGSRTNLQSRKHTVLEDLHDAVSFSRLSSFCKLIVPVGLPSLSKSKASRFLHIEDAKHYHSSAVYAAALHSISLPFRMVPVGPTSDACSVSGAVDVHGVVQMLSGQGRQNMVSVLDVAMPAPALTGVQNELSLLEILQPLTPQIAEDVEDMQAIEHMTVHGALASEGHRASVGQVKDTVDAAFLCADTRPMFCHLSVALSPLPIPLPFPSIFGNNVGQHGELMSGQITNSSPKGSLVIHSIPMAARLRSSSIVLPFLESKLRNLHQYGIQRRAAGAELLRTWGFGQEELVEMEEVLSKMVAALHSPHLSSDSD

SEQ ID NO: 163089 - protein, 76 aa, Glycine max
  Coding DNA Sequence Number=SeqID_46311
MDKVYIQDDNIDDKKSTLAYTIFLGGNPISRLSTKQKTMAQSSTGTEYRAIAIEIIWQSHLLIELHIPLHSPPKQL

SEQ ID NO: 163090 - protein, 176 aa, Glycine max
  Coding DNA Sequence Number=SeqID_46312
  Gene Ontology: Mol. function=DNA binding; Biological process =regulation of transcription
  Homolog annotation: Hit_ID=Q1EPE4; Match level="QueryCoverage=68%, HitCoverage=34%, E-value=1e-15, Identity=40%"; Hit description=Myb DNA-binding domain-containing protein
MELSLDLSLGFVPKPLSLFFADVSANRDKVATLDGFVQRLEEELKKVEAFKRELPLCILLLNDAIARLKEEKVKCSGMQDPPLKTSSGGNKNESSEKMNWMSSAQLWSTQKTKSRNEEDDRSVPANPINGNSCVLEKEGSQVPRFGLMARASELSHSNSKSVGGDISSGSSLLRVE

SEQ ID NO: 163091 - protein, 48 aa, Glycine max
  Coding DNA Sequence Number=SeqID_46313
MKYLEKDLITKDEGRPPFNSEKLFVWSWIGIMVGRGQDKFLDLACRIG

SEQ ID NO: 163092 - protein, 123 aa, Glycine max
  Coding DNA Sequence Number=SeqID_46314
METIGELTRFTLILGSSRMIHHHHHDVQSRKVCHSWKLTLLVFLSLDSLMKKRMWHLLSYSWLVLRKSANNSLNVQANCRVIVNHCHAKLGAIKRTVHCFAEEFHPRICKTGSHLILKMQPRS

SEQ ID NO: 163093 - protein, 92 aa, Glycine max
  Coding DNA Sequence Number=SeqID_46315
  Homolog annotation: Hit_ID=Q1SG53; Match level="QueryCoverage=99%, HitCoverage=22%, E-value=7e-21, Identity=51%"; Hit description=GRAS transcription factor
MVVAEIEANHNSTSFVNRFIEALFFFSAFFDCLETCMKREVAERNTRNLKVDVWRAFLSRFGMVEKEWSKLCLFQAFKEWTLPSYWVERNTD

SEQ ID NO: 163094 - protein, 99 aa, Glycine max
  Coding DNA Sequence Number=SeqID_46316
  Homolog annotation: Hit_ID=Q1SG54; Match level="QueryCoverage=99%, HitCoverage=22%, E-value=2e-27, Identity=51%"; Hit description=GRAS transcription factor
ITAVESGTTGHIAEDTGKRLKDYAQGLNLPFSFNIVMVSDMLHLGDVFEIDAEEIIAVYSHFALRTKILESDQLEIMMRALSFFSAFFDCRETCMKGDE

SEQ ID NO: 163095 - protein, 130 aa, Glycine max
  Coding DNA Sequence Number=SeqID_46317
MTSTVKSNFHDRRLASLTAEWSETTKLQKRREGIDDMKKGGDDACRGDVHRLYGEVEKRLNGGRRRSWQRRMEGGRRGGGVTAWMIRVGPLRHKLNYFWNHTPTRDVWYHSQTTSRKEISLYSSSTKAFV

SEQ ID NO: 163096 - protein, 127 aa, Glycine max
  Coding DNA Sequence Number=SeqID_46318
  Homolog annotation: Hit_ID=Q1SG51; Match level="QueryCoverage=100%, HitCoverage=32%, E-value=1e-17, Identity=35%"; Hit description=GRAS transcription factor
MVPLCDQTRDKPHSNSTTPLASLEILNNYGKGFKRLRNDDVAMATTNEESESLPFLETHPFGIYFSGLSDEEKEDAKLAEFLLASAEKVGQQHFEQALRLRMDRATGRVSCKDLQKGPSFDPLEAAK

SEQ ID NO: 163097 - protein, 275 aa, Glycine max
  Coding DNA Sequence Number=SeqID_46319
  Homolog annotation: Hit_ID=Q10MH0; Match level="QueryCoverage=67%, HitCoverage=61%, E-value=4e-72, Identity=66%"; Hit description =Expressed protein
MKNGILVLKELERKGVAKGWVFDPKSQCFASVGLRPKTILVTVMEFLLFVTRLGMLRYLLMFFLLGLGTRVESHEESGHWSCESESEIRVEAEFKYGVITLDGHTDDWKDIDGSYFPLLPALDPDAENEFKGGKITVKSVHDGRDIFFLLQVDGDYAYSKGESNKCPSVALMFQIGDGASYHNMGGCEEHPTSCTDKSCKGHEVDIMHFSIGSAIPGRLYGGNPLDNRYGNGGDRFGHLVDLYAWNPHCRYLDGIGPPGSGMYKCNTIDKNYMLL

SEQ ID NO: 163098 - protein, 82 aa, Glycine max
  Coding DNA Sequence Number=SeqID_46320
  Subcellular localization annotation: CTP_CleavageSite=51; ConfidenceScore=5.23e-01
MKIKYLSLTLILCYPNLVTNNRNSITVTRILQFRSTAPSTVVVIVVAIWKRCRIERSKFLDTFLGAIQPRQSTDFWGRKPIL

SEQ ID NO: 163099 - protein, 141 aa, Glycine max
  Coding DNA Sequence Number=SeqID_46321
MMTWVRFPDHVYGRDFVGRGKIHFGDLYASSERPNSTPKDRSRGEGCPSLIYSNVGLLLADVGLGLFPTVVAVVTTTDSRDSSGDDDSIDGDDNGDNDNSDNNNCGSNDGDNDGSGGGGDYSDNDYNDDNDGDDDESDGSI

SEQ ID NO: 163100 - protein, 70 aa, Glycine max
  Coding DNA Sequence Number=SeqID_46322
MVAKVETVVKCCHSGDGDDGDKDDDVGGGIDDDDNDGGGVMRGRERVTILFCCSLTNTLCQDKKYTTPIR

SEQ ID NO: 163101 - protein, 139 aa, Glycine max
  Coding DNA Sequence Number=SeqID_46323
MEDEALRHFDKMDELGYVTNSQAFKFQQSDDDCVAAYLKQNTVEEAALVFEEARRRRSKEPLFSIKEKLMSYFLEIHELDDAVRHLEVAFSEVKGDDEWRPSVQIVWDFLEYYEEEMNVDGHDELYKITKAISFDHAWI

SEQ ID NO: 163102 - protein, 476 aa, Glycine max
  Coding DNA Sequence Number=SeqID_46324
  Gene Ontology: Mol. function=binding; Cellular component=mitochondrion
  Homolog annotation: Hit_ID=Q5JL31; Match level="QueryCoverage=94%, HitCoverage=87%, E-value=3e-75, Identity=36%"; Hit description =Putative DNA-binding protein
  Pfam annotation: Domain name=PPR; Domain location=129-163; Score =28.9; E_value=1.8e-05; Accession=PF01535.11; Description=PPR repeat
  Pfam annotation: Domain name=PPR; Domain location=164-197; Score=6.4; E_value=1.3; Accession=PF01535.11; Description=PPR repeat
  Pfam annotation: Domain name=PPR; Domain location=198-232; Score =14.9; E_value=0.13; Accession=PF01535.11; Description=PPR repeat
  Pfam annotation: Domain name=PPR; Domain location=234-267; Score =11.6; E_value=0.31; Accession=PF01535.11; Description=PPR repeat
  Pfam annotation: Domain name=PPR; Domain location=269-302; Score=1.1; E_value=5.5; Accession=PF01535.11; Description=PPR repeat
  Pfam annotation: Domain name=PPR; Domain location=303-337; Score=8.5; E_value=0.73; Accession=PF01535.11; Description=PPR repeat
  Pfam module annotation: Pfam domain module=PPR::PPR::PPR::PPR::PPR::PP R; Domain location=129-163::164-197::198-232::234-267::269-302::303 -337
MNYARLISGGGWLLRRLCTAAETPAKKPNLYRMLSALDITGGTVSQTLDQYIMEGKVIKKPELERCVEQLRKYRRFQHALEIIEWMEIRKVNFSWSNYAVQLDLVSKTKGVDAAENFFGGLPPPAKNRYTYGALLNCYCKELMKDKALSHFDTMDELGYVTNLAFNNVMTLFMKLGEPQKVPQLVELMKKRTIPMSPFTYHIWMNSCASSNDLGGAERVYEEMKTENEGQIGWHTYSNLASIYVKFKDFEKAEMMLKMLEEQVKPKQRDAYHCLLGLYAGTGNLGEVHRVWDSLKSVSPVTNFSYLVMLSTLRRLNDMEGLTKCFKEWEASCVSYDARLVSVCVSAHLNQNMLEEAELVFEEASRRSKGPFFRVREEFMKFFLKKHELDAAVRHLEAALSEVKGDKWRPSPQVVGAFLKYYEEETDVDGVDELSKILKANNFDDSWIKSCITASKSSPEIDPGMKEDSQVYHAQEN

SEQ ID NO: 163103 - protein, 347 aa, Glycine max
  Coding DNA Sequence Number=SeqID_46325
MELLITYHLCNVFGELPVPLSSYRYLTVNVVLISVNGGHHLATTANSNTSDSTQLCPPSPLRVPLHSLPAVDFIPPPVDLIWTVPGVADVAARRFHLFIWLMIGGLKWWLVLLSCMVWFVVDYGVCGRALQLEAPPSLSPAAAPVVAVDDLPLPVNAHGLKHLPAPFPSRANFTKGRGELQHPPVSGFKNIAPMHPIADAIPSALAQPPLSPYVSDCCKQDMVWKRGSEVCHCAYPIKIDLLLLNVSQNSNWNAFLNGLATQLELQTTQIEIIKFYLLSLSTLNISVDITPHKGVSFSAEEAAKINSSLLLHKVQLDRRFVGDYKVINVTWFKPSPPSPGKFRTLKF

SEQ ID NO: 163104 - protein, 240 aa, Glycine max
  Coding DNA Sequence Number=SeqID_46326
  Gene Ontology: Mol. function=peroxidase activity
  Homolog annotation: Hit_ID=Q014B2; Match level="QueryCoverage=80%, HitCoverage=52%, E-value=3e-21, Identity=34%"; Hit description =Homology to unknown gene
MKALGAVGGGGAPVPVVEQVGIGALKSDYKPGVFDDLFLKLFRNKLVQEVGWDSKKAGYDGLIEVANRLMMKGTTNSDTVEAAVRILRSLFPPYLLELYKMLIAPIGGGKIAAMMVARVTVLTCQWLMGPCKVNSVDLPDGTSCSSGVYVERCKYLEESKCVGICTHTCKFPTQTFFKDHMGVPLLMEPNFADYSCQFKFGVLPPRDDTIVKEPCLEACPNAKQRRMVARNIDITACPKT

SEQ ID NO: 163105 - protein, 262 aa, Glycine max
  Coding DNA Sequence Number=SeqID_46327
  Gene Ontology: Mol. function=protein serine/threonine kinase activity; Cellular component=membrane; Biological process=protein amino acid phosphorylation
  Homolog annotation: Hit_ID=Q1EPA3; Match level="QueryCoverage=77%, HitCoverage=37%, E-value=1e-25, Identity=34%"; Hit description =Protein kinase family protein
  Pfam annotation: Domain name=Pkinase_Tyr; Domain location=162-262; Score=-150.7; E_value=0.0032; Accession=PF07714.7; Description =Protein tyrosine kinase
MVLELIMDPKIYLTLWLSSRYFSVVTAFDPVEEELLTTASSIFMGAPTIATSPTKAPKRRAPTTTLSSTSDGGRHSNLLIILGIVTGVLFISIVCVLILCLCTMRPKTKTPPTETGLLLRFALLSTENSRIESAVPAVGSLPHPTSTRFIAYEELKEATNNFEPASVLGEGGFGRVFKGVLNDGTAVAIKRLTSGGQQGDKEFLVEVEMLSRLHHRNLVKLVGYYSNRDSSQNLLCYELVANGSLEAWLHGNIISQMMAPAL

SEQ ID NO: 163106 - protein, 216 aa, Glycine max
  Coding DNA Sequence Number=SeqID_46328
  Homolog annotation: Hit_ID=Q2QZQ3; Match level="QueryCoverage=82%, HitCoverage=41%, E-value=3e-08, Identity=26%"; Hit description=Plant invertase/pectin methylesterase inhibitor family protein, expressed
  Pfam annotation: Domain name=PMEI; Domain location=60-206; Score =62.2; E_value=1.7e-15; Accession=PF04043.6; Description=Plant invertasepectin methylesterase inhibitor
  Subcellular localization annotation: CTP_CleavageSite=51; ConfidenceScore=5.12e-01
MDQFNKTTILFIGTLSCLLLSITAVPSTRVFELAPSQAPTVQPKASGIRLLANLVAKNAKQFSPEILKFCSGTEHAALCAETIAPYLAGEFDPLKALEMEINASMEKAKEIGGNIKKMLDNPATEKKAIDALGICQSQYDDMVDSMKEGVDLVRQQNVVDARYKLSSVLSYKSACDDAFTESPGVHIPFPEDITKLFQLTSNCLAVMDAIVHKHKM

SEQ ID NO: 163107 - protein, 89 aa, Glycine max
  Coding DNA Sequence Number=SeqID_46329
MRIHFLRWILPRKSCRHLRQTLRRIAARGRWRSAEALHPSGQLFGFVLYILRVGVSRTNYLMYRHLMIVYMWLKPPLWTPLLWMTLYLL

SEQ ID NO: 163108 - protein, 146 aa, Glycine max
  Coding DNA Sequence Number=SeqID_46330
  Gene Ontology: Mol. function=structural constituent of ribosome; Cellular component=ribonucleoprotein complex; Biological process =translation
  Homolog annotation: Hit_ID=Q942D0; Match level="QueryCoverage=92%, HitCoverage=86%, E-value=2e-47, Identity=72%"; Hit description =Putative 50S ribosomal protein L20
  Pfam annotation: Domain name=Ribosomal_L20; Domain location=3-128; Score=80.8; E_value=4.4e-21; Accession=PF00453.8; Description =Ribosomal protein L20
MNKDKIFKLAKGFRGRAKNCIRIARERVEKALQYSYRDRRNKKRDMRSLWIQRINAGTRIHGENVWDEQTSDNESLKQNSWLGSKIGFLGEHVNYGNFMHGLMKENIQLNRKVLSEISMHEPYSFKSLVDISRNAFHRKQECGDSS

SEQ ID NO: 163109 - protein, 283 aa, Glycine max
  Coding DNA Sequence Number=SeqID_46331
GYLNAEGHPRKILIKDLTTLAQVWSVLSYFNLAPTSHSSNLTVDRAKLIFGLVTQLDMNVRALISGQITSMAQSNSSRLEFPALITALCRSRGVASDSLVFERLSPVISLAYIRKNYWNPDDPTIIIRGARRPRARPAEAPCTSAAPPPARMTAFRSHASKHTSGADYFTAKPTADLAAQVPHHPEDESSESSTPEPLIRKRRVVVTQEAATTSEKSLEATPEPSAPVADTTSLQQAADPSTPEDQTTPVQSPNASPVATLVLHLLEEKEAQTQDTQDQSQDF

SEQ ID NO: 163110 - protein, 275 aa, Glycine max
  Coding DNA Sequence Number=SeqID_46332
  Subcellular localization annotation: CTP_CleavageSite=31; ConfidenceScore=5.35e-01
MAEPLKKQKGSSSRSQRSFGSQDTPIPPSISSSTLFSSEEQHIRYTTLFSSCSIIDPKFMDMEFFSDEMFECVQAFQNFGLIPFMSLKILVYPELVKVFYSNLEIQEGSLISEVYGIKMVIDQSLFFELTQLSSDGVPFEGTLDDDWKFDFSVSDACQLVPLDSEPSVQIKKSFSIGAAMVASFGYRKERDGSWIKKDAQPHDVEGCSPAREDSSLLQSVMDRFDSLQTYVGERFDSLESRVDIRFREMDSRITKIDGDITFIRDCFDLPPPPST

SEQ ID NO: 163111 - protein, 59 aa, Glycine max
  Coding DNA Sequence Number=SeqID_46333
RIPLRQAQRRWPWLAIPYANAAASVLPQTDADAVMPSVVRSSFITIASHTCPHPKPLFV

SEQ ID NO: 163112 - protein, 304 aa, Glycine max
  Coding DNA Sequence Number=SeqID_46334
  Homolog annotation: Hit_ID=UPI00005F9CC3; Match level="QueryCoverage =61%, HitCoverage=99%, E-value=8e-52, Identity=55%"; Hit description =COG3758: Uncharacterized protein conserved in bacteria
  Pfam annotation: Domain name=DUF886; Domain location=120-304; Score =211.6; E_value=1.8e-60; Accession=PF05962.2; Description=Bacterial protein of unknown function (DUF886)
  Subcellular localization annotation: CTP_CleavageSite=23; ConfidenceScore=5.37e-01
AARSAPQPSDDAGTVGGGRCAVPAGAAGRCAGVRRADRPVAERLSRRLAGAGRRRSVSSGGAGRLDPQPLAVRRRQRANSRRVRRRPAGDRAGAARAAAAEQRRVPAGAENLSAGGVMSLTRFSFAALPVSPWRNGGGETREIVSWPPGAQDFDWRASIATIAQDGPFSAFTGIDRSITLLEGDGVRLFSAGHIDHQLARVGEPFAFSGDVALEATLLGGASQDFNIMTRRGRQAAEVRRSTAPVTLPPNRAGVLYVLNGVWSLPGGGELRAREGVWWAAQAAGGEVAPLTADGALLWANITAC

SEQ ID NO: 163113 - protein, 165 aa, Glycine max
  Coding DNA Sequence Number=SeqID_46335
  Gene Ontology: Mol. function=transcription factor activity; Cellular component=intracellular; Biological process=regulation of transcription, DNA-dependent
  Homolog annotation: Hit_ID=Q48BH5; Match level="QueryCoverage=96%, HitCoverage=48%, E-value=1e-50, Identity=60%"; Hit description =Transcriptional regulator, LacI family
  Pfam annotation: Domain name=LacI; Domain location=2-27; Score=50.4; E_value=6.1e-12; Accession=PF00356.11; Description=Bacterial regulatory proteins, lacI f
MASLKDVAKLAGVSLMTVSRAINEPGKLRPETYRRVKQAIDQLDYVPDLSARRIRGDGNRVQTLGVLALDTATTPFSVEMILSIEKTARERGWNSFVVNLFADDNAEQTVDLLLAHRPDGVIFTTMGLREVTLPAKLLDKKLVLAKCVSPAHSIASYIPDDGGIL

SEQ ID NO: 163114 - protein, 300 aa, Glycine max
  Coding DNA Sequence Number=SeqID_46336
MAKVVDDQNFLRVPSDLIVSRWRRWQMTIIFLRVPLDLIVSGRQGKWMSIICLHMPINLIVSERQGKRMTIICLCMPMDLIVYGRQGKQMTIICLRMLMDLIVSGRKGKWMTIISLCMPMDLIVSGRQGKRMTIICLCMPTNLIVSGRQKERMTIICLRVPIDLIVSGRQRKEDGHNLSPHANVLDCLWKAKGTDDHVLSLCANRLDCLWKARKVDDHNLFQRANGLDCLWKARKADDHNLFLHTNGLDCLSKARKADDHNLSLHANRLHCLWKARKADGHNLSSHANGLDCLLEGKESG

SEQ ID NO: 163115 - protein, 105 aa, Glycine max
  Coding DNA Sequence Number=SeqID_46337
MVLRKDNYKDSLGKFDAKANKAIFLGFHCIEKDSTLEDDIKAEEHEQSKEISTTMPKEFLRKWRTQKDLSLDNIIGEISKGVSTRSRLRILCNNMAFVSTVDQEH

SEQ ID NO: 163116 - protein, 45 aa, Glycine max
  Coding DNA Sequence Number=SeqID_46338
MAPKKLLAKSSRKDATGEGSSVAQQADMDFDGHREASLAEGQGVC

SEQ ID NO: 163117 - protein, 315 aa, Glycine max
  Coding DNA Sequence Number=SeqID_46339
MASRKLSTKRSRKDATGEGSNVTQPVDMNFDRNRFRSAEHQQLFESIKGWSFLSERRVQLRDDEFPDFQEEVARRHWAPLVTPMAKFDPEIVMEFYANAWPTVEGARDMRSWDFAWTAAGRWVRIMHTSMTMLTQIKMTLLLSNILPSDHNSDLPLPKCQLVYAILAHMSIHVAELIADAIYQFVGTAPTRHPVDPENKVIWPPITRAFIENYCTPRLVQGKMLAKLADWLSEKPVADAPPPPPESTSDHLRRWERYIRHVADQQASNHRGQQFEAVVAWPRGWPDDQTGPTDTPGGGDEVEDDQDMADMIDFLL

SEQ ID NO: 163118 - protein, 120 aa, Glycine max
  Coding DNA Sequence Number=SeqID_46340
MEYDASNNSRGWRTYMRIRVNIDVLKSLKKEIKLHKSGRKWRMVTFKYERLGGKRESMVAGGYGTTYQVWKVEVRLKGTMECRVTKAMLIVGKLKLPITINGQCQYHGKSYVEKYFERES

SEQ ID NO: 163119 - protein, 291 aa, Glycine max
  Coding DNA Sequence Number=SeqID_46341
  Gene Ontology: Mol. function=nucleoside-triphosphatase activity; Cellular component=membrane; Biological process=defense response
  Homolog annotation: Hit_ID=Q1STU9; Match level="QueryCoverage=90%, HitCoverage=22%, E-value=3e-34, Identity=34%"; Hit description=H+ -transporting two-sector ATPase, alpha/beta subunit, central region; Disease resistance protein
MNYLNKVGEKAFGCVLDLGIRHVAYIFSYGKKVDELNNSIKDLGHAKERVDHLRDEAKKNLHNIEGQVTEWFRKVEECKTEVEEFGNDEGHRKTRLLHDLFPYLWNRYRLGKQAVEMTEDVKNLIDECSKFKEVAYRENITSNDVTLSNAGYVEFGSRKSILEGVMAQLEDSTVRMIGLHGPGGVGKSTLIKDIAKKSLDKKLFDVVVKLEITANPNLQKIQEEIAYVLGLRLEGEGENVRADCLRRRLKQEKESILVILDDLWDRLDLNKLGVPLDGDVDHNDLSKKTLD

SEQ ID NO: 163120 - protein, 151 aa, Glycine max
  Coding DNA Sequence Number=SeqID_46342
  Subcellular localization annotation: CTP_CleavageSite=42; ConfidenceScore=5.01e-01
MRTLGPSSAALAQSSWSLLLMALVTGPFLGRIASFGDTFHQRCDSLKSLRPIDVVRKYAPQKPSERKEKAINTDSLSAKVTNIIGISRVTHSGCIFAAPDLPVRPANAKGKAKMIAEEANEARRFAEKGEDSMKSGVLRGGQRVPPYNPTE

SEQ ID NO: 163121 - protein, 156 aa, Glycine max
  Coding DNA Sequence Number=SeqID_46343
MEISMIDAASGGALGDMTPVEARNLIEKMASNSQQFSARSDAIVIRGVHEVATNSSSSAETKKLEGKLDALVNLQPEAVEQPEAYAANIYNRPPQPQQQNQPQQNNYDLSSNRPYVPPPSQQQQQQQQQPQKQQTVEAPPQPSLEELVRQMTIQNM

SEQ ID NO: 163122 - protein, 49 aa, Glycine max
  Coding DNA Sequence Number=SeqID_46344
VAWPGDWPDAQAGEAPAGAPAEAPDGAEEAREDEEMTDLLDFLGGSGAA

SEQ ID NO: 163123 - protein, 364 aa, Glycine max
  Coding DNA Sequence Number=SeqID_46345
  Homolog annotation: Hit_ID=Q1SDS1; Match level="QueryCoverage=49%, HitCoverage=34%, E-value=1e-17, Identity=30%"; Hit description=IMP dehydrogenase/GMP reductase
AAIDAFFAFHDRKESPVVAILANLYDTFDRRCEKNSIRIVCYTSAFYVWLVSHLFRQELRHACPLEGHLSCTEKKEASWDRLLASKEGASINWFPRWKEGRTGVLISCGGFPNIPLLGTRGCINYNPILAIRQLGYPMSGAPLKEDLTPIIARGFNNTNAEALQKVHKAWEMVQKKDKELRGSSNGPISGYHRWLKAYTQGLDWLPNLRTTKGVEVEALEENEEVQALRAELEKAQTVKKKFKSAAIRIRKENAELRDVNIATTKTLEQETKRVRREEHGQNKFRGALWGSNNELKLRREERDQSRVGSLILKDELRICLRSKRSLSQRLCETETNMVIDSLHQEATIWMDKFALTWNGSQELP

SEQ ID NO: 163124 - protein, 294 aa, Glycine max
  Coding DNA Sequence Number=SeqID_46346
MAEHGVDATAIGQFADLNAPEKEEQKKTADDGWNEANTSSLLAQSFDYFMIASLVNGADATSRKAKLRPMFLRHLCEKNPALWDYGQERLPNWRHYTVSKLYLQECDAIEAWDGDWAMLAKQRREAVHWSYSNDSDAVHPSLFLANVGIALLDWIMADDGELRNLAVPLWNRLFESVLPFATHWSLADDKWRSILQALFARFPTAFRIAGSGADVDPLWPYLDALGGDDILFTVAVVHVLLNGVHLNSLTRKDDSDPGVVQRIQAFLDWDASSGGHSVGLQILAAWESAVKSMS

SEQ ID NO: 163125 - protein, 125 aa, Glycine max
  Coding DNA Sequence Number=SeqID_46347
  Gene Ontology: Mol. function=metal ion binding; Cellular component =integral to membrane; Biological process=electron transport
  Homolog annotation: Hit_ID=Q1LIZ0; Match level="QueryCoverage=97%, HitCoverage=76%, E-value=2e-20, Identity=44%"; Hit description =Cytochrome B561
  Pfam annotation: Domain name=Ni_hydr_CYTB; Domain location=5-123; Score=-15.1; E_value=0.00023; Accession=PF01292.10; Description =Cytochrome b561 family
HRSVQQRQGAAFLAGVVCDWVGGFAGGYPGGFGCGAWRAAADAAVAGCAFTGDALRVVCVHDRHADSGVPALVAPDKALADRVKELHETLATVGYFLVGLHAAAALLHHYVFRDNTLVRMLPGRR

SEQ ID NO: 163126 - protein, 101 aa, Glycine max
  Coding DNA Sequence Number=SeqID_46348
MCLPTSLFTSPSNSNHSFNLHNISCQGPHDHNEHHQDHKAPTGQHHHGVLLREARGPPGRAKARRTLRMNVTIDVITDRVVSSPDFATRFRFGAVDYEQLL

SEQ ID NO: 163127 - protein, 371 aa, Glycine max
  Coding DNA Sequence Number=SeqID_46349
  Gene Ontology: Mol. function=nucleoside-triphosphatase activity; Biological process=defense response
  Homolog annotation: Hit_ID=Q1STU5; Match level="QueryCoverage=96%, HitCoverage=73%, E-value=4e-24, Identity=33%"; Hit description =Leucine-rich repeat
MEAHKIFPNLECLVIDFDEAQKWLLSNTVKHPMHRLKELRLSEVNDGERLCQILYRMPNLEKLLLWEAKHLLKESSESRLGTVLQLKELVLSLSGIKDIGFEREPVLRRLELLSLFACKKLRNLAPPSVSVAYLTNLNVKYCNGLRNLMASSTAKSLVQLKSMKISGCDELEEIVSNEGNKEEEQIVFGKLITIELEWLGKLKSFCSYKNCEFKFPSLEVLIVRGCRIMQRFTEGGARAPKLQNIVTANEEGKEEAKWQVISCLSSINLVPCTVSFSNLTYLLVQNCKSLLYLFTSSTARSLGQLKTMEISGCDSMEEIVSEEGDESDEDEIIFQQLNCLELEGLGKLRRFYKGSLSFPSLREEIERIYKN

SEQ ID NO: 163128 - protein, 189 aa, Glycine max
  Coding DNA Sequence Number=SeqID_46350
MEVILCIPSKGFVLNVEGQPWKLLRKDLTTLAQTWSVFSYSNLAPTSHTSDLNMDRARLVYGLVTGMDINIGGLISRQITGMAQSNSSHLGFPALITALCRSRGVGSDALTSYRSLRPVINLAYIKRKCWNVNDQTVNFPRARKTRSRAAGVPSSPASTTSSAQSSQTSDAKLQSLLEGQILIMQSLQE

SEQ ID NO: 163129 - protein, 129 aa, Glycine max
  Coding DNA Sequence Number=SeqID_46351
  Gene Ontology: Mol. function=cysteine-type endopeptidase activity; Cellular component=vacuole; Biological process=proteolysis
  Homolog annotation: Hit_ID=Q84M29; Match level="QueryCoverage=99%, HitCoverage=30%, E-value=2e-42, Identity=60%"; Hit description =Cysteine protease-1
  Pfam annotation: Domain name=Inhibitor_I29; Domain location=17-74; Score=107.4; E_value=4.3e-29; Accession=PF08246.2; Description =Cathepsin propeptide inhibitor domain (
MDMSIIDYDESHTRHVYEAWLVKHGKAYNALGEKERRFKIFKDNLRFIEEHNGAGDKSYKLGLNKFADLTNEEYRAMFLGTRTRGPKNKAAVVAKKTDRYAYRAGEELPAMVDWREKGAVTPIKDQGQC

SEQ ID NO: 163130 - protein, 118 aa, Glycine max
  Coding DNA Sequence Number=SeqID_46352
MYQYPFEGHHTDTSTSKHSFGGVVETHPHFSWLTMTPSQQHDAPIPTPSALLGTQWNVPRAIPNMGDLLGVDLRHQFSVEVDQVEAERHRGRRNPDRQARRWDRPCDTSSRHHGHHNK

SEQ ID NO: 163131 - protein, 495 aa, Glycine max
  Coding DNA Sequence Number=SeqID_46353
  Gene Ontology: Mol. function=kinase activity
  Homolog annotation: Hit_ID=Q8ZKZ0; Match level="QueryCoverage=49%, HitCoverage=84%, E-value=3e-75, Identity=56%"; Hit description=2-oxo- 3-deoxygalactonate kinase
  Pfam annotation: Domain name=Aldolase; Domain location=232-413; Score= -9.9; E_value=2e-08; Accession=PF01081.9; Description=KDPG and KHG aldolase
  Pfam annotation: Domain name=DGOK; Domain location=1-244; Score =281.5; E_value=1.6e-81; Accession=PF05035.3; Description=2-keto-3 -deoxy-galactonokinase
  Pfam annotation: Domain name=His_biosynth; Domain location=183-405; Score=-129.2; E_value=0.081; Accession=PF00977.11; Description =Histidine biosynthesis protein
  Pfam annotation: Domain name=MR_MLE_N; Domain location=356-475; Score= 78.6; E_value=1.9e-20; Accession=PF02746.6; Description=Mandelate racemase  muconate lactonizing enzyme, N-terminal domain
  Pfam annotation: Domain name=TMP-TENI; Domain location=227-399; Score= -53.3; E_value=0.0011; Accession=PF02581.7; Description=Thiamine monophosphate synthaseTENI
  Pfam module annotation: Pfam domain module=Aldolase::DGOK::His _biosynth::MR_MLE_N::TMP-TENI; Domain location=232-413::1-244::183 -405::356-475::227-399
VFATITDGWPVAEVPVIMAGMVGSNAGWLAVPYLACPVALNALSDRLTCVEGKAWIVPGLSIERDDNYNVMRGEETQLLGAVTLQPAPLYVMPGTHAKWVQLEQDRVIDFRTVMTGELHHLLLKQSLIGAGLPAQEASPDAFRDGLQLGSHDPSILARLFEVRAAHVLGARDRRHISDFLSGLLIGHEVAQMTQQLTHSRQPIVIIAGSALAQRYQQALAFIGTDSVTLEGDRAFQHGIRTEAHVAALIDAGFDAIEIPLNSPEWAKSIGAMVQTFGDKALIGAGTVLQATQVDQLAALNSKLVVTPNTDAAVIRQAVAHGMLVAAGCATASEAFTALQAGAQALKIFPSSAFGPGYIKALKAVLPPEVPVFAVGGVTPENLHEFIAAGCVGAGLGSDLYRAGQPLSRTVEKARAFIAAYKDADPARINDLWQVMYRGGFYRGGPILMSAIAGIDQALWDIKGKALGVPVYQLLGGLVRDSIKAYSWVGGDRPAE

SEQ ID NO: 163132 - protein, 71 aa, Glycine max
  Coding DNA Sequence Number=SeqID_46354
MAKMYECVDSLEEKWMNFEPRWGISHMEERMGRMEERLLSKIFYGGWIFELQWGPLMVIFHHGDAAEDKGK

SEQ ID NO: 163133 - protein, 116 aa, Glycine max
  Coding DNA Sequence Number=SeqID_46355
MAACAGVFWDEFGNWIYGFVRNLGMLSQLNFGASFQPYRLHGIRGFALCTQFGSGCLETRWYNWLTFIGKPTLLQMILLIGAYSSLGFCTSCHLPHQSSLFFVRRCSGGLGPLFDL

SEQ ID NO: 163134 - protein, 254 aa, Glycine max
  Coding DNA Sequence Number=SeqID_46356
  Gene Ontology: Mol. function=hydrolase activity; Biological process =intracellular signaling cascade
  Homolog annotation: Hit_ID=Q5XM22; Match level="QueryCoverage=51%, HitCoverage=89%, E-value=2e-35, Identity=49%"; Hit description =Resistance-like protein HAAS-2
  Pfam annotation: Domain name=DUF1723; Domain location=43-92; Score =61.3; E_value=3.2e-15; Accession=PF08330.1; Description=Protein of unknown function (DUF1723)
ERPDLKLVSHGRKVDKFGRPAAEIEGMIAATGLDPLIRCSVITTDPGLISAFVERWHRETSSFHLPVGEVTITLDDISSLLHIPITGALHSFEPLATSDAVALLTELLEVTPDEATAETRQAGGPHVRLSWLRDMYQSRCRARQWVAAARTYLLHLVGCTLFANKSATHVHVVHLQAFRDLGQARAFSWGAAALVHLYDQLNEASQAPTRQMAGYISLLQCWIYEHFPSVHRSVVDDGYVEASPRACRWLTGKA

SEQ ID NO: 163135 - protein, 39 aa, Glycine max
  Coding DNA Sequence Number=SeqID_46357
MPESEDFRIRLPNQVVFKDCRNWFHSKVNLGSKSMLLRP

SEQ ID NO: 163136 - protein, 35 aa, Glycine max
  Coding DNA Sequence Number=SeqID_46358
MAITQATGLQIKTRLKMKWWNERITLSSEGNTQRM

SEQ ID NO: 163137 - protein, 712 aa, Glycine max
  Coding DNA Sequence Number=SeqID_46359
  Gene Ontology: Mol. function=DNA binding; Cellular component=nucleus; Biological process=porphyrin biosynthetic process
  Homolog annotation: Hit_ID=Q8W240; Match level="QueryCoverage=68%, HitCoverage=70%, E-value=5e-73, Identity=55%"; Hit description=GT-2 factor
MVSSSTKLYSFRVITLFKFSKPIILLGITHDPQYHGHQNFDAIYYAAVSNCCGAVLAKRERERDPKETMLGDSALLGGGGGEGGASADVVAATATHDATTTTTTGGGGGGSNNSGDDERGRIEEGERSFGGNRWPRQETLALLRIRSDMDVAFRDASVKGPLWEEVSRKMAELGYHRSSKKCKEKFENVYKYHKRTKEGRSGKQDGKTYRFFDQLQALENHSPTPHSPNPSSKPLQSAPSRVVATTTASSMSLPIPTPTTTVPMQPILSNTIPTSSVPNITVPSTTILPITIPQPILTTPSINLTIPSYPPSNPTNFPPPSNPTPPLSFPTDTFSNSTSSSSTSSDETLERRRKRKRKWKDFFERLMKEVIEKQEELQKKFLEAIEKREHDRIAREEAWRVQEMQRINREREILAQERSIAAAKDAAVMSFLQKIAEQQNLGQALTNINLVQPQPQLQPQPPVQQQVTPPNIVPAPMQQPLPVIVTQPVVLPVVSQVTNMEIMKADNNNNNNNNNNCENFLPPSSSRWPKVEVQALIKLRTSMDEKYQENGPKGPLWEEISASMKKLGYNRNAKRCKEKWENINKYFKKVKESNKRRPEDSKTCPYFHQLDALYRQKHKAEESTAAAKAESAVAPLMVQPEQQWPPQQQDDRDITMEDMENEDDEYEEEREGEEEEEEDEEDEEGGGGNYEIVANKTSGGGGAAASVGASTE

SEQ ID NO: 163138 - protein, 93 aa, Glycine max
  Coding DNA Sequence Number=SeqID_46360
MLHPFVPFSHTSLPPINCDSNDSDSEGDDSNIGGGGGSSRNNDASDDDNDNNNCVRNNNGSDSYGDYGGDNNNIIDGGDYNNIPIFLEYRMVC

SEQ ID NO: 163139 - protein, 56 aa, Glycine max
  Coding DNA Sequence Number=SeqID_46361
MTKHTKPKKVESYETPVCRGKISLLQKKVTCQKQHRNQLVEKPMGKIMVDFLLNKQ

SEQ ID NO: 163140 - protein, 127 aa, Glycine max
  Coding DNA Sequence Number=SeqID_46362
MAFIMSSFIHFILKFRDSCKEYYSQQVVHSQLRATTSPDDESERSAIPPTWEAGGSAISPASESGGATASSNDALEMIIRGGDGGTTSRSGEEGGFTTGDCGLAGSGSTYKGVGSGGAASLGLTDGS

SEQ ID NO: 163141 - protein, 70 aa, Glycine max
  Coding DNA Sequence Number=SeqID_46363
  Gene Ontology: Mol. function=serine-type endopeptidase activity; Cellular component=chloroplast; Biological process=proteolysis
  Homolog annotation: Hit_ID=Q6EW27; Match level="QueryCoverage=73%, HitCoverage=25%, E-value=1e-15, Identity=80%"; Hit description=ATP -dependent Clp protease proteolytic subunit
  Pfam annotation: Domain name=CLP_protease; Domain location=3-70; Score=-90.8; E_value=0.046; Accession=PF00574.13; Description=Clp protease
MNHQKRPFQNILEVGLLKEEATGRQESLNGVYVQRTGKPLWVISEDMERDVFMSAAEAQAHGIVDLVAVE

SEQ ID NO: 163142 - protein, 71 aa, Glycine max
  Coding DNA Sequence Number=SeqID_46364
MPEVEREHCRAMRKVPQHSRGCATSNQTHLGLPGCSNRRRCLLVEATQLARASWAATNSLFSPINRGKRAE

SEQ ID NO: 163143 - protein, 43 aa, Glycine max
  Coding DNA Sequence Number=SeqID_46365
MSGRIQRQKPIKGRTQVEARITIDRSSSHAQHWTSGKHSWGTA

SEQ ID NO: 163144 - protein, 52 aa, Glycine max
  Coding DNA Sequence Number=SeqID_46366
MCLTKSTLVVVGSDAEALGHYELAMALMVDHDTHELNMAMVNLPTPSSLTLF

SEQ ID NO: 163145 - protein, 251 aa, Glycine max
  Coding DNA Sequence Number=SeqID_46367
  Homolog annotation: Hit_ID=Q2R3F0; Match level="QueryCoverage=85%, HitCoverage=83%, E-value=6e-97, Identity=70%"; Hit description =Expressed protein
  Pfam annotation: Domain name=DUF1001; Domain location=42-218; Score= -54.6; E_value=0.00049; Accession=PF06206.2; Description=Protein of unknown function (DUF1001)
MGTGDSDSESNGWNRARGLALKTLLLIGGALLVKRLRKSTTRWDHAHFVSNSLTGEKEQASRDPDNYFNIRMLTCPAAELVDGSKVLYFEQRLFMVKPCPKELKCDVELSTYAIRDMEEYKNFCDRPRDQRPQPEEVIGDIAEHLTTVHLKRCPRGKRCLYEGSTPPGGFPNSWNGATYCTSELAILKNNEIHTWDRGYDDGGNQVWGQKEGPYEFKPAPTSSFNDMFSPLNFPPPPSMERRIEGSFVLQE

SEQ ID NO: 163146 - protein, 314 aa, Glycine max
  Coding DNA Sequence Number=SeqID_46368
  Gene Ontology: Mol. function=RNA-directed DNA polymerase activity; Cellular component=nucleus; Biological process=RNA-dependent DNA replication
  Homolog annotation: Hit_ID=Q1SWC8; Match level="QueryCoverage=98%, HitCoverage=40%, E-value=4e-25, Identity=35%"; Hit description=RNA -directed DNA polymerase
MNELKNILEVYEAASGQAINLSKSEMFFNSNVIELKRNSISNMLGVYARIGAGKYLGMSSNIGRNRKSTFGFMKEKSLEEDHIHGWEIPVQSWLGNHDKFPTPGNFIKDGMENCRCSGPISTAPLEAVKDLVVSDLMIQGTRQWNKHLIYALLPQRSIMEQARNHQQFQIEGDWMNIWSLNVPHKVRVFLWRVCRDCIPTKIQLESRDIDCSSIRLFCQQDLENSFHCFFKCPGSISVWEKEGDDGINSCKSSKLLWSLAKRRNEKLWNEVEENVIAVCCRANSVLQDWRLAQDSQQFQQFHCSPNVLVWQKPS

SEQ ID NO: 163147 - protein, 83 aa, Glycine max
  Coding DNA Sequence Number=SeqID_46369
  Homolog annotation: Hit_ID=Q9FI44; Match level="QueryCoverage=52%, HitCoverage=23%, E-value=1e-12, Identity=77%"; Hit description =Arabidopsis thaliana genomic DNA, chromosome 5, TAC clone:K3K7
  Pfam annotation: Domain name=DUF339; Domain location=26-83; Score= -4.1; E_value=0.0046; Accession=PF03937.6; Description=Protein of unknown function (DUF339)
MGSFRNAAINVVRVINSNKATIAASTNPLHTLRLLYRSKQRGFLELDLVLGKWVEDNIHSLDEIRIKALIHVLDLELECLYLS

SEQ ID NO: 163148 - protein, 67 aa, Glycine max
  Coding DNA Sequence Number=SeqID_46370
  Gene Ontology: Mol. function=calcium ion binding; Cellular component =endoplasmic reticulum; Biological process=protein folding
  Homolog annotation: Hit_ID=Q39817; Match level="QueryCoverage=92%, HitCoverage=11%, E-value=2e-24, Identity=88%"; Hit description =Calnexin homolog precursor
MGERKGIPIALGLLAMLLFFIASSSSSHLVRASDDADDAIFYESFDEDFDGRWIVSDKEDYNGKQIL

SEQ ID NO: 163149 - protein, 461 aa, Glycine max
  Coding DNA Sequence Number=SeqID_46371
  Gene Ontology: Mol. function=transporter activity; Cellular component= mitochondrial inner membrane; Biological process=transport
  Homolog annotation: Hit_ID=Q1SMQ9; Match level="QueryCoverage=99%, HitCoverage=96%, E-value=0.0, Identity=78%"; Hit description=Calcium- binding EF-hand; Adenine nucleotide translocator 1
  Pfam annotation: Domain name=Mito_carr; Domain location=185-272; Score=100.0; E_value=6.9e-27; Accession=PF00153.17; Description =Mitochondrial carrier protein
  Pfam annotation: Domain name=Mito_carr; Domain location=279-370; Score=101.2; E_value=3e-27; Accession=PF00153.17; Description =Mitochondrial carrier protein
  Pfam annotation: Domain name=Mito_carr; Domain location=377-460; Score=77.7; E_value=3.6e-20; Accession=PF00153.17; Description =Mitochondrial carrier protein
  Pfam annotation: Domain name=efhand; Domain location=121-149; Score =25.3; E_value=0.00021; Accession=PF00036.22; Description=EF hand
  Pfam annotation: Domain name=efhand; Domain location=18-46; Score =15.7; E_value=0.17; Accession=PF00036.22; Description=EF hand
  Pfam annotation: Domain name=efhand; Domain location=54-82; Score =19.9; E_value=0.009; Accession=PF00036.22; Description=EF hand
  Pfam annotation: Domain name=efhand; Domain location=85-113; Score =21.2; E_value=0.0036; Accession=PF00036.22; Description=EF hand
  Pfam module annotation: Pfam domain module=Mito_carr::Mito_carr::Mito_ carr::efhand::efhand::efhand::efhand; Domain location=185-272::279 -370::377-460::121-149::18-46::54-82::85-113
MDHVLVALGETKEEREVRIRSLFNFFDAANNGYLDYAQIEAGLSALQIPPEYKYARELCEVCDANSDGRVEYHEFRRYMDDKELELYRIFQAIDVEHDGTILPEELYEALLKAGIEMNDEELAHFVEHVDKDNNGIITFEEWRDFLLLYPHEATIENIYHHWERVCLVDIGEQAVIPEGISKHANRSKYFLAGGIAGGISRTATAPLDRLKVVLQVQSERASIMPAVTRIWKQDGLLGFFRGNGLNVVKVAPESAIKFYAFEMLKKVIGEAQGNKSDIGTAGRLVAGGTAGAIAQAAIYPMDLIKTRLQTCPSEGGKVPKLGTLTMNIWFQEGPRAFYRGLVPSLLGMIPYAAIDLTAYDTLKDMSKRYILQDSEPGPLVQLGCGTISGAVGATCVYPLQAQPSNTSDAYKGMFDAFRRTFQLEGFIGFYKGLFPNLLKVVPAASITYVVYESLKKNLDLD

SEQ ID NO: 163150 - protein, 876 aa, Glycine max
  Coding DNA Sequence Number=SeqID_46372
  Gene Ontology: Mol. function=DNA binding; Cellular component=beta -galactosidase complex; Biological process=DNA integration
  Homolog annotation: Hit_ID=Q1SLU3; Match level="QueryCoverage=99%, HitCoverage=66%, E-value=0.0, Identity=47%"; Hit description =Integrase, catalytic region
  Pfam annotation: Domain name=rve; Domain location=116-271; Score =133.0; E_value=8.5e-37; Accession=PF00665.16; Description=Integrase core domain
  Pfam module annotation: Pfam domain module=RVT_2::rve; Domain location=381-636::116-271
MHYQLIFLANKCLIQEISTKKMIGTIDVESGLYKLKTTSGHHNSTPLAVLNPSNYANSCTKILIDIWHCRLGHLSNERMLAMKQYYPNLNSVKEIICDACHKAKQKKLIFPISSSHSLSPFTLIHVDIWGPCSTTSIHGHKYFITIVDDHTRFVWVLPTSSKAETQSLLQGFIKSVERQFDTKVKTIRSDNGAEFIMSHFFQATGIIHQTTCVETPQQNGIVERKHQHLLNVTRALLFQSNLPHIFWSYALLHAATLINIIPTTHNPQAFSFPIDSPSPPPLPPQSEPVPIDQPNTDHTSSAPTPRRTDRIRTRPTKYTDYQTSFTSATITNHPGTKHPISSVISYNKLSSSYHSFILNISANSEPKSYNEACKHDSWVQAMHDEISALERNNTWVLTDLPQHKNVIGCKWVYKIKHNSDGSIERYKARLVAKGYTQIEGLDYLDTFSPVAKITTVRLLLALAALNNWYLRQLDVNNAFLHGGLHEEVYMVLPPGMKSAKPGQVCKLQRSLYGLKQASRQWYARLSTFLAHHGFKQSVADYSLFTLKKANSFTALLVYVDDIVLSGNDLSVISSITKLLDDTFKIKDLGNLKYFLGFEVARGTSGINICQRKYALDLLTDTDMLHCKPVSTPFDYYTRLHQASGSMLSDSQISSYRCLIGRLIYLTNTRPDITFAVQHLSQFIASPTTAHYTALYRILRYIKAAPGLGLFFPSTSELQLKAFSDSDWAGCVDTRKSITGFSVYLGSSLISWKSKKQAIVSRSSFEAGYRALTSVTCEIQWLTYLLHDFDITYKPALVFCDNKSGLHIAVNPVFHERTKHIEIDCHIVRDKLLSGLIKLLPIASQQQLADVYTKALAPGAFRFICSKLGMNDIHSPV

SEQ ID NO: 163151 - protein, 184 aa, Glycine max
  Coding DNA Sequence Number=SeqID_46373
  Gene Ontology: Mol. function=protein-tyrosine kinase activity; Cellular component=integral to membrane; Biological process=protein amino acid phosphorylation
  Homolog annotation: Hit_ID=Q1RSY3; Match level="QueryCoverage=97%, HitCoverage=32%, E-value=4e-40, Identity=47%"; Hit description =Protein kinase
  Pfam annotation: Domain name=LRR_1; Domain location=111-133; Score =4.9; E_value=35; Accession=PF00560.23; Description=Leucine Rich Repeat
  Pfam annotation: Domain name=LRR_1; Domain location=135-156; Score =3.2; E_value=71; Accession=PF00560.23; Description=Leucine Rich Repeat
  Pfam annotation: Domain name=LRR_1; Domain location=62-85; Score=8.2; E_value=8.3; Accession=PF00560.23; Description=Leucine Rich Repeat
  Pfam annotation: Domain name=LRR_1; Domain location=87-109; Score =0.1; E_value=2.7e+02; Accession=PF00560.23; Description=Leucine Rich Repeat
  Pfam module annotation: Pfam domain module=LRR_1::LRR_1::LRR_1::LRR _1; Domain location=111-133::135-156::62-85::87-109
MGNDIFCLKSIKESLRDPYNYLQSWNFNNKMKALFVLCSIHKKNFQIWISRANFLVIQNCTSLTGLDFSINTLSGTIPENTATLLPFVTSLDQSSNKFSGAIPMSLANCTDLNALKLDQNRLSYHFPQQLGLLQRPRTFTVSNNSLTGPVPNFTNGHVVVNYSNNEGLCGPSLRPCPNNSSTGH

SEQ ID NO: 163152 - protein, 998 aa, Glycine max
  Coding DNA Sequence Number=SeqID_46374
  Gene Ontology: Mol. function=nucleic acid binding; Cellular component= nucleus; Biological process=regulation of transcription, DNA-dependent
  Homolog annotation: Hit_ID=Q1SMQ6; Match level="QueryCoverage=99%, HitCoverage=99%, E-value=0.0, Identity=83%"; Hit description=Tudor; Staphylococcus nuclease subtype
  Pfam annotation: Domain name=SNase; Domain location=10-151; Score =20.1; E_value=1.3e-06; Accession=PF00565.8; Description =Staphylococcal nuclease homologue
  Pfam annotation: Domain name=SNase; Domain location=186-373; Score =31.9; E_value=1.5e-07; Accession=PF00565.8; Description =Staphylococcal nuclease homologue
  Pfam annotation: Domain name=SNase; Domain location=595-722; Score =70.2; E_value=6.4e-18; Accession=PF00565.8; Description =Staphylococcal nuclease homologue
  Pfam annotation: Domain name=TUDOR; Domain location=737-864; Score =136.0; E_value=1e-37; Accession=PF00567.14; Description=Tudor domain
  Pfam module annotation: Pfam domain module=SNase::SNase::SNase::TUDOR; Domain location=10-151::186-373::595-722::737-864
MASTASGATGWYRGRVKAVPSGDCLVIVAISSTKPGPLPEKTITLSSLIAPRLARRGGVDEPFAWESREFLRKLCIGKEVTFRVDYNVPSISRDFGTVFVGDKNVAMLVVSQGWVKVREQGQQKGEVSPYLAELLRLEEQAKQEGLGRWSKVPGAAEASIRNLPPSALGDPSNFDAMTFLNAKKGLPMEAVVEQVRDGSTLRIYLLPEFQFVQVFVAGIQLIVLPLPQSPQMGRRAAPESVVEPELTSDDTNGDVPGEPRAPLTSAQRLAVSTSAAETAADPFAHDAKFFTEMRVLNREVRLVLEGVDKFSNLIGSVYYPDGESAKDLALELVENGYAKYVDWSANMMEEEAKQKLKTAELQAKKDRLRMWTNYVPPPSNSKAIHNQNFSGKVVEVVSGDCIVVADDSIPYGSPLAERRVNLSSIRCPKMGNPRRDEKPAPYAREAKEFLRTRLIGRQVNVQMEYSRKVSPTDGSVVPSAADSRVMDFGSVFLLSGAKVDNDDAPSSAPPAGSQQNGVNVAELIVGRGFGTVIRHRDFEERSNYYDSLLAAESRAISGRKGTHSAKDPPVMHITDLTMASAKKARDFLPFLHRSRRVPAVVEYVLSGHRFKLLIPKETCSIAFSFSGVRCPGRDEPYSDEAIALMRRKIMQRDVEIEVETVDRTGTFLGSLWESRTNVAITLLEAGLAKLHTSFGSDRIPDFHLLDQAEQSAKRQKLKIWENFVEGEEVSNGAAVENKQQEVLKVIVTEVLGGGKFYVQTVGDQKIASIQQQLASLNLKDAPVLGAFNPKKGDIVLCYFHADKSWYRAMVVNTPRGPVESPNDLFEVFYIDYGNQEVVPYSQLRPVDPSVSAAPGLAQLCSLAYIKIPNLEEDFGQEAAEYLSELTLNSGKEFRAKVEEKDTSGGKVKGQGTGTVLAVTLVAVDAEISVNAAMLQEGLARTEKRNRWDRKDRQTALDNLENFQEEAKTSRRGMWQYGDIQSDDEDTAPPPRKAAGGRK

SEQ ID NO: 163153 - protein, 50 aa, Glycine max
  Coding DNA Sequence Number=SeqID_46375
MHKNERDVKWKNGLKLRTVLSLSSHKIDTQEKSYQGIKSHLKGLLRSIIT

SEQ ID NO: 163154 - protein, 58 aa, Glycine max
  Coding DNA Sequence Number=SeqID_46376
  Homolog annotation: Hit_ID=Q9ZU94; Match level="QueryCoverage=97%, HitCoverage=21%, E-value=7e-07, Identity=45%"; Hit description =Expressed protein
MGDRMRQAVRAPVIGEVAATLEEAVDVVRGSGEGEVVVVGKGDGVDEGGEERVDGVFV

SEQ ID NO: 163155 - protein, 166 aa, Glycine max
  Coding DNA Sequence Number=SeqID_46377
MPPSSGQGRDGGATKSSLLLFLVIFDSVSGSRGHSVVDGFTQTLLHSMHPIWLIGCQLYVSPKAKKGKIDVTNVVHLSIGTFNVFIPITLYVKVYNMFDCVRRSTVKKFLSKQHRKIDYQSLALGNLQEAQSSGLQELSSISCQLLRGSCTSAPPYPGMQCVRLAT

SEQ ID NO: 163156 - protein, 209 aa, Glycine max
  Coding DNA Sequence Number=SeqID_46378
  Subcellular localization annotation: CTP_CleavageSite=66; ConfidenceScore=5.65e-01
MDRRRNASPVYARQWSGGSSSTGSSSPAMSPAHPQSRLGPTSATGLSTVKRTQNVAAKAAAQRLARVMASQNTTADDGEDDDDLDFRFSAPSPASLSSFSSNSGSNRSASTNATAIPPISVARPNRSPSPALGRNFVEHTHSVRSTSAGRPAVSVRSAAVVPPNKSTLRTPMAIPPIDPPTNRNREKRYCGVLFYLNSYGFVAVVVIDL

SEQ ID NO: 163157 - protein, 463 aa, Glycine max
  Coding DNA Sequence Number=SeqID_46379
  Gene Ontology: Cellular component=phycobilisome; Biological process =photosynthesis
  Homolog annotation: Hit_ID=Q2R3H0; Match level="QueryCoverage=66%, HitCoverage=37%, E-value=6e-85, Identity=53%"; Hit description =Expressed protein
MSIRPLNSKDTGDQREASALRDELDMLQEENEDLLEKLRQAEEKRQEVEARTRELEKQNLGLGSNSTPQNWLVRFFMSQLQMSSVVGNTDIAVFAHDYPKCQCTTSLHGVSAVKCGPGISDYNSQLLWHDSPKVASLGEGVSLEAKLLSRKEAALRQREAALKAAQQTQSGRDEDITALRVEIQNLKDDATAALEQQQEAEAEAKSLRTMTQRMILTQEEMEEVVLKRCWLARYWGLAVKHGICADIAQSKHEHWSSLAPLPFELVISAGQKAKEESWNKMHGPGADGPDRSKLVRDLNDLAGEGNIESMLSVEMGLRELASLKVEDAVVLALAQHRRPNSVRQSVLDSKSRGDAKYSEAFELSEEEAEDVLFKEAWLTYFWRRALFHGVEEDIAEERLQFWIARSGQSPSSHDAVDVERGLLELRKLSIEQQLWEASRKGIDQLQGSADANHKHASDSDASS

SEQ ID NO: 163158 - protein, 281 aa, Glycine max
  Coding DNA Sequence Number=SeqID_46380
  Gene Ontology: Mol. function=hydroxymethylbilane synthase activity; Cellular component=chloroplast; Biological process=tetrapyrrole biosynthetic process
  Homolog annotation: Hit_ID=Q43082; Match level="QueryCoverage=75%, HitCoverage=57%, E-value=1e-100, Identity=85%"; Hit description =Porphobilinogen deaminase, chloroplast precursor
  Pfam annotation: Domain name=Porphobil_deam; Domain location=55-206; Score=165.8; E_value=1.1e-46; Accession=PF01379.11; Description =Porphobilinogen deaminase, dipyromethane cofactor binding domain
  Pfam annotation: Domain name=Porphobil_deamC; Domain location=214 -279; Score=72.6; E_value=1.3e-18; Accession=PF03900.6; Description =Porphobilinogen deaminase, C-terminal domain
  Pfam module annotation: Pfam domain module=Porphobil_deam::Porphobil _deamC; Domain location=55-206::214-279
MEYLYSHHTHQYHRRMRELYLDSGWLPHPCSAPKTKTASLSKASVAVEQQTKVALIRIGTRGRRQNPHTTTDVPTYLPDKTILPCNLPREDVRDAFISLTAASLADLPPASVIGTASLRRKSQILHRYPSLNVQENFRGNVQTRLRKLNEGVVQATLLALAGLKRLSMTENVTSILSIDDMLPAVAQGAIGIACRSDDDKMAEYIATLNHEETRLAVVCERAFLQTLDGSCRTPIAGYACRNEDGNCLFRGLVASPDGTRVLETSRVGPYAVEDMIEMGVQ

SEQ ID NO: 163159 - protein, 694 aa, Glycine max
  Coding DNA Sequence Number=SeqID_46381
  Gene Ontology: Mol. function=nucleic acid binding; Cellular component= spliceosome; Biological process=mRNA processing
  Homolog annotation: Hit_ID=Q10M01; Match level="QueryCoverage=75%, HitCoverage=78%, E-value=7e-80, Identity=38%"; Hit description=Zinc finger C-x8-C-x5-C-x3-H type family protein, expressed
  Pfam annotation: Domain name=RRM_1; Domain location=349-417; Score =22.7; E_value=0.0011; Accession=PF00076.12; Description=RNA recognition motif. (a.k.a. RRM, R
  Pfam annotation: Domain name=zf-CCCH; Domain location=225-250; Score =28.8; E_value=1.9e-05; Accession=PF00642.15; Description=Zinc finger C-x8-C-x5-C-x3-H type (and similar)
  Pfam module annotation: Pfam domain module=RRM_1::zf-CCCH; Domain location=349-417::225-250
MGSCEATNVVLSKIKNFDPENASKIMGYLLMNLEESELIRLACSPDPVLHTLVLRVKNHLSGLTLSSTTPSSPSLPPSPLNPTARLTAISSNPFSRGGGPTNGFDFTRNHPSSPSSHSHAWNFPNNNPISPKSTPLFSYDNIRALSPRVVNDDCGDFVDEQQVNEYFPFLNDSSKNEDLVDPRLEFGVGAQNWHSGDSHLQHRRSYSASDVGFGCDEAAAAAPGLGYKPCLYFARGFCKNGTNCKFLHGAFTDSLDAIVGSPSKQLEGMEQREEFVRFNKAPQLQRIASGPSAAAREKYFEFLIQESQRAAAAFIMGEEFYNFGWDKPERNDFLAAISSEKSNSASQQIYLTFPAESTFKDEDVSEYFSKFGPVQDVRIPYQQKRMFGFVTFVYPETVRLILSKGNPHFICDSRVLVKPYKEKGKVPDKRQQHQQQQLERGDLSPCLSPSGFGSKEPYDFHLGARMLYNPHDVLLRRKIEEQAELQQVRELQERRLKNLQLPDFKNNPIHHHQRSLSVGIPLALPHQLHSHINDAGLSPDSIKGDITGYSGSFSSTNSLGIASDQQLPLKEVDPACIDDSENGNLKESGNTEGVDLSNSILGAVLILICPRRGYVHFISNFLILCSFMMLSWPWRSVEQALPDSLFASPTKATGDYHADFSTLAEVNESAVFSASSSSEDKLEPTTSSSDVASH

SEQ ID NO: 163160 - protein, 622 aa, Glycine max
  Coding DNA Sequence Number=SeqID_46382
MSFSSSSCCKRKLEAAELRWINHGQPAGANVAAIADAASTREVVYTIRWMKIKTIMEEALMARKQAAPLIPSKGCSLPGLSDDHSECLFLLTKEGTLVERRLHQRKWKWVVHGRHQDQNLTCITPALQDESSETSSTSLFFTTSLGSVFEYRIPKQLGLVPNNQFPGAWKSYQHPLHAKAAKGIAGLQLYIGRILFPLDDGRIAELHPLGRDGESSGPSPPQNIRRKASTKYIWSVLDVPESEGWNAEYCTEERGLRNCLTGIKDESEESLVSLVTGRRKQSQIQNHYLSVGTSGGGRLIQSSEEYNTPDNWISSNFLLRLMDVGKSFFLITDDGLIFEYISIESAWIWLRHESSTAMKGVSSNYNGSLFMVDTQGSLLLRERSGKELAWRNCTAVRKGRNVIGGQPWDGLPGQERKVTTEDTLFFVSKTGRLMKLMYNKVTDLWHEHYHSQHLVLSQFTGTVIRPSLKTLSGSLFMVSREGGVVEFQWSSSYGWNWVEHGTPNRGVTLVGSPGTSSEGNQLLLIGSDGKVYLRYMDKMAWMWKDCGFPYVGNKLVEAHKHGGFQKEKVDCIDEDSASYLKKDQGNFCDLNIKCDSKVASTRPIPFSEGSVIFELRDGRVGT

SEQ ID NO: 163161 - protein, 397 aa, Glycine max
  Coding DNA Sequence Number=SeqID_46383
  Gene Ontology: Mol. function=protein serine/threonine kinase activity; Cellular component=nucleus; Biological process=protein amino acid phosphorylation
  Homolog annotation: Hit_ID=Q6ZCC7; Match level="QueryCoverage=98%, HitCoverage=61%, E-value=1e-107, Identity=47%"; Hit description =Putative CRK1 protein
  Pfam annotation: Domain name=Pkinase; Domain location=1-204; Score =116.3; E_value=8.6e-32; Accession=PF00069.15; Description=Protein kinase domain
  Pfam annotation: Domain name=Pkinase_Tyr; Domain location=1-203; Score=-138.8; E_value=0.00059; Accession=PF07714.7; Description =Protein tyrosine kinase
  Pfam module annotation: Pfam domain module=Pkinase::Pkinase_Tyr; Domain location=1-204::1-203
MEHDLAGLATIHGFKLTEPQIKCYMQQLLRGLEHCHSRGVLHRDIKGSNLLIDNNGNLKIGDFGLSIVCDPDKKQPLTSRVVTLWYRAPELLLGATDYGAAIDMWSVGCILAELLVGKPIMPGRTEVEQMHKIFKLCGSPSEDYWQRTKLPHATSFKPQHPYNRQVSETFKNFSPTALALVDMLLTIEPEDRGSATSALESQFFTTNPLPCNPSSLPKFSPTKEFDSKRREKEATRKNAESIKGRGPASVYRGAADTKVMGSPKYIARGDISMRGKSNTRMSHVKHQSEEDGGSNDNGEATMISLHNAYTQMQSSMAGPSSLRKNSELPTHHAAAEFSTSSVKKEPGMSVREPGVGYMPKKNRIHCSGPLGGNIDDMLKEHERLMQDVFRSVKKNNP

SEQ ID NO: 163162 - protein, 460 aa, Glycine max
  Coding DNA Sequence Number=SeqID_46384
  Gene Ontology: Mol. function=3'-5'-exoribonuclease activity; Cellular component=exosome (RNase complex); Biological process=RNA processing
  Homolog annotation: Hit_ID=Q9M209; Match level="QueryCoverage=81%, HitCoverage=86%, E-value=1e-126, Identity=57%"; Hit description =Nucleolar autoantigen-like protein
  Pfam annotation: Domain name=RNase_PH; Domain location=36-168; Score =106.5; E_value=7.7e-29; Accession=PF01138.11; Description=3' exoribonuclease family, domain 1
  Pfam annotation: Domain name=RNase_PH_C; Domain location=197-265; Score=37.9; E_value=3.4e-08; Accession=PF03725.5; Description=3' exoribonuclease family, domain 2
  Pfam module annotation: Pfam domain module=RNase_PH::RNase_PH_C; Domain location=36-168::197-265
MEQRLANTWRMPLNDKKFIETALLSDLRLDGRRPSDYRKLTVKLAKQDGSAEVHLGQTHVMTFVTAQLVRPYRDRPNEGSLSIFTEFSPMADPSFDPGRPSDAAVELGRVVDRGLRESRAIDTESLCVLSGKLVWAIRVDIHILDNAGNLVDAANIAALASLLTFRRPECSLAGEDGQDVVVHPPEERDPIPLIIHHLPIAVTFGFFSNENLLVIDPTHHEECVMTGRMTATLNSNGDVCAIQKPGGESVSHSVIMHCLKLAHVKATDITTKIRDAVEIHNNERALRKIKRHSSSVAVDVCGEKQNQLDASHLDKLKLEEEEESPMECEASPSGQEQSKDGVSKNFTGGPSSWDPYSECVNSDLLKASLASRGPSVPSKQKDSRRETKPKEPPLEIKTDSTPINKALTAGQNNKAHLLDKRSKELLENKLVRNTCSPRTTYTAQQVVQWNQQASATMEDK

SEQ ID NO: 163163 - protein, 115 aa, Glycine max
  Coding DNA Sequence Number=SeqID_46385
  Gene Ontology: Mol. function=cobyrinic acid a,c-diamide synthase activity; Biological process=selection of site for barrier septum formation
  Homolog annotation: Hit_ID=Q9MBA2; Match level="QueryCoverage=52%, HitCoverage=20%, E-value=3e-11, Identity=62%"; Hit description=MinD
MSFRKVDHTLFFSRHHHQRTYTRVPQLPAEEEVEVAKADISVDGDHKKAQAGEGEADVGGLVHVALTGGNDNDARDGAGELGWACGSTGGGRWGVWGLGFWRGGDGNGGGGEERA

SEQ ID NO: 163164 - protein, 319 aa, Glycine max
  Coding DNA Sequence Number=SeqID_46386
  Gene Ontology: Mol. function=DNA binding; Cellular component=nucleus; Biological process=regulation of transcription
  Homolog annotation: Hit_ID=Q2HVT2; Match level="QueryCoverage=95%, HitCoverage=96%, E-value=8e-85, Identity=54%"; Hit description =Homeodomain-related
  Pfam annotation: Domain name=Myb_DNA-binding; Domain location=14-61; Score=45.9; E_value=1.3e-10; Accession=PF00249.21; Description=Myb -like DNA-binding domain
  Pfam annotation: Domain name=Myb_DNA-binding; Domain location=67-112; Score=43.8; E_value=5.7e-10; Accession=PF00249.21; Description=Myb -like DNA-binding domain
  Pfam module annotation: Pfam domain module=Myb_DNA-binding::Myb_DNA -binding; Domain location=14-61::67-112
MGRPPCCDKIGIKKGPWTPEEDIILVSYIQEHGPGNWRSVPTNTGLMRCSKSCRLRWTNYLRPGIKRGNFTDHEEKMIIHLQALLGNRWAAIASYLPQRTDNDIKNYWNTHLKKKLKKMQSGGDDDDNNDDKLNSCNSQIKGQWERRLQTDIHMAKQALCEALSLDKPTQIFPETKLPSTSSHNPTTTPNQTSLYASSTENIAKLLENWMKKSPNITTITETKPFNINNMVATGSSSSEGTQSTITCTQDHALDSLWSFNSERSCQSEENTNLGESKPQYQEAQVPLMLLENWLLDDAAPQCNEDLMNMSLEESTEGLF

SEQ ID NO: 163165 - protein, 399 aa, Glycine max
  Coding DNA Sequence Number=SeqID_46387
MTRIPEYDLDIERACCRNNADTRRTRIAEANTEIGVMEAMKQNHELRHGRINMIERMQFHGLPSEDHVLHLKKFLRLIDRTRSLANAYDYIKLATFLLSLAGKAEDWLYDLRNRNITTWDQCLTYCRGVVHTMGTHHKACPLFNGGLSQHNRSCLDAATGGNLMHKMNNATMHIIEAMASHGYNVTSDKRILMRPREFTRYMIFNCPFSQALEEVNYASGRNNNYEPYTNPFNQGALPSQTEPNPKEDLKVVSIRSEKPHPEYKKKKKIASLEKEKEVLTEHQRTRKLLLRGVQRQGKKRRPIVYPNGVVEDVLVKVDKFIFLADFVVLDMKEDKDVLIILGHPFMNTIARDPTNALVEALFPSVEVKDPLKRVLINEDLDWDLSSDEEEIEATLRLCS

SEQ ID NO: 163166 - protein, 61 aa, Glycine max
  Coding DNA Sequence Number=SeqID_46388
  Homolog annotation: Hit_ID=P48732; Match level="QueryCoverage=88%, HitCoverage=11%, E-value=4e-07, Identity=49%"; Hit description=Light- mediated development protein DET1
MALSDKNKQLQLPGNHIENHLHQGQPNLGNSFLSGIKQRLLSFIFQGLWNEERDDTLVIAL

SEQ ID NO: 163167 - protein, 130 aa, Glycine max
  Coding DNA Sequence Number=SeqID_46389
  Gene Ontology: Cellular component=nucleus; Biological process=red or far red light signaling pathway
  Homolog annotation: Hit_ID=Q9ZNU6; Match level="QueryCoverage=87%, HitCoverage=21%, E-value=1e-46, Identity=76%"; Hit description=Light- mediated development protein DET1
MTNVLIFHAFKPQVSRNADHHPAFVAVYNMDTTEIVSFYQNSPDELYLLFEQFCDHFHATSRNSMYMNFISSHSNNIHALEQLRSIKDKASSSAQFVKKMLASLPFSCQSQSPSPYFDQSLFRFDDKVYY

SEQ ID NO: 163168 - protein, 80 aa, Glycine max
  Coding DNA Sequence Number=SeqID_46390
MGTPSRSMDTKSSIMRRYCFKCTTLCIFRCEVFLHVTHQAQDVKQSLPRGATYGFCGSLKTHMYPLWVIVSQHGPCWFSC

SEQ ID NO: 163169 - protein, 183 aa, Glycine max
  Coding DNA Sequence Number=SeqID_46391
  Gene Ontology: Mol. function=transcription factor activity; Cellular component=nucleus; Biological process=regulation of transcription, DNA-dependent
  Homolog annotation: Hit_ID=Q9C9I2; Match level="QueryCoverage=90%, HitCoverage=87%, E-value=2e-49, Identity=62%"; Hit description =Putative TINY; 48985-48434
  Pfam annotation: Domain name=AP2; Domain location=14-78; Score=142.2; E_value=1.4e-39; Accession=PF00847.10; Description=AP2 domain
MPSSSSSHVVGAASSAYRGVRKRKWGKWVSEIREPGTKTRIWLGSFETPEMAAAAYDVAALHFRGRDARLNFPELASTLPRPVSNNADHIRMAAHEAALRLRTNPAAPNTVGSAGSVSAAPLTVRLSPTQIQAINDSPMDSPQTWMQMPDTFMMHDQSMMFANGYSFEDNEWEDMHNDSLWDP

SEQ ID NO: 163170 - protein, 636 aa, Glycine max
  Coding DNA Sequence Number=SeqID_46392
  Gene Ontology: Mol. function=peptidyl-prolyl cis-trans isomerase activity; Cellular component=nucleus; Biological process=protein folding
  Homolog annotation: Hit_ID=Q9STK2; Match level="QueryCoverage=74%, HitCoverage=97%, E-value=2e-76, Identity=35%"; Hit description =Peptidyl-prolyl cis-trans isomerase
  Pfam annotation: Domain name=FKBP_C; Domain location=540-632; Score =153.3; E_value=6.3e-43; Accession=PF00254.18; Description=FKBP-type peptidyl-prolyl cis-trans i
  Pfam annotation: Domain name=NTF2; Domain location=81-192; Score =14.7; E_value=0.0034; Accession=PF02136.11; Description=Nuclear transport factor 2 (NTF2) domain
  Pfam module annotation: Pfam domain module=FKBP_C::NTF2; Domain location=540-632::81-192
MFIIVSTTSTCLLLNNSASSPLLLSCCIDSVKYGSFALPKFERRRRSKWRAVDGSGEKQSAVTVAATTTSTFDDDNDVVDSASAVLKNFYGGINAHDVDSVEYLIAENCVYEDLVFPRPFVGRKEILEFFKKFTNSTSKDLQFVIDDLSTEDSSSVGVIWHLGIEVKPGRPCPYHADNVRGKLHVTQATLGIGSSSEKSILQCSSGHKSPVFLCSLLPDKVESCPLNLEFDADDLVAFSVVGSRSIHLSGTESEESSEYDSEDGYADDFIVDSDTDMYPSSPVPNSGVVIEEIVDDDKPENGYDPTKKLKKKKQVAQLKEKDNKSSGLPIVAKGDTDLVESEDEDGFPIPTAEKGVSVSQKAEAETKGEQARKKAEKAKKEKDVDHSASVKRKVDTADEDEPQDGKKKKKRNKLKEHIKGESDHATGNSNETKITEPDEKHPEEIKTTINLSDVSHAKDEDDGKLSNNEVLAEKKNKKKKKKKTKESEGEVAANQITITPEKQNLSTSEKKGQKQTETKPSQVRTFPNGLIIEEVFMGKPDGKKAAPGKKVSVKYIGKLQKDGKIFDSNVGRAPFKFRLGVGQVIKGWEVGINGMRIGDKRRITIPPSMGYADKRVGSIPPNSWLVFDVELVDVDR

SEQ ID NO: 163171 - protein, 410 aa, Glycine max
  Coding DNA Sequence Number=SeqID_46393
  Gene Ontology: Mol. function=hydrolase activity; Biological process =aromatic compound metabolic process
  Homolog annotation: Hit_ID=Q5N8H1; Match level="QueryCoverage=86%, HitCoverage=83%, E-value=1e-114, Identity=60%"; Hit description =Hydrolase-like protein
  Pfam annotation: Domain name=Abhydrolase_1; Domain location=140-401; Score=28.7; E_value=2.1e-05; Accession=PF00561.10; Description =alphabeta hydrolase fold
  Pfam annotation: Domain name=PGAP1; Domain location=107-324; Score= -80.9; E_value=0.0093; Accession=PF07819.3; Description=PGAP1-like protein
  Pfam module annotation: Pfam domain module=Abhydrolase_1::PGAP1; Domain location=140-401::107-324
  Subcellular localization annotation: CTP_CleavageSite=64; ConfidenceScore=5.81e-01
MPLLSNSSPCCTAAAVVNSSDRKPGFVSPSWRNCKVTSPILRLSQNDKFNVSRLALSHSRRTISMALVGETVGVGQKGQVASSSGILAYDLIQGALVRWSSVMDRSLPEPPTAVFLHGILGCRKNWGTFARRLAQEFPTWQFLLVDLRCHGDSASIKKRDPHTVASAAMDVLKLVRELRITPRVLVGHSFGGKVVLSMVDQAAKPLARPVRAWVLDATPGKVRAGGDGEDHPAELISFLSTLPNEGLGIIRDMRMRMSVRNIVLKVPSKWDVLRALIQQGFSNDVAQWVVTNLRPSSSPGSQSSSFSWVFDLRGIAEINYIVSVFTDARKIVEDVPRGVHVNFLKAERSLHRWALEDLQRIHAAEELAVEEGGGVEMHVLEDAGHWVHTDNPDGLFRILSSSFQFQGGKI

SEQ ID NO: 163172 - protein, 93 aa, Glycine max
  Coding DNA Sequence Number=SeqID_46394
MKKTTSAVHCDATKWIGCWLLEQTGRLLVVLGLMLAVNPHASEIYPLMDGSDELMKDVGYFVITIPCLWPKKHKLATVARSSRKIELCTLKLS

SEQ ID NO: 163173 - protein, 54 aa, Glycine max
  Coding DNA Sequence Number=SeqID_46395
MTNATMKIIEAMVSNAYNGIRDGDLDEGTNSDDDKCSSTPCLQLVWGDMSYMRR

SEQ ID NO: 163174 - protein, 58 aa, Glycine max
  Coding DNA Sequence Number=SeqID_46396
MEMVMVTKMANKLPTDGGPVMVVTAKGWLTPALNNRHPRDTLSLLLEPATGKSPHDLH

SEQ ID NO: 163175 - protein, 503 aa, Glycine max
  Coding DNA Sequence Number=SeqID_46397
  Gene Ontology: Mol. function=RNA-directed DNA polymerase activity; Biological process=RNA-dependent DNA replication
MVGITSNILLPNLGEQNYQLRHGLINLIERMQFHGLPSEDNVLHLKKFLRLTDTMRILTNALDYIRLTSFLFSLVGKAEDWLCDLPNQSITTWDQGNLKHKMTNVAVDIIKAMASNAYNGTSDKRFLKRSMGLYQVEVNSSSLAFNQKLDILTKLMETLIRLKLRGDRQGLGRRRRDPSLKGMMIEHPTKSDERFKTLESIVSNLVTLMSQRSEEKENKALTEESLAKDKKAPIERSLETGKEKEVLTPPQGEVEDVLVKVDKFIFPTDFVVLDMEEDEDIPIILGRPFMNTCDTVIEVRQGKLTLRMGRDPIDALVKASFPSVEMGNPLERVLIDDDLDLSSDEEYIMMFLQAQSNAKLTRNQRFEELKRRSGSKSNPFIKKPPMLELKSLPSNLKYEIEEEELLRVLRDNNEAFGWTIHEIKGIDLIMCTHWIHMEKGKEPKHLPGRRINCNIMEAVKGKVLKLLDADIIYPIFDGEWVSPVQCVPKKGALLSWRMTRKSS

SEQ ID NO: 163176 - protein, 98 aa, Glycine max
  Coding DNA Sequence Number=SeqID_46398
  Subcellular localization annotation: CTP_CleavageSite=68; ConfidenceScore=5.17e-01
MDQETATTCTMQECHVIAPTTTTTTSSYRGVRQRNPKMPRPTSSKPEDIQVAAQQAALMFKRLRVGLSATKIQAINECPLDSPKMWMMQNGRSTQVWV

SEQ ID NO: 163177 - protein, 59 aa, Glycine max
  Coding DNA Sequence Number=SeqID_46399
MSHKARVELSEGVHAEINEMVVRLRPKKKLMDEKRKKKMEETAQSESTDTIVDPPSPIK

SEQ ID NO: 163178 - protein, 172 aa, Glycine max
  Coding DNA Sequence Number=SeqID_46400
  Gene Ontology: Mol. function=hydrolase activity; Biological process =aromatic compound metabolic process
  Homolog annotation: Hit_ID=Q94F26; Match level="QueryCoverage=98%, HitCoverage=44%, E-value=1e-51, Identity=62%"; Hit description =Lipase-like protein
MDSSSHMASLPEDIITDEHLQQQTQPASASAFASVPQRPPTKSSSEKYAPLDWSVYFDKEDDVAIPESNDVFHVYTAGTEGPVVFCLHGGGYSGQKTCKLYETECWVVKRQQETSKIKEKARVVAMDLRGHGKSLTEDDLDLSVETMCNDVLAVIKELYSDSPPAIILVGHR

SEQ ID NO: 163179 - protein, 1031 aa, Glycine max
  Coding DNA Sequence Number=SeqID_46401
  Gene Ontology: Mol. function=binding; Cellular component =intracellular; Biological process=metabolic process
  Homolog annotation: Hit_ID=Q5Z9G2; Match level="QueryCoverage=85%, HitCoverage=85%, E-value=1e-135, Identity=38%"; Hit description =Putative crp1 protein
  Pfam annotation: Domain name=PPR; Domain location=120-154; Score =28.7; E_value=2.1e-05; Accession=PF01535.11; Description=PPR repeat
  Pfam annotation: Domain name=PPR; Domain location=155-189; Score =15.8; E_value=0.099; Accession=PF01535.11; Description=PPR repeat
  Pfam annotation: Domain name=PPR; Domain location=190-224; Score =20.8; E_value=0.005; Accession=PF01535.11; Description=PPR repeat
  Pfam annotation: Domain name=PPR; Domain location=225-259; Score =29.5; E_value=1.2e-05; Accession=PF01535.11; Description=PPR repeat
  Pfam annotation: Domain name=PPR; Domain location=260-294; Score =43.2; E_value=8.9e-10; Accession=PF01535.11; Description=PPR repeat
  Pfam annotation: Domain name=PPR; Domain location=295-329; Score =45.0; E_value=2.6e-10; Accession=PF01535.11; Description=PPR repeat
  Pfam annotation: Domain name=PPR; Domain location=330-364; Score=7.6; E_value=0.95; Accession=PF01535.11; Description=PPR repeat
  Pfam annotation: Domain name=PPR; Domain location=365-399; Score =10.6; E_value=0.41; Accession=PF01535.11; Description=PPR repeat
  Pfam annotation: Domain name=PPR; Domain location=400-434; Score =27.3; E_value=5.4e-05; Accession=PF01535.11; Description=PPR repeat
  Pfam annotation: Domain name=PPR; Domain location=435-469; Score =38.2; E_value=2.7e-08; Accession=PF01535.11; Description=PPR repeat
  Pfam annotation: Domain name=PPR; Domain location=470-504; Score =41.7; E_value=2.5e-09; Accession=PF01535.11; Description=PPR repeat
  Pfam annotation: Domain name=PPR; Domain location=705-738; Score =15.3; E_value=0.12; Accession=PF01535.11; Description=PPR repeat
  Pfam annotation: Domain name=PPR; Domain location=774-808; Score =13.9; E_value=0.17; Accession=PF01535.11; Description=PPR repeat
  Pfam annotation: Domain name=PPR; Domain location=837-871; Score =16.8; E_value=0.077; Accession=PF01535.11; Description=PPR repeat
  Pfam annotation: Domain name=PPR; Domain location=85-119; Score=26.5; E_value=9.4e-05; Accession=PF01535.11; Description=PPR repeat
  Pfam annotation: Domain name=PPR; Domain location=873-907; Score =15.2; E_value=0.12; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR; Domain location =120-154::155-189::190-224::225-259::260-294::295-329::330-364::365 -399::400-434::...
  Pfam module annotation: Domain location=435-469::470-504::705 -738::774-808::837-871::85-119::873-907
MDIHSVFCSMQISLSYNRGNPLLRFSRAIVIQCSKKHNFLKSPNRWVRNKGVKDVGSEFDSKTKSIKTTLFRSPDIGENEELSSNLCSQLICECCKEGDLDRAMSLLSQMEAKGFHLSSTSYACLIEALGNVGRTSEADMLFKEMVCYGYKPKLNLYHSLLRGFLKKGLLGLANGVLKEMDDLGIWRSKETYQIFLDYYVGAGRLEDTWSTINEMKQKGFPLNSFMYSKVVGIYRDNGMWKKAIEVLEEIRERGISLDTHICNSIIDTFGKYGELDEALKLFKKMQKEGVRPNIVTWNSLIKWHCKEGDFMKAFHLFTDMQEQGLYPDPKIFVTIISCLGEQGKWDIIKKYFESMKIRGNKEYGAVYAVLVDIYGQYGKFQNAGECVQALKSEGVLVSPSIFCVLANAYAQQGLCEQVIMVLQIMEAEGIEPNIVMLNMLINAFGNAGRYMEAISVYHHIKESGVSPDVVTYTTLMKAFIRAKKFDEVPIIYKEMENDGCTPDRKARQMLQVALTLYTVCVIGFDDMCWFAGEQFEERKLRFSRMSSLLKEVNLHHGCGSLLKGRKLIDHDRLIIKTRMLLAAKDAMTCQLLIEYGILRQISLTISRPRKVKLAQDTPGVLIIVLIKESVVLCYPSKHSGFGGGYAQTPDDAWTMFKSMEFQNLVSWNSVIAVITALIKSYANLGGHISGCYRIFHDTGSQPDIVSWTALISAFAEQDPEQAFLLFCQLHRQSYLPDWYTFSIALKASTYFATEQRAMDIHSQVIKEGFQEDTVLCNALIHAYAWCGSLALSKQVFNEMGCRDLVSWNSMLKSYAIHGQTKDAVELFQRMNVCTDSATFVVLLSACSHVGFVDEGVKLFNCMSDDHGVVPQLDHYSCMVDLYGGAGKIFEAEELIRKMPMKPDSVIWSSLLGSCRKHGKTPLAKSAADKFKELDQTIHWDMFMNLALVVNIIQTRAMLSRLEIVIGQLKEMGYVPELSLALYDTEVEHKEDQLLHHSKKMALRTTFIPQLGLYLLEDSLGLPALVEEAHKF

SEQ ID NO: 163180 - protein, 130 aa, Glycine max
  Coding DNA Sequence Number=SeqID_46402
  Homolog annotation: Hit_ID=Q8S8T8; Match level="QueryCoverage=99%, HitCoverage=91%, E-value=2e-09, Identity=56%"; Hit description =Expressed protein
MKNQHGYVPPAYIPLGPSDSEAVDVSLLQRSSTNGSNQMQAQWSSGICACCDDMQSCMLLPYPGALAQWGKGCCLMTYESLAQILKTIFLPVGGKHPVGILLPIFAAILVPFVKSTVRYVKDLGIVKPQT

SEQ ID NO: 163181 - protein, 1487 aa, Glycine max
  Coding DNA Sequence Number=SeqID_46403
  Gene Ontology: Mol. function=binding; Cellular component=plastid chromosome; Biological process=positive regulation of transcription, DNA-dependent
  Homolog annotation: Hit_ID=Q69K58; Match level="QueryCoverage=82%, HitCoverage=93%, E-value=0.0, Identity=41%"; Hit description =Putative PPR protein
  Pfam annotation: Domain name=PPR; Domain location=1020-1054; Score =33.8; E_value=6.1e-07; Accession=PF01535.11; Description=PPR repeat
  Pfam annotation: Domain name=PPR; Domain location=1055-1089; Score =22.8; E_value=0.0012; Accession=PF01535.11; Description=PPR repeat
  Pfam annotation: Domain name=PPR; Domain location=1090-1124; Score =22.0; E_value=0.0022; Accession=PF01535.11; Description=PPR repeat
  Pfam annotation: Domain name=PPR; Domain location=1125-1159; Score =33.4; E_value=7.8e-07; Accession=PF01535.11; Description=PPR repeat
  Pfam annotation: Domain name=PPR; Domain location=1160-1194; Score =3.1; E_value=3.2; Accession=PF01535.11; Description=PPR repeat
  Pfam annotation: Domain name=PPR; Domain location=250-284; Score =45.2; E_value=2.3e-10; Accession=PF01535.11; Description=PPR repeat
  Pfam annotation: Domain name=PPR; Domain location=322-356; Score =47.3; E_value=5e-11; Accession=PF01535.11; Description=PPR repeat
  Pfam annotation: Domain name=PPR; Domain location=357-391; Score =42.7; E_value=1.3e-09; Accession=PF01535.11; Description=PPR repeat
  Pfam annotation: Domain name=PPR; Domain location=392-426; Score =38.2; E_value=2.9e-08; Accession=PF01535.11; Description=PPR repeat
  Pfam annotation: Domain name=PPR; Domain location=427-461; Score =41.6; E_value=2.6e-09; Accession=PF01535.11; Description=PPR repeat
  Pfam annotation: Domain name=PPR; Domain location=462-496; Score =41.6; E_value=2.7e-09; Accession=PF01535.11; Description=PPR repeat
  Pfam annotation: Domain name=PPR; Domain location=497-531; Score =47.0; E_value=6.3e-11; Accession=PF01535.11; Description=PPR repeat
  Pfam annotation: Domain name=PPR; Domain location=532-566; Score =35.5; E_value=1.9e-07; Accession=PF01535.11; Description=PPR repeat
  Pfam annotation: Domain name=PPR; Domain location=567-600; Score=6.1; E_value=1.4; Accession=PF01535.11; Description=PPR repeat
  Pfam annotation: Domain name=PPR; Domain location=703-737; Score =17.0; E_value=0.07; Accession=PF01535.11; Description=PPR repeat
  Pfam annotation: Domain name=PPR; Domain location=738-772; Score =13.2; E_value=0.21; Accession=PF01535.11; Description=PPR repeat
  Pfam annotation: Domain name=PPR; Domain location=775-809; Score=3.8; E_value=2.6; Accession=PF01535.11; Description=PPR repeat
  Pfam annotation: Domain name=PPR; Domain location=810-844; Score =33.4; E_value=7.8e-07; Accession=PF01535.11; Description=PPR repeat
  Pfam annotation: Domain name=PPR; Domain location=845-879; Score=3.3; E_value=3.1; Accession=PF01535.11; Description=PPR repeat
  Pfam annotation: Domain name=PPR; Domain location=880-914; Score=5.9; E_value=1.5; Accession=PF01535.11; Description=PPR repeat
  Pfam annotation: Domain name=PPR; Domain location=915-949; Score =31.8; E_value=2.5e-06; Accession=PF01535.11; Description=PPR repeat
  Pfam annotation: Domain name=PPR; Domain location=950-984; Score=3.9; E_value=2.6; Accession=PF01535.11; Description=PPR repeat
  Pfam annotation: Domain name=PPR; Domain location=985-1019; Score =38.5; E_value=2.4e-08; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR::PPR::PPR::PP R::PPR::PPR::PPR; Domain location=1020-1054::1055-1089::1090 -1124::1125-1159::...
  Pfam module annotation: Domain location=1160-1194::250-284::322 -356::357-391::392-426::427-461::462-496::497-531::532-566::567 -600::703-737::738-772::775-809::810-844::845-879::880-914::915 -949::950-984::985-1019
  Subcellular localization annotation: CTP_CleavageSite=8; ConfidenceScore=5.34e-01
MSVPVPVSVSVSGSGLLSFPSIQRPHSNPPPKHAALPSTSPEPDTDTNSSSEPNTVKPVKFIYTRASPSIRWPHLKLSQTYPSTQPHFPQNDIFPSKTPPSESPEEESPKPVVNDDDDDEAQEALGRRSKTRVKKMNKLALKRDKNWRERVKYLTDTILALKSEEFVAGVLEERRVQMTPTDFCFVVKWVGQQNWQRALELYECLNLRHWYAPNARMVATILGVLGKANQEALAVEIFARAESSVGDTVQVYNAMMGVYARNGRFSKVKELLDLMRERGCVPDLVSFNTLINARMKSGAMEPNLALQLLNEVRRSGIRPDIITYNTLISACSRESNLEEAVAVFSDMESHRCQPDLWTYNAMISVYGRCARARKAEELFKELESKGFFPDAVTYNSLLYAFSREGNTEKVRDICEEMVKRGFGQDEMTYNTIIHMYGKQGRHDQAMQIYRDMKSSGRNPDAVTYTVLIDSLGKASKVEEAANVMSEMLDAGVKPTLHTYSALICAYAKAGKREEAEETFNCMRRSGIKPDRLAYSVMLDFFLRFNEMKKAMGLYHEMIREGFTPDNGLYEVMMHALVRENMWDVVDRIIRDMEELSGMNPQVISSVLVKGGCYDHAAKMLKVAISNGYELDHEIFLSIMSSYSSSARYSEACELLEFSREHAPNDIQMITEALIIILCKAKKLDAALEEYRSKGELGQFRSCTMYESLIQECIQNELFDVASQIFSDMRFNGVESSECLYQGMVSVYCRMDLPETAHHLLYHAEKNGIILDNDISVYIDIVETYGKLKIWQKAESLVGSLRQRCSKMDRKVWNALIHAYAFSGCYERARAIFNTMMRDGPSPTVDSVNGLLQALIVDRRLNELYVVIQELQDMGLKISKSSILLTLEAFAQAGNLFEVQKIYNGMKAAGYFPTMHVYRIMLRLLCKCKRVRDVETMLCEMEEAGFQPDLQICNSILKLYLGIEDFKSMGIIYQKIQDASLKPDEETYNTLIIMYCRDRRPEEGFSLMNKMRSLGLEPKLDTYRSLITAFNKQRMYEQAEELFEELRSNGYKLDRAFYHLMMKTYRTSGDHRKAENLLAIMKESGIEPTISTMHLLMVSYGKSGQPEEAENVLKNLRTTGVVLDTLPYSSVIDAYLKKGDFKAGIEKLTEMKEAGIEPDHRIWTCFIRAATLSEGTNEAIVLLNALQDAGFDLPIRLLKEKSESLVSEVDQCLERLEPVEDNAAFNLVNALVDLLWAFELRATASWVFQLAIKRSIYRHDIFRVADKDWGADFRKLSAGSALVGLTLWLDHMQDASLQGYPESPKSVVLITGTAEYNMVSLDSTLKACLWEMGSPFLPCKTRQGILVAKAHSLRMWLKDSPFCLDLELKDAPSLPELNSMRLIEGCFIRRGLVPAFKEITEKLEIVSPKKFSKLALLPDDQRSKTIQAYKEGRKEKLEKSKKVVDPKRLKKIRMIRKLKRRKYFREQAIPNAIGKQKTFKPLGAERAP

SEQ ID NO: 163182 - protein, 94 aa, Glycine max
  Coding DNA Sequence Number=SeqID_46404
  Homolog annotation: Hit_ID=Q7XYW5; Match level="QueryCoverage=87%, HitCoverage=68%, E-value=2e-17, Identity=58%"; Hit description=Seed specific protein Bn15D1B
MICKLYKWRGAYSSGSVYDKNPDDEIQSGQVPDDVIQAATQSGKYWAPHPQTGVFGPPGGGDQTASAIHSDALEEKAWFRPTSLEDFEKPHTLP

SEQ ID NO: 163183 - protein, 178 aa, Glycine max
  Coding DNA Sequence Number=SeqID_46405
  Gene Ontology: Mol. function=RNA-directed DNA polymerase activity; Cellular component=chromatin; Biological process=RNA-dependent DNA replication
MAQIIEEFIDGWERKAIFNNDCVQSTVEIAKVGQVFGKGGSACQEGHIMEVDERGYQKQLDHVLGVGCGIGSLPAVWLSDAVLGRDESQMGLPKSLSQATPNTISAPPNPITYKSRSNMWLGIETATSWQTLSQVILVSLPTMTARGGMGCVTKWRKWAKQSWTKLCMLLLSTRITTS

SEQ ID NO: 163184 - protein, 154 aa, Glycine max
  Coding DNA Sequence Number=SeqID_46406
MVRGAWEVTPLLVTLGFLLEVVEVKPDQLSEAYPLSEEASSPSERRTLENVKSESSVLRDEGIPVINPNVLLIEKEIIPDQLSEANPLSEEASSPSEKRNLENIQSESSVLRDEGIPVINPNVLLIEKEIIPGVELRALQGIIANTIHEGFEFL

SEQ ID NO: 163185 - protein, 109 aa, Glycine max
  Coding DNA Sequence Number=SeqID_46407
MSLKIEIVMDIIVDPEQAMVVEIEKVVIRIVEVVVLGISSEEQGLNWWSTIVALDTSGVSSMTQVLVRSMMTPSTMVSSIALVDASTWTEAMSFFIAATTTSSYAFLFC

SEQ ID NO: 163186 - protein, 87 aa, Glycine max
  Coding DNA Sequence Number=SeqID_46408
  Pfam annotation: Domain name=DUF26; Domain location=15-69; Score=5.3; E_value=0.0013; Accession=PF01657.8; Description=Domain of unknown function DUF26
MVNFVAFANHNNFTVYHLFQCRDDLTNNQCSLCMSHAITQLNNIYFISYDNTLQFDNGFIKASHWSTVQRDNKVRGAEFRYATKLVT

SEQ ID NO: 163187 - protein, 430 aa, Glycine max
  Coding DNA Sequence Number=SeqID_46409
  Gene Ontology: Mol. function=pepsin A activity; Cellular component =membrane; Biological process=proteolysis
  Homolog annotation: Hit_ID=Q1STA6; Match level="QueryCoverage=98%, HitCoverage=98%, E-value=1e-115, Identity=52%"; Hit description =Peptidase aspartic, active site
  Pfam annotation: Domain name=Asp; Domain location=80-424; Score= -128.2; E_value=4.9e-06; Accession=PF00026.14; Description=Eukaryotic aspartyl protease
MVVYFYPCLVATIICFMLLPFLHISATEGNDVGFSVNLIRKNSSHHGHVLPALRRLMEMELSAMEKTVSPQSPIYAYLGHYLMEVSIGTPPFKIYGIADTGSDLTWTSCVPCNKCYKQRNPIFDPQKSTSYRNISCDSKLCHKLDTGVCSPQKHCNYTYAYASAAITQGVLAQETITLSSTKGESVPLKGIVFGCGHNNTGGFNDREMGIIGLGGGPVSFISQIGSSFGGKRFSQCLVPFHTDVSVSSKMSLGKGSEVSGKGVVSTPLVAKQDKTPYFVTLLGISVGNTYLHFNGSSSQSVEKGNVFLDSGTPPTILPTQLYDRLVAQVRSEVAMKPVTNDLDLGPQLCYRTKNNLRGPVLTAHFEGGDVKLLPTQTFVSPKDGVFCLGFTNTSSDGGVYGNFAQSNYLIGFDLDRQVVSFKPMDCTKHK

SEQ ID NO: 163188 - protein, 121 aa, Glycine max
  Coding DNA Sequence Number=SeqID_46410
  Homolog annotation: Hit_ID=Q1RW52; Match level="QueryCoverage=68%, HitCoverage=30%, E-value=4e-10, Identity=46%"; Hit description =Cyclin-like F-box; F-box protein interaction domain
MKQYNVHTSWTKSVVLHTHGIPHNCFSPICITKDGGFLGSNIIGTLEKLNDKGELLEDLPYGRAPRLYKDNLQVATYIESLLTASVIDGNKENQGIHSSSCIMENPKTSVCYSGDIRKAGL

SEQ ID NO: 163189 - protein, 118 aa, Glycine max
  Coding DNA Sequence Number=SeqID_46411
  Gene Ontology: Mol. function=pepsin A activity; Biological process =proteolysis
  Homolog annotation: Hit_ID=Q1SAR7; Match level="QueryCoverage=77%, HitCoverage=22%, E-value=3e-15, Identity=43%"; Hit description =Eukaryotic aspartyl protease, putative
  Subcellular localization annotation: CTP_CleavageSite=44; ConfidenceScore=5.20e-01
MGEIYPGLSRFLKLTNIKHSLNSPFYKSNKLHMHRPGSFYQVPKKSYASNGPFTRVTSNNGDYLMKLTLGTPPVDVYGLVDTDSDLVWAQCTPCQGCYKQKNPMFDPLKVQNICSYSM

SEQ ID NO: 163190 - protein, 267 aa, Glycine max
  Coding DNA Sequence Number=SeqID_46412
  Gene Ontology: Mol. function=electron carrier activity; Cellular component=chloroplast thylakoid membrane; Biological process =electron transport
  Homolog annotation: Hit_ID=Q9FFJ2; Match level="QueryCoverage=73%, HitCoverage=74%, E-value=5e-73, Identity=73%"; Hit description =Arabidopsis thaliana genomic DNA, chromosome 5, P1 clone:MKP11
  Pfam annotation: Domain name=Rubredoxin; Domain location=190-227; Score=25.3; E_value=5.8e-06; Accession=PF00301.10; Description =Rubredoxin
  Subcellular localization annotation: CTP_CleavageSite=63; ConfidenceScore=5.88e-01
MSAVVAGSSSSFSATFTTRRSPSLKNSQLSHSKTLTSPQCQKTSLQGLSLHEAKRGVSESFLVENKNGSSIAGRRLEIKARTAGASKTIEVEVDKPLGLTLGQKSGGGVVITAVDGGGNAARAGLKAGDQVLYTSSFFGDELWPADKLGFTKTAIQAKPDSVYFVVSRLKMILCPFYNQLLIKCTSMQARATHICLDCGYIYTLQKSFDEQPDTYGCPQCQAPKKRFARYDVNTGKAIGGGLPPIGVIIGLLAGVGAVGALLVYGLQ

SEQ ID NO: 163191 - protein, 592 aa, Glycine max
  Coding DNA Sequence Number=SeqID_46413
  Gene Ontology: Mol. function=transferase activity, transferring glycosyl groups; Cellular component=membrane
  Homolog annotation: Hit_ID=Q337B5; Match level="QueryCoverage=86%, HitCoverage=96%, E-value=1e-153, Identity=53%"; Hit description =Fringe protein, putative, expressed
  Pfam annotation: Domain name=DUF604; Domain location=310-567; Score =442.4; E_value=6.1e-130; Accession=PF04646.3; Description=Protein of unknown function, DUF604
  Pfam annotation: Domain name=Fringe; Domain location=175-429; Score= -92.3; E_value=0.024; Accession=PF02434.7; Description=Fringe-like
  Pfam module annotation: Pfam domain module=DUF604::Fringe; Domain location=310-567::175-429
  Subcellular localization annotation: CTP_CleavageSite=53; ConfidenceScore=5.39e-01
MSVGDSNPRPLLPHLSLHPSSTTGPSLYLPVKSPSCPGGVASLARVDMHIGMMVMMTQALKTIVSSYHDYDKNSRLCPLPISRSRSRQWRQCRIGTFAVAIAALLISTTAWLSVVFSDATTCCFHHLKDWESSPHFFNWKKCISHRLAKVKPPPALQFETMNDHLHNGSSIVEEEGLSLKHIVFGIAGSSQLWKRRKEYVKLWWRPNDMRGHVWLEEQVLEEPGDDLLPPIMISEDTSYFRYTNPVGHPSGLRISRIVRESFCLGLSDVRWFVLCDDDTIFNVNNLVDVLSKYNSSEMIYIGSPSESHSANTYFSHSMAFGGSGIAISYPLAKALSEILDECIERYPKLYGSDDRLHACITELGIPLTCEHGFHQWDIRGDAHGLLSSHPIAPFVSIHHVEAVNSFYPGLSSLDSLKLFTKAMKADPKSFLQRSICYDHARHLTFSVSLGYVVQVLPNIVFPRELERSERTYSAWNGISQTNEFDFDAREPYKSVCKGPTRFFLKDTGREGNASWGSYVRGRDKDDFKKRILCFPLLPPLRNVGEIRVAVQPLSKNWHQVPRRLCCRQSQAGKEILQISVGECGKGTFSSVY

SEQ ID NO: 163192 - protein, 168 aa, Glycine max
  Coding DNA Sequence Number=SeqID_46414
  Gene Ontology: Mol. function=pepsin A activity; Biological process =proteolysis
  Homolog annotation: Hit_ID=Q1STA9; Match level="QueryCoverage=98%, HitCoverage=46%, E-value=4e-46, Identity=47%"; Hit description =Peptidase aspartic, active site
MGNLYGSKRFSQCLVPFHADPHTSGTISLGEASDVSGEGVVTTPLVSEEGTPETYLPQEFYDRLVEELKVQINLPPIHVDPDLGTQLCYKSETNLEGPILTAHFEGADVKLLPLQTFIPPKDGVFCFAMTGTTDGLYIFGNFAQSNVLIGFDLDKRIVFFKPTDFTKP

SEQ ID NO: 163193 - protein, 142 aa, Glycine max
  Coding DNA Sequence Number=SeqID_46415
  Gene Ontology: Mol. function=pepsin A activity; Biological process =proteolysis
  Homolog annotation: Hit_ID=Q1STA9; Match level="QueryCoverage=95%, HitCoverage=31%, E-value=7e-36, Identity=56%"; Hit description =Peptidase aspartic, active site
MGAYNFGDVSGEGVATTPLVSEQVTPATYLPQEFYDRLVEELKVQSNMLPIHDDPDLGTQFCYRSETNLEGPILTAHFEGADVQLMPIQTFIPPKDGVFCFAMAGTTDGEYIFGNFAQSNVLIGFDLDRRTVSYKATDCTNR

SEQ ID NO: 163194 - protein, 179 aa, Glycine max
  Coding DNA Sequence Number=SeqID_46416
  Homolog annotation: Hit_ID=Q1SYP3; Match level="QueryCoverage=63%, HitCoverage=9%, E-value=2e-32, Identity=59%"; Hit description =Leucine Rich Repeat, putative
MAEECLTGVSIVNYTKCTIHIYKRDTIISFNDEDWQGVISNLRPSDNVEIFVVLGHGLTVVKTALYLIYDDESITVKMEPSPNVIMESSSNMKTDPSPNVKMEPLSNMKSEPSMKPKKNIFARLIQRMGECTCMRVRRCSSVYGWEKEMISTRSQRESSGSFLSQEDASAEVASIGVSN

SEQ ID NO: 163195 - protein, 65 aa, Glycine max
  Coding DNA Sequence Number=SeqID_46417
MVDCGMTQVLFEMDCKVIVDRVNQLFSTQDTTDLGAIILQFHALAKAAIYLAKLNFSYYCLYQQH

SEQ ID NO: 163196 - protein, 138 aa, Glycine max
  Coding DNA Sequence Number=SeqID_46418
  Homolog annotation: Hit_ID=Q8I5S6; Match level="QueryCoverage=98%, HitCoverage=9%, E-value=5e-09, Identity=28%"; Hit description =Eukaryotic translation initiation factor 3 subunit 10, putative
MDDRVKSEKRSRDRHLERDDKYHQDSDDIRHHRSDRNHKCDHKSRDRDRDRAYDREGIKDRNRAYDREGSRDRDRAYDREGSKDRERAYDREGSKDRDREYEREGSKVRLKGKHDEGREDLVEPRLSSHSHKRKEREH

SEQ ID NO: 163197 - protein, 198 aa, Glycine max
  Coding DNA Sequence Number=SeqID_46419
MPFCRRGSRVRFPKEERCAESPSTFICGKRQKNRRKPVEMKILSSGVVFTFEEGISTSHVDKSGALASTYPPSKEELATQLAEASKVASSRSNRLLEEESGRPKNRSGKQHKLHFPVTGGSAPDGEEHIGETENCTRQSLRVAPNSLARMENCTKQSLRMAPNSLVEESNGKITKTTFPSQEGPHLTVKNTLENGGLH

SEQ ID NO: 163198 - protein, 715 aa, Glycine max
  Coding DNA Sequence Number=SeqID_46420
  Gene Ontology: Mol. function=RNA splicing factor activity, transesterification mechanism; Cellular component=spliceosome; Biological process=nuclear mRNA splicing, via spliceosome
  Homolog annotation: Hit_ID=Q6K476; Match level="QueryCoverage=67%, HitCoverage=100%, E-value=1e-152, Identity=59%"; Hit description =Putative U4/U6-associated RNA splicing factor
  Pfam annotation: Domain name=PRP3; Domain location=327-708; Score =589.5; E_value=3.2e-174; Accession=PF08572.1; Description=pre-mRNA processing factor 3 (PRP3)
MVMIILEAFMRPRSRRKSLMVPMAQLLPMALCLSKTVAYIQLLLTEGALGSPAVAPMSVPETSLAPPPSVPIKVSSNSTTNENKGISITRSHEVTGKSSTDGSSSTARKTGSLSIDALAKAKKALQMQKELSEKLKKIPQLNKSSTQNSQGSSNLGSMNESAVPSSAAGVASKSSTSASLVHAANMSIFPSTAFAASANTPVIGTSAAGIPNATLPNWEAVRRAQELAARMGFRQDPQFAPLINMFPGQMVTDVTLLQKPMKAPVLRLDAQGREIDEHGNVINVTKPINLSTLKARNYVLTFQVNINKQKKEAFEILQPVLDVDPESNPHFDASMGINKTKLLRPKRMNFQFVEEGKWSKDAETIKLKSKFGEAQAKEHKAKLAQLAKAKAAPDINPNLIEITERVVIKEKPKDQIPDIEWWDVPLLHCRNYGDIDNGTIGEDKLKIEKITFYVEHPRPVEPPAEPAPPPPQPLKLTKQEQKKLRTQRRIAKEKERQEMIRQGVIEPPKPKVKISNLMKVLGSEATQDPTRLEKEIRTAAAEREQAHIDRNIARKLTPAELREKKEKKLFDDPNTLETLVSLYRINDLSHPKARFRVDVNAQENRLTGCAVICDGISVVVVEGGSKSIKRYGKLMLRRINWSEVSKDKEENEDSDDDKPANKCVLVWQGSVAKPSFNRFSVHDCITEAAARKVFADAGVPHYWDQAVNYKEDEAI

SEQ ID NO: 163199 - protein, 140 aa, Glycine max
  Coding DNA Sequence Number=SeqID_46421
MAPTRHPLDPDKSNRALRFPALIIGLCQSFGVLVAPSKRQAQGDAPQAADASPPHQASPAGSFDSEQYLRHVVRQQATNHRAHFRAEVAWPGDWPEAQAGEAPVEAPAEAPAEAPGEADEAREDEEMTDLLDFLGGSGAT

SEQ ID NO: 163200 - protein, 248 aa, Glycine max
  Coding DNA Sequence Number=SeqID_46422
  Gene Ontology: Mol. function=transmembrane receptor activity; Cellular component=membrane; Biological process=defense response
  Homolog annotation: Hit_ID=Q1SYP3; Match level="QueryCoverage=95%, HitCoverage=20%, E-value=1e-69, Identity=56%"; Hit description =Leucine Rich Repeat, putative
  Pfam annotation: Domain name=TIR; Domain location=15-147; Score =168.6; E_value=1.5e-47; Accession=PF01582.10; Description=TIR domain
MASSSSNSYSKVNDVFLNFRGEDTRKTFVSHLYAALSNAGINTFIDHKLRKGTELGEELLAVIKGSRISIVVFSANYASSTWCLHELVEIIYHRRAYGQVVVPVFYDVDPSDVRHQTGAFGQRLKALMQKSKPIDFMFTSWKSALKEASDLVGWDARNWRSEGDLVKQIVEDISRKLDTRLLSIPEFPVGLESRVQEVIEFINAQSDTGCVVGIWGMGGLGKTTMAKVIYNKIHRRFRHSSFIENIRE

SEQ ID NO: 163201 - protein, 380 aa, Glycine max
  Coding DNA Sequence Number=SeqID_46423
  Homolog annotation: Hit_ID=Q8H0U8; Match level="QueryCoverage=39%, HitCoverage=13%, E-value=6e-27, Identity=46%"; Hit description=DEAD -box ATP-dependent RNA helicase 42
MDEGKHKSRKENHEVKDGDSKRSHRDRDRDRTGERGKDKNDGRHRDKEKRDRESRRHERESTDSEDRYDRDREKLKDKDKDVDRERGRDKKRERDRERERTDRVREKERERERKEDKERIRERERERKDHEREKEKERERGRKARGREKRREVDSDCSDGESKERDRKRHRKEDGDYKRERERSVSKSSRKSEEHEGSPRKKSGGDDSDTKDEEKKPTREEEMEDEQKRLDEEMEKRRRRVQEWQELRRKREEAEREKHGEASANEPESGKTWTLEGESDDEEGPGTGKQTGMDVDEDDKPADKEPKDVMVVDTVNGTIASDLQDGPAGAPEDEEIDPLDAFMNSMVLPEVEKLNNAVTSSLSGKAIDVKPKDKGNEQNR

SEQ ID NO: 163202 - protein, 512 aa, Glycine max
  Coding DNA Sequence Number=SeqID_46424
MVLCIGSTIQANGLEQLGVAHQVKRSKFVYLPEESSDSLDYKETPVNVAMSQFGGEYAYCSSLAEESESAFMDVVESDSLETGSANADSDSSEMELDKDDEMTTLSEIGRDTEEQESTSSEELDELAISGDMPHLYPRQHISCSEAVSKWKLKGKRNNRNLVKRSVGAADGKGVVLYEADVEGLRSRLNHKRLVPSMHYYGNGISDVFDDTDQMFGFEDEYSPTSKALAKGQNKIDHGVDWDEWAWEDQTALKGYWESKGFAPLYSDRYHFDGRIRSMLVDVDLKVQASYRKAPVPIVSITSKLDGKSIIGHPIQIESLKDGSSDKLFSAIDDFSNDGTGFEGSSVLPPAWRTARRTANFRVPRPLVLSSNGADSYADFCIDQERNIEYKKLNGGSSNHMASLSRKSGFNSSVPSVDKKSSKKMPKKVSLSSSQKTRTLSSLSIENNHGKKQLHDRSFYQTNRLTKPEVSGLTTVACIPVKLVFSRLLEKINRPPLKAASNAALSNTGVERK

SEQ ID NO: 163203 - protein, 455 aa, Glycine max
  Coding DNA Sequence Number=SeqID_46425
  Gene Ontology: Mol. function=signal transducer activity; Cellular component=spindle; Biological process=cell division
  Homolog annotation: Hit_ID=Q9SZA4; Match level="QueryCoverage=99%, HitCoverage=100%, E-value=0.0, Identity=76%"; Hit description=WD -repeat protein-like protein
  Pfam annotation: Domain name=WD40; Domain location=170-208; Score =27.4; E_value=5.2e-05; Accession=PF00400.22; Description=WD domain, G-beta repeat
  Pfam annotation: Domain name=WD40; Domain location=212-249; Score =11.4; E_value=1.7; Accession=PF00400.22; Description=WD domain, G -beta repeat
  Pfam annotation: Domain name=WD40; Domain location=254-292; Score =42.3; E_value=1.6e-09; Accession=PF00400.22; Description=WD domain, G-beta repeat
  Pfam annotation: Domain name=WD40; Domain location=302-343; Score =20.9; E_value=0.0045; Accession=PF00400.22; Description=WD domain, G- beta repeat
  Pfam annotation: Domain name=WD40; Domain location=390-428; Score =33.4; E_value=7.9e-07; Accession=PF00400.22; Description=WD domain, G-beta repeat
  Pfam module annotation: Pfam domain module=WD40::WD40::WD40::WD40::WD4 0; Domain location=170-208::212-249::254-292::302-343::390-428
MDAGSLSSSGTLKTRSRYPLQEQFIQRKSSKENLDRFIPNRSAMDFDYAHYMLTEGNKGKENPDVCSPSREAYRKQLAESLNMNRTRILAFKNKPPAPLDLIPHEMSTYTHDNKPAKPKRFIPQSSEKTLDAPDIVDDYYLNLLDWGSANVLAIALGSTVYLWDARNGSTSELVTVDDEDGPVTSVSWAPDGRHIAVGLNNSEVQLWDTSSNRQLRTLRGGHRQRVGSLAWNNHILTSGGMDGRIVNNDVRIRSHVVETYSGHEQEVCGLKWSASGSQLASGGNDNLLYIWDRATASSNSATQWLHRLEDHTSAVKALAWCPFQGNLLASGGGSGDRCIKFWNTHTGACLNSIDTGSQVCSLLWNKNERELLSSHGFTQNQLTLWKYPSMVKMAELNGHTSRVLFMAQSPDGCTVASAAADETLRFWNVFGAPEAASKAAPKARAEPFSNVNRIR

SEQ ID NO: 163204 - protein, 464 aa, Glycine max
  Coding DNA Sequence Number=SeqID_46426
  Gene Ontology: Mol. function=hydrolase activity; Biological process =guanosine tetraphosphate metabolic process
  Homolog annotation: Hit_ID=Q1SB52; Match level="QueryCoverage=87%, HitCoverage=47%, E-value=0.0, Identity=78%"; Hit description=ATP -dependent DNA ligase; Metal-dependent phosphohydrolase, HD region; TGS; DNA polymerase ...
  Homolog annotation: Hit description=III clamp loader subunit, C -terminal
  Pfam annotation: Domain name=RelA_SpoT; Domain location=1-118; Score =70.1; E_value=7e-18; Accession=PF04607.7; Description=Region found in RelA  SpoT proteins
  Pfam annotation: Domain name=TGS; Domain location=354-409; Score =36.6; E_value=8.4e-08; Accession=PF02824.11; Description=TGS domain
  Pfam module annotation: Pfam domain module=RelA_SpoT::TGS; Domain location=1-118::354-409
MKRKDVSIDKVYDARALRVVVGDKNGTLHGPAVRCCYSLLDIVHRLWTPIDGEFDDYIINPKPSGYQSLHTAVQGPDNSPLEVQIRTQVPSYFTCVAERMHECAEHGLAAHWLYKETGNPFLSIDSMDEPETEASSYFSKNLEEGNSSDILSSKYKSLKAGHPVLRVEGSHLLAAVIISVENDERELLVAVSFGLAASEAVADRRSFQIKRWEAYARLYKKVSDEWWFEPGHGDWFTCLEKYTLCRDGMYHKQDQFGRLLPTFIQVINFTEQEKSEYWAVVSAVFEGRQVDWITSRSKFDLVASTSVEAGIDNKVNLLRTMLSWEEQLRSEVNFKQTKHDVKLYDLHGSLGEVVIICWPHGEILRLKAGSTATDAAQRVGLEGKLVLINGQLVLPNTKLKDGDVVELVEKYYLYCISREVATARFHAQASIPLNPSNENHLLLTIAHYGRLRNFEVSEKKKLTA

SEQ ID NO: 163205 - protein, 249 aa, Glycine max
  Coding DNA Sequence Number=SeqID_46427
  Gene Ontology: Mol. function=ribonuclease activity; Cellular component=ribonuclease P complex; Biological process=tRNA processing
  Homolog annotation: Hit_ID=Q9ZW76; Match level="QueryCoverage=99%, HitCoverage=75%, E-value=5e-32, Identity=38%"; Hit description =Expressed protein
MAEDSRKRTLEALERRIAFAKVEVLQKEKKNKKTINEDGKLPIPADSTSNDPSPHLLHSSSVSSKKGNFSFSGHTTLQDIEDGPAYAQLSVPVNGNLLTTNEEFSAERGGSIDGILHELLQKGDAAHKYMQGSRNMKIDNWILLDNYVQGRVLSSGSQARALQLHSKRSKKHMSMKRHKKDGSLDLPQEFQKFDIFKPMHEMWKDYIMLLLKSTGLSSKEGKKFMILYIAGKINWLNVSLVQIYMVLLF

SEQ ID NO: 163206 - protein, 713 aa, Glycine max
  Coding DNA Sequence Number=SeqID_46428
  Gene Ontology: Mol. function=ATP-dependent helicase activity; Cellular component=nucleus; Biological process=mRNA processing
  Homolog annotation: Hit_ID=Q8H0U8; Match level="QueryCoverage=99%, HitCoverage=62%, E-value=0.0, Identity=75%"; Hit description=DEAD -box ATP-dependent RNA helicase 42
  Pfam annotation: Domain name=DEAD; Domain location=117-291; Score =243.7; E_value=3.9e-70; Accession=PF00270.19; Description=DEADDEAH box helicase
  Pfam annotation: Domain name=Helicase_C; Domain location=359-435; Score=115.8; E_value=1.3e-31; Accession=PF00271.21; Description =Helicase conserved C-terminal domain
  Pfam annotation: Domain name=ResIII; Domain location=113-286; Score= -24.4; E_value=0.0052; Accession=PF04851.6; Description=Type III restriction enzyme, res subunit
  Pfam module annotation: Pfam domain module=DEAD::Helicase_C::ResIII; Domain location=117-291::359-435::113-286
IIPGEESDSDYADDEVEKDPLDEDDDEFMKRVKKTKAEKLSLVDHSKIVYEPFKKNFYIEVKEVSKMTPEESAVYRKQLELKIHGKDVPKPIKSWHQTGLASKILETIKKMNFEKPMPIQAQALPVIMSGRDCIGIAKTGSGKTLAFVLPMLRHIKDQPPVVAGDGPIGLIMAPTRELVQQIHSDIKKFAKVLGLRCVPVYGGSGVAQQISELKRGAEIVVCTPGRMIDILCTSSGKITNLHRVTYLVMDEADRMFDMGFEPQITRIVQNIRPDRQTVLFSATFPRQVEILARKVLNKPVEIQVGGRSVVNKDITQLVEVRPDNERFLRLLEILGEWYEKGKILIFVHSQEKCDSLFKDLLRHGYPCLSLHGAKDQTDRESTISDFKSNVCNLLVATSIAARGLDVKELELVINFDVPNHYEDYVHRVGRTGRAGRKGCAITFISEEEARYAPDLLKALELSEQTVPNDLKALAGSFMAKVNQGLEQAHGTGYGGSGFKFNEEEDEVRKAAKKAQAKEYGFEEEKSDSEDEDEGIRKAGGDISQHSAFAQIIAATKGNVPALPTPMLLPSLPVLPGTGLPLPANEGAARAAAIAALNLQDKLDKIRSEALPEHYEAELEINDFPQNARWKVTHKETLGPISEWSGAAITTRGQFFPPGKIPGPGERKLYLFIEGPTEHSVKSAKADLKRVLEDITNQAMQLPGGTQPGKYSVV

SEQ ID NO: 163207 - protein, 238 aa, Glycine max
  Coding DNA Sequence Number=SeqID_46429
  Gene Ontology: Mol. function=hydrolase activity; Biological process =guanosine tetraphosphate metabolic process
  Homolog annotation: Hit_ID=Q1SB52; Match level="QueryCoverage=72%, HitCoverage=19%, E-value=9e-73, Identity=80%"; Hit description=ATP -dependent DNA ligase; Metal-dependent phosphohydrolase, HD region; TGS; DNA ...
  Homolog annotation: Hit description=polymerase III clamp loader subunit, C-terminal
MVDDPRVVLIKLADRLHNMRTIYALPLQKAQAVAEETLIIWCSLASRLGLWALKAELEDLCFAVLQPQIFQKMRADLASMWSPTSRTGNPRRLSIKGNLIHLDENSSTAFCNGSLTFNEDVNRKDLLEAVVPFDILLDRRKRANYLSSIGNNLETCKKPKVVQEAGLALATMLTNSYLSCSTTDSSLTLSRVFSNIHLSPSISPSINTPPKMDLVLKVKLRKNSLYFISKFPVIFMVG

SEQ ID NO: 163208 - protein, 586 aa, Glycine max
  Coding DNA Sequence Number=SeqID_46430
  Gene Ontology: Mol. function=binding; Cellular component =intracellular; Biological process=RNA processing
  Homolog annotation: Hit_ID=Q9FND1; Match level="QueryCoverage=92%, HitCoverage=96%, E-value=0.0, Identity=58%"; Hit description =Arabidopsis thaliana genomic DNA, chromosome 5, P1 clone:MRH10
  Pfam annotation: Domain name=DUF946; Domain location=43-584; Score =1109.7; E_value=0; Accession=PF06101.2; Description=Plant protein of unknown function (DUF946)
MKQRLLRLCYYWVSLIPQLLRLLQMLCFKFNHFPWNRKGNTITLPQTFSLPSPLPQWPQGQGFASGIVNLGEIEVCKVTGFEFVWNSNIGKPVAFYKPVRIPDGFRILGHYCQPSDKPLRGFVLGVREVETASSETSNCHTLPALKNPLDYMLVWCSNAGSKELPIGSAYFWVPQLPEGYSALGYLVTNVPDKPNLDEMICVRADLTDKCEPYRLMLDAAPVTPEFPFQVWNLRPRDRGMLGEGVSVGTFFCTSCWNKGEELPVVCLKNLNPVLPAMPRLHQIHALIEHYGPTVFFHPEEAYLPSSVDWFFNNGALLYRKGVSTGETIDAAGSNLPGGGRNDGEFWIDLPSDDRRDFVKHGDLKSAKLYVHVKAALGGTFTDVAMWVFCPFNGPSTLKIGITSRAFSKVGEHVGDWEHFTLRICNFTGELWSIYFSQHSGGKWVDAYELEYIDGNKAVVYSSKNGHASYPHPGTYLQGSSKLGIGIRNDATRSHLYVDSSIQYELVAAEYLGDVVREPQWLQFMREWGPKIVYDSKTELDKIMNALPRGLRNAFGNLIKKLPVELYGEEGPTGPKEKNNWIGDERW

SEQ ID NO: 163209 - protein, 50 aa, Glycine max
  Coding DNA Sequence Number=SeqID_46431
MQECLWFYGRASVYQFETKKLTLKFRVENGETRKLLGCTQHTRLHANAKL

SEQ ID NO: 163210 - protein, 301 aa, Glycine max
  Coding DNA Sequence Number=SeqID_46432
  Gene Ontology: Mol. function=protein transporter activity; Cellular component=nuclear pore; Biological process=protein import into nucleus, docking
  Homolog annotation: Hit_ID=Q1SB44; Match level="QueryCoverage=79%, HitCoverage=22%, E-value=1e-125, Identity=92%"; Hit description =Importin-beta, N-terminal
MAEKECIGSYDGLVRTEHRATKEARTSLDREETELYNWEKGFWVKCNTRDASLEGRPNGLTYENRFLVMVIRDLLNLCEITKGKDNKAVIASNIMYVVGQYPRFLRAHWKFLKTVVNKLFEFMHESHPGVQDMACDTFLKIVQKCKRKFVITQVGENEPFVSELLSGLPNTIADLEPHQIHTFYESVGNMIQAESDAQKRDEYLQKLMVLPNQRWMEIIGKAHQNADFLKDQDVIRNVLNILQTNTSVASSLGTYFLPQITLIFLDMLNVYRMYSELISKSIAEGGPFASRTSYVKLLRLD

SEQ ID NO: 163211 - protein, 1016 aa, Glycine max
  Coding DNA Sequence Number=SeqID_46433
  Gene Ontology: Mol. function=RNA-directed DNA polymerase activity; Biological process=RNA-dependent DNA replication
  Homolog annotation: Hit_ID=Q1SDT5; Match level="QueryCoverage=39%, HitCoverage=78%, E-value=1e-34, Identity=29%"; Hit description =Ribonuclease H
MSERDVASMSNSKPSPKPPDGEGKAGVTKAMWKLLGVFDMLDVGFGFYMVKFDLPQDTKKVVSGGPQMVFDHYPTSILGIGISGVEFDQSGYLNNGCNQRQVCEGFAFRMQEVWVAWTYCKNMSTIKGGGRKYTGQFLRVEGQMATLGFSRENYGPILVSNNEEVPTLKEPMKREYHHVSRWHNKDSICEPNSGEAMMKERREVTITKNPQQAEGAPVGSSTIMSERIVAPFRLGWNTESDLSKDQGEGVQNKGGDEGVENTTQTMEVVVDGDAGSEKCSMVSRNVRGFASRKSQELILKYHPDRKDTQVAFGGFVQNGVYVSLHSSTRKTLWGWKGVLAFVSRHFKVCLDIYALVNLEYFGSKFTWQKRCTRGMLMAKRLDRVMSDIQWRLAFPEATMEHLVRRHSDHNPILLRCCNQVTTRGKRSFRFQAAKCTYEGYAQVVSRAWNKERAEVFKALYNVSKETLVFNKEDFCSVIGMRKDIEAHNLFNAQIVIRRKKNKIHGLHLLDGEWCTKAETLKMEALKYFKARMVLMASVSKVEVVGDDVWKFFARAFQRGMFDPRVMKALLVLIPMEDSLTTVVSVHQSSFILGQGPKDNAIMLQEARSNQARKIEEGVLTRIKNELYGVMEIHFTKQLGKYLGFKIYHGRVRHLNFKDLFDKVISKLSVWQNKLLNKPGRLMLANAVLSSLPAYGMHVQWFPQYACDAIDKKNKSFLWKGNKERGIHMVKWDTIMRSRGHGSLGASTPCDSPVVVVFGGCGWWRKQRASAAEPAVQQISKSKFKGDPTVNEFEIALQVELRGVIHESSYGECGRSVFGQVCKQISQGQGKGSGGNGGLKMGVEIEECELDSRLDYREKQGSEDYYSHHHLDHLKVFELKAKVQVTVNHSKVVFNQGSPRGGFGGIYRDYRGLFPRGLCGNVGSSNMVFVELVALWRRLWLCWDEGYKELICYTDLSLVVQLVLGVLDYHHAYNNEIMQTKELLGIDLRQWWSFQHPPEELRTQLREDASGMSFTRS

SEQ ID NO: 163212 - protein, 146 aa, Glycine max
  Coding DNA Sequence Number=SeqID_46434
  Gene Ontology: Mol. function=protein transporter activity; Cellular component=nuclear pore; Biological process=protein import into nucleus, docking
  Homolog annotation: Hit_ID=Q1SB44; Match level="QueryCoverage=100%, HitCoverage=14%, E-value=1e-68, Identity=88%"; Hit description =Importin-beta, N-terminal
STQENISALLLGLEYLINISYVDDTEVFKVCLDYWNVLVSELFEPQRSLENPAAANMIGLQVPGMIDGIGSQLLQRRQLYASPMSKLRMLMICRMAKPEEVLIVEDENGNIVRETMKDNDVLVQYKIMRETLIYLSHLDHDDTEKQ

SEQ ID NO: 163213 - protein, 254 aa, Glycine max
  Coding DNA Sequence Number=SeqID_46435
  Gene Ontology: Mol. function=protein transporter activity; Cellular component=nuclear pore; Biological process=protein import into nucleus, docking
  Homolog annotation: Hit_ID=Q1SB44; Match level="QueryCoverage=99%, HitCoverage=17%, E-value=1e-78, Identity=93%"; Hit description =Importin-beta, N-terminal
  Pfam annotation: Domain name=IBN_N; Domain location=100-166; Score =73.2; E_value=8.1e-19; Accession=PF03810.9; Description=Importin -beta N-terminal domain
  Pfam annotation: Domain name=Xpo1; Domain location=177-253; Score =3.9; E_value=0.0025; Accession=PF08389.2; Description=Exportin 1 -like protein
  Pfam module annotation: Pfam domain module=IBN_N::Xpo1; Domain location=100-166::177-253
MAAEKLRDLSQPIDVPLLDATVAAFYGTGSKEQVAPPFPFSLFLFSLFPSRFNILHNSPLSASPLCFSKLLLFHCLFVSPNASKQFNRTELTCSVRRTAADQILRDLKNNPDTWLQVMHILQNTQSLNTKFFALQVLEGVIKYRWNALPVDQRDGMKNFISDVIVQLSGNEASFRTDRLYVNKLNIILVQILKHEWPVRWRSFIPDLVSAAKTSETICENCMAILKLLSEEVFDFSRGEMTQQKIKELKHSLNR

SEQ ID NO: 163214 - protein, 217 aa, Glycine max
  Coding DNA Sequence Number=SeqID_46436
  Homolog annotation: Hit_ID=Q2HRX8; Match level="QueryCoverage=58%, HitCoverage=18%, E-value=4e-11, Identity=34%"; Hit description=IMP dehydrogenase/GMP reductase
  Pfam annotation: Domain name=DUF1723; Domain location=117-166; Score =43.1; E_value=9.5e-10; Accession=PF08330.1; Description=Protein of unknown function (DUF1723)
MVRTRGLHWALSIVLGKALGRQVSGDAQEVPQRQRPTTSACRQRLAAVVAEDVKHVDHSADEVHEQPREPVTDDERTHLKLDSHGRKVKKFGRPAPKIEGLVVATRLSPLITCSSDTGDTGLISPFAERCHKETSSFHLSVGEVTVTFNDVTSLLHLPITGAFHTFDALDIDQVMDLIIELLEVSTQEAKNETSQTRGAYVRLAWLRDIYRSKCDAR

SEQ ID NO: 163215 - protein, 52 aa, Glycine max
  Coding DNA Sequence Number=SeqID_46437
MEAQFLYREEMMAMLVQVTSFIAWGVISYRIYILSYRLQYCLSGMPPTNFIS

SEQ ID NO: 163216 - protein, 464 aa, Glycine max
  Coding DNA Sequence Number=SeqID_46438
  Gene Ontology: Mol. function=GTP binding; Cellular component =intracellular; Biological process=RNA-dependent DNA replication
  Homolog annotation: Hit_ID=Q1SRW7; Match level="QueryCoverage=99%, HitCoverage=100%, E-value=1e-175, Identity=64%"; Hit description=IMP dehydrogenase/GMP reductase
  Pfam annotation: Domain name=PPR; Domain location=158-192; Score =35.1; E_value=2.5e-07; Accession=PF01535.11; Description=PPR repeat
  Pfam annotation: Domain name=PPR; Domain location=193-227; Score =40.3; E_value=6.7e-09; Accession=PF01535.11; Description=PPR repeat
  Pfam annotation: Domain name=PPR; Domain location=228-262; Score =38.0; E_value=3.3e-08; Accession=PF01535.11; Description=PPR repeat
  Pfam annotation: Domain name=PPR; Domain location=263-297; Score =47.6; E_value=4.2e-11; Accession=PF01535.11; Description=PPR repeat
  Pfam annotation: Domain name=PPR; Domain location=298-332; Score =14.7; E_value=0.13; Accession=PF01535.11; Description=PPR repeat
  Pfam annotation: Domain name=PPR; Domain location=333-367; Score =21.1; E_value=0.0041; Accession=PF01535.11; Description=PPR repeat
  Pfam annotation: Domain name=PPR; Domain location=368-403; Score =19.0; E_value=0.018; Accession=PF01535.11; Description=PPR repeat
  Pfam annotation: Domain name=PPR; Domain location=89-123; Score=0.6; E_value=6.3; Accession=PF01535.11; Description=PPR repeat
  Pfam module annotation: Pfam domain module=PPR::PPR::PPR::PPR::PPR::PP R::PPR::PPR; Domain location=158-192::193-227::228-262::263-297::298 -332::333-367::368-403::89-123
MAFQSLFSKYKILPSFFCTLVQHKPSYHHFHSFPTPQVSGPLLPDLVNEISRLLSDHRYPHHDLELSLNPFSAQISTNLVDQVLKRCNNLGFSAHRAYSQANLPDGAIRSFNRMDEFGIKPTINDFDKLLFILCKTKHVKQAQQFFDQAKNRFLLTAKTYSILISGWGDIGDSEKAHELFQAMLEQGCPVDLLAYNNLLQALCKGGCVDEAKTIFHDMLSKRVEPDAFTYSIFIHSYCDADDVQSALRVLDKMRRYNILPNVFTYNCIIKRLCKNEHVEEAYLLLDEMISRGVRPDTWSYNAIQAYHCDHCEVNRAIRLMFRMEKDNCLPDRHTYNMVLKLLIRIGRFDKVTKVWGNMGDKKFYPSVSTYSVMIHGFCKKKGKLEEACKYFEMMIDEGIPPYVTTVEMLRNQLLGLGFLDHIEILAAKMRQSTSYAIQELANIMIGNRTTHNTLRRDEMDIESD

SEQ ID NO: 163217 - protein, 444 aa, Glycine max
  Coding DNA Sequence Number=SeqID_46439
  Gene Ontology: Mol. function=polygalacturonase activity; Cellular component=cellulose and pectin-containing cell wall; Biological process=carbohydrate metabolic process
  Homolog annotation: Hit_ID=Q1SGW6; Match level="QueryCoverage=96%, HitCoverage=98%, E-value=0.0, Identity=64%"; Hit description =Glycoside hydrolase, family 28
  Pfam annotation: Domain name=Glyco_hydro_28; Domain location=108-416; Score=13.6; E_value=7.7e-10; Accession=PF00295.8; Description =Glycosyl hydrolases family 28
  Subcellular localization annotation: CTP_CleavageSite=93; ConfidenceScore=5.06e-01
MVESTEQGGRGILGLFQFQLLHPKTTPFASHKTLLAFLWVATLASVLLWQRTTISGFLVQGGVPVRAPPKLRPVVFCLTEFGGVGDGVTLNTEAFERGVGAISKLGDKGGGQLNVPPGRWLTAPFNLTSHMTLFLARDSVILAVQDEKYWPLMPALPSYGYGREHPGPRYSSLIHGQNLRDVVITGHNGTINGQGQTWWTKYRQKLLNHTRGPLVQILWSSNIVISNITLRDSPFWTLHPYDCKNVTVKNVTILAPVSHAPNTDGIDPGNAGISIGSEMSGGVSNVLVENILVWESRRAMRIKTAPGRGGYVRQITYKNLMFKNVRVGIVIKTDYNEHPGTGYDPRALPILRDISFINIRGQGVRVPVRIQGSEQIPVRNVTFQDMKIGITYKKKHIFQCAFVQGQAIGTIFPSPCDSFDRYNEQGQLVKHAASQNVTDIDYEI

SEQ ID NO: 163218 - protein, 195 aa, Glycine max
  Coding DNA Sequence Number=SeqID_46440
  Gene Ontology: Mol. function=protein transporter activity; Cellular component=nucleus
  Homolog annotation: Hit_ID=Q1SET3; Match level="QueryCoverage=83%, HitCoverage=64%, E-value=1e-63, Identity=78%"; Hit description =Translin
  Pfam annotation: Domain name=Translin; Domain location=1-177; Score =185.4; E_value=1.4e-52; Accession=PF01997.7; Description=Translin family
MSKYNKVEILEKAEKDLAAVTDQYMSRLVKELQGTDFWKLRRAYSPGIQEYVEAATFYGFCKSGTLLKLDEINKTLLPLSDPSLDPLQINILDYILGVADLTGELMRLAIGRISDGELEFAEKICRFARDIYRELTLVVPHMDDSSDMKTKMDVMLQSVMKIENGNALVFKTLFARLKVLSVMFDALIPYYCKHK

SEQ ID NO: 163219 - protein, 99 aa, Glycine max
  Coding DNA Sequence Number=SeqID_46441
  Homolog annotation: Hit_ID=Q69P91; Match level="QueryCoverage=42%, HitCoverage=17%, E-value=4e-10, Identity=71%"; Hit description =Putative chlorophyll a/b-binding protein type II
  Subcellular localization annotation: CTP_CleavageSite=40; ConfidenceScore=5.27e-01
MALALSSTALSSLPNREIRQKGFPERTPTCLSLTRRTIANATKGVSAVCEPLPPDRPLWFPGSSPPEWLDGRFEFNYNTLNEIAQLSIILLSDSHDSLR

SEQ ID NO: 163220 - protein, 88 aa, Glycine max
  Coding DNA Sequence Number=SeqID_46442
MYNTYGLAIHILGESTINQPRRQALSGAVELMGYDHAMNELCRSKDFDFDVLMMPYEHDVLMPYEYALLKLRSRQKSKRFKIHHQEDL

SEQ ID NO: 163221 - protein, 310 aa, Glycine max
  Coding DNA Sequence Number=SeqID_46443
  Gene Ontology: Mol. function=magnesium ion binding; Cellular component=membrane; Biological process=photosynthesis, light harvesting
  Homolog annotation: Hit_ID=Q43382; Match level="QueryCoverage=54%, HitCoverage=63%, E-value=1e-83, Identity=82%"; Hit description=PSI type II chlorophyll a/b-binding protein
  Pfam annotation: Domain name=Chloroa_b-bind; Domain location=1-147; Score=194.7; E_value=2.2e-55; Accession=PF00504.12; Description =Chlorophyll A-B binding protein
  Pfam annotation: Domain name=DUF1723; Domain location=228-272; Score =9.5; E_value=0.038; Accession=PF08330.1; Description=Protein of unknown function (DUF1723)
  Pfam module annotation: Pfam domain module=Chloroa_b-bind::DUF1723; Domain location=1-147::228-272
SDPELLKWFAQAELMHSRWAMLAVFGILVPELLERIGYIENFSWYDAGTREYFVDPTTLFVVQMGLMGWVEGRRWADIVNPGSVDIEPKVPHVTNPKPDVGYPGGLWFDPMMWGRGSPEPVMVLRTKEIKNGRLAMLAFVGFWFQAIYTGEGPIENLMAHLADPGHCNIFSEPVTIDVRADTQGFSGGPKDTSALTDYVHHVAIKVWKGQECTNLKLASHGRKVEKFGRPTPEIEGIVETSSFHLLIGDVTITLNDVASLLHLSITSAFHTFDAHDVNQVVDLIVELLEVSTQEAKDETFQTKGTYVRLA

SEQ ID NO: 163222 - protein, 80 aa, Glycine max
  Coding DNA Sequence Number=SeqID_46444
MVHDDTFIVPDPLQQLINATTILEPPAPTDIDMPRHAVDACQLIAGILEHMINTRMIVVGIKAYTLTKHCLRLARGTPEC

SEQ ID NO: 163223 - protein, 474 aa, Glycine max
  Coding DNA Sequence Number=SeqID_46445
  Homolog annotation: Hit_ID=UPI000054763C; Match level="QueryCoverage =70%, HitCoverage=66%, E-value=4e-24, Identity=24%"; Hit description =PREDICTED: similar to gluconokinase like (43.8 kD) (2P34) isoform 1
  Pfam annotation: Domain name=MMR_HSR1; Domain location=126-264; Score= -18.1; E_value=0.045; Accession=PF01926.13; Description=GTPase of unknown function
MSSSDTEKEKALRLKMTGRNHRTVFSNKVTRPDPQSSQLSGYILPRNSQLTMAGSEASPKILLAKPGLVTGGPVAGKFGRGGGGDDDSTQLRSRLPSAASLNLLSDSWDFRIDRFLPFLTENTDFTVIGVIGSPGVGKSTIMNEIYGFDSTSPGMLPPFAIQSEETRAMARHCSTGIEPRISTERIILLDTQPVFSASVLSEMMRPDGSSTISVLSGETLSAELAHELLGIQLAVLLASICHIVLVVSEGIHDDSMWHLMLTVDLLKHGISDPSLMTSLSQSSSSGLEKDKLPEHEEYMATPVFVHTKLQDQDFTPSNSVQLRKALMQYFRPSYFVREHTENKPEEHVSSSPVHGSQMDSNMIKFYAIPLKKKDENPRAQHESYVSALWKLRDQILSMKSPSFTRPVSEREWLKNSAKIWELVKSSPTILEYCRTLQHSGDLEPRPTLNLKAKEPRPTLNLKTKEPRPTQPYRN

SEQ ID NO: 163224 - protein, 149 aa, Glycine max
  Coding DNA Sequence Number=SeqID_46446
  Gene Ontology: Mol. function=NADH dehydrogenase (ubiquinone) activity; Cellular component=membrane; Biological process=electron transport
  Homolog annotation: Hit_ID=Q336M6; Match level="QueryCoverage=67%, HitCoverage=94%, E-value=6e-40, Identity=72%"; Hit description =NADH:ubiquinone oxidoreductase 17.2 kD subunit family protein, expressed
  Pfam annotation: Domain name=NDUFA12; Domain location=39-147; Score =204.2; E_value=3.1e-58; Accession=PF05071.7; Description=NADH ubiquinone oxidoreductase subunit NDUFA
MASVVKNVLKSVREKGFGAFLRELKDEGYLQTKIHNIGATLVGVDKFGNKYYEKLGDTQFGRHRWVEYAEKTRYNASQVPAEWHGWLHFITDHTGDELLLLKPKRYGIEHKENLSGEGEQYIYHSKGHALNPGQRNWTRYQPWESKPEP

SEQ ID NO: 163225 - protein, 257 aa, Glycine max
  Coding DNA Sequence Number=SeqID_46447
  Gene Ontology: Mol. function=nucleic acid binding; Cellular component= nucleus
  Homolog annotation: Hit_ID=UPI0000D4DEEF; Match level="QueryCoverage =41%, HitCoverage=26%, E-value=7e-38, Identity=66%"; Hit description =PREDICTED: similar to MGC10433 protein isoform 2
  Pfam annotation: Domain name=RRM_1; Domain location=155-226; Score =86.3; E_value=9.6e-23; Accession=PF00076.12; Description=RNA recognition motif. (a.k.a. RRM, R
  Subcellular localization annotation: CTP_CleavageSite=80; ConfidenceScore=5.57e-01
MMVLLSSFVPFELRSMTTPSSSSSSAPQSQFTYSNPSSYFPVPFHLQQPATTHYAAPYVAAPSVQIPAPPIVGPVVPAPVAGVYSTVPQYQAQQLFERDAQIITPEALENVKAAIASSDVEHKADAKKKAVPRKAAGQSWEDPILAEWPEDDYRLFCGDLGNEVNDDVLSKVFSRFPSFNLARVVRDKRTGKTKGYGFVSFANPADLAAAVKEMNGKYVGNRPIKLRKKSHSKETEIAKERRAAQVTKGQNLCKSDY

SEQ ID NO: 163226 - protein, 138 aa, Glycine max
  Coding DNA Sequence Number=SeqID_46448
  Gene Ontology: Mol. function=transcription factor activity; Cellular component=transcription factor complex; Biological process =regulation of progression through cell cycle
  Homolog annotation: Hit_ID=Q7XZI4; Match level="QueryCoverage=66%, HitCoverage=21%, E-value=1e-24, Identity=67%"; Hit description=DP1
MGTQPQQTFREEEEEEMQGHGTTMSGQSMSTSRSVGSPSSRSEQTMATPASDSTFLRLNHLDIHGDDAGSQGTVAKKKKRGQRAVGGDKSGRGLRQFSMKGHDDIFPYWFYFPSIGCPVCEKVESKGRTTYNEVSQLI

SEQ ID NO: 163227 - protein, 243 aa, Glycine max
  Coding DNA Sequence Number=SeqID_46449
  Gene Ontology: Mol. function=transcription factor activity; Cellular component=transcription factor complex; Biological process =regulation of progression through cell cycle
  Homolog annotation: Hit_ID=Q7XZI4; Match level="QueryCoverage=91%, HitCoverage=64%, E-value=1e-93, Identity=78%"; Hit description=DP1
  Pfam annotation: Domain name=DP; Domain location=85-242; Score=249.1; E_value=9.4e-72; Accession=PF08781.1; Description=Transcription factor DP
  Pfam annotation: Domain name=E2F_TDP; Domain location=6-78; Score =74.6; E_value=3.2e-19; Accession=PF02319.11; Description =Transcription factor E2Fdimerisation partner (TDP)
  Pfam module annotation: Pfam domain module=DP::E2F_TDP; Domain location=85-242::6-78
MQLPRILTVSNKLYCKEMFLKTADELVAEFADPINGVSTPDQQQYDEKNIRRRVYDALNVLMAMDIISKDKKEIQWKGLPRTSLSDIEELKSERLGLRNRIEKKAAYLQELEEQYIGLQKLIQRNEQLYSSGNAPNGGVSLPFILVQTRPHATVEVEISEDMQLVHFDFNSTPFELHDDNYVLKAMKFCERSQNDNTTDNSTDGGEGSSIYAQVPTSVSNPPNRPPSSPPLPGILKARVKNEH

SEQ ID NO: 163228 - protein, 93 aa, Glycine max
  Coding DNA Sequence Number=SeqID_46450
MAASPGIIFYIFNSKEASLYALNGICFAGKHIKLEPGLPKIATCMMQQSQKGKDEPDFGRSLSDNISLRHKVLGPHMPPWYHWYIRACLDALL

SEQ ID NO: 163229 - protein, 249 aa, Glycine max
  Coding DNA Sequence Number=SeqID_46451
MDEKQVDGEILFLGVLEYLDREECYWHSVETDLMNIWGLLPLEIEVDVLGMCNTTSIDPEKDAVMVIEDDVGVEYNGQEVDTEKCSNDMDHSVPLGDKVLAEKCAEDAHHNVQEEGGVTFVEEHNYGRVDYGVIIEERMMFRALKVTRSMDVNHGIFPIAYVVMDVEDKENWKWFLTLLHQDLGDYSQFGWNFMFDLQKGLLPTMKEVFPGAFHKLCYELVEELFQTMEIQGAEGISLAMCKDYNKTKI

SEQ ID NO: 163230 - protein, 94 aa, Glycine max
  Coding DNA Sequence Number=SeqID_46452
MTKHIDVRLHFIKDVVEFEEVKIVKIASEDNLAYLFTKSLPRSVRGIKIVEKHKRGNTRYVGKREKQSVRLRFMQSVLLEFKGAELRRFFVVSH

SEQ ID NO: 163231 - protein, 42 aa, Glycine max
  Coding DNA Sequence Number=SeqID_46453
MLGSEDHSGEEFQEGHRNRLCQDNLWKLDSIWIVLDKWPQIS

SEQ ID NO: 163232 - protein, 377 aa, Glycine max
  Coding DNA Sequence Number=SeqID_46454
  Gene Ontology: Mol. function=4-coumarate-CoA ligase activity; Cellular component=peroxisome; Biological process=phenylpropanoid metabolic process
  Homolog annotation: Hit_ID=P31687; Match level="QueryCoverage=94%, HitCoverage=62%, E-value=1e-167, Identity=86%"; Hit description=4 -coumarate--CoA ligase 2
  Pfam annotation: Domain name=AMP-binding; Domain location=76-377; Score=71.7; E_value=2.4e-18; Accession=PF00501.18; Description=AMP -binding enzyme
MTTVAASLDAKEVSTSKTDQNQVCDCDPQTSHVFKSKLPDIPISNHLPLHAYCFQKLSQFSDRPCLIVGPAAKTYTYSETHLISRKIAAGLSNLGIRKGDVVMILLQNSAEFVFSFLAASMIGAVATTANPFYTAAEIFKQFTVSKTKLIITQAMYVDKLRNHDDGAKLGEDFKVVTVDDPPENCLHFSVLSEANESDAPEVDIQPDDAVAMPFSSGTTGLPKGVVLTHKSLTTSVAQQVDGENPNLYLTTEDVLLCVLPLFHIFSLNSVLLCALRAGSAVLLMQKFEIGTLLELIQRHRVSVAMVVPPLVLALAKNPMVADFDLSSIRLVLSGAAPLGKELVEALRNRVPQAVLGQEIKDEFGFGVIANYNLVLPS

SEQ ID NO: 163233 - protein, 237 aa, Glycine max
  Coding DNA Sequence Number=SeqID_46455
  Subcellular localization annotation: CTP_CleavageSite=36; ConfidenceScore=5.38e-01
MAEPSKKRKDSTSTTSAAGQRHHDTSGDPPAPPNPSLSSPRSLTLFSSHEQRQRLLVGSFTFECHIMHYILCRILLPHSTNLAQASKEDLILLWALQTGRQIDWAHLARYRMYKTLQANAPLPYPQLVTLFLHHFNVPLDDEPFVKVNRSFEHGYRKGEDGQWVRKQDLPPLISDDRTPSPPPQRDSSSSLLHDVLTELRDLQAFVGDRFNAMDSRITRLENDMSFIRRCFDPPADP

SEQ ID NO: 163234 - protein, 48 aa, Glycine max
  Coding DNA Sequence Number=SeqID_46456
MALSRQRYGILIFPKLDLIALLKEYSGVIIEEDAFINYSIPLTGLYHA

SEQ ID NO: 163235 - protein, 97 aa, Glycine max
  Coding DNA Sequence Number=SeqID_46457
MAISQYLAESVDVNKLKFDLKKVESSLDSALTANISMTGDNATLKDKISKLEEIAKDELIFDINKDLCNGALVVIDDIPVYVPPSNAQSSTPIGETR

SEQ ID NO: 163236 - protein, 121 aa, Glycine max
  Coding DNA Sequence Number=SeqID_46458
  Gene Ontology: Mol. function=RNA-directed DNA polymerase activity; Biological process=RNA-dependent DNA replication
MKFPSVVNSIIIVHAYQKKASECYMARLQLTHMAKGKSYKDINNVEMLAVDGTSRHRILSFLDAYSDYNQIRMNVEATYQYLMDKVFEPQIGRNIEVYVDDVIIKSNDLLTHIKDLEKAFG

SEQ ID NO: 163237 - protein, 81 aa, Glycine max
  Coding DNA Sequence Number=SeqID_46459
MKPLELLMRLWWQTVYFMLTDVDEHGGSHSRKCTSNFLGYWFIGCMLESKSKSPNKSKRDVAVEILFAGRKMMNGILAAAQ

SEQ ID NO: 163238 - protein, 1203 aa, Glycine max
  Coding DNA Sequence Number=SeqID_46460
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=P98204; Match level="QueryCoverage=93%, HitCoverage=95%, E-value=0.0, Identity=65%"; Hit description =Phospholipid-transporting ATPase 1
  Pfam annotation: Domain name=E1-E2_ATPase; Domain location=176-447; Score=-123.0; E_value=0.02; Accession=PF00122.10; Description=E1-E2 ATPase
  Pfam annotation: Domain name=Hydrolase; Domain location=485-931; Score=9.7; E_value=0.0076; Accession=PF00702.16; Description =haloacid dehalogenase-like hydrolase
  Pfam module annotation: Pfam domain module=E1-E2_ATPase::Hydrolase; Domain location=176-447::485-931
  Subcellular localization annotation: CTP_CleavageSite=80; ConfidenceScore=5.90e-01
MGSNRPLLMTVPSPTTTSSTSIDPELPKSKSSSSNNAFNPFENTLNNSSSSRRSSGSRSNNSIHEVSLSSSGSIKSKPVRYGSKGGADSEGLSMSQRELRDEDARLVYINEPFKTNEAFEFAANSIRTSKYSLLTFIPRNLFEQFHRVAYVYFLIIAILNQLPQLAVFGRTVSILPLAFVLFVTAVKDVYEDWRRHQNDKVENNRLASVMVDGGRSFVEKKWRDVRVGEVIKIKANETIPCDTVLLSTSDPTGVAYVQTINLDGESNLKTRYAKQETHGKEGFGGVIKCEKPNRNIYGFLANMEVDGKKLSLGSSNIVLRGCELKNTSWAIGVAVYCGSETKAMLNNSGAPSKRSRLETCMNSEIIWLSFFLVALCTVTSVCVAVWLKRHKDELNLLPYYRKLDFSEGDVDSYEYYGWGLEIFFTFLMSVIVFQVMIPISLYISMELVRVGQAYFMFQDKRMYDEATKSRFQCRALNINEDLGQIKYVFSDKTGTLTQNKMEFQCASIWGVDYSSKENNSMERDEVVEHSVKVDGKVFRPKMKVKVNPELLQLSRSGLQNVEGKRIHDFFLAMATCNTIVPLVVDTPDPDVKLIDYQGESPDEQALAYAAAAYGFMLTERTSGHIVIDIHGQRQKFNVLGLHEFDSDRKRMSVILGYPDNSVKVFVKGADTSMLNVIDKSFKMDLVRATEAHLHSYSSMGLRTLVIGMRDLNASEFEQWHGSFEAASTAVFGRAVMLHKVSSIVENNLTILGASAIEDKLQQCVPESIESLRIAGIKVWVLTGDKQETAISIGYSSKLLTSNMTQIIINSKNRESCRKSLQDALVMSKKLMSTSDVANNAGGSSHATPVALIIDGTSLVHILDSELEEQLFQLASRCSVVLCCRVAPLQKAGIVALVKNRTSDLTLAIGDGANDVSMIQMADVGVGISGQEGRQAVMASDFAMGQFRFLVPLLLIHGHWNYQRLGYMILYNFYRNAVLVLVLFWYVLYTAFTLTTAINEWSSTLYSIIYSSLPTIIVGILDKDVGKRTLLKYPQLYGAGQRHVAYNKKLFLLTMLDTLWQSMVIFWAPLFAYWSSTVDVASIGDLWTLGVVILVNLHLAMDVIRWYWVTHAVIWGSIVATFISVMIIDAIPNLPGYWAFFDAAGTGLFWLLLLGIIVAALLPRLVVRFVYQYYFPNDIQICREAEKIGYERVVESGHIEMLPI

SEQ ID NO: 163239 - protein, 80 aa, Glycine max
  Coding DNA Sequence Number=SeqID_46461
MSGGGGSSNRHGSGAGIILEGLNNVALPQSLCFKFKATNNHAEYEVVLAGLRLAKDVGGEGSNAKVILRLHQNKLTKSSK

SEQ ID NO: 163240 - protein, 60 aa, Glycine max
  Coding DNA Sequence Number=SeqID_46462
MAKSHNILRGSEVVFEMQAHVLAKEFSLKRVLEFLNLFFYKKSVVTRGMDFKLSEVFTAE

SEQ ID NO: 163241 - protein, 47 aa, Glycine max
  Coding DNA Sequence Number=SeqID_46463
MEKSTTKGKDEIDRKWKGMCHTQHSDKSSEESPHRLDLLPLESSAPS

SEQ ID NO: 163242 - protein, 568 aa, Glycine max
  Coding DNA Sequence Number=SeqID_46464
  Gene Ontology: Mol. function=DNA-directed RNA polymerase activity; Cellular component=nucleus; Biological process=transcription
  Homolog annotation: Hit_ID=Q66JI8; Match level="QueryCoverage=68%, HitCoverage=77%, E-value=4e-27, Identity=26%"; Hit description =Polr3e protein
  Pfam annotation: Domain name=Sin_N; Domain location=101-501; Score =344.5; E_value=1.8e-100; Accession=PF04801.4; Description=Sin-like protein conserved region
MDFDDLEEAPIKATSRVSKFAPKSSKLKPKPKSEPAPPKPEPQPPISKPEPQEFVAATVKKNEDDGVETVPPTHTKPELDATVKMEEAEDEPESVRDDPIDEDIPEEDTVVREIDVFFSPSVDAQTQLYVFQYPLRPSWRPYDLDEQCEEVRLKTKTSEVEIDLSIDLDSDHIDKEFATKYNITKQTLSTTWKPSHANGCAVGLLMGDKLHLHPVHAVVQLRPTLQHLNSGGSKRKNAASTGANATVKIEGSNEEKSVATSKKQNKQTGPSIIEQKSDGDECWVPLKYHSCKSDISSRYLQQMVTQESSPINFTMRAYDYVTALCPGGSSNNLPKGLSKRYLLSLPVEERLKKMLEDRPLHRFSAIKHFAPEYSENELLGFLQQHAILVWGLWTAKSSLLYPDGGVETLARDYSLLLFSKSLKVQFSDVSIRGGELVNRVRNCLKIFGVERNDLDKSTGKPNPYWKFRELPDESFKKLYPDIVEKQEELFKGLEKQLSGFSSNVGKRKIGKNAVANQGVNTEVHKSESSDQRVTSLGRVPPAKMTMSNETRHALPIALKKLFQTHKVC

SEQ ID NO: 163243 - protein, 485 aa, Glycine max
  Coding DNA Sequence Number=SeqID_46465
  Gene Ontology: Mol. function=sequence-specific DNA binding; Cellular component=nucleus; Biological process=regulation of transcription, DNA-dependent
  Homolog annotation: Hit_ID=O81821; Match level="QueryCoverage=96%, HitCoverage=93%, E-value=7e-84, Identity=42%"; Hit description=Heat shock factor protein 3
  Pfam annotation: Domain name=HSF_DNA-bind; Domain location=13-208; Score=262.4; E_value=9.1e-76; Accession=PF00447.8; Description=HSF -type DNA-binding
MEGASRNGSVCVAPFLSKTYDMVDDPSTDSVVSWGKNNNTFVVWNVPQFTTDILPKHFKHNNFSSFVRQLNTYELKSGKLVRTMIETAYARCLVGFRKVDPDRWEFANEGFLRGEKQLLKSISRRKSAHVNGSQQPSQVHKSAVRACVEVGKFGFEEEVERLKRDKNVLMQELVRLRQKQQGTDNQLKNVGQRVQSMEQRQQQMMSFLAKAMQSPCFIAQFVQQQNESSKHIPGSNKKRRLQRQEEDSLATKDLHSSLEGHTVKYQSSINEAAKALFLQILQINNSTTQSSIKSPDVFLIDDVPSAIASDSSSSSTQVSNVMVPPISELTSMEVGSQFPLNCMPSNISELQSSPAVLGFCRNQGMETESSLLNHDLNVMGADTRNMGEIDMMSTVLDEADEANHFSPDTDGISKLPEISDEFWELLLRPSPLTEGTEETKCSSLGCGLTDDQGLPSEMENKQENFDKILHVDHLTQQMGLHALDY

SEQ ID NO: 163244 - protein, 74 aa, Glycine max
  Coding DNA Sequence Number=SeqID_46466
MAAEHAKAEAAGGGQRRACGGSGLTRLTCGVREAGRGEPIYLIHASLARNGLIRLTIPICDHLHPCFPLLLTGF

SEQ ID NO: 163245 - protein, 91 aa, Glycine max
  Coding DNA Sequence Number=SeqID_46467
MAITVFFRRKASLMSMTMSRSTGRKRGGRGGFEQLRDESEEKVNEKDVRFSVVGGIELGEVKKVMDSGHDLVIIGEVDVEGRRPWRLRRST

SEQ ID NO: 163246 - protein, 416 aa, Glycine max
  Coding DNA Sequence Number=SeqID_46468
  Gene Ontology: Mol. function=protein kinase activity; Biological process=protein amino acid phosphorylation
  Homolog annotation: Hit_ID=Q1SDD6; Match level="QueryCoverage=88%, HitCoverage=92%, E-value=1e-158, Identity=77%"; Hit description =Protein kinase
  Pfam annotation: Domain name=Pkinase; Domain location=92-411; Score= -100.9; E_value=0.015; Accession=PF00069.15; Description=Protein kinase domain
  Subcellular localization annotation: CTP_CleavageSite=25; ConfidenceScore=5.60e-01
MVVVVPLDWLSFQHCLRNRTTHLPLSSRFTTTTTTSLCFHSPIIQAKLPFFTNSDSFQVGRPIGTYGFINVTSYSAFPSGPGTDYSLEDLGGLKTQDVGEGNVKIRLYEGRVSRGPLTGTPVTFKVVYPGRRAGGVVADALAANELNTHLFLQSSSKGIGQNLVLLVGGFETTTGEQWLAFRDDGKYNAADYAKLASERVSRDREGSSWNPFEQGLTTKRRQNFIIKMLQGVMKGLAYLHDHDRLHQSLGPFSVVLNTISEREGSYLIPRLRDLAFSVNVRYTELDDSGQLVEGLWRRATGAGAFTQMEKRAFGIADDIYEAGLFFAYMAFVPFCEAGVMDSLSLQRLLENTFQLDLEATREYCLADDRLVNAVEFLDLGDGAGWELLQAMLNADFRKRPTAEAVLNHRFMTGAVL

SEQ ID NO: 163247 - protein, 88 aa, Glycine max
  Coding DNA Sequence Number=SeqID_46469
  Gene Ontology: Mol. function=enzyme inhibitor activity
  Homolog annotation: Hit_ID=Q1RYM1; Match level="QueryCoverage=92%, HitCoverage=46%, E-value=2e-19, Identity=57%"; Hit description =Pectinesterase inhibitor
MMTTPSPAIVQCATSLYDGTIGSFKSSLSELAEDGQTANYDAKVAGDGPTTCDIALSNAKIVNPTISALNKDILLISKLAFLATDKLP

SEQ ID NO: 163248 - protein, 492 aa, Glycine max
  Coding DNA Sequence Number=SeqID_46470
  Gene Ontology: Mol. function=hydrolase activity, acting on glycosyl bonds; Biological process=metabolic process
  Homolog annotation: Hit_ID=UPI0000526CB3; Match level="QueryCoverage =43%, HitCoverage=68%, E-value=3e-70, Identity=62%"; Hit description =binding-protein-dependent transport systems inner membrane component
LVRVDGDLSAAVVDIDRAVIVHDPGGTVREEQQQPVVGHDGGGADLDERLVPGAWRRRVHRLGVGRPGGPVDEVVAGRPVDRPLTEVHPPLPVHLLRHDDPGLGPVEAARVQGLERVEVVEQRTVLGPGAQVGRGGQAQLGAVPIPARVGEVVGAVDERDARVLAAVPLVVLRWRQDRRVLAGEGHPVLRPCQADVGDDVVGVRAVQEYHLVAVDERGGVVQVRRFPAVAARAQDRVALVGRERTEGEGGSGEHAGPFWVRMCEALEHDEQDDDGERERCCPGEDGAVGVRRGLGHVGDVVRERHRQRLQARVLGDEEGPQELVPGSDERHEHDGHQHRADERDRDRGEQADLPGAVDTGGFEDLHRQRLEELHEDEHRRRVDEERQDHAQVRVAQAVVPGDLHVERDHQQLERHHLHQQHQHPDHAAPPEVEAGDGVAGEQTEYHGAQQHPCREDQRVRERADQVDARVDRDEVVDGPPARREQLVGGVRR

SEQ ID NO: 163249 - protein, 57 aa, Glycine max
  Coding DNA Sequence Number=SeqID_46471
MSEIRRFGGLGMEERRERKRGCAGISGKCDIYRAGRVAICSSVIDYSIHVIDHQNKE

SEQ ID NO: 163250 - protein, 117 aa, Glycine max
  Coding DNA Sequence Number=SeqID_46472
MSYRMSRHHASEHADYMCPYEQPLFTTFSPNHYPCDLYLRATLRYEKPRSLPLKHSPVFTIKSKTHQRSTLNKRDQPYTLEINSTHKRSTLHTQVQHLMLGYHQGGSQNTQVPKLTK

SEQ ID NO: 163251 - protein, 219 aa, Glycine max
  Coding DNA Sequence Number=SeqID_46473
  Homolog annotation: Hit_ID=Q1SZU3; Match level="QueryCoverage=94%, HitCoverage=61%, E-value=3e-83, Identity=74%"; Hit description=NERD
VEEARKQASILQSYLEQRGVALPEGYISCKVILPNPKLCTVPADGFPSEVITHDQWTRLKPEPKSMLSSWVKGAFRSGKKDMQESVNQNLDFVLCSAPIWDSFSLTKEIVYRVQLKGNKYVLGEFLEFKGKQEDVEALRHIRRSKVGRIIIQKTSMFGLAPSRLQVLYSLRDYRTEGASEPEWKEVTVRSSTEIVFQPENASKVRKFKLSSVSSMLLSA

SEQ ID NO: 163252 - protein, 162 aa, Glycine max
  Coding DNA Sequence Number=SeqID_46474
  Homolog annotation: Hit_ID=Q1RSQ2; Match level="QueryCoverage=68%, HitCoverage=37%, E-value=1e-09, Identity=35%"; Hit description =Cyclin-like F-box; F-box protein interaction domain
MATHTKRLVFLTPRACEFRSIDFNASVHDDSASTALKLGFLPTKSYYVRILGVHEQLSYSPVAFDMDVRFFTFLYGFGYDSSTDDYLVVQASNNPSLDDYTTRLEFFSLRANVCKELEDYCLQEHRFYCNGPNGYEVAVYTESLLSLPTYISQLAVKQEEDD

SEQ ID NO: 163253 - protein, 198 aa, Glycine max
  Coding DNA Sequence Number=SeqID_46475
  Homolog annotation: Hit_ID=Q5ZC72; Match level="QueryCoverage=87%, HitCoverage=34%, E-value=4e-30, Identity=41%"; Hit description=Light stress-responsive one-helix protein-like
GGFFSSSASGYTKGLALLLLGQRSDDKSMRVLPWNQFHLGQESDHELQLASRKNRVSSGCASFVCFGRVSAGFDTTSHLKVGPAKHHDVSSGTLVSNKGKYPSANVNDDSRKVALKSSLKRKQNKKPAPVEAATEHEASSGGKRKVQWTDTCGSELVEIREFEPRFQLPKSRHLVGYAYDAPLNRFICISFQDIGNQL

SEQ ID NO: 163254 - protein, 90 aa, Glycine max
  Coding DNA Sequence Number=SeqID_46476
  Homolog annotation: Hit_ID=O64580; Match level="QueryCoverage=79%, HitCoverage=61%, E-value=4e-07, Identity=43%"; Hit description =Expressed protein
MEKNNSLPKYSCSYSEFGFAERSNSYNFNGPIQKGSGFCAANDPELKRKKRIKAYNVFTVEEKLKTSVRNGFKWIKDKFGDIHSGGKKIE

SEQ ID NO: 163255 - protein, 126 aa, Glycine max
  Coding DNA Sequence Number=SeqID_46477
  Homolog annotation: Hit_ID=Q8S268; Match level="QueryCoverage=77%, HitCoverage=43%, E-value=5e-09, Identity=41%"; Hit description =Putative holocarboxylase synthetase
MNELDYCGEEPSMSPRAPLQHQQSQPALHAPSFPVTSASSGQTIVAQGLRSDHCENQSKNYVFSNALSSPICRSLQHYQIGEGGCYTNGLSMGNGNWNTEPGFLHQQSRDSNAMSSNDSNMDMHAD

SEQ ID NO: 163256 - protein, 1016 aa, Glycine max
  Coding DNA Sequence Number=SeqID_46478
  Gene Ontology: Mol. function=binding; Cellular component =mitochondrion; Biological process=metabolic process
  Homolog annotation: Hit_ID=Q1SZV4; Match level="QueryCoverage=95%, HitCoverage=90%, E-value=0.0, Identity=76%"; Hit description =Pentatricopeptide repeat
  Pfam annotation: Domain name=PPR; Domain location=178-212; Score =10.8; E_value=0.39; Accession=PF01535.11; Description=PPR repeat
  Pfam annotation: Domain name=PPR; Domain location=213-247; Score =31.3; E_value=3.3e-06; Accession=PF01535.11; Description=PPR repeat
  Pfam annotation: Domain name=PPR; Domain location=280-314; Score =37.4; E_value=5e-08; Accession=PF01535.11; Description=PPR repeat
  Pfam annotation: Domain name=PPR; Domain location=315-349; Score =27.4; E_value=5e-05; Accession=PF01535.11; Description=PPR repeat
  Pfam annotation: Domain name=PPR; Domain location=350-384; Score =38.8; E_value=1.9e-08; Accession=PF01535.11; Description=PPR repeat
  Pfam annotation: Domain name=PPR; Domain location=426-460; Score =30.9; E_value=4.5e-06; Accession=PF01535.11; Description=PPR repeat
  Pfam annotation: Domain name=PPR; Domain location=461-495; Score =38.2; E_value=2.8e-08; Accession=PF01535.11; Description=PPR repeat
  Pfam annotation: Domain name=PPR; Domain location=496-530; Score =47.6; E_value=4.3e-11; Accession=PF01535.11; Description=PPR repeat
  Pfam annotation: Domain name=PPR; Domain location=531-565; Score =44.0; E_value=5.1e-10; Accession=PF01535.11; Description=PPR repeat
  Pfam annotation: Domain name=PPR; Domain location=566-600; Score =30.8; E_value=4.9e-06; Accession=PF01535.11; Description=PPR repeat
  Pfam annotation: Domain name=PPR; Domain location=617-651; Score =44.0; E_value=4.9e-10; Accession=PF01535.11; Description=PPR repeat
  Pfam annotation: Domain name=PPR; Domain location=652-686; Score =41.9; E_value=2.1e-09; Accession=PF01535.11; Description=PPR repeat
  Pfam annotation: Domain name=PPR; Domain location=687-721; Score =37.9; E_value=3.5e-08; Accession=PF01535.11; Description=PPR repeat
  Pfam annotation: Domain name=PPR; Domain location=722-756; Score =46.1; E_value=1.2e-10; Accession=PF01535.11; Description=PPR repeat
  Pfam annotation: Domain name=PPR; Domain location=757-791; Score =47.5; E_value=4.6e-11; Accession=PF01535.11; Description=PPR repeat
  Pfam annotation: Domain name=PPR; Domain location=792-826; Score =22.4; E_value=0.0016; Accession=PF01535.11; Description=PPR repeat
  Pfam annotation: Domain name=PPR; Domain location=860-894; Score =10.4; E_value=0.44; Accession=PF01535.11; Description=PPR repeat
  Pfam annotation: Domain name=PPR; Domain location=897-931; Score =31.6; E_value=2.8e-06; Accession=PF01535.11; Description=PPR repeat
  Pfam annotation: Domain name=PPR; Domain location=932-966; Score =12.6; E_value=0.24; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR::PPR::PPR; Domain location=178-212::213-247::280-314::315-349::350-384::426 -460::461-495::...
  Pfam module annotation: Domain location=496-530::531-565::566 -600::617-651::652-686::687-721::722-756::757-791::792-826::860 -894::897-931::932-966
VCVVLVIMRKRELNSLASRSLQFLKPKPFSTSSSHHPLPGLLPPEETSPLDSSPDLSQHYAFLRTSLLNSATTQTSNDALSISNAIRTGFGAETQNFLRQFRGRLSEPLVVEVMNLVKHPEFCVEFFLWASRQIGYSHTPVVYNALIELLCCNAVNNDRVSHKFLMQIRDDDRELLRKLLNFLIQKCCRNGMWNVALEELGRLKDFGYKASPTTYNALIQVFLRADKLDTAFLVHREMSNSGFRMDGCTLGCFAYSLCKAGRCGDALSLLEKEEFVPDTVFYNRMVSGLCEASLFQEAMDILDRMRSISCIPNVVTYRILLSGCLGKGQLGRCKRILSMMMTEGCYPNREMFNSLVHAYCKSRDYSYAYKLFKKMIKCGCQPGYLLYNIFIGSICSNEELPGSDLLELAEKAYSEMLDLGVVLNKVNVSNFARCLCGAGKFDKAFEIICEMMSKGFVPDDSTYSKVIGFLCDASKVEKAFLLFEEMKKNGIVPSVYTYTILIDSFCKAGLIQQARNWFDEMLRDNCTPNVVTYTSLIHAYLKARKVFDANKLFEMMLLEGSKPNVVTYTALIDGHCKAGQIDKACQIYARMQGDIESSDIDMYFKLDDNDCETPNIITYGALVDGLCKANRVEEAHELLDTMSVNGCEPNQIVYDALIDGFCKTGKLENAQEVFVKMSERGYCPNLYTYSSLINSLFKEKRLDLVLKVLSKMLENSCTPNVVIYTDMIDGLCKVGKTEEAYRLMLKMEEVGCYPNVITYTAMIDGFGKIGKIEQCLELYRDMCSKGCAPNFITYRVLINHCCSTGLLDEAHRLLDEMKQTYWPRHISSYRKIIEGFNREFITSIGLLDELSENESVPVESLYRILIDNFIKAGRLEGALNLLEEISSSPSLAVANKYLYTSLIESLSHASKVDKAFELYASMINKNVVPELSTFVHLIKGLTRVGKWQEALQLSDSICQMVCHVCSNFVNYKTTRALPLCIKHFLISTGFMKRYQCELVSDAQNCRLNGSSVTEGK

SEQ ID NO: 163257 - protein, 200 aa, Glycine max
  Coding DNA Sequence Number=SeqID_46479
  Gene Ontology: Mol. function=transferase activity; Cellular component= integral to membrane; Biological process=metabolic process
  Homolog annotation: Hit_ID=Q10QG7; Match level="QueryCoverage=92%, HitCoverage=78%, E-value=2e-38, Identity=42%"; Hit description =Expressed protein
MKYKSLHSGKVRYLAIVIESEEAYQISKVVKLSQWLDSIGVKNVCLYDMNGMKSIKSVQEVSEVVTLHAPDHMTLEFLSYLDGKEAVAKAANLIFVENSKRHNLGGELDLQILLEPQMNKALQIVGSKGPEPDLLLVYGPVRSHLGFPAWRLRYTEIIHMGSLNFMRYGSLMKVINNFTKVHQNYGKYSLYRVIYWSAMV

SEQ ID NO: 163258 - protein, 219 aa, Glycine max
  Coding DNA Sequence Number=SeqID_46480
  Gene Ontology: Mol. function=zinc ion binding; Cellular component =intracellular
  Homolog annotation: Hit_ID=Q0VJB4; Match level="QueryCoverage=62%, HitCoverage=58%, E-value=5e-51, Identity=72%"; Hit description =Putative zinc-binding protein
  Pfam annotation: Domain name=PLATZ; Domain location=1-69; Score =118.7; E_value=1.6e-32; Accession=PF04640.4; Description=PLATZ transcription factor
SYHDVIRVSEIQKFLDIAGVQTYIINSAKIVFLNERPQPRPGKGVTNTCQVCERNLLDSFSFCSLGCKIVGTSKKFRKKKMLAETEGSNGEESINGISNESGRNKIQSFTPSTPPPTVVNYRTAKRRKGVPHRAPMGGDLPNHNYTLKDTTVVSSATSLSGNICLVKVTIPEPLFTEAGVGKWFTILYSRCKNSSKIIRIGIRCAMYKVACRKLLYFTQ

SEQ ID NO: 163259 - protein, 104 aa, Glycine max
  Coding DNA Sequence Number=SeqID_46481
MEVEESSKGSQKEAKGKKTTLETKIREMTSTIPDHCAFLLTASLSNDSKKSNQGYFPSSLHLKHGPKSLAAKKMNLACKCLITNRSLKPTLKLCSQMIGGKTSC

SEQ ID NO: 163260 - protein, 753 aa, Glycine max
  Coding DNA Sequence Number=SeqID_46482
  Gene Ontology: Mol. function=binding; Cellular component =intracellular; Biological process=metabolic process
  Homolog annotation: Hit_ID=Q5G1T1; Match level="QueryCoverage=92%, HitCoverage=96%, E-value=1e-127, Identity=29%"; Hit description =Embryo-defective 2261
  Pfam annotation: Domain name=PPR; Domain location=146-180; Score =37.6; E_value=4.3e-08; Accession=PF01535.11; Description=PPR repeat
  Pfam annotation: Domain name=PPR; Domain location=181-215; Score=2.5; E_value=3.8; Accession=PF01535.11; Description=PPR repeat
  Pfam annotation: Domain name=PPR; Domain location=247-281; Score =23.0; E_value=0.0011; Accession=PF01535.11; Description=PPR repeat
  Pfam annotation: Domain name=PPR; Domain location=282-316; Score=2.5; E_value=3.8; Accession=PF01535.11; Description=PPR repeat
  Pfam annotation: Domain name=PPR; Domain location=348-382; Score =43.0; E_value=1e-09; Accession=PF01535.11; Description=PPR repeat
  Pfam annotation: Domain name=PPR; Domain location=449-483; Score =45.5; E_value=1.9e-10; Accession=PF01535.11; Description=PPR repeat
  Pfam annotation: Domain name=PPR; Domain location=484-517; Score =10.0; E_value=0.49; Accession=PF01535.11; Description=PPR repeat
  Pfam annotation: Domain name=PPR; Domain location=520-554; Score =22.8; E_value=0.0012; Accession=PF01535.11; Description=PPR repeat
  Pfam annotation: Domain name=PPR; Domain location=586-620; Score =19.8; E_value=0.0096; Accession=PF01535.11; Description=PPR repeat
  Pfam module annotation: Pfam domain module=PPR::PPR::PPR::PPR::PPR::PP R::PPR::PPR::PPR; Domain location=146-180::181-215::247-281::282 -316::348-382::449-483::484-517::520-554::586-620
MSSITCQCSWLLSNDARHANFAQIPSWVSLKSTHSSFRTHQNQQGQVENLHLISLAKQGKLRQVHEFIRNMDIAGISINPRSYEYLFKMCGTLGALSDGKLFHNRLQRMANSNKFIDNCILQMYCDCKSFTAAERFFDKIVDRDLSSWATIISAYTEEGRIDEAVGLFLRMLDLGIIPNFSIFSTLIMSFADPSMLDLGKQIHSQLIRIEFAADISIETLISNMYVKCGWLDGAEVATNKMTRKSAVACTGLMVGYTQAARNRDALLLFSKMISEGVELDGFVFSIILKACAALGDLYTGKQIHSYCIKLGLESEVSVGTPLVDFYVKCARFEAARQAFESIHEPNDFSWSALIAGYCQSGKFDRALEVFKTIRSKGVLLNSFIYNNIFQACSAVSDLICGAQIHADAIKKGLVAYLSGESAMITMYSKCGKVDYAHQAFLAIDKPDTVAWTAIICAHAYHGKASEALRLFKEMQGSGVRPNVVTFIGLLNACSHSGLVKEGKQFLDSMTDKYGVNPTIDHYNCMIDIYSRAGLLLEALEVIRSMPFEPDVMSWKSLLGGCWSRRNLEIGMIAADNIFRLDPLDSATYVIMFNLYALAGKWDEAAQFRKMMAERNLRKEVSCSWIIVKGKVHRFVVGDRHHPQTEQIYSKLKELNVSFKKGEERLLNEENALCDFTERKDQLLDHSERLAIAYGLICTAADTPIMVFKNTRSCKDCHEFAKRVSVVTGRELVVRDGNRFHHINSGECSCRDYW

SEQ ID NO: 163261 - protein, 100 aa, Glycine max
  Coding DNA Sequence Number=SeqID_46483
  Homolog annotation: Hit_ID=Q6Z8A4; Match level="QueryCoverage=54%, HitCoverage=21%, E-value=2e-24, Identity=81%"; Hit description =Putative zinc-binding protein
  Pfam annotation: Domain name=PLATZ; Domain location=45-99; Score= -12.2; E_value=7.7e-05; Accession=PF04640.4; Description=PLATZ transcription factor
  Pfam annotation: Domain name=zf-B_box; Domain location=44-84; Score =6.2; E_value=0.027; Accession=PF00643.14; Description=B-box zinc finger
  Pfam module annotation: Pfam domain module=PLATZ::zf-B_box; Domain location=45-99::44-84
MGGGGGAIGVRGLNEDDDDIGKIEEENKWPPWLRPLLQTSFFVQCKVHADSHKSECNMYCLDCMNGALCSACLASHREHRAIQGFEPPKSQNSRIWMPVI

SEQ ID NO: 163262 - protein, 894 aa, Glycine max
  Coding DNA Sequence Number=SeqID_46484
  Gene Ontology: Mol. function=zinc ion binding
  Homolog annotation: Hit_ID=Q2QSD0; Match level="QueryCoverage=71%, HitCoverage=47%, E-value=9e-44, Identity=26%"; Hit description=PHD -finger family protein, expressed
  Pfam annotation: Domain name=C1_3; Domain location=250-280; Score =5.9; E_value=0.1; Accession=PF07649.3; Description=C1-like domain
  Pfam annotation: Domain name=PHD; Domain location=251-300; Score =25.4; E_value=0.00016; Accession=PF00628.19; Description=PHD-finger
  Pfam module annotation: Pfam domain module=C1_3::PHD; Domain location= 250-280::251-300
MRLESGTCNVCSAPCSSCMHLNHALMGSKAEEFSDENCRIGEANSMDEDNACSLRSRACESSQHTVSETSNMQSVNSSHDALSENADSRQIIPNKYQDSKHLEGHDDNTSCISRASDANLVNDSHQRNEERIIMHVERDSCSHVPEKLSECFIENSSSSLTKEREPVVSGKKYIAVKDGLIESTSKISLKVCPKSEADTDVCDANNEDPKCAVQDGQCEKAEELVKSPGKQEPQSEDESDESDVVEHDVKVCDICGDAGREDLLAICSRCSDGAEHTYCMREMLEKVPEGDWLCEECKDAEENEKKRLDVDDKKMVEVSSTSQVSGKRLSDNIEVAPAAKRQALESSTGSPKTSSPKRLVPVSRESSFKSLDKSKVKPGLLMPIRNHSGCYDTEIARSPSIGSRGQNPKGMLLKSNSFNNLNSKPRVKLVDEVVPQKQKGGNEHTSKNMEMPARVTGKSTLFKSSSLGRSNATESKVKMLSPKSATTQDLKGSRHLKESGAFDRKFPSRIDRPVASSVVSSPKGDQKLTPHAESNKASAMNNNRELKVNQDGKSSALSRSMSNISRKSLEPQVSSERTSTRVDETQQDVLPRSRETANQVEKSRNSSSDRGRPAVPTSKNQFCQKCKEFGHALECCTAVSTQESGAEISVTASSSSKEEMHKDNTLKAAIQAALLRRPEIYKKKEVSNQTDEVSTAGTELNCEVTSRDQVLVSSTLKNSISADETQEREILENSTSDSSKCSSANGLKQLNSCPTDFRSQPGKSDSIGLATGKPVVRDLSNKALTMSSVPLKMLAFPEYEYTWQGVFEVHRNGKPPDIYTGLQAHLSSCASPKVLGVVNKFLPKVSLSEISRLSMWPSQFHHGGVSDDNIALYFFARDVERQADGYYSYIDSRP

SEQ ID NO: 163263 - protein, 37 aa, Glycine max
  Coding DNA Sequence Number=SeqID_46485
  Homolog annotation: Hit_ID=Q9M450; Match level="QueryCoverage=100%, HitCoverage=10%, E-value=5e-07, Identity=67%"; Hit description =Serine carboxipeptidase
MKWSGQKAFRTSPTMKFVVDGAEAGSLNSYGPLSFLK

SEQ ID NO: 163264 - protein, 1029 aa, Glycine max
  Coding DNA Sequence Number=SeqID_46486
  Gene Ontology: Mol. function=nucleic acid binding; Cellular component= intracellular; Biological process=DNA integration
  Homolog annotation: Hit_ID=Q1T010; Match level="QueryCoverage=93%, HitCoverage=79%, E-value=0.0, Identity=47%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=259-422; Score =170.9; E_value=3.1e-48; Accession=PF00665.16; Description=Integrase core domain
  Pfam module annotation: Pfam domain module=RVT_2::rve; Domain location=553-785::259-422
EEVVLEEEVVVGTIEEEVAMLLEVEEVRIMLKINLISRREAGAEATIEVVAMVEEEVGHFADECYAKKDSQGDEANLAKGDDEENELVMLMVTTADEMCTINEWYLDTGCSTHMNGHKEWLVNFDASKKNRIKFADGRAMLAEGVGNVMIKMPNGTQYCISGVFYVPGLESNLLSLGQLVEKGHKVIMEDKKLKLFDSGGKNSLIFDVSMSRNRTFRANLEALCHKCLVAVVNEDDWVWHHRYGHLNFRDLHDLNTHNMEREKLEVIYSDVCGPMQCESLGESRYFVSFLDDFTRKIWVYILKRKSEVLGVFKKFKRMVERQTGFLIKTIVTDGGGEYTSNEFDEFCELEGIVHDVTPPYTPQHNGAAERRNQTVMNMVRCMLNGKKLPKFLWAEAVSTAVYVLNRSPTKRLNKITPEEACEIMILLGYHATGGYKWFNPITKEVLVSRDVVVDESKDWNWDKEMVEEPTKVVIEASIDEPSDSSAAVIDDSYQGGVRKSQRARQPSSRLQDYELIHDSAIGEEGELVHLTLFAESKSVSLEEAMNDTKWTDAMKEELKAIEKNNTWQLVPLPAKKKSIVVKWVYKVKKNPKGEISKYKARLVAKGFLQKAGIDFKEVFAPVARMETVRIITAIASQKGWHMHHMDVKSTFLNGPLEEEVYVSQPPGFEIKGSEEKVYRLNKALYGLKQAPRAWNRRIDGFLMKLGFLKCTTEHGNNETEIANFKGEMMREFEMTDLDLISYFLGIEFKRTDEGVIMHQGRYARDVLKKFRMVDCNSADTPTATGVNLVKDPNEEEVDVTLYRQMVGSLRYLCCTRPDLLYAVGLISRYMENPKLSDFRAAKRIMRYVKGTLDYGILFPSAAKKCNVLGYSDSDWCRDKSDRKSTTGYVFFYGDAPISWSSKKEQVVALSSCEAKYIAAAMAACQAQWLDNIFGELKMKENGAITLMVDNKSAINLAKHPVAHGRSKHIETRFHFLREQVTKGKLSVKYCPTTVQVADIFTKPLKIDRFKELRSRLGVIEDRYRIKGEY

SEQ ID NO: 163265 - protein, 231 aa, Glycine max
  Coding DNA Sequence Number=SeqID_46487
  Gene Ontology: Mol. function=serine-type endopeptidase activity; Cellular component=mitochondrion; Biological process=proteolysis
  Homolog annotation: Hit_ID=Q9S834; Match level="QueryCoverage=64%, HitCoverage=50%, E-value=4e-67, Identity=84%"; Hit description=ATP -dependent Clp protease subunit ClpP
  Pfam annotation: Domain name=CLP_protease; Domain location=103-229; Score=66.6; E_value=8.1e-17; Accession=PF00574.13; Description=Clp protease
  Subcellular localization annotation: CTP_CleavageSite=58; ConfidenceScore=5.78e-01
MGHTSLFTPSSSLRFNSLLVSSTPSSSSRSNSVSFPALSRNIRKSVEDRKINKNSAVKAVYGDEFWTPARSSPQDIWSIRSDLQVPSSPYFPTYAQGQGPPPMVAERFQSVISQLFQYRIIRCGGAVDDDMANIIVAQLLYLDAVDPNKDIVMYVNSPGGSVTAGMAIFDTMRHIRPDVSTVCVGLAARSSLETLMRRVDYMVFSRVRRGRGKPKRGLEEIVKTLKESHDE

SEQ ID NO: 163266 - protein, 110 aa, Glycine max
  Coding DNA Sequence Number=SeqID_46488
  Gene Ontology: Mol. function=serine-type endopeptidase activity; Cellular component=membrane fraction; Biological process=proteolysis
  Homolog annotation: Hit_ID=Q9S834; Match level="QueryCoverage=74%, HitCoverage=27%, E-value=7e-41, Identity=97%"; Hit description=ATP -dependent Clp protease subunit ClpP
  Pfam annotation: Domain name=CLP_protease; Domain location=1-73; Score=15.3; E_value=1.6e-09; Accession=PF00574.13; Description=Clp protease
MIHQPLGGAQGGQTDIDIQANEMLHHKANLNGYLAYHTGQSLDKINQDTDRDFFMSAKEAKEYGLIDGVIMNPLKALQPLEAAAEEFILTEGSLMEPECDFNFKHSFVMN

SEQ ID NO: 163267 - protein, 700 aa, Glycine max
  Coding DNA Sequence Number=SeqID_46489
  Gene Ontology: Mol. function=protein binding; Cellular component =nucleus; Biological process=regulation of transcription, DNA -dependent
  Homolog annotation: Hit_ID=Q76I94; Match level="QueryCoverage=99%, HitCoverage=82%, E-value=1e-167, Identity=47%"; Hit description =PHCLF3
  Pfam annotation: Domain name=SET; Domain location=74-672; Score=42.6; E_value=1.4e-09; Accession=PF00856.18; Description=SET domain
MAEDQSVVGRRRIYYDQHGSEALICSDSEEELTGPEEEKHEFSEAEDRVIWMAFEEYGLNDEVLNIVSEFVGGTSLEIQERYKTIKEKNIGRLDQPSENSGEYESIIGICPEKSLSAALDSFDNLFCRRCLIFDCRLHGCSQPLIYPSEKQTVWSDPEGDRKPCSDQCYLQQLKVVKNVTEDSTSGSDQNKRTTITEEADVKLAPSIIEEPSNQSIAPFPTEVDCLGSLNLNVPISVSVEKWKVPNQSDTALRDSSLPPDDSQHSYKKLKTISDDVVTANSDSSKNINFGACDESIHTITSGLLDKSVKDNSNKLIDSSSTCCSDEQDKSIGDGPKDPTNKTEFKKLSNSMEGKVDGMLRVSDWKPLEKELYLKGVEMFGRNSCLIARNLLSGLKTCMEISSYMHSGGVSMPHGSIVAPSSIMEDKGKFDAECTVRGGLEMPSRSRLLRKRGKTRKFKYSWKSAGHPSIWKRIADGKNQSCKQYTPCGCQSMCGKECTCVNGGTCCEKYCGLDKCNKLALLPSVVLKAAKIGLEDAIVPRVSVEVDNAHALLQDGNVTQMSVGIAGCGDGSLGEPPRRGEGQCGNMRLLLRQQQRILLSKSDVAGWGAFLKYVLDAYRKGDKLKFANHSSNPNCYAKVMLVAGDHRVGIFAKEHIDASEELFYDYRYGPDQAPPWARKPEGSKRDESTASQGRAKKHQSH

SEQ ID NO: 163268 - protein, 316 aa, Glycine max
  Coding DNA Sequence Number=SeqID_46490
  Gene Ontology: Mol. function=transcription factor activity; Cellular component=nucleus; Biological process=regulation of transcription, DNA-dependent
  Homolog annotation: Hit_ID=Q1SG54; Match level="QueryCoverage=74%, HitCoverage=41%, E-value=9e-57, Identity=50%"; Hit description=GRAS transcription factor
  Pfam annotation: Domain name=GRAS; Domain location=2-202; Score=1.5; E_value=2.1e-08; Accession=PF03514.5; Description=GRAS family transcription factor
MDTNMAVACHQKIPFNQMMQFSGVQAIVENVASKTKIHLINLDIGCGVQCMALMQALAERQEEQVEILKITAIGLQGKTEPEKTGKRLVSFAESLNLPFLYKVVFVTSIIEIKVEQFGIEDNEAVAVYSPYMLRTMVSDSDSLEHLIRVMRKIRPSIMIILELEAKHHSPTFVNRFIEALFFYSAFSDCIETCMKQDYECRMRIEGILSEGIRNIVAMEDGERMVRNVKIDVWRRFFASSFRKQSQANPKQQNTGTSVTSLTLRGFKFGLPEEDEKEKGFRSKGYEEPQIQSREKDFFDCERANKSPTLPNTTQKI

SEQ ID NO: 163269 - protein, 223 aa, Glycine max
  Coding DNA Sequence Number=SeqID_46491
  Homolog annotation: Hit_ID=Q6ZIK5; Match level="QueryCoverage=74%, HitCoverage=44%, E-value=5e-44, Identity=52%"; Hit description =Putative growth-regulating factor 1
  Pfam annotation: Domain name=QLQ; Domain location=4-40; Score=69.3; E_ value=1.2e-17; Accession=PF08880.1; Description=QLQ
  Pfam annotation: Domain name=WRC; Domain location=68-113; Score =100.8; E_value=3.9e-27; Accession=PF08879.1; Description=WRC
  Pfam module annotation: Pfam domain module=QLQ::WRC; Domain location =4-40::68-113
MSKWPFTISQWQELEHQALIYKYMVAGLPVPPDLVIPIQNSFHSISQTFLHHPSTTMSYCSFYGKKVDPEPGRCRRTDGKKWRCSKEAYPDSKYCERHMHRGRNRSRKPVESQTMTQSSSNVSSLTVTAGSSTSATGNFQNLSTTNAYGNPQGTASGTDQTHYHMDSIPYGIPSNHWMSEWQLFPVYFILITVLGPDVFVQLLNSVAIYENGGVVFDFGYIVA

SEQ ID NO: 163270 - protein, 65 aa, Glycine max
  Coding DNA Sequence Number=SeqID_46492
MADTLDSGGQECNRMEIEFPRRTMNIEVNDQELDGRNTTILEVPTRAGRGGGGDGGGYGGGRRRR

SEQ ID NO: 163271 - protein, 123 aa, Glycine max
  Coding DNA Sequence Number=SeqID_46493
  Homolog annotation: Hit_ID=Q9LZQ0; Match level="QueryCoverage=44%, HitCoverage=85%, E-value=6e-15, Identity=67%"; Hit description =Cytochrome c oxidase polypeptide Vc-2
  Pfam annotation: Domain name=COX5C; Domain location=2-62; Score =134.3; E_value=3.3e-37; Accession=PF05799.2; Description=Cytochrome c oxidase subunit Vc (COX5C)
MAGPRIAHATLKGPSVVKEIIIGITLGLAAGGVWKMHHWNEQRKTRTFYDLLEKGVSLGATVRLLLYDLEVVGLNLGNNLSLCRSKTVLAAFFNIWLQVFVACTKMDSNWLVALAVRESFSIY

SEQ ID NO: 163272 - protein, 208 aa, Glycine max
  Coding DNA Sequence Number=SeqID_46494
  Gene Ontology: Mol. function=sugar binding; Cellular component =membrane; Biological process=defense response
  Homolog annotation: Hit_ID=Q69F75; Match level="QueryCoverage=99%, HitCoverage=100%, E-value=4e-76, Identity=77%"; Hit description =Lectin
  Pfam annotation: Domain name=Lectin_legB; Domain location=2-189; Score=137.4; E_value=4e-38; Accession=PF00139.10; Description=Legume lectin domain
  Subcellular localization annotation: CTP_CleavageSite=62; ConfidenceScore=5.39e-01
MATSKFHTQKPLFVVLSVVVVLLTMTKVNSTKPFLSPGTTRSLGRALYSTPIHIWDSEIGSVASFAASFNFTVYASDIANLADGLAFFLAPIDTQPQTRGGYLGLYNNPSNSSWGLANDQVTNVLITYDASTNLLVASLVHPSQRSSYILSDVLDLKVALPEWVRIGFSATTGLNVASETHDVHSWSFSSNLPFGSSNTNPSDFAIFI

SEQ ID NO: 163273 - protein, 304 aa, Glycine max
  Coding DNA Sequence Number=SeqID_46495
  Homolog annotation: Hit_ID=Q9SLE2; Match level="QueryCoverage=95%, HitCoverage=87%, E-value=1e-98, Identity=63%"; Hit description =Expressed protein
  Pfam annotation: Domain name=SGL; Domain location=35-298; Score= -96.6; E_value=0.0033; Accession=PF08450.2; Description=SMP -30GluconolaconaseLRE-like region
MALCSPRFLTLLLLLSAIPIGIIVTLERAQPATHVYHYHSSGWFRECAKWDSHHRRFIVSFFEGGLGQVKLPEKDSESSSSSPPLEEVTVVRDAHLAGNASLGIAIDPPRNRVLVVNADVIGNRYGALAAYDLSTWNRLFLTQLSSPSDEKSFADDVAVDAEGNAYVTDIKGNKIWKVGVEGKLISIIRNPLFSAKEWYKNLVGLNGIVYHPDGFLIVIHTFSGNLFKIDLTKGEEVKIIKVKGGTLSFGDGLELLSPTKLVVAGNPSGRLVESSDGWNTASVVGTFSGPKHRLASAATVKEGK

SEQ ID NO: 163274 - protein, 401 aa, Glycine max
  Coding DNA Sequence Number=SeqID_46496
  Gene Ontology: Mol. function=serine carboxypeptidase activity; Cellular component=vacuole; Biological process=proteolysis
  Homolog annotation: Hit_ID=Q2Z1Y2; Match level="QueryCoverage=98%, HitCoverage=75%, E-value=1e-167, Identity=68%"; Hit description =Serine carboxypeptidase
  Pfam annotation: Domain name=Peptidase_S10; Domain location=1-394; Score=510.3; E_value=2.1e-150; Accession=PF00450.12; Description =Serine carboxypeptidase
MFYFFFESRNNKDDPVVIWLTGGPGCGSELALFYENGPFHIANNLSLTWNDYGWDQASNILFVDQPTGTGFSYSSEESDIRHDETGISNDLYDFLQEFFKAHPEFVKNDFYITGESYAGHYVPALASRVNQGNKQNQGIHINLKGFAIGNGLTNPAIQYQAYPDFALDNGIITNAEYDNISKLIPGCEQAAKTCENQGGQSCATALYICQNIFSLILDYAGNINFTNCTVLIHKVQYYDIRKKCVGELCYDFGNVEEFLNQKKVKSALGVRDDLQYVLCSTTVHAAMLQDWMRNMEVGIPSLLEDGIKLLVYAGEEDLICNWLGNSRWAHAMEWSGQKAFGTSSTVKFVVDGVEAGSLNSYGPLSFLKVHGAGHMVPMDQPKVALQMLKSWMGGKLNASFY

SEQ ID NO: 163275 - protein, 750 aa, Glycine max
  Coding DNA Sequence Number=SeqID_46497
  Gene Ontology: Mol. function=nucleic acid binding
  Homolog annotation: Hit_ID=Q1STK5; Match level="QueryCoverage=75%, HitCoverage=99%, E-value=4e-84, Identity=57%"; Hit description=Zinc finger, CCHC-type
  Pfam annotation: Domain name=zf-CCHC; Domain location=560-577; Score =13.3; E_value=0.0063; Accession=PF00098.13; Description=Zinc knuckle
  Pfam annotation: Domain name=zf-CCHC; Domain location=601-618; Score =12.9; E_value=0.0075; Accession=PF00098.13; Description=Zinc knuckle
  Pfam module annotation: Pfam domain module=zf-CCHC::zf-CCHC; Domain location=560-577::601-618
SVGNKDKVNTAATAPNLPNDQNGNLTNNWEKIIGDQANIGTDKISGIAGNIISAISGQADQGPFNHLLLQSDENRPSMDQNPSPGRHSDGGVNIGLKKKAVVTDDDLHTAVKPIIEYKGSGAHGTNLASSSRNPLEKLEYSAENDLQTFNCEAGCAGTSEVNVNESENKFQDNEMMLPCDSRIHMAINKGKEKSLSDGDANVILSREENDSHSSVESCNSAGFFSTGKKRRNFQQQLIIGSKRVKKQIEESSGFKSYVKQDSSFMNWISNMVKGLQQSIQNDSNTLALTLTNPDHHNLLPDEKLFTCNMNQDPEPKNTGFKSFFQSIYCPSLKNGGTRMSHQEGKSSDDLEPGNMEHGIDATPITYCAENNSLSKLRLQSNKFEVSIGGNDAGPSSQPKVKPLNFFNCQESSKNNPVETKNYSILGHSKDKEEVASHSSSTKQNTDDNDNIDSNALPDRKEEENICHRRDNLGSLWITRFSPKFTAPLREQPANDTEASTDLKEDKGNNDHKSMYMFKPLSSSPGLRNLEPMASMFARRFSAIKHIIPTNATDTTTQVNMLCLFCGTKGHQLSDCSAIAENKLEDLQKNIDSYGGLEEHSCLCIKCFQPNHWAISCPTSISTRKHELKANALVNDCGKQKHLIPSNEESARLLTDEDDRVLSGGSINDETDQRTGQNINLKLKSNEIITHKVGCNASFQKYCGSSLEENKFRENPISSPSKLTERQISHVPKKIFDAVKKLQLSRTDILK

SEQ ID NO: 163276 - protein, 267 aa, Glycine max
  Coding DNA Sequence Number=SeqID_46498
  Gene Ontology: Mol. function=ligase activity
  Homolog annotation: Hit_ID=Q6K9R7; Match level="QueryCoverage=96%, HitCoverage=59%, E-value=5e-74, Identity=49%"; Hit description=DNA ligase-like
MEPDRLNSPTTFEMPLEVMGHELQFSQDPNSKHLGTTVWDASLVFAKFLERNCRKGRFSPAKLKGKRVIELGAGCGVSGIDSFGSIKVAELQWGDESHIKAVGPPFDYIIGTDVVYVEHLLEPLLQTILALSGPRTTTMLGYEIRSTSVHEKMLQMWKRNFDVKTVAKSKMDETFQHPSIQLFIMGFKQSAECTENPGQATVEKVDVETVVEDESSEGNVVVEGSGLVEENVGDHSKPISQNAKLSEWEARRYGAMAARVLKDVKIS

SEQ ID NO: 163277 - protein, 370 aa, Glycine max
  Coding DNA Sequence Number=SeqID_46499
  Gene Ontology: Mol. function=molecular_function; Cellular component =integral to membrane; Biological process=Golgi organization and biogenesis
  Homolog annotation: Hit_ID=UPI0000E47D98; Match level="QueryCoverage =76%, HitCoverage=26%, E-value=5e-34, Identity=30%"; Hit description =PREDICTED: similar to fat-free protein
  Pfam annotation: Domain name=Dor1; Domain location=40-359; Score= -119.5; E_value=0.018; Accession=PF04124.3; Description=Dor1-like family
MVGEEVVPMDDKAKRMRDLLSSFYSPDPSISNNTSKHASLDDINSTSFDPDQYMNILAHKSNLEGLLQRHVEMAAEIKNLDTDLQMLVYENYNKFISATDTIKRMKSNISGMETNMEQLLEKIMSVQSRSDSVNTSLFDKREHIEKLHRTCNLLRKVQFIYDLPDRLSKCIKSEAYADAVRFYIGAMPIFKVVAYGDSSFRDCKQASEEAIAVVVKNLQGKLFSDSESIQVRADAAVLLKQLDFPVNNLKAKLFEKLEQSITDIRLNPEEINNPSGDRSTHEAAIHEFVEAVCAFRVIFPDSEEQLVKVAEDLVTKNFVIAEEYVKTRISPEDLLGVLPIYLTSKARWIFTFSTTLDIRASDLLTHMPAI

SEQ ID NO: 163278 - protein, 574 aa, Glycine max
  Coding DNA Sequence Number=SeqID_46500
  Gene Ontology: Mol. function=molecular_function; Cellular component =cellular_component; Biological process=regulation of transcription, DNA-dependent
  Homolog annotation: Hit_ID=Q8L7M8; Match level="QueryCoverage=90%, HitCoverage=33%, E-value=0.0, Identity=67%"; Hit description =Putative WD-40 repeat protein
  Pfam annotation: Domain name=WD40; Domain location=233-271; Score =36.7; E_value=8.2e-08; Accession=PF00400.22; Description=WD domain, G-beta repeat
  Pfam annotation: Domain name=WD40; Domain location=275-313; Score =35.7; E_value=1.6e-07; Accession=PF00400.22; Description=WD domain, G-beta repeat
  Pfam annotation: Domain name=WD40; Domain location=317-356; Score =48.0; E_value=3.1e-11; Accession=PF00400.22; Description=WD domain, G-beta repeat
  Pfam annotation: Domain name=WD40; Domain location=385-423; Score =19.8; E_value=0.0097; Accession=PF00400.22; Description=WD domain, G- beta repeat
  Pfam annotation: Domain name=WD40; Domain location=436-500; Score =14.8; E_value=0.31; Accession=PF00400.22; Description=WD domain, G -beta repeat
  Pfam module annotation: Pfam domain module=WD40::WD40::WD40::WD40::WD4 0; Domain location=233-271::275-313::317-356::385-423::436-500
MDSRKGKASVHASSLSVAPLSVSNKVDQMVSPPRHLRAVETDVDIDLREIYFLIMHFLSVGPCRRTFLNFKEELLEHQLLPRRYHAWFSRSGEPRVDDADEDDGISLPLDYSNLVGRYPHITKDHLVKLLKQLMLSTVHPLHGKLEGSSPNAADVPTLLGYGSFSLLDIDRKTADKLVKPPLLYMRWPHMKANQVQGLSLRETGGGFAKHHRAPSIRSACYAIAKPSTMVQKMQNIKKLRGHRVAVYCAIFDGSGRYVISGSDDRLVKIWYMETAFCLASCRGHEGDITDLAVSSNNALVASASNDFVIRVWRLPDGMPISVLRGHTGAVNTITFSPSVIYQLLSSSDDGTCRIWDARNSHNPRIYVPRPLDAINGKSNAPPASLPSSSSNGQQSYQVLCCAYNANGTVFVTGSSDTYARVWSALKPNTDDSEQPIHEMDLLSGHENDVNYVQFSGCSVASKILTSDPWKEENTLKFRNFWYCHDNIVTCSRDGSAIIWVPRSRKSHGKVGRWTRAYHLKVPPPPLPPQPPRGGPRQRFLPTPRGVNMIIWSLDNRFVLAAIMGNVLANPLFVI

SEQ ID NO: 163279 - protein, 136 aa, Glycine max
  Coding DNA Sequence Number=SeqID_46501
MSAENEKIKPKTDIELFLNNANQCVWKKLNNDSGAGANAASREDMTLAATDPLSEIVWSPDKGLSLKCADSSFAHKNSSPFRDFGTSCMVFAPPQNFTGSSSTTDKPLDDDFVKPIAVVCAKSDIAEADAPTMPPT

SEQ ID NO: 163280 - protein, 130 aa, Glycine max
  Coding DNA Sequence Number=SeqID_46502
  Gene Ontology: Mol. function=protein binding; Biological process =insulin receptor signaling pathway
  Homolog annotation: Hit_ID=Q2HU19; Match level="QueryCoverage=57%, HitCoverage=5%, E-value=1e-35, Identity=88%"; Hit description =Bromodomain; WD40-like
  Pfam annotation: Domain name=WD40; Domain location=18-57; Score=26.6; E_value=8.7e-05; Accession=PF00400.22; Description=WD domain, G-beta repeat
MSFHLEDCRICVWNAVDGSLVHSLTGHTESSYVLDVHPFNPRIAMSAGYDGRTIVWDIWEGIPIRTYEIGHFKLVDGKFSPYLTFKQIQRKKQNSSPPLVDFWICPWLEAARTVPMLTDSVNTKLHTFSG

SEQ ID NO: 163281 - protein, 200 aa, Glycine max
  Coding DNA Sequence Number=SeqID_46503
  Homolog annotation: Hit_ID=Q10MK8; Match level="QueryCoverage=97%, HitCoverage=100%, E-value=2e-17, Identity=31%"; Hit description =Expressed protein
MGNQLVSLRPSEATGKIITWDGSVHEIEQSLTVAELMLEHPEQVVVELHSAVNNKRPTPLPADNKLETNKVYLMLPLKRGKPVGLSGEETRRILLILNSALQHSKCLVGSSSSSSKFVPWLTRLCQNTTTIVEPQRKINEEITEKSDEESCQLFLPEMLEGRPEYLNRQVSGKGWKPTLDTIKEKNIDRKLTHWLFLKTF

SEQ ID NO: 163282 - protein, 1089 aa, Glycine max
  Coding DNA Sequence Number=SeqID_46504
  Homolog annotation: Hit_ID=Q2HU19; Match level="QueryCoverage=94%, HitCoverage=81%, E-value=1e-164, Identity=35%"; Hit description =Bromodomain; WD40-like
  Pfam annotation: Domain name=Bromodomain; Domain location=989-1071; Score=0.7; E_value=0.0018; Accession=PF00439.15; Description =Bromodomain
MGLQALNLNTCPPLCHSGICFKVKSNRLYTYLADHEGSMSHELCHLLSILDESGSMTFFLGDYRPLIQDTQGNVLDQVESSHCAPETQLPPHRRNIQEPLCDSSMMPYPEPYQSQFQQRRLGALGIEWRPSLIKYAVGPDFSVGQDYPVVPLVDLEGMVEPQPEFLDAMFWEPEYDIIVSDDNDSEYNVNEDSSSAAGQGSVISSSDLEYSEDDSSNRDGLRRSRRKKHNVGVEVMTSSGRCVRKRNLDECNGNTSGSNRLRKKSKGSSKPSKRKSSKAKTLRPQRIAAHNARSMFSQIDEASTDGEDNDSDEEASDSFQDPDDLSEPEMEMNNKHVELKIPLLEKFATVSKPPAFCESQANVETRPRLVVKFSLRDSKKNVPTEDTRLACETQDNMVCQSFRPQPEESDQKTFPDTKSLDPALSSMAAPNAKLPQSLDRNENDDKEQTENITNNLDASRYVEANTDQCRKMKTHTHELSRSGDALLTDAEIDDHLEQNANGYVKPEMNLTKRRSEQVIGKLETVGSMVNTELTDFEDAPKFSSLEPSLFCNPQPNAEGSLTSGYDKFHGGDKGQSGSEKCAEDSLENNEVVQSSHCRNLKMKAPVKSTKLVIKKKQISPDTEGSCKLKIVSSKADSTGARGIVISGSSSFMGPNLVTEVPEGEDDRKFSSPQLLHSYSDKRSYDHVHKRDKSYKGKVNQDGFESFDCDTEEHTSVFSNPHGLGIGLFDVTSDPMRQTRSIRMKTTSEEPSTSNRRIKIRQGQSSRGKPEEGVNDSGTSTRRVSNHHVKKLSWLMLSELEEGYRYIPQLGDEVVYFRQGHQEYIESYSLSESGPWRLFVGLGASEICKVEELEYAELPGSGDSCCKLKLRFVDPSSCVHGKSFKLTLPELINFTDFVIEKTWYDTAMKRNWSSRDKCMVWWRNEDGKGGSWWDGRIIQVQAKSDDFPNSPWERYRVQYKTDPSENHLHSPWELYDPEMLWEHPHIDHEIRDKLLSYFIKLDHRQRFDIQALNQVAERLEFANRFPAPFYPELIQSRLKNDYYRSVEGVKHDIMVMLSNAEEYFKITKNAQLVSKIRRISEWFRRKLERI

SEQ ID NO: 163283 - protein, 50 aa, Glycine max
  Coding DNA Sequence Number=SeqID_46505
MVCGATVVCGKFSLRDAEFKMGGAVFKCPFAEEEAQVLVKIPVVEEAKVI

SEQ ID NO: 163284 - protein, 202 aa, Glycine max
  Coding DNA Sequence Number=SeqID_46506
  Homolog annotation: Hit_ID=Q1G2Y5; Match level="QueryCoverage=44%, HitCoverage=40%, E-value=2e-23, Identity=58%"; Hit description =Protease inhibitor
  Pfam annotation: Domain name=Tryp_alpha_amyl; Domain location=30-112; Score=33.7; E_value=6.6e-07; Accession=PF00234.12; Description =Protease inhibitorseed storageLTP f
  Subcellular localization annotation: CTP_CleavageSite=62; ConfidenceScore=5.33e-01
MERFVRLLTVVLAMAMVLAAPAHAQISTPCSTSMINGFFNPCMNFLTNSSGNGNGTSPTAECCNSIKSLTSGGMDCLCLIMTGNVPFRIPINRTLAISLPRTCNLPRLPLQCKSSPLPAPGPAAFGPSLSPSAPSLSPEASSVLPSPSLAPLSDITPPLLTPSSATTGSGRSDLTPSSAMPSYRFLPSVVLIALGFAVLKHY

SEQ ID NO: 163285 - protein, 107 aa, Glycine max
  Coding DNA Sequence Number=SeqID_46507
  Gene Ontology: Mol. function=lipid binding; Cellular component =anchored to membrane; Biological process=lipid transport
  Homolog annotation: Hit_ID=Q852L4; Match level="QueryCoverage=61%, HitCoverage=32%, E-value=6e-13, Identity=51%"; Hit description =Expressed protein
MARVRLIGILKGTLPVIMRHKQSMPPLVRDLMELQHSAVGEVPLPLPLLFVRKFIQGLKKPFIIDAHKTFHVVEFGSFDNGKVQQDKEVCKERSEVEGKKVEVLKLV

SEQ ID NO: 163286 - protein, 597 aa, Glycine max
  Coding DNA Sequence Number=SeqID_46508
  Gene Ontology: Mol. function=inositol or phosphatidylinositol phosphatase activity; Biological process=abscisic acid mediated signaling
  Homolog annotation: Hit_ID=Q9LR47; Match level="QueryCoverage=98%, HitCoverage=99%, E-value=0.0, Identity=63%"; Hit description=Type I inositol-1,4,5-trisphosphate 5-phosphatase CVP2
  Pfam annotation: Domain name=Exo_endo_phos; Domain location=93-557; Score=138.9; E_value=1.4e-38; Accession=PF03372.13; Description =EndonucleaseExonucleasephosphatase family
MRDENSKKSKLSWSKRMVRKFFNVKSKAEDSYQSNGVAYGGGDVEYRSRNSSFSEREIKKSKTDKFSRNTEQVRRGRVSLDHPRIIDVHNYSIFVASWNVAGRSPPSNLSIDDWLHASPPADIYVLGFQEIVPLNAGNILGAEDNGPAKKWLALIGKTLNNLPGTSGGGGYYTPSPIPQPVVEINADFEGSARQKNSSFFHRRSFQTTSSGWGLDNDSSTMQPRLDRRFSVCDRVIFGHRKSDFDPSYRWGYRPSDYSRASDYSRPSDYSRWGSSDDDNGLGDSPSTVSPLSYGGPASAEDGYGMPGRSRYCLVASKQMVGIFLTIWVRSELKDHVRNMKVSCVGRGLMGYLGNKGSISISMSLHETSFCFICSHLTSGQKEGDELRRNSDVMEILKKTRFPRVHDADNEKSPETILEHEYEFTCIHLSITNTLNMFIRIIWLGDLNYRIALSYRSAKALVEMQNWRALLENDQLRIEQKRGRAFVGWNEGKIYFPPTYKYSTNSDRYAGDDMHPKEKRRTPAWCDRILWYGEGLHQLSYVRGESRFSDHRPVYGIFWAEVESSHGRLKKSMSCSRNRIEVEELLPYSHGYTELSFF

SEQ ID NO: 163287 - protein, 66 aa, Glycine max
  Coding DNA Sequence Number=SeqID_46509
  Subcellular localization annotation: CTP_CleavageSite=26; ConfidenceScore=5.12e-01
MAGQSGVVFGNNFIRVVQPHFPIAPTAKAVCVAFKFLVPSSNGCELDASLKALFPKFKGTKVVTKR

SEQ ID NO: 163288 - protein, 371 aa, Glycine max
  Coding DNA Sequence Number=SeqID_46510
  Gene Ontology: Mol. function=oxidoreductase activity; Cellular component=peroxisome; Biological process=electron transport
  Homolog annotation: Hit_ID=P93699; Match level="QueryCoverage=98%, HitCoverage=95%, E-value=1e-166, Identity=76%"; Hit description =CPRD8 protein
  Pfam annotation: Domain name=Oxidored_FMN; Domain location=4-340; Score=341.9; E_value=1e-99; Accession=PF00724.10; Description =NADH:flavin oxidoreductase  NADH oxid
MDAPLLTPYKMGNFNLSHRVVLAPLTRQRSSYNNVPEPHLILYYSQRTSNGGILISEANGISETAQGYPHTPGIWTKQQVQAWKPIVDAVHAKGGIFFCQIWHAGRVSNSVYQPNGQAPISSTDKLLAPQGRGDGIDEVHYTPPRRLRTDEIPHIVNDFRLAARNAIQAGFDGVEIHGAHGYLIDQFLKDKVNDRTDQYGGSLENRCRFALEIVEALVDEIGAERVGIRLSPFSEYCECGDSNPEQLGLYIVNALNKYSILYCHMVEPRMKTVVERVECPQSLVLMRKAFNGTFIAAGGYDRQEGIDAISENRADLVAYGRLFLANPDLPKRFALNAPLNKYHRETFYTHDPVVGYTDYPFHAEESNVVAS

SEQ ID NO: 163289 - protein, 322 aa, Glycine max
  Coding DNA Sequence Number=SeqID_46511
  Gene Ontology: Mol. function=nucleic acid binding; Cellular component= mitochondrion; Biological process=RNA catabolic process
  Homolog annotation: Hit_ID=Q0WMU8; Match level="QueryCoverage=82%, HitCoverage=49%, E-value=1e-117, Identity=72%"; Hit description=RNA helicase like protein
  Pfam annotation: Domain name=DEAD; Domain location=74-203; Score= -39.5; E_value=0.012; Accession=PF00270.19; Description=DEADDEAH box helicase
  Pfam annotation: Domain name=Helicase_C; Domain location=240-320; Score=15.6; E_value=0.00054; Accession=PF00271.21; Description =Helicase conserved C-terminal domain
  Pfam module annotation: Pfam domain module=DEAD::Helicase_C; Domain location=74-203::240-320
MASFLLRRNRNLFSRSLLGKKEPFRLYFQFKSQSLGGAANKVHPYSSRNGPIRNDFTDLTCPHTWYPQARKKHRRIILHVGPTNSGKTHHALKQLESSASGVYCGPLRLLAWEIAKRLNKAQVPCDLITGQERDEVDGANHKAVTVEMVDVSADYQCAVIDEIQARIAADELHLCGDPAAVPLIQEIMKITGDEIEVQFYERLSPLVPLKVPLGSFSNVRNGDCIVTFSRQEIYKLKKRIEKEGKHLCSVVYGSLPPETRTRQASMFNDASSEFDVLVASDAIGMGLNLNISRIIFSTMKKFDGFEVRDLTVPEIKQIAGSM

SEQ ID NO: 163290 - protein, 527 aa, Glycine max
  Coding DNA Sequence Number=SeqID_46512
  Gene Ontology: Mol. function=diacylglycerol kinase activity; Cellular component=intracellular; Biological process=protein kinase C activation
  Homolog annotation: Hit_ID=Q1S7U1; Match level="QueryCoverage=88%, HitCoverage=88%, E-value=0.0, Identity=45%"; Hit description =Tetratricopeptide-like helical
  Pfam annotation: Domain name=PPR; Domain location=108-142; Score =43.1; E_value=9.8e-10; Accession=PF01535.11; Description=PPR repeat
  Pfam annotation: Domain name=PPR; Domain location=209-243; Score =35.1; E_value=2.4e-07; Accession=PF01535.11; Description=PPR repeat
  Pfam annotation: Domain name=PPR; Domain location=244-278; Score=8.7; E_value=0.7; Accession=PF01535.11; Description=PPR repeat
  Pfam annotation: Domain name=PPR; Domain location=280-314; Score =15.3; E_value=0.12; Accession=PF01535.11; Description=PPR repeat
  Pfam annotation: Domain name=PPR; Domain location=346-380; Score=0.5; E_value=6.5; Accession=PF01535.11; Description=PPR repeat
  Pfam annotation: Domain name=PPR; Domain location=46-80; Score=7.8; E_ value=0.88; Accession=PF01535.11; Description=PPR repeat
  Pfam module annotation: Pfam domain module=PPR::PPR::PPR::PPR::PPR::PP R; Domain location=108-142::209-243::244-278::280-314::346-380::46-80
MLQKGPRPDKVTMLSTIAACAQLGDLSVGKSSHAYVLRNGLEGWDNISNAIIDMYMKCGKREAACKVFEHMPNKTVVTWNSLIAGLVRDGDMELAWRIFDEMLERDLVSWNTMIGALVQVSMFEEAIELFREMQNQGIPGDRVTMVGIASACGYLGALDLAKWVCTYIEKNDIHVDLQLGTALVDMFSRCGDPSSAMHVFKRMEKRDVSAWTAAIGVMAMEGNTEGAIELFNEMLEQKVKPDDVVFVALLTACSHGGSVDQGRQLFWSMEKAHGIRPHIVHYGCMVDLLGRAGLLEEAVDLIQSMPIEPNDVVWGSLLAACRKHKNVELAHYAAEKLTQLAPERVGIHVLLSNIYASAGKWTDVARVRLQMKEKGVQKVPGSSSIEVQGLIHEFTSGDESHAENTHIGLMLEEINCRLSEAGYVPDTTNVLLDVDEQEKEHLLSRHSEKLAMAYGLITTGQGLPMDFFNEPDGGLSFVWMNYGVQGLVFILTANSQLIPLLEENICECLDDLGLGSASCNPDTFLPV

SEQ ID NO: 163291 - protein, 215 aa, Glycine max
  Coding DNA Sequence Number=SeqID_46513
  Gene Ontology: Mol. function=protein dimerization activity
  Homolog annotation: Hit_ID=Q1S735; Match level="QueryCoverage=65%, HitCoverage=28%, E-value=2e-22, Identity=41%"; Hit description =Probable transposase [imported]-Arabidopsis thaliana-related
MTSIKEGQPSLILTATVSLNCTGVSGKVESMLKDHLASERDQVSLCKKVSPDVRYQMKQNIEENNNKNKKRIIDEEHDLYPPSEEGGEVPIKVNNKPRTTPRAQPTLKNVMQNKQVIRRCDLAIAKWFIDASIPFNAANSAYFQPMIDDLCSMSPRYKAPSMHCCRWDPQLHKNLHASGYWLKPACRFNEEEFEQHMTTTTGLLDVIERYAHRDS

SEQ ID NO: 163292 - protein, 83 aa, Glycine max
  Coding DNA Sequence Number=SeqID_46514
MSYILLNVMHVEKNVCDSVIETFFKIQGKTNDDLNTHQDLAEMGIRDQFHPRSDEEAIEFCSEYIATAKPVGLPKSRHDKRVR

SEQ ID NO: 163293 - protein, 786 aa, Glycine max
  Coding DNA Sequence Number=SeqID_46515
  Homolog annotation: Hit_ID=Q1S7U5; Match level="QueryCoverage=99%, HitCoverage=100%, E-value=0.0, Identity=64%"; Hit description =Calcium-binding EF-hand; Tesmin/TSO1-like, CXC
  Pfam annotation: Domain name=CXC; Domain location=495-536; Score =87.1; E_value=5.4e-23; Accession=PF03638.5; Description=TesminTSO1 -like CXC domain
  Pfam annotation: Domain name=CXC; Domain location=581-622; Score =84.3; E_value=3.8e-22; Accession=PF03638.5; Description=TesminTSO1 -like CXC domain
  Pfam module annotation: Pfam domain module=CXC::CXC; Domain location =495-536::581-622
  Subcellular localization annotation: CTP_CleavageSite=61; ConfidenceScore=5.28e-01
MDTPERNQITATLSMFEDSPVFNYINSLSPIKPVKSVPISQTFNSLSFSSPPSVFTSPHVSCLKESRFLRRHNPLGTSKPKVSSEDVIKVHSSEETLADTTRAHHNSSKLQEENTGKGISLRDASLELSREHIRFSDELPKALKYNCGSPGYDHPPCGDEANSLLELPGEAAENVGYVQEGCKTDSVEGEVHLQEICQMEPKSEGPDCYWDSLIPDAPDMLIFNSPGEAEAFKGLMHKPLDSSIRLSKFMSMLPHSTINNGRKMHIVDSVASGSAHEIEDNHSEPMTATGTSQTQDNLADVALVTSNSNEKANDQLVSVTHRTIRRRCLDFEMANVQRKNSDDNSNIGFSTSESDERNVANEKQLLPAKRNGNLQRGILQGIGLHLNALAALKEYNGTQVEKLSSGRQLSLPSSTSLQITTSQEHQHLSLVPVSSERELDPSDIGVHPAEDCSQPSAYMAGEDFNQNSPRMKRQVKFLTPSWICRRKSETPGDTEGCKRCNCKKSKCLKLYCECFAAGVYCIEPCSCQDCFNKPIHEDTVLQTRKQIESRNPLAFAPKVIRNSDSVPEIGDDPNKTPASARHKRGCNCKKSSCLKKYCECYQGGVGCSISCRCEGCKNAFGRKDGSAPVGIETDPEETEASDKGMVEKTLQKTEIQNTENHPDSATVSTPLRLSRPLLPLPFSSKGKPPRSFVTTISGSALFANQKLGKPNPLWSQAKHFQTVPDEEMPDILRGDSSPITCIKTSSPNGKRISSPNCDLGLSPSRRGGRKLILQSIPSFPSLTPHP

SEQ ID NO: 163294 - protein, 70 aa, Glycine max
  Coding DNA Sequence Number=SeqID_46516
MVENGELQEAITLQGSKLAGGGRMKENPNHGPQKRVENRELPLAITTHGSQLVGGGPMNENAIHGAPKKG

SEQ ID NO: 163295 - protein, 154 aa, Glycine max
  Coding DNA Sequence Number=SeqID_46517
MGGYVGARASLLSTTPPFVAMTQELVIRGDTLWLFAPFCHPEAAGPMTSRDQVWSFCTHDTRRYLTVIRTFLSSRGGGPDDKQRPKTKFGHSAPMIRGDTLWLFAPFCHPEAAGPMTSRDQVWSFCTHDTRRYLTVIRTLLSSRGGGPDDKQRP

SEQ ID NO: 163296 - protein, 119 aa, Glycine max
  Coding DNA Sequence Number=SeqID_46518
  Homolog annotation: Hit_ID=Q7CR55; Match level="QueryCoverage=98%, HitCoverage=86%, E-value=2e-36, Identity=62%"; Hit description =Homology to Shigella VirG protein
  Pfam annotation: Domain name=LTXXQ; Domain location=30-52; Score =19.8; E_value=0.01; Accession=PF07813.3; Description=LTXXQ motif
MTRIALVAASLAACSFTAQAANVEAAPSPSQDPLVQHLKLSNEQVKKIEDLHKQLEQNVSKIPMTGVKDGALIDMFQAGKWDESTVKSQLAAFSKIEEQTRYYRVKYYFDVSQVLTPEQ

SEQ ID NO: 163297 - protein, 179 aa, Glycine max
  Coding DNA Sequence Number=SeqID_46519
  Homolog annotation: Hit_ID=Q2QNQ6; Match level="QueryCoverage=76%, HitCoverage=66%, E-value=1e-49, Identity=65%"; Hit description =Expressed protein
MGWLSRFITAVAFLAIGVIFSPETLGSKSTTLSTYLKLAHLLCFSTAFGAALWVTFIGGIIMFKNLPRHQFGNLQSKMFPAYFSMVGVCCAVSVASFGYLHPWKTSSTTERYQLGFLLSSFAFNLTNLFVFTPMTIEPYPCICKEAVSGFKPMTNKSPRHNFTAAPGLTLTKFSCSVKV

SEQ ID NO: 163298 - protein, 77 aa, Glycine max
  Coding DNA Sequence Number=SeqID_46520
  Homolog annotation: Hit_ID=Q1SDB1; Match level="QueryCoverage=55%, HitCoverage=7%, E-value=2e-11, Identity=80%"; Hit description =Tetratricopeptide repeat, putative
  Subcellular localization annotation: CTP_CleavageSite=35; ConfidenceScore=5.05e-01
MANNDDSGSSVSSDSSLSREGVKLLPSSDSDQSFKCFSVSDLNKKVMAGLCKTCNNEGYWRSESQVVLVVMWGWGSE

SEQ ID NO: 163299 - protein, 1316 aa, Glycine max
  Coding DNA Sequence Number=SeqID_46521
  Gene Ontology: Mol. function=zinc ion binding; Cellular component =intracellular
  Homolog annotation: Hit_ID=Q1RUU9; Match level="QueryCoverage=97%, HitCoverage=97%, E-value=0.0, Identity=48%"; Hit description=BRCA1 C Terminus (BRCT) domain, putative
  Pfam annotation: Domain name=BRCT; Domain location=102-178; Score =32.8; E_value=1.2e-06; Accession=PF00533.16; Description=BRCA1 C Terminus (BRCT) domain
  Pfam annotation: Domain name=BRCT; Domain location=1102-1188; Score =6.4; E_value=0.92; Accession=PF00533.16; Description=BRCA1 C Terminus (BRCT) domain
  Pfam annotation: Domain name=BRCT; Domain location=5-82; Score=16.2; E_value=0.067; Accession=PF00533.16; Description=BRCA1 C Terminus (BRCT) domain
  Pfam annotation: Domain name=BRCT; Domain location=982-1063; Score =34.2; E_value=4.4e-07; Accession=PF00533.16; Description=BRCA1 C Terminus (BRCT) domain
  Pfam annotation: Domain name=PHD; Domain location=1240-1294; Score =39.1; E_value=1.5e-08; Accession=PF00628.19; Description=PHD-finger
  Pfam module annotation: Pfam domain module=BRCT::BRCT::BRCT::BRCT::PHD ; Domain location=102-178::1102-1188::5-82::982-1063::1240-1294
MEATYPSPMFRGVRFVLRGFNPVAQNQIRFKLANGGGVDVGQYGGSCTHVIVDNVAYDDPVCVAARNDRKTVVTALWVEHSADIGMPVDATSVMYRPLKDLDGIPGAKDLIMCLTGYLRQDRDDIMTMVGLMGAQFSKPLVANKVTHLICYKFEEKYELAKKLGTIKLVNHRWLEDCLKEWVLLPEDKYNKSGFELEMMEEEAKDSEQEAEDSKLGQSGGRKRKQSPLSSKIGIAATPGLSKSATEASNALPDSTGPQVLPNVNNGENSLTVPGNKSRPDQGSSFHNVDDSKVSYQAADISRHSTSCQLPNKYVKTSESKNADSPKAPGCQDLGNMGNTNSSDQQPDLNGDISESKKVASDLRETSASAAGVAHSNEKLRTASYSRKNQKGFTLPRILDESSGREGNNCDNSKVQKASEGVKSTSVEVSGKGNDFVKDEPISLLPQKRINKASFTKLKSRKKTSVPSANGKSQGLKVTSQVDEPPEADDYFSIGKDGINNSNTCLVSKPSGSTSNSLAFDELLSRNASPESVQCDNVCQNSSKMAVQSLSESKINGKPDITGSGMQQVGGNEVEQHTVTKNLDCSSLGNKKSCNVESAGCTKLDLGTEESNKLVSKSPRKKSVAKRSLGSKPKVGATAKQKKSLSLTKTTLQGEGETFSSGSKEVATGDARMHQGCPQIFDVNKTTEQETVSKNAGDRTEFLDDETEAPDDKCEYELGMALDEDLVHLSKKPDTAKEEKSEATYPATKCEEAMPPKNGTNKTEKQKTSSLAVKHQARKLPAGKVKATVSKYAEDDGDRTELVGDETEAPDGKCEPELRMALDEESHLSKKSDTATEEKSEVICPETKCEEPMPPKKGTKKTEKQKPSSLVVKNQARKRPAGKTKAKVAKELPKSMAVYGEKIPNETEHEPEIETMEEMPLPDDKSDQPAIQRNKSENFAEEKENRPIDGEQGKSNGSSTIKSSVRTAKIKSKKSGLNPSITESNTRVKTEAACFILSGHRLQRKEFQQVIKRLKGRVCRDSHQWSYQATHFIAPDPIRRTEKFFAAAASGRWILKTDFLTASSQAGKLLAEEPYEWHQNGFSEDGTINMEAPRKWRLLKERTGHGAFYGMRIVVYGDCIAPPLDTLKRVIKAGDGTILATSPPYTRFLSTGIDYAVVSPGMPRVDMWVQEFLKHEIPCVVADYLVEYVCKPGFSLERHVLYGTHAWAERSFDKLKSKAEEIVEELVAPEDSGDDHDHDIICKVCGSRDRGDVMLICGDESGSVGCGIGTHIDCCDPPLTHVPEEDWFCPKCSSNRNCSNNPSKRKKTVLSSSVYVR

SEQ ID NO: 163300 - protein, 102 aa, Glycine max
  Coding DNA Sequence Number=SeqID_46522
MNQPLREEDNFQKNKLITNTNRLSACLEIHSKWRGIAFGLRNLGSGASKECAVACEDYAIICAVEPLGKLGGTESRSRRVRPATEDGGGAIEKKGKKENIIF

SEQ ID NO: 163301 - protein, 361 aa, Glycine max
  Coding DNA Sequence Number=SeqID_46523
  Gene Ontology: Mol. function=heat shock protein binding; Cellular component=integral to membrane; Biological process=protein folding
  Homolog annotation: Hit_ID=Q1SDB1; Match level="QueryCoverage=99%, HitCoverage=70%, E-value=1e-132, Identity=63%"; Hit description =Tetratricopeptide repeat, putative
  Pfam annotation: Domain name=DnaJ; Domain location=221-299; Score =8.7; E_value=0.00064; Accession=PF00226.21; Description=DnaJ domain
  Pfam annotation: Domain name=TPR_1; Domain location=102-135; Score =23.2; E_value=0.00094; Accession=PF00515.18; Description =Tetratricopeptide repeat
  Pfam annotation: Domain name=TPR_2; Domain location=102-135; Score =20.3; E_value=0.007; Accession=PF07719.7; Description=Tetratricopepti de repeat
  Pfam module annotation: Pfam domain module=DnaJ::TPR_1::TPR_2; Domain location=221-299::102-135::102-135
MEDAMVLLQTGKRLATAAFRRESVCWSDDSFSLSNPLFSGDTPTTPPPESEAVTQLLAHIKLLLRRRAAALAAIDAGLHSEAIRHFSKILEGRRGAPQGFLAECYMHRASANRSAGRIADSIADCNRTLALDPTSIQALETRASLFESIRCFPDSLHDLEHLKLLYNTILRDRKLAGPTWKQLRHHNNLRYREIPGKLCALTVKTQELKQRIASGDTGNVDYYSLIGLRRGCGRSELQRAHLLLCLKHKPDKATCFVERCELADELDLDSIKERGKMSALLLYRLLQKGAAEKQRKKVLEAQVLMSNENLEDKKCNVSSPSTANPSVYQGVFCRDIAVVGNLLSQSGFNRSIPVKYEALSC

SEQ ID NO: 163302 - protein, 64 aa, Glycine max
  Coding DNA Sequence Number=SeqID_46524
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=O81149; Match level="QueryCoverage=90%, HitCoverage=24%, E-value=5e-25, Identity=98%"; Hit description =Proteasome subunit alpha type 5-A
MFLTRTEYDRGVNTFSPEGRLFQVEYAIEAIKLGSTAIGLKTKEGVVLAVEKRITSPLLYDGIK

SEQ ID NO: 163303 - protein, 557 aa, Glycine max
  Coding DNA Sequence Number=SeqID_46525
  Gene Ontology: Mol. function=triacylglycerol lipase activity; Biological process=lipid metabolic process
  Homolog annotation: Hit_ID=Q1SDA9; Match level="QueryCoverage=72%, HitCoverage=63%, E-value=1e-173, Identity=75%"; Hit description =Lipase, class 3
  Pfam annotation: Domain name=Lipase_3; Domain location=202-341; Score= 129.2; E_value=1.2e-35; Accession=PF01764.16; Description=Lipase (class 3)
PGKLLKHHGLRFVISSIEKKELAVAATAEKDPQKVGSSIEKKEFAAIAEKDPQKVGSSTEKKEFAAIAEKDPQKVETDEKVEEKEETKDPKNAGYKISATAAYNIAASAATYLHSQTSSIFPFKSSNAVTGEGSLEGSNESLDTVNMLNTEVASLMATTDSVTAVVAAKEEVKQAVADDLNSAHSTPCEWFVCDDDQSATRFFVIQGSETLASWQANLLFEPIKFEGLDVLVHRGIYEAAKGIYQQMLPEVRAHLKSRGSRATFRFTGHSLGGSLALLVNLMLLIRNEVPVSSLLPVITFGSPSIMCGGDSLLKKLGLPRSHVQAITMHRDIVPRAFSCNYPNHVAELLKAVNGNFRSHPCLNKQKLLYAPMGNLLILQPDEKFSPSHHLLPSGSGLYLLCCPLSESDDTEKRLRAAQMVFLNSPHPLEILSDRSAYGSGGSIQRDHDMNSYLKSLRTVIRKELNQIRKAKREQRRKVWWPLLLSRGADTSIVAGRSMISINVGQRQSPFSSVIQTGRESLKRFSRIVTSQHMHLFVLLLFPARLLLLGTYSVINLK

SEQ ID NO: 163304 - protein, 73 aa, Glycine max
  Coding DNA Sequence Number=SeqID_46526
MSSIWMKLQFKTLALATIQCNLDSSVTIEKFSVRIGWNKFAIYEPEDSNKCALCLLDINGSISDCHIDCEFFE

SEQ ID NO: 163305 - protein, 94 aa, Glycine max
  Coding DNA Sequence Number=SeqID_46527
MTLESDQFPLLNDPNKACIYVIKSGNLLYNKEKNKMKDFKNTSGEDVSFTSRISQSLTNSSQALKTASTSNSLLCKSSHSKISQNSLELGPFSL

SEQ ID NO: 163306 - protein, 180 aa, Glycine max
  Coding DNA Sequence Number=SeqID_46528
  Subcellular localization annotation: CTP_CleavageSite=38; ConfidenceScore=5.48e-01
MDSLKTWSKFLQKSCLPPFSETLCFSFSLFRAALPLVRGGSSVERSGEGEGTTVERCGGRWRQTRYVDGGLTIVDMDEDEWMYEIMSERADMDYENAKSCGANEPHVDCSDAVKISQVFECREDVLRWARSVVDENGFVAVILRSDTNTGVASISVGKKNLSEETLGLGNVGVPSSFVAS

SEQ ID NO: 163307 - protein, 342 aa, Glycine max
  Coding DNA Sequence Number=SeqID_46529
  Gene Ontology: Mol. function=DNA binding; Cellular component=nucleus; Biological process=regulation of transcription
  Homolog annotation: Hit_ID=Q1SDA6; Match level="QueryCoverage=99%, HitCoverage=100%, E-value=3e-81, Identity=46%"; Hit description=Myb -like DNA-binding domain, putative
  Pfam annotation: Domain name=Myb_DNA-binding; Domain location=14-61; Score=44.2; E_value=4.5e-10; Accession=PF00249.21; Description=Myb -like DNA-binding domain
  Pfam annotation: Domain name=Myb_DNA-binding; Domain location=67-112; Score=51.4; E_value=3e-12; Accession=PF00249.21; Description=Myb-like DNA-binding domain
  Pfam module annotation: Pfam domain module=Myb_DNA-binding::Myb_DNA -binding; Domain location=14-61::67-112
MGRAPCCEKVGLKKGRWTAEEDETLAKYIQTNGEGSWRSLPKNAGLLRCGKSCRLRWINYLRADLKRGNISAEEENTIVKLHASFGNRWSLIASHLPGRTDNEIKNYWNSHLSRKIYSFPGASAGIMDTPKVASIPPKLKGGRTSRWAMNKNKTYTQNVNVAIYQRPKQTFTQPNSDFTVLDADVADVNEPRIEELEAEVNKCDRSVDESNDEDILGLCQMEGISDILESWLPETTCVVWDLSEEIDNNDMVVRVSDACRDKMASSGEGYSCSSSMALDQHWDWESVIEFNNVVESEACNNWEQQEKPLTWPWEDDAWESQSKNLGETDTQMQNDMVDWFLS

SEQ ID NO: 163308 - protein, 134 aa, Glycine max
  Coding DNA Sequence Number=SeqID_46530
  Gene Ontology: Mol. function=heat shock protein binding; Cellular component=endoplasmic reticulum; Biological process=protein folding
  Homolog annotation: Hit_ID=Q1SDA8; Match level="QueryCoverage=75%, HitCoverage=29%, E-value=9e-44, Identity=84%"; Hit description=Heat shock protein DnaJ, N-terminal
  Pfam annotation: Domain name=DnaJ_C; Domain location=31-133; Score =16.9; E_value=7.7e-08; Accession=PF01556.9; Description=DnaJ C terminal region
MRGKDHQKHFCSFLMTIRARTVCLQYIWYFEQFRIRTAPHGLFRREGNDLHTTVTITLVQALVGYEKTVKHLDEHLVDISTKGITNPKQVRKFNGEGMPLHMSTKKGYLYVTFKVLFPTSLTEERKTNIIAILD

SEQ ID NO: 163309 - protein, 160 aa, Glycine max
  Coding DNA Sequence Number=SeqID_46531
MAPLLLCFLLHLHGEKSPLKDLIETQRSNLHRSPTSKLPSQMVATEAIQEVVVAESLLQCLRLPITRFRNLRFVFLFTLDSINASLVTISKRLNKTCDWIVAIKALLEYEHCVVGLIFGAWKERAAKEVVDAVWYEKDDLCEAGKRKTEMRQMQRFLTLW

SEQ ID NO: 163310 - protein, 141 aa, Glycine max
  Coding DNA Sequence Number=SeqID_46532
MYETDWSATVSIDDFYLTTEGQNKLREANPGNALLEFLEVIKLGVAHSPGDSIMPREMFLFQDFIIFPLMHSMVNFLEFGYDPCFMVLCIGYLHVHREKTSKMELFIISGAACLPHPSKVPSILQYHDSFCSVNRNENEAC

SEQ ID NO: 163311 - protein, 249 aa, Glycine max
  Coding DNA Sequence Number=SeqID_46533
MSRESGDLGDIRWGAIVQNQAWLIPTQPGHSQSVRTCDVPKQASSWQSTNKRTKSTKQGDLCGGWPAMYLGWYLKITLWALVIDYQLCVIDYIVLPATDSNVQRLSNSFLGTGNRLHTLIAMAAQLIHDRVVMECLEGVWETLEGNERCRFRGTIRLTATSLVHPEQPACTLQQPVEWILPTPTPYRLVEPIQVIEVSSSEEDLEEDPEELSPEPAMDAPDLPEDIMSASKADSTEESGPGGTARKKLP

SEQ ID NO: 163312 - protein, 68 aa, Glycine max
  Coding DNA Sequence Number=SeqID_46534
MSPLQPNRVDPKIWRACAGATVHMEHASPSHHLSPLIRGAMGRVTAEAVARASTVQTSLSSVIGVLFR

SEQ ID NO: 163313 - protein, 147 aa, Glycine max
  Coding DNA Sequence Number=SeqID_46535
  Subcellular localization annotation: CTP_CleavageSite=54; ConfidenceScore=5.37e-01
MDLCSSCRFTSSPKWWNLLDFIIFMSGRRGLGSSTYSSYSSFLVGSGQSVIFLRGAMLKNKKTPLHLTYLINTNTRKENILELKREISNNHKKKGDVGIWNIKSNGECMCISMMGNWVEKVVWKRESFNERQKGANLKKCQSGCRAK

SEQ ID NO: 163314 - protein, 96 aa, Glycine max
  Coding DNA Sequence Number=SeqID_46536
  Homolog annotation: Hit_ID=Q52ZI4; Match level="QueryCoverage=98%, HitCoverage=27%, E-value=2e-20, Identity=60%"; Hit description =Expressed protein
MGSDSNLGGSPSASSPSAKRTRDPEEEVYLDNLRSHKRYLSELFLCNGLSGDFRVLASITFFFPIMASSLNGLTVGDSLPDNLMDSPARSESMFSF

SEQ ID NO: 163315 - protein, 147 aa, Glycine max
  Coding DNA Sequence Number=SeqID_46537
MRYNVATINKYLENTFQEPVSQDCAYFIMYARRSGFSNTDLSNKLCLPWRSYMDNDATKVLSSGCLAWGPTHFHGGVGVVSVATNAEATRLVAGEGEQAEEERLSKEEIEDDEGRGSSDEDEEGSEEEGIYDDDDGFDNSGSKFDDA

SEQ ID NO: 163316 - protein, 75 aa, Glycine max
  Coding DNA Sequence Number=SeqID_46538
EIRHLSESPTEGQEARQERFARLKTVLDSVDSRLDQAREIDRVRDNERARLRAEMDHDCDRWRALERKNAQMRLK

SEQ ID NO: 163317 - protein, 60 aa, Glycine max
  Coding DNA Sequence Number=SeqID_46539
  Subcellular localization annotation: CTP_CleavageSite=15; ConfidenceScore=5.04e-01
MEVTRRPQALSTTPMLLAVTPLPRPLTTPPLMSTYFILLLPTVQLAAFAHSRYDVARKSF

SEQ ID NO: 163318 - protein, 36 aa, Glycine max
  Coding DNA Sequence Number=SeqID_46540
MLATKKIREYNRKTHMGPTFSRYSPYSKGNNSPTLN

SEQ ID NO: 163319 - protein, 184 aa, Glycine max
  Coding DNA Sequence Number=SeqID_46541
SDGPSPKQARVRGHLVKIDAGSLNAFLETPVVLAEGRGFILNAEGHSGRILRKDLTTLAQADLWPRVVSDSLTFESLSTAINLAYIRKNCWNLDDLIVFIRGARRARARPAELRSTSAAPTPASTSATRSIPSVKQFLERVAWPGAQPSLYREDEGPTAQVPQHVEDASSEATIPEPYMVEEEA

SEQ ID NO: 163320 - protein, 101 aa, Glycine max
  Coding DNA Sequence Number=SeqID_46542
LVTGLCSPTGCPFPPTRSRHHGIEIVPARHPVDPKKSNMVLELSNSNYGQAQGETPQQPGDGQQRATDAPPSPLEFTSSHPQKAIKRPAQDVKEALLGGNL

SEQ ID NO: 163321 - protein, 77 aa, Glycine max
  Coding DNA Sequence Number=SeqID_46543
MKYERRTVKNVHGIGHGNVTKIGGGAYRPTRPGELVTYSKSNLLAQRAGCFSPKSSSGSKWAQGLKNVQKWTILPLS

SEQ ID NO: 163322 - protein, 61 aa, Glycine max
  Coding DNA Sequence Number=SeqID_46544
MAEKFCHGIQIKLPPSNVVTLRCTHKFLGMNEDYSDDDLISKKKESVYSLNVFRTIINGRK

SEQ ID NO: 163323 - protein, 74 aa, Glycine max
  Coding DNA Sequence Number=SeqID_46545
MDYGSGQRRVEIVSGKSYGCSQSYMAAIPSEVTRASHSGAATAAKPWSFGGPESRRRKRIAKYKVYAVEGKGHP

SEQ ID NO: 163324 - protein, 87 aa, Glycine max
  Coding DNA Sequence Number=SeqID_46546
MDDGDLVEMVHVDISPFEVKAPSFDVQDPLIELNLDTSEEPRIMKASGLLNEEQGKKLVELIKKYQDCITWDYHQMLGLSKELVEHY

SEQ ID NO: 163325 - protein, 259 aa, Glycine max
  Coding DNA Sequence Number=SeqID_46547
  Homolog annotation: Hit_ID=Q1RV57; Match level="QueryCoverage=87%, HitCoverage=30%, E-value=1e-25, Identity=69%"; Hit description =ENSANGP00000004406, related
MAAITCFMGLQYGHIIVHLQGHKQRVLLWSVFSFSLLLIGYILEILGMPLSKALYTLSYTCITAGASGLVLTAIYYICYTHPQSLILLSSNGPNKNTLVNNESRAKRCRVRDANKGITIVYNRGSGIKCLAFLCQIFSHSALKLSLGNDVCEVLAMMFVDIEHLRKPTVLLQWMGMNALVVYALAACDIFPAVIQGFYWHSPENNLVDASEALMQIIFHSKSLPKLSFSTLALECLKGISTICVLKILRVAEFSMGLNA

SEQ ID NO: 163326 - protein, 269 aa, Glycine max
  Coding DNA Sequence Number=SeqID_46548
  Gene Ontology: Cellular component=integral to membrane; Biological process=autophagy
  Homolog annotation: Hit_ID=Q1S3N8; Match level="QueryCoverage=99%, HitCoverage=100%, E-value=1e-129, Identity=79%"; Hit description =CD9/CD37/CD63 antigen
  Pfam annotation: Domain name=Tetraspannin; Domain location=3-241; Score=247.8; E_value=2.3e-71; Accession=PF00335.10; Description =Tetraspanin family
MALSNNVIGAINFVAVLLSIPIIGAGIWLTTEPADSCVKILQWPIIILGVLIFVVALAGFIGAFWRIPMLLVFYLIAMLVLIVLLVSLVVFTYAVTLRGRGNIEPNRSYLEYRMDDFSIWLRRRVRSSSKWDGIRSCLRSSNICADLDQQYRTAQEFFNAHLTPIQSGCCKPPTKCGYTFVNPTYWISPINTAVDMDCMKWSNDQAQLCYNCDSCKAGLLATLRVEWRRANVILIVTLVALIAVYLVGCFAFRNAKTEELFRKYKQGYS

SEQ ID NO: 163327 - protein, 177 aa, Glycine max
  Coding DNA Sequence Number=SeqID_46549
  Homolog annotation: Hit_ID=Q1RV57; Match level="QueryCoverage=92%, HitCoverage=30%, E-value=3e-45, Identity=64%"; Hit description =ENSANGP00000004406, related
MSSEVEEEERRPLIGHDLGSSILIVHQNEDTISICPLPQSNPTDTSSLSLPNQRLSSLDVFRGLTVALMILVDNVGRAFPSLNHSPWFGVTLADFVMPFFLFVVGVSIGLVFKKVSSKPNATKKVISRTLKLFLLGLLLQGGYFHGHGKLTYGVDLSKIRWLGVLQVAGTSKVVNPC

SEQ ID NO: 163328 - protein, 346 aa, Glycine max
  Coding DNA Sequence Number=SeqID_46550
  Homolog annotation: Hit_ID=Q1T506; Match level="QueryCoverage=31%, HitCoverage=29%, E-value=3e-45, Identity=81%"; Hit description =Aminotransferases class-I pyridoxal-phosphate-binding site
MERLTVDLNLYLHKRSSGLIIFAPLRSSRSIVPGGFGERDGGTRYPPGPSGGIDKGGNTGDGRFGGRGDGGSSGGGDGRKGGGGARAPLIISSRSIVPGDDGSCGGGCRYWGSSGVSGKVGSKQSAPPPHGGFGGGGHSITTGGGGGSGFGGGGHLIITGGGGDAGNGGGGDGGIGGGGDGGGGHSFGCGGGGGSSHSLHIMRGTWSFPTVEVVVWVVVVDEAVVRRKIMEYKLAQRCNAINLAEGFPAPPHLKNAAVSAIISDSSQYRHLQGVCDLLAKIVKQMHGLDIDPLKDVAICCGQSEAFAAAIFATLDPGDEVILFDPSYETYEGCVVMTGGVPGSLQS

SEQ ID NO: 163329 - protein, 71 aa, Glycine max
  Coding DNA Sequence Number=SeqID_46551
MLSSVESDNLDWCKNCRSAKLVKPPNLDKCCPSFFCLVVWGGHTFGFASVCSTRAILLRTCHSWSRHALET

SEQ ID NO: 163330 - protein, 192 aa, Glycine max
  Coding DNA Sequence Number=SeqID_46552
  Gene Ontology: Mol. function=transferase activity, transferring nitrogenous groups; Cellular component=cytosol; Biological process =biosynthetic process
  Homolog annotation: Hit_ID=Q1T506; Match level="QueryCoverage=95%, HitCoverage=48%, E-value=1e-82, Identity=83%"; Hit description =Aminotransferases class-I pyridoxal-phosphate-binding site
MVYEHITYDNLKHISLASFPGMQERTIITSSLPKSFSVTGWRVGWAIAPAFLASAIRNIDGRVTDYAPAPFQEAALTALRSPPEYFESLRRDYQSKRDYIIKLLGGVGFKIEFIPQDSFFLFAELPDNCPLSDVEFVKKLILEAGVVAVPGQGFFHTNLSSNEVSNLNYQKRYVRKTGQAFGCCKASCASLK

SEQ ID NO: 163331 - protein, 134 aa, Glycine max
  Coding DNA Sequence Number=SeqID_46553
  Gene Ontology: Mol. function=DNA binding; Cellular component =chromosome; Biological process=chromosome organization and biogenesis (sensu Eukaryota)
  Homolog annotation: Hit_ID=P23444; Match level="QueryCoverage=76%, HitCoverage=41%, E-value=3e-11, Identity=43%"; Hit description =Histone H1
  Pfam annotation: Domain name=Linker_histone; Domain location=12-83; Score=66.3; E_value=9.7e-17; Accession=PF00538.9; Description=linker histone H1 and H5 family
MKKCQKKMRRTNLPRPLFFVIADAISSLKECKGSSQPAIAKFIEDKHTKVLPPNFRKLLSVQLKKLVKSEKLYKVKNFYKLSSATDKQTQKSTETEPKQKVGEKAKRLSQVKTHEALKKKAPTKKDAAAAVDAS

SEQ ID NO: 163332 - protein, 172 aa, Glycine max
  Coding DNA Sequence Number=SeqID_46554
  Gene Ontology: Mol. function=metal ion transporter activity; Cellular component=integral to membrane; Biological process=metal ion transport
  Homolog annotation: Hit_ID=P0A8H3; Match level="QueryCoverage=99%, HitCoverage=76%, E-value=1e-53, Identity=70%"; Hit description=Zinc transporter zupT
MAAIITGETAGPSSRKAIMPPRISAMPDRQAQNSALAFEPVAAYIGPATASPSGILWIATASAMPSPSSISLLAVTKVAMPSGKLCRLIPSVSRIAAIHGEITQQTEHEHAVAEHRRHAFRMQRGGQHLHQGNQQHDAGGKSERKGQYAVRRLLTEHAKNRADEGGTASQDG

SEQ ID NO: 163333 - protein, 330 aa, Glycine max
  Coding DNA Sequence Number=SeqID_46555
  Gene Ontology: Mol. function=oxidoreductase activity; Cellular component=cytosol; Biological process=aromatic compound metabolic process
  Homolog annotation: Hit_ID=UPI00005F712F; Match level="QueryCoverage =77%, HitCoverage=98%, E-value=1e-113, Identity=73%"; Hit description= COG3384: Uncharacterized conserved protein
  Pfam annotation: Domain name=LigB; Domain location=5-259; Score =314.8; E_value=1.5e-91; Accession=PF02900.8; Description=Catalytic LigB subunit of aromatic ring-opening dioxygenase
MTRMPALFLGHGSPMNVLEDNRYTRVWQQLGETLPRPRAILAISAHWYTRGTAVTAMSNPRTIHDFGGFPQALFDVRYPAPGSPALAQRVIDLLAPVAVQADQQWGFDHGSWGVLAKMYPQADIPLIQLSIDGTQPAAWHFALGRKLAALRDEGVMLVASGNVVHNLRMIRWQGAESAYPWAESFNQFVRDNLDYEGEAAQHPLVNYQQHEGAQLANPTPEHYLPLLYILGARAEGEAVSIPVEGMEMGSISMLSVQILGDQRTIFAQTDTGRLIVNQPAANQRIAVAKLRQRPELLDDHALFAIRAIGARDFLTVFHDGDIGTFAGKPA

SEQ ID NO: 163334 - protein, 130 aa, Glycine max
  Coding DNA Sequence Number=SeqID_46556
  Subcellular localization annotation: CTP_CleavageSite=85; ConfidenceScore=5.20e-01
MKLASTLRHSSFVLRRSSIFNRSAFYWFFQRFPQINVGGDSTHFPSLEDAPSSLASPSHRRVKKRLSHEVPKRASTTKRSFSVLRATEESGRASISRPRAKREISALSVAAVFSQAERMTSAKLKSTYSY

SEQ ID NO: 163335 - protein, 186 aa, Glycine max
  Coding DNA Sequence Number=SeqID_46557
MGKVGEVQERIKVDTEALKEQMGTMMEAMMSMKKMMEVNAATIAAINAIAEVDPTPPPSLNQINHPISDMVGRRGKELGSMGDPHFVQVQNKHPFSLYGLPPNYTPPNVVHTPDENVNNSNPILIDSQQPQSDHAHVSQPMGETHEIPHHNLVDFEPRLKYATKGQAVGCVPLLNTLEGPRFCPQP

SEQ ID NO: 163336 - protein, 96 aa, Glycine max
  Coding DNA Sequence Number=SeqID_46558
MAELYLVPDVVIPPKFKVPNFDRYKGTTCPKNHLKWAKHASTTKHRFSVLSATEESGRASISRSHAKHEISALSAIVVFSQTQRTTGAKLKSTYSR

SEQ ID NO: 163337 - protein, 83 aa, Glycine max
  Coding DNA Sequence Number=SeqID_46559
MVRLQRKKNVWSRHQCLFEENIEKTKMEKGRRSAYFENEGSRVVYARGSDKTRLRHERSVKTHFKQRKRSSIIKEGDEEAQTI

SEQ ID NO: 163338 - protein, 73 aa, Glycine max
  Coding DNA Sequence Number=SeqID_46560
MDKSLKVGEDEWRERERMSMKFCASNECSNLEATSQVQRSRKRHHPMLYRECIRRRIGNLKIDPTRCWTLWPQ

SEQ ID NO: 163339 - protein, 87 aa, Glycine max
  Coding DNA Sequence Number=SeqID_46561
  Subcellular localization annotation: CTP_CleavageSite=22; ConfidenceScore=5.11e-01
MASMDTSDMVNSKIFPCNLRIRGSGEFVTFLDTTSRGSEMPQRTFLRRRHGPSVGLFTVGIKTEPICNAYAKDTMRECAQYDNIYRT

SEQ ID NO: 163340 - protein, 571 aa, Glycine max
  Coding DNA Sequence Number=SeqID_46562
  Gene Ontology: Mol. function=mannosyltransferase activity; Cellular component=membrane; Biological process=protein amino acid O-linked glycosylation
  Homolog annotation: Hit_ID=P76473; Match level="QueryCoverage=91%, HitCoverage=94%, E-value=1e-157, Identity=51%"; Hit description =Undecaprenyl phosphate-alpha-4-amino-4-deoxy-L-arabinose arabinosyl transferase
  Pfam annotation: Domain name=Glyco_transf_22; Domain location=38-433; Score=-188.9; E_value=0.099; Accession=PF03901.7; Description=Alg9 -like mannosyltransferase family
  Pfam annotation: Domain name=PMT; Domain location=35-266; Score =153.7; E_value=4.7e-43; Accession=PF02366.9; Description=Dolichyl -phosphate-mannose-protein mannosyltransferase
  Pfam module annotation: Pfam domain module=Glyco_transf_22::PMT; Domain location=38-433::35-266
MWCAGTLPAGKAGWVARVNILQDPSMETPMRSRTRIVLLIALFALYYLIPVPFRDLWQPDETRYAEISREMLLSGNWVVPHFFDLRYFEKPIAGYWVNNLGQLLFGHDNFGVRAGAIICTTLSALLIYWLGKRMFASRKIALTASVIFLTSLLVYGIGTYAVLDPILLLWLVAAMCSFWFAAQAHSTSQRLTGYVLLGAACAMGFMTKGFLALAVPVLAIVPWVLWQRRFGELLRWGPLTVLVAAAISAPWALSIQHQEGDFWHYFFWVEHIQRFAESDAQHKAPFWYYLPVLVAGCLPWLGLLPGALSGAWRQRQQHAAAIYLLSWVVLPLLFFSIAKGKLPTYILPCFAPLALLMAHYAHGNTARLKQALVVNGWINLLFGLGATLLVVVVLAPWGLAHHPVYARDELLRVVCAALAFAGWAVMGWLSLKTGRWQLAALCPLALALLVGLAIPQKVRDSKQPQSFVSAVRPQLAQSRYLVVDNSGIASAVAWELRRSDITFFDEKGELEYGLGYPDAKTRYVDGEAFADWLRLHRRQGPVALVLLLNSDEKQADAHLPVPDDVYQQGRL

SEQ ID NO: 163341 - protein, 89 aa, Glycine max
  Coding DNA Sequence Number=SeqID_46563
DRARKTPSGPDEGQQGLGVASSKYGSLSVQGSACCPQQGHQAPYQSSFHQEATDAPPSPLEFTSAHPQKGLSIAYTTWLTNRRPSPRPK

SEQ ID NO: 163342 - protein, 87 aa, Glycine max
  Coding DNA Sequence Number=SeqID_46564
MRILFYRPRFKKSKVVFQWGLLSWEPNLDIWGETKFGSQARWALKHPIYGIVILRLGIYTDRPNVSKLCSFISSMNSSILISVYSGK

SEQ ID NO: 163343 - protein, 61 aa, Glycine max
  Coding DNA Sequence Number=SeqID_46565
MKNKILTANNQYTFEHRLKNTTHHQPKYKDKGSEREVAHTFDSGEGDNGARAAQASRLGFS

SEQ ID NO: 163344 - protein, 82 aa, Glycine max
  Coding DNA Sequence Number=SeqID_46566
  Gene Ontology: Mol. function=DNA binding; Biological process=DNA integration
  Homolog annotation: Hit_ID=Q1SIT1; Match level="QueryCoverage=77%, HitCoverage=17%, E-value=4e-15, Identity=59%"; Hit description =Integrase, catalytic region
MDQAGEERKLQLSELDEIRLEAYENAKFYKEKTKKFHDSMIIKKDFMVGQKVLLYNSKLGLMSAEIKRDSTNKSFQGQWTST

SEQ ID NO: 163345 - protein, 440 aa, Glycine max
  Coding DNA Sequence Number=SeqID_46567
  Gene Ontology: Mol. function=RNA-directed DNA polymerase activity; Biological process=RNA-dependent DNA replication
MDENKYLWREYNEILVHEELFWYRKARCEWFRFGDRNTRFFHSSVVIRRKRNRIEALEDSSRDLIMGLVLLKGMAQNYFQELYQKEEGGELWNLCNNFARIEEVLMLNVQKVFEEEEIKEAMFSMGPFKSPGTDGLHLIFFQANWSTVGESVVAMVRKCYEHPLTIKDINGTSLVLIPKFDAPTHVNQLAHLIDRELVRFRWTPLPVRELRELSGFALTRYLERYFGVPLIHGLRRKRCASSCWTKLNAVLEIGVLIVCRLQGDVLCQRRFVWGTLKGERKCHSVAGSTMCQPKQVVGVEGGFLVKELKWQILNKLAYESLADPSPLLGPGRWKQAQNDLVFNETPFERHKVIHEAKSCLVGGETLINKSSQHDRFVESQLCYLSWEPSQEGWVKASTYRYVQLGGLRLMDREWEVHLHYVYLEMNLIVDYLSNEAHNYE

SEQ ID NO: 163346 - protein, 321 aa, Glycine max
  Coding DNA Sequence Number=SeqID_46568
  Gene Ontology: Mol. function=hydrolase activity, acting on ester bonds; Biological process=lipid metabolic process
  Homolog annotation: Hit_ID=Q9FFC6; Match level="QueryCoverage=91%, HitCoverage=98%, E-value=1e-100, Identity=58%"; Hit description=GDSL- motif lipase/hydrolase-like protein
  Pfam annotation: Domain name=Lipase_GDSL; Domain location=32-312; Score=202.3; E_value=1.2e-57; Accession=PF00657.12; Description=GDSL- like LipaseAcylhydrolase
MSSMGYSRSFLASFLLAVLLNVTNGQPLVPAIFTFGDSIVDVGNNNHQLTIVKANFPPYGRDFENHFPTGRFCNGKLATDFIADILGFTSYQPAYLNLKTKGKNLLNGANFASASSGYFELTSKLYSSIPLSKQLEYYKECQTKLVEAAGQSSASSIISDAIYLISAGTSDFSLYALGARRIGVTSLPPIGCLPAVITLFGAHINECVTSLNSDAINFNEKLNTTSQNLKNMLPGLNLVVFDIYQPLYDLATKPSENGFFEARKACCGTGLIEVSILCNKKSIGTCANASEYVFWDGFHPSEAANKVLADELITSGISLIS

SEQ ID NO: 163347 - protein, 163 aa, Glycine max
  Coding DNA Sequence Number=SeqID_46569
MDQPFLSLILVFPTHAPPHFTAKGLGFAIASHHRYRGGSRLGRADGDHVSWFRASLKHTRLAEGLDQGSGIEGCGSKSEVGGPKQMAFTVEVNHGGYFTPEPFLKYFGGDITLLSEIDIDKWSFFEFVGILKQDVKIKGDFKLCWEGANAGFKELVLDSHVAE

SEQ ID NO: 163348 - protein, 235 aa, Glycine max
  Coding DNA Sequence Number=SeqID_46570
MALMILSLQVNEQNAGKVQKRKAPAKPAKPAHVKPAKPTPVSVKIAKAAPVKTAKPVPKPAPIKNAKLAGCFVCSTIGSAQLKNTAATPAATSPVGHYTKMSYGIAKSANTGKRKDAVLHNNNDKAKKKMKLSERTTPSANAAPSSIHKLKKLCELIKGLIKLCMSLAYPNKAKSNGQANIQKGDKEKYDAKVQKKAQGLKPPRPVTKSSATTTKESLSQEVNSPTLGLQKTPKK

SEQ ID NO: 163349 - protein, 107 aa, Glycine max
  Coding DNA Sequence Number=SeqID_46571
MVAHWWSSDNQSQANASLMLEEGCVIPLKSDRLLTISEKRPHEKFYHGLMVNVKCTYQNLELINVRDDVAKMSSTILCVGLVVPFIRRSRRGTCKTKDSDTQIIASL

SEQ ID NO: 163350 - protein, 113 aa, Glycine max
  Coding DNA Sequence Number=SeqID_46572
  Subcellular localization annotation: CTP_CleavageSite=24; ConfidenceScore=5.26e-01
MLIVFYFFTPSFSLFPLHPFPFVSASLPLLALQIAFTLSTLPAKALLTRGRIDNHKDDNNERKNDALLVMADVGRSLESIFMNLVRMIKDDNISVSLEWEKSLFLHWENLEAR

SEQ ID NO: 163351 - protein, 1615 aa, Glycine max
  Coding DNA Sequence Number=SeqID_46573
  Gene Ontology: Mol. function=zinc ion binding; Biological process =proteolysis
  Homolog annotation: Hit_ID=UPI0000196E5D; Match level="QueryCoverage =93%, HitCoverage=92%, E-value=0.0, Identity=43%"; Hit description =DNA binding / protein binding / zinc ion binding
  Pfam annotation: Domain name=C1_1; Domain location=1080-1128; Score =5.7; E_value=0.0056; Accession=PF00130.12; Description=Phorbol estersdiacylglycerol binding
  Pfam annotation: Domain name=DDT; Domain location=193-252; Score =42.0; E_value=2e-09; Accession=PF02791.7; Description=DDT domain
  Pfam annotation: Domain name=PHD; Domain location=1281-1331; Score =25.5; E_value=0.00016; Accession=PF00628.19; Description=PHD-finger
  Pfam annotation: Domain name=PHD; Domain location=417-462; Score =42.3; E_value=1.7e-09; Accession=PF00628.19; Description=PHD-finger
  Pfam module annotation: Pfam domain module=C1_1::DDT::PHD::PHD; Domain location=1080-1128::193-252::1281-1331::417-462
MEPPVARSRGRPRKRRREEEEKKNENEAKRQAMGTRAVALVGKYVLKDFAGNGVFLGKVIFYECGLYRVSYEDGDFEDLDSSEVRAILVKDDEFGKDMAQRRVVLEKLVAKNSVKAELDKGGDEGKKEESAVEVTGSKGESGAENNGGEENDDDNESSSDSGLEGSEPGIDEESLPPLPEFPSSSGTIGVPEESVSLLFAVYGFLRSFSTRLFLMPFTLDEFVGAVNCRVPNSVFDAVHVSLMKVLRRHLESLSSEGSEIASKCLGCNDWSLLDSLTWPVFVIQYLVVSGHTTAHEWRGFYKEVATDEYYLLPVSRKLMILQILCDNALESEEIVTEMNIRRESEVGVDYDGEDILPSEVGLRRVQPRYANTLACEDKEATKFVSASNAVNQPGSSVSYSRDTEGTEDGDVDRNGDECRLCGMDGILLCCDGCPSAYHSRCIGVLKNHIPEGPWYCPECKINMMGPTIAKGTLLRGAEIFGKDLYGQLFVGSCEHLLVLNIGNDEFCHRYYNLNDIPKVLKVLYGSTEHRAIYHDICMAVLQYCNVPESTLLFPPLGETPLSPATRCNGNGSSNECPPSKCSLVNGQFCNYDHANDSAPIILSSQTKESTQAGFEKCERNVINDPAYMGFSYKPLLYNNYYAHGYFAASAAAKFALLSSEESRSDGHASDNQRKNASGNTYLQAKAFSLTASRFFWPSSEKKPVEVPRERCGWCFSCKAPASSKRGCMLNHAALSATKNAAKMLAGFSSIRSGEGVLPSIATYIIYMEECLHGLVVGPFLSASYRRQWRKQVEQATTFSAIKPLLLKLEENIRTIAFCGDWVKLMDDWLVEFSMVQSATSTLGTAQKRAPSGRRYKKRSANDEATAEGCPENFVWWRGGKFTKFIFQKAVLPKSMVRKAARQGGSRKISGIFYADSSEIPKRSRQLVWRVAVQMSRNASQLALQVRYLDFYLRWSDLIRPEQNIQDGKGQETEASAFRNANICDNKLVEGKSCYGIAFGSQKHLPSRVMKNVFQIEQDPERKEKYWFFETRIPLYLIKEYEEGNGNMPCNEEHLNTASELLYRRRLKAICKDIFLYLTCKRDNLDVVSCSVCQMGLLIRDAHKCNACQGYCHEGCSTRSTVSANEVVYLTTCKQCYHARLLAQKENNNESPTSPLLLQGRENNSGTFLKGSRPKSHDQVLKSSRTKANNPSMKQVTPVTALKGTKAKYYEQEPTSPGTKDNNHFDMPQVASEATSTGKKPRKNCSWGLIWQKKNNEDTDNDFWLRNILLKGSSNMPQLKPVCHLCRKPYMSDLTYICCETCQNWYHAEAVELEESKISSVLGFKCSKCRRIKSPVCPYSDLKPKRQEGKKSRTKTKKKEHSGADSNSGAIYYGMREYEAATPAFPVEDGSTPVFNVEDDPTHLFPVEGDPTPVFPVEDDPLLFSLPSVELITEPKMEGDVEWNSVSGPGLRKLPVRRNVKHEGDGDVSFGGMPAEVSLPLEYASAVDFDNKLLNDSDNVNYDDYMDFEPNTYFSLTELLEPDDGSQFEGLNVSGDLSGYLENSSTLFPEECGDEPTLSLQDTGFSSNVRLGLKYHLGLEVGGVGIAGIGNAGFASAVEFCYRSCKLVAISSPWMN

SEQ ID NO: 163352 - protein, 42 aa, Glycine max
  Coding DNA Sequence Number=SeqID_46574
MDILAEMPKFPKRQAEDTDVDATEQSAINGTPPVSQLSLVCN

SEQ ID NO: 163353 - protein, 94 aa, Glycine max
  Coding DNA Sequence Number=SeqID_46575
MANNDEGEENDDDMVDDSSSYSGLGDREPGIDLEALSPLSSPLELLPLFGTHCDQGSNIGGWRGEKRDSEGVRNKKKHFPNGYGIGGETKKKRR

SEQ ID NO: 163354 - protein, 115 aa, Glycine max
  Coding DNA Sequence Number=SeqID_46576
  Gene Ontology: Mol. function=structural molecule activity; Cellular component=clathrin coat of trans-Golgi network vesicle; Biological process=intracellular protein transport
  Homolog annotation: Hit_ID=Q10SS6; Match level="QueryCoverage=86%, HitCoverage=51%, E-value=1e-18, Identity=82%"; Hit description =Adaptin N terminal region family protein, expressed
MALSGMRGLSVFVSDIRNCQNKEQVRLRVDKELGNIRKRFKTEKLIDKAGEFISDDIWFCVVQFVTNNEDLQPYTAAKAREYLDKPAIHETMNVHGRHLLMLKKDDLNVHEEAKI

SEQ ID NO: 163355 - protein, 49 aa, Glycine max
  Coding DNA Sequence Number=SeqID_46577
MDLGIPRSCGSACHWTLGSRTSFLNDHLEETLGPTKIGENHSKCINLTQ

SEQ ID NO: 163356 - protein, 137 aa, Glycine max
  Coding DNA Sequence Number=SeqID_46578
MNQLRKPSREGFNFPLFLATNNSTNPTKSHHHHHHQVLLNVVNEEDTIPRESLHVFQPPSPPKSRAMDDDAASDASSDLFEIESFSTQTTTTLPYPIITPSITQCHESTDHEFFFATDAGGSLWRRRLRDTEVLPPL

SEQ ID NO: 163357 - protein, 140 aa, Glycine max
  Coding DNA Sequence Number=SeqID_46579
MASGNRLPRGVIEYKAWKWSQDGEVAFGFHVLKLCNSSLASEEPAHMLQRTVEWILPTPTPYRLVEPVQVIEVLSSEEDPEEDPEELPLEPVVDALDFPEGDEDPLPDMDSPEDVMLASEADSTEDSSPGGITTSGDSSS

SEQ ID NO: 163358 - protein, 96 aa, Glycine max
  Coding DNA Sequence Number=SeqID_46580
MVAVGDGESAWDVRNGFGRKKEEEIVFFLSYTKAKAELRENSRHFLKDPNGLIVDTCLVKLQTKFREAPTANEGWAAFLPRQLHVASSRSFIKRLL

SEQ ID NO: 163359 - protein, 78 aa, Glycine max
  Coding DNA Sequence Number=SeqID_46581
MSQRKDKELRGSSNGPIDGYCRWLKAYAQDLDWLPSLRTTKGMEIETPKEDEEVQALKTELEKTQAVKEKFKSTAVRF

SEQ ID NO: 163360 - protein, 196 aa, Glycine max
  Coding DNA Sequence Number=SeqID_46582
MAKFDPDIVLEFYVNAWPTEEGVRDMRSWVRGQWIPFNADALNQFLGYPLVLEEGQECEYGQRRNRADGFDEEAIAQLLCIPGQDFARTAAGRRVRIMRTNMTTLTQTWMTLLLSNILPSDHNSDLPLPKCHLVYAILTRMSVHVAQLIADAIYLFAGMPPTRHPLDPNKSNKALGFPALITGLCQSFGVPVAPSK

SEQ ID NO: 163361 - protein, 83 aa, Glycine max
  Coding DNA Sequence Number=SeqID_46583
MRKKNYDCETRVQIQEPRDGKEKEGEAQYQAFDAVMNKATFVEDAITYIKSMQDMVQSLSQELHEMEATSEKIKQENLLQQKR

SEQ ID NO: 163362 - protein, 277 aa, Glycine max
  Coding DNA Sequence Number=SeqID_46584
MEGTPFNLPQIFFYYFATEVMKDKSIRKDIYHSVVLTKKVFSQENISNIRMVDGGSFQQTPQVDDSILVELQHKFGLNTRWNDQRTKERMDTPSSKVVLAQQYPPPTLVAPMATGVMEKTKSDDERPLVFRKRKVAPLSDETFVPQVKKTIRLRKKKRIETTAAMDDEYQHEAPPSPIHLDHFHHQGPPVTDPNLTVVDIARLHFPINFLFENAYNIKIRMEAKFQPTIDWMQFPLDIEKEEVTCPSSMHRGFQVASITTELDPSIGIEGLPPPKRK

SEQ ID NO: 163363 - protein, 557 aa, Glycine max
  Coding DNA Sequence Number=SeqID_46585
  Gene Ontology: Mol. function=RNA-directed DNA polymerase activity; Biological process=RNA-dependent DNA replication
IYLGVHENPKAFFSSSSPILLESSIQYPWGVGLHHLVRALIIYEVSLDNVFDVDPCVETVDKGPKPMEELVKLQLGPKPRLNHCHKRRGRCEKSDARQSERKLTSSSKPILLEKSGTLLGSPTSSWLVDGAPGFQVLSFLDAYSQYNQIQMQAPDEEKTKFITEGANFCYRVYVDDMVINSQSTAQHVADLEEALRGKFLGFMITNRGIEANPDKCTTILEMHSPTNIKEAQNLNGRLASLSRFLPKLVEKAKPFYKLLRKTEPFLWDESCKQAFLASVETYPSAGTQKGQNRWAKVFVSKGENEWSRHQCLLEENVVALAPMYPQGTSTWVVVTKNKRGYISCGSVQVEVFYKVEKKSQGPQVAWGLDVGTDEGHCRLLKACNDRRHCRLRNVDEGADDHVWSLRAIGLDCLWMAKRVWMTMFGLCVPSNSIVSGWQRGDCNSLGRKTLSLRQREQMTIFVSACEDFESYEGKDFESFEGEDFESSKGEDFEFSEGKDFESSEGEDFEPSEGEDFESSKARTLSPLKARTLSPLKTRTLSPLKARTLSPLKEANKY

SEQ ID NO: 163364 - protein, 155 aa, Glycine max
  Coding DNA Sequence Number=SeqID_46586
  Homolog annotation: Hit_ID=Q5MJW5; Match level="QueryCoverage=82%, HitCoverage=95%, E-value=8e-13, Identity=27%"; Hit description =Avr9/Cf-9 rapidly elicited protein 76
  Pfam annotation: Domain name=Hin1; Domain location=2-132; Score=58.1; E_value=2.9e-14; Accession=PF07320.4; Description=Harpin-induced protein 1 (Hin1)
MLLTPKDPQFSITRFKVVETKPHPKYDVTLEVHNLNSDVGVSYKNKGHVSLSLRRQEVASGAYPSFNQDAHDRTTFGVTLTSSKVGLPKEVEESVTNDKKKVNVTFSLAIHALARMKMGLLRSGTMKFDVTCNVKLDTLAKTTQVLSQQCETKRH

SEQ ID NO: 163365 - protein, 124 aa, Glycine max
  Coding DNA Sequence Number=SeqID_46587
MGSIMISYLKQRLRRLAEECLETINENEALEVHHFNSITYLLNYSQFIQLKFLANKQYTFELKIKKTTHHQARYKVKAKNYKEHTPSIAGKGVNDDTQRDDTTDDLSFEVLSFASGSERVRFKW

SEQ ID NO: 163366 - protein, 338 aa, Glycine max
  Coding DNA Sequence Number=SeqID_46588
  Gene Ontology: Mol. function=nucleic acid binding; Cellular component= intracellular
  Homolog annotation: Hit_ID=Q8H6R5; Match level="QueryCoverage=99%, HitCoverage=100%, E-value=1e-39, Identity=35%"; Hit description =CTV.12
MDAQAKKKALFRAKLNAQKKKKRIESPLVRLVLGAHHSESLWDAHQVSRKHREAISNLKANAAGLTQHNIAKPVADTSFFKAKPEHSLDSQSKAPEASQVVSKPQSSSVLPPGFFDDSNSGKTRSGSGNIILVFHHFYWVYPIGALHTFGLLAATCRKAGVSAQSQVLNLEKEKGHFHDNNAAKSNVGQAAMESRQTPVKSTDTEIQQIKGTLPEGFFDNKEADLRARGIKLVKPDVKDEYKEFEKLIQEDLREVDDRLEEEEIDAAEMIEEEEVVEQKILSEKVEMLKKRRLELKAANAAKRSKSSEIVAKESRREEPSSDDESEGNLAVDWRAQHL

SEQ ID NO: 163367 - protein, 90 aa, Glycine max
  Coding DNA Sequence Number=SeqID_46589
  Homolog annotation: Hit_ID=P31757; Match level="QueryCoverage=46%, HitCoverage=8%, E-value=7e-12, Identity=69%"; Hit description=Alliin lyase precursor
  Subcellular localization annotation: CTP_CleavageSite=45; ConfidenceScore=5.13e-01
MAIAIASPISSICMQLSTTCRIVTKLQLGLQFKTFMAILASQAIRQAVSSHFLHSTCCIRKQACHEEVNHPKKPFHGRSTRSTIQLQLLS

SEQ ID NO: 163368 - protein, 438 aa, Glycine max
  Coding DNA Sequence Number=SeqID_46590
  Gene Ontology: Mol. function=carbon-sulfur lyase activity; Cellular component=vacuole
  Homolog annotation: Hit_ID=Q9FE98; Match level="QueryCoverage=84%, HitCoverage=89%, E-value=1e-121, Identity=52%"; Hit description =Alliinase, putative; 28821-30567
  Pfam annotation: Domain name=Alliinase_C; Domain location=51-372; Score=575.4; E_value=5.6e-170; Accession=PF04864.4; Description =Allinase, C-terminal domain
  Pfam annotation: Domain name=Aminotran_1_2; Domain location=48-368; Score=-103.3; E_value=0.033; Accession=PF00155.11; Description =Aminotransferase class I and II
  Pfam annotation: Domain name=EGF_alliinase; Domain location=2-49; Score=88.7; E_value=1.8e-23; Accession=PF04863.4; Description =Alliinase EGF-like domain
  Pfam module annotation: Pfam domain module=Alliinase_C::Aminotran_1 _2::EGF_alliinase; Domain location=51-372::48-368::2-49
MTEAEAVSSISCSGHGKAFLDGLLLHGKPVCECNMCYGGSDCSQLQPDCMVDADSGDPTFLEPFWVKNAASSAIVIAGWHRMSYEYSDGSLISEELKAHIRNVHASVGNAITDGKYIIFGAGATHLLNAAVHALSSKASSSPTKVVASTPYYPVYKEQTEFFNSEDYKFNGDTSMWNNDTSNSTFIELVTSPNNPDGHMKKAVLQGQFVKTIHDLAYYWPHFTPIVAPADEDLMIFTLSKLTGHAGSRFGWAIINDEAVYKRMLTYMDLSTYGVSRETQLRVMKLLKVVLSGNGREMYEFGHNTMKNRWTFAWLKCETSILEDRSCYEVLKEVNITGREGSLFGADNRYVRLSLVRSEDDFDLLLRQINKLVSVEINDKHVATTSTILRQSNETTLLLTAGVNVVNRTLDLRMELETLNSNIFPRQNGLYTTIDLSFN

SEQ ID NO: 163369 - protein, 85 aa, Glycine max
  Coding DNA Sequence Number=SeqID_46591
MMIVAHSSAVYRQQNHLRERARVRERNNREKKQALNKEEVENRGRESPQNNPTTCNPPALYSPSPTLCYACLLHFADREPCVLRF

SEQ ID NO: 163370 - protein, 196 aa, Glycine max
  Coding DNA Sequence Number=SeqID_46592
  Gene Ontology: Mol. function=RNA binding
  Homolog annotation: Hit_ID=Q2VY14; Match level="QueryCoverage=57%, HitCoverage=19%, E-value=1e-48, Identity=76%"; Hit description =CONSTANS interacting protein 5
MLQMHPLSFTNNTCVSPLSYKNYTRYPSSLSVTGMYKEIEDKGNEDKARHRNWIEQEWAPWEEILTPKADFARKCLNKGKEVPLRSPEAIEAFKMLNPNYRKKKREEMGLIEEEFYAKQFEIKGDIPEPLMMTWAGPLVVRLVPPHDWTPRGWHVDQEELAFIREEGDAGEGGELWIGLRKGKRIEKERPKRARRR

SEQ ID NO: 163371 - protein, 48 aa, Glycine max
  Coding DNA Sequence Number=SeqID_46593
MQKIQQGKMAMRERRLLITIAKEKMPCITTTKEKHAHLQSWNHEGPYA

SEQ ID NO: 163372 - protein, 296 aa, Glycine max
  Coding DNA Sequence Number=SeqID_46594
  Gene Ontology: Mol. function=hydrolase activity, hydrolyzing O -glycosyl compounds; Cellular component=cell surface; Biological process=carbohydrate metabolic process
  Homolog annotation: Hit_ID=Q4CCP9; Match level="QueryCoverage=98%, HitCoverage=76%, E-value=2e-78, Identity=57%"; Hit description =Clostridium cellulosome enzyme, dockerin type I:Carbohydrate binding module, family 6:...
  Homolog annotation: Hit description=Glycoside hydrolase, family 43 precursor
  Pfam annotation: Domain name=CBM_6; Domain location=3-101; Score =20.1; E_value=0.00017; Accession=PF03422.6; Description=Carbohydrate binding module (family 6)
TSENRKTGVYVSDARAGGYIRVRSVDFEKGTSGFSASVAAGIDGGILEVHLDDVKGPKIAEIEIPRTGGWEEFKTLTSKISESVSGVHDNPIIQTNYTADPAPMVYNDRLYVYTTHDEDDSTWFTMNDWKVYSTNDMVNWTDHGTILSYKDFDWAKRDAWAAQCVERNGKFFLYVPMWSKTNNKGAIGVAVGDSPFGPFHDPLGKPLVQSEWGDIDPTVFVDDDGQAHMYWGNPKLKYVKLNEDMISYSGNITEVPMTEESFGIRDGKPNPERPTKYEEGPWLYKRKNLYYLFWPG

SEQ ID NO: 163373 - protein, 129 aa, Glycine max
  Coding DNA Sequence Number=SeqID_46595
MRKGPLKEGGTEAIDSVGTRRTYTKNEVTLSKNGNRNEEKEGILKKAQPNSGAKRESGAKRATKSRDPNALSARARLTGALPKGGKMRGVATNEGISTSYVDKSGAFAPTYPPLERKSDLRSSSLCVNQ

SEQ ID NO: 163374 - protein, 164 aa, Glycine max
  Coding DNA Sequence Number=SeqID_46596
  Homolog annotation: Hit_ID=Q4R1J3; Match level="QueryCoverage=16%, HitCoverage=4%, E-value=6e-07, Identity=85%"; Hit description=SEL-1
MTESGHPSAQSVLGFLWEMGLFREQRKGKVFTPLGDSLATFDRQTLLRSGADPQQRHRLVAAIEAGGHGVEACPAANANHYRERHCPRPEDSPLCLILPPHGYRVPVPWWESLHKERTKELVFGDSKFRKGLYPVFSVFGFEFLEKNFHFQLFLDPKTRCQYWL

SEQ ID NO: 163375 - protein, 124 aa, Glycine max
  Coding DNA Sequence Number=SeqID_46597
  Homolog annotation: Hit_ID=Q1SAV4; Match level="QueryCoverage=36%, HitCoverage=11%, E-value=5e-10, Identity=60%"; Hit description =Integrase, catalytic region
  Pfam annotation: Domain name=Chromo; Domain location=1-42; Score =14.7; E_value=0.018; Accession=PF00385.14; Description='chromo' (CHRromatin Organisation MOdifier
MDTSSQPPRKLVLVQWKGMAPEDSTWENWADIRDSLHLEDKVTFPGEDTVRIVRSNDTSSNEARPRRATTRPRYLEEYEMKLRIPCLSAACCVLKREETKAEIFEDQPSLSETLFTLKRCTIHA

SEQ ID NO: 163376 - protein, 177 aa, Glycine max
  Coding DNA Sequence Number=SeqID_46598
  Gene Ontology: Mol. function=chromatin binding; Cellular component =chromatin; Biological process=chromatin assembly or disassembly
  Homolog annotation: Hit_ID=Q1SAV4; Match level="QueryCoverage=84%, HitCoverage=45%, E-value=1e-40, Identity=56%"; Hit description =Integrase, catalytic region
SKAFVRKCSICQQVKHETRKSGGLLQPIPIPTGIWEDLSMDFVTHLPSSHGFMVVLVVVYRFSKGIHLGALPTQFTAFKVANLFMGMNEWHHSANEYCLPSTNGWSNRSPQPHTRNVSTRLRSLATYSLVSVLTDASSIGACRPRIFFINGFLCFLEDEWQRNGEGRKRGDATSRRR

SEQ ID NO: 163377 - protein, 69 aa, Glycine max
  Coding DNA Sequence Number=SeqID_46599
MISYSFKSSLRDEYKEFEKLIQEDLREVDDRLEEKIDEAEMIEEEEVVDQKFFTSSMKHVLFQLICSLS

SEQ ID NO: 163378 - protein, 110 aa, Glycine max
  Coding DNA Sequence Number=SeqID_46600
  Gene Ontology: Mol. function=methyltransferase activity; Cellular component=ribonucleoprotein complex; Biological process=mRNA metabolic process
  Homolog annotation: Hit_ID=Q5N9F1; Match level="QueryCoverage=98%, HitCoverage=92%, E-value=6e-29, Identity=66%"; Hit description=Small nuclear ribonucleoprotein-like
  Pfam annotation: Domain name=LSM; Domain location=14-105; Score=51.8; E_value=2.2e-12; Accession=PF01423.12; Description=LSM domain
MSTEEESAVKEPLDLIRLSLDERIYVKLRSDRELRGKLHAKNFMVDVKDWINAYDQHLNMILGDVEEIITTVEIDDETYEEIVRTTKRTVPFLFVRGDGVILVSPPLRTA

SEQ ID NO: 163379 - protein, 328 aa, Glycine max
  Coding DNA Sequence Number=SeqID_46601
  Gene Ontology: Mol. function=protein binding; Cellular component =integral to membrane; Biological process=protein amino acid phosphorylation
  Homolog annotation: Hit_ID=Q6ZIU0; Match level="QueryCoverage=96%, HitCoverage=79%, E-value=4e-36, Identity=31%"; Hit description =Putative HcrVf3 protein
  Pfam annotation: Domain name=LRR_1; Domain location=148-177; Score =1.3; E_value=1.6e+02; Accession=PF00560.23; Description=Leucine Rich Repeat
  Pfam annotation: Domain name=LRR_1; Domain location=203-225; Score =19.3; E_value=0.014; Accession=PF00560.23; Description=Leucine Rich Repeat
  Pfam annotation: Domain name=LRR_1; Domain location=227-250; Score =7.2; E_value=13; Accession=PF00560.23; Description=Leucine Rich Repeat
  Pfam annotation: Domain name=LRR_1; Domain location=252-280; Score =12.0; E_value=1.6; Accession=PF00560.23; Description=Leucine Rich Repeat
  Pfam annotation: Domain name=LRR_1; Domain location=26-48; Score =12.7; E_value=1.2; Accession=PF00560.23; Description=Leucine Rich Repeat
  Pfam annotation: Domain name=LRR_1; Domain location=300-323; Score =7.2; E_value=13; Accession=PF00560.23; Description=Leucine Rich Repeat
  Pfam annotation: Domain name=LRR_1; Domain location=50-72; Score =13.7; E_value=0.67; Accession=PF00560.23; Description=Leucine Rich Repeat
  Pfam annotation: Domain name=LRR_1; Domain location=74-97; Score =11.0; E_value=2.5; Accession=PF00560.23; Description=Leucine Rich Repeat
  Pfam annotation: Domain name=LRR_1; Domain location=99-121; Score =15.7; E_value=0.16; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=148-177::203 -225::227-250::252-280::26-48::300-323::50-72::74-97::99-121
MEHLDFSSNYDSSEMQIPEYIGSFKNLRYLNLSYIGLSGRIPYELGNLLKLEYLDLQENFLDGAIPSQLGNLTSLRYLDLSYNFEIDGEIPCQFRNLSQLQYLDLEGTHLSGAIPFQIGNLPILNTLKLGQNLDVKSMDTMWLSSLYSLTHLGLDSLHNLDSSHHLLQTISKLFANLRELSLIQHFSWCNKTGMLPNLTNLPSLRNLNLSYNRLTREIPKSIGLLYELMSLHLEENYLVGDIIESHLTNLTKLEELDLTDNSLSLKFGTTWVPPFQLYVLGLASCKLGPSFPSWIQTQSHLQFLDVSDAGIDDFVPDWLWNKLQLYMP

SEQ ID NO: 163380 - protein, 764 aa, Glycine max
  Coding DNA Sequence Number=SeqID_46602
  Gene Ontology: Mol. function=hydrolase activity, acting on acid anhydrides, in phosphorus-containing anhydrides; Cellular component =nucleus; Biological process=nucleobase, nucleoside, nucleotide and nucleic acid metabolic process
  Homolog annotation: Hit_ID=Q8W4M7; Match level="QueryCoverage=99%, HitCoverage=100%, E-value=0.0, Identity=78%"; Hit description=DNA repair helicase UVH6
  Pfam annotation: Domain name=DEAD_2; Domain location=72-286; Score =237.7; E_value=2.5e-68; Accession=PF06733.6; Description=DEAD_2
  Pfam annotation: Domain name=DUF1227; Domain location=287-443; Score =328.3; E_value=1.4e-95; Accession=PF06777.2; Description=Protein of unknown function (DUF1227)
  Pfam module annotation: Pfam domain module=DEAD_2::DUF1227; Domain location=72-286::287-443
MKLEIEDITVYFPYDKIYPEQYSYMVELKRALDAKGHCLLEMPTGTGKTIALLSLITSYVLSKPHSPLKLLYCTRTVHEMEKTLAELRLLHHYQLRHLGPAAKILALGLSSRKNLCVNPRVLAAENRDSVDAGCRKLTASWVRAVAAENPSVPSCEFFEQYERAGSSAVLPPGVYTLQPLCICKGKAAYNIPPPYLRIAKSLWAMGYEDLRAYGKEKGWCPYYLARHMVQFANVVVYSYQYLLDPKVAGIISKEMQKESVVVFDEAHNIDNVCIEALSVSVRRQTIEGARRNLSRMRQEIDKFKATDAGRLRAEYNRLVEGLALRGDLPATDAWLANPALPDDILKEAVPGNIRRAEHFIHVLRRLVQYLEGRLDTENVEKESPVSFVVSILNHAGIDQKSLKFCYDRLHSLMMTLEITDTDEFLHIQTICDFATLVGTYARGFSIIIEPFDERMPHIPDPVLQLCCHDASLAIKPVFERFQSVVITSGTLSPIDLYPRLLNFNPVVSRSFTMSLTRDCICPMVLTRGSDQLPVSTKFDMRSDLGVVRNYGRLLLEMASVVPDGIEIMQHKLVFIETQDVVETTLALDNYRKACDCGRGAIFFSVARGKVAEGIDFDRHYGRLVIMFGVPFQYTLSKILLARLEYLRDTFQIKEGDFLTFDALRQAAQCVGRVIRSKADYGMMIFADKRYSRHDKRSKLPSWILSHLHDAHLNLSTDMALHVARDFLRKMAQPYDKTGGTGRKTLLSQEDLEKMAVSGMGDVMY

SEQ ID NO: 163381 - protein, 216 aa, Glycine max
  Coding DNA Sequence Number=SeqID_46603
  Homolog annotation: Hit_ID=Q2QXB1; Match level="QueryCoverage=39%, HitCoverage=19%, E-value=3e-17, Identity=54%"; Hit description =Expressed protein
DRNKNSPSDESFVEEGIHGHYEVGKGKKGLSWQRVKWTDKMVKLLITVVSYIGEDATFDNGCGRGKFTVLQKNGKGKWKYVSKVMAERDDHDNDGIRKSHHGDHDKDVLDVEIDDHDDSEENYTSPANSKGYRATGQPFKSLKLGQGQEDAATFGSALNNKEYNKSSHPHMQWDESGSLQLEEQKLQNFGRDVEARETKIQVAMSLVRKKTGKWNN

SEQ ID NO: 163382 - protein, 119 aa, Glycine max
  Coding DNA Sequence Number=SeqID_46604
MVYMRCSGVYSEVGSLFVTEEKEKNNNNEGVATQCTKNKYDKARRILTSKENEEDERKKKQQRIRSHQQEKPRMEDQHPRRKKNKHQRSETRQERGRRTTTATQEVKKEEGKKKNKNDA

SEQ ID NO: 163383 - protein, 574 aa, Glycine max
  Coding DNA Sequence Number=SeqID_46605
  Gene Ontology: Mol. function=identical protein binding; Cellular component=cytoplasm; Biological process=negative regulation of enzyme activity
  Homolog annotation: Hit_ID=Q9ZTT3; Match level="QueryCoverage=97%, HitCoverage=75%, E-value=1e-168, Identity=54%"; Hit description =Subtilisin-like protease C1
  Pfam annotation: Domain name=PA; Domain location=189-287; Score=44.2; E_value=4.4e-10; Accession=PF02225.12; Description=PA domain
  Pfam annotation: Domain name=Peptidase_S8; Domain location=11-417; Score=-5.6; E_value=1.8e-06; Accession=PF00082.12; Description =Subtilase family
  Pfam module annotation: Pfam domain module=PA::Peptidase_S8; Domain location=189-287::11-417
MEDTCGVVKIIGAKYFNIEGDYAKEDSISPRDVQGHGSHTASTIAGNLVKSSSLLGFASGTARGGVPSARIAIYKVCWIKIGCPQAETLAAFDEAIADGVDIISISTGLTSIVYIPYFQSAFDIGSFHAMKRGILTSKSADNSGPGLSSITTYSPWILSVAASTIGRKFLTKVQLGNGMVFEGVSINTFDLKNKMFPLVYAGDVPNTADGYNSSTSRFCYVNSVDKHLVKGKIVLCDGNASPKKVGDLSGAAGMLLGATDVKDAPFTYALPTAFISLRNFKLIHSYMVSLRNSTATIFRSDEDNDDSQTPFIVSFSSRGPNPLTPNTLKPDLAAPGVNILAAWSPVYTISEFKGDKRAVQYNIESGTSMACPHVSAAAAYVKSFHPNWSPAMIKSALMTTATPMSPTLNPDAEFAYGAGLINPLKAANPGLVYDISEADYVKFLCGEGYTDEMLRVLTKDHSRCSKHAKKEAVYDLNLPSLALYVNVSSFSRIFHRTVTNVGLATSSYKAKVVSPSLIDIQVKPNVLSFTSIGQKKSFSVIIEGNVNPDILSASLVWDDGTFQVRSPIVVYGDT

SEQ ID NO: 163384 - protein, 125 aa, Glycine max
  Coding DNA Sequence Number=SeqID_46606
  Gene Ontology: Mol. function=magnesium ion binding; Cellular component=chloroplast; Biological process=metabolic process
  Homolog annotation: Hit_ID=Q5UB07; Match level="QueryCoverage=75%, HitCoverage=16%, E-value=4e-33, Identity=69%"; Hit description=Wound- inducible putative chloroplast terpene synthase 4
MHDINMLNNWNSEDIGADTEGSKKIQLWAELERGEAASSIVCYMRESGASEEGAYKHIRRLLNETWKKMNKDKVSQSPFPKPFIEIAINLGRISQCTYQYGDGHGAPDSTVENRIRSLIIEPIAI

SEQ ID NO: 163385 - protein, 99 aa, Glycine max
  Coding DNA Sequence Number=SeqID_46607
MAVWGGQKGEVECEKKARLDRCDKKGVGVDSPTQNKKDNQEVGSVGPTVSFTLSQIEHGGLNMEQKHHEKGSTLLGNDLIGLLGDEGVLSEIRIWALKL

SEQ ID NO: 163386 - protein, 297 aa, Glycine max
  Coding DNA Sequence Number=SeqID_46608
  Gene Ontology: Mol. function=magnesium ion binding; Cellular component=chloroplast; Biological process=metabolic process
  Homolog annotation: Hit_ID=Q672F7; Match level="QueryCoverage=93%, HitCoverage=45%, E-value=8e-94, Identity=67%"; Hit description=E -beta-ocimene synthase
  Pfam annotation: Domain name=Terpene_synth; Domain location=66-269; Score=241.2; E_value=2.2e-69; Accession=PF01397.11; Description =Terpene synthase, N-terminal domain
  Subcellular localization annotation: CTP_CleavageSite=52; ConfidenceScore=5.52e-01
MTLVNSTLLNSSFISNFSFGKPQKPEGTNNLLLRRIICPIRCNATTTTTNVNASERKSANYQPNLWNYDFLQSLKCDHADIRYEDKAKKLLEEVRRMIKDENTDIWIKLELIDDVKRLGIGYSFDMEIGEALHRCLSSETFIDTITHNHRSLHETALSFRVLREYGYDVTTDIFERFKDYNGNFKAILSRDVKGMLSLYEASFLSYEGEQILDEAKAFTSFHLKGALKEGRSNTMILEQVNHAMELPLHHRIQRLEARWYIESYAKRKDANMVLLEAAKLDFNIVQSTLQTDLQEMS

SEQ ID NO: 163387 - protein, 121 aa, Glycine max
  Coding DNA Sequence Number=SeqID_46609
MAPDRMQLQSMCKKEHESFKEYAQRWRDLATQVSPLMTKKEMITMIVDTLPVFHYEKMVGYTPSSFANLVFTGKGSKKPGENGENKKEGGTHVVTVIPTWQNFPPAQYSANISPSLYPPPY

SEQ ID NO: 163388 - protein, 85 aa, Glycine max
  Coding DNA Sequence Number=SeqID_46610
MGLNQARAFRKKVHRVKLKYGSRDLGSTDGPHDVKIQNEHAFPPYGLPLNYTPPNVAYTPSENVNNSTPIPIESQQTQTDHAHVS

SEQ ID NO: 163389 - protein, 329 aa, Glycine max
  Coding DNA Sequence Number=SeqID_46611
  Gene Ontology: Mol. function=DNA binding; Cellular component=nucleus
  Homolog annotation: Hit_ID=Q8W239; Match level="QueryCoverage=66%, HitCoverage=85%, E-value=3e-77, Identity=70%"; Hit description=GT-2 factor
MLGDSAVLGTGGGGSGDAVAAPPVVGGGAAASGGAHEGGANGGGGSNSGDDRVEEGDKSFGGNRWPRQETLALLKIRSDMDVAFRDASVKGPLWEEVSRKLAELGYHRNAKKCKEKFENVYKYHKRTKEGRSGKSEGKTYRFFDQLQALENNPSIHAMQSPTPTPSKPPQTTALLATPVSIVVTTTTTPSTLVSNNATVPSTNTPPLPQAILNITPPSTLNITTPSFPSSNPTTYFPTQTPNPTTNNNPPNTITPASFPNFSADLLSNSSFSSTSSEETTTMGGGGMRRKRKRKWKDFFERLMKEVIEKQEGLQRRFLEAIEKREQERV

SEQ ID NO: 163390 - protein, 112 aa, Glycine max
  Coding DNA Sequence Number=SeqID_46612
  Gene Ontology: Mol. function=subtilase activity; Cellular component =cytoplasm; Biological process=proteolysis
  Homolog annotation: Hit_ID=Q93WW5; Match level="QueryCoverage=96%, HitCoverage=45%, E-value=2e-25, Identity=51%"; Hit description =Putative subtilisin
PDIAAPGVEVIAARSPVGPISNVKGDKRKVQYNIESTSMASPHATAAAAYVKSFHPNWSPAMIKFALMTTATPMSQTLNPEAEFAYGAGLINPGLVYDISEADYIKFLCEER

SEQ ID NO: 163391 - protein, 82 aa, Glycine max
  Coding DNA Sequence Number=SeqID_46613
  Homolog annotation: Hit_ID=Q1STT2; Match level="QueryCoverage=75%, HitCoverage=13%, E-value=3e-08, Identity=39%"; Hit description =Lipocalin
MASTTQDFNGWRSEILEHIFNEEDSKEIQQMSLVNIVGQDKIFWRLGSNGDYSVRSAYHHLMENMLDNEHLKVEVTGCRFGD

SEQ ID NO: 163392 - protein, 599 aa, Glycine max
  Coding DNA Sequence Number=SeqID_46614
  Gene Ontology: Mol. function=DNA binding; Cellular component=nucleus; Biological process=porphyrin biosynthetic process
  Homolog annotation: Hit_ID=Q8W240; Match level="QueryCoverage=82%, HitCoverage=80%, E-value=3e-71, Identity=47%"; Hit description=GT-2 factor
MQLGDSSVLEISSHTEPEMAVVSPPEEAPHEGGHNSGGGGGSDEMIGMDLDANSGEGNEGNKMSFGGNRWPRQETLALLKIRLDMDAVFRDSSLKGPLWEEVSRKLAELGYQRSAKKCKEKFENVYKYNKRTKENKSGKSHGKAYKFFDQLQALENQFTVSYPPKPEATSTLTTTNTLTSDHGNKVISYVTPFPSTNPTLIPPSPQTNTNTTTTTTTTSTTDPRDSSPPQTNNNNNSVPHSLPNMNAPFLTTTTSTSSSTASDEDLEERYRRKRKWKDYFRRLTRKVLLKQEEMQKKFLEAMDQRERERVAQQDNWRMQEMARINREHEILVQERSTASAKDAAVIALLQKMYGQQNPTQHVEVEPPQQQKQTMPQSQPPILMPNNNFEVKKMNNGHSATSTTTTTTSPVSSSSSSRWPKAEVHDLIRLRTSLEIKYQENGPKAPLWEDISIAMQRLGYNRSAKRCKEKWENINKYFKKVRESSKERREDSKTCPYFHELEALYKEKGKSQNPFGMFQNMTPNETMMMEPLMVQPEQQWRPPPQSLEEGIGKDNASEEYNQEKEEEVEENGGDDDDNIEEDGDSVEDAGPNPCEIATNN

SEQ ID NO: 163393 - protein, 448 aa, Glycine max
  Coding DNA Sequence Number=SeqID_46615
  Gene Ontology: Mol. function=[protein-PII] uridylyltransferase activity; Biological process=nitrogen compound metabolic process
  Homolog annotation: Hit_ID=Q6ZI91; Match level="QueryCoverage=97%, HitCoverage=98%, E-value=1e-134, Identity=55%"; Hit description =Putative ACT domain-containing protein
  Pfam annotation: Domain name=ACT; Domain location=129-196; Score =31.2; E_value=3.6e-06; Accession=PF01842.15; Description=ACT domain
  Pfam annotation: Domain name=ACT; Domain location=265-336; Score =17.5; E_value=0.021; Accession=PF01842.15; Description=ACT domain
  Pfam annotation: Domain name=ACT; Domain location=343-409; Score =36.9; E_value=6.8e-08; Accession=PF01842.15; Description=ACT domain
  Pfam annotation: Domain name=ACT; Domain location=36-99; Score=22.0; E_value=0.0021; Accession=PF01842.15; Description=ACT domain
  Pfam module annotation: Pfam domain module=ACT::ACT::ACT::ACT; Domain location=129-196::265-336::343-409::36-99
MAKVCWPYFDPEYENFSNRINPPRVSVDNDSCHDCTLIKFDSINKPGILLEVVQILTDLDFIITKAYISSDGGWFMDVFHVTDQQGKKITDSKTIDFIEKTLGPKGQSTEGVNCWQGKRVGVHSIGDHTAIELIGRDRPGLLSEISAVLASLQFNVIAAEVWTHNRRIACVLYVNDATNQAMDDSKRLSIMEEQLNHILRGCEDDEKVARTSFTMGFTHMDRRLHQMLFADRDYESVGLTTTDVDCPPSFRPKIRIERIVEKGYSVVSVRCKDRAKLMFDIVCTLTDMEYVVFHATISSEGQYASQEYFIRHMDGCTLDTEGEKERVIKCIEAAIQRRVSEGVSLELCAKDRVGLLSEVTRILRENGLRVSRAGVSTVGEKGLNVFYVRDASGNPVDMKIIEALHKEIGQIMMVNVKRVPGYVKAPAETRGWAKTSFFFGNLLERFLT

SEQ ID NO: 163394 - protein, 64 aa, Glycine max
  Coding DNA Sequence Number=SeqID_46616
  Subcellular localization annotation: CTP_CleavageSite=57; ConfidenceScore=5.05e-01
MYSISRVYESMNSGLDLNSSVTPTPPCQRPSLGHNQPCLPPPLSLLHLTRIKTLPTSSAMRNGA

SEQ ID NO: 163395 - protein, 69 aa, Glycine max
  Coding DNA Sequence Number=SeqID_46617
MGLNQAPSFNKRFYHVKIKSLEVASLQELGQRMEQLQRQAFLKTYGKIWDLAVIEVSVEAIASLAQYYD

SEQ ID NO: 163396 - protein, 99 aa, Glycine max
  Coding DNA Sequence Number=SeqID_46618
MVSRGIILVEEHTAAVGTTSHDRFSKRNTLDEVESPTVATYPSAGGRRETRGMRVPRKEYARSRHQRLFEENVGKTGKDAIYELLSGRFGSCIYARGRY

SEQ ID NO: 163397 - protein, 77 aa, Glycine max
  Coding DNA Sequence Number=SeqID_46619
MSLFGSSNDHHHCHVEEDMSPLCPRIKINKIMIEELEAYNNTDLKKPCSWPSRIKFVMSPIVGLLSHKTHPMAPLDF

SEQ ID NO: 163398 - protein, 142 aa, Glycine max
  Coding DNA Sequence Number=SeqID_46620
MKVDMEAMKEQMTTMMEAMISLRRMMEVNAATVVAASTSIEVDPTHPPSFNQVNHPALDMVGQRGKALESAGGPILCRFRTSIPFNHMACLPTIHHSMLHTLPMRMSTTPHPYPLRSNNPNLIMHMSLNPWGRHMKHPETTI

SEQ ID NO: 163399 - protein, 476 aa, Glycine max
  Coding DNA Sequence Number=SeqID_46621
  Homolog annotation: Hit_ID=Q5JKH1; Match level="QueryCoverage=82%, HitCoverage=85%, E-value=5e-50, Identity=31%"; Hit description =Putative BRI1-KD interacting protein 112
  Pfam annotation: Domain name=DEK_C; Domain location=402-455; Score =58.5; E_value=2.2e-14; Accession=PF08766.1; Description=DEK C terminal domain
MSSGTLENEKPQVEEEQAQAEDNHTKQEDNSEMKDDDDRGEEERDQVEQEKDVEKEEEKEEEEEEKEEDRDEVKSKKSTKESGYATPGSERPTRERKTVERYTVSSPDKFPRSSSIKALSIEKGNGTQLKDIPNGLFSGYVWTENEEKQRVKIKEKIDKCVKEKLVDFCNVLNIPINKTSKKKEELSAKLLQFLESPHATTDVLLADKEKLVSMLQKGKKRARKQTPSKSSGEGSKTSAKKQKQNSQVGKNQKQSSDIEDSDAAEPSDAKVDSQEDDDSSQKSESDNEESISEKEEDKEKAHKRTSKKILKEDQTTPVKKTTVVKTAKSNEKAPEKSSSKRAVTDSTSKSKQSASKKQKTMKENQNSIGKDANQKQADKSSKALVKDQGKGKSSEKAKAEPSKVEMHRVAVDILKEVDFNKATLSDILRQLGTHFDVDLMHRKAEVKDIITDVINNMSDDDGEEAENVGDDDEDDA

SEQ ID NO: 163400 - protein, 77 aa, Glycine max
  Coding DNA Sequence Number=SeqID_46622
  Gene Ontology: Mol. function=structural constituent of ribosome; Cellular component=ribonucleoprotein complex; Biological process =translation
  Homolog annotation: Hit_ID=O81363; Match level="QueryCoverage=73%, HitCoverage=21%, E-value=2e-25, Identity=96%"; Hit description=40S ribosomal protein S4
  Pfam annotation: Domain name=RS4NT; Domain location=17-54; Score =78.8; E_value=1.8e-20; Accession=PF08071.2; Description=RS4NT (NUC023) domain
MGQLAMYIHAYLQLQATGLKKHLKRLNAPKHWMLDKLGGAFAPKPSSGSHKSRECLPLILILRNRLKYALTYLKTSR

SEQ ID NO: 163401 - protein, 124 aa, Glycine max
  Coding DNA Sequence Number=SeqID_46623
  Homolog annotation: Hit_ID=Q1S1D0; Match level="QueryCoverage=50%, HitCoverage=36%, E-value=3e-07, Identity=40%"; Hit description =Pectinesterase inhibitor
AILQLSLYKAIEGQKFLRTLMKSENVPAIAQCANSDYESVITAYKSALSKLKDDPKTAKHYARDAECANSDYEYVVMAFRSALSDLKYDPLTAIYANLMPNMLLMDLNTAAHIFNPAIPALIVA

SEQ ID NO: 163402 - protein, 256 aa, Glycine max
  Coding DNA Sequence Number=SeqID_46624
  Gene Ontology: Mol. function=oxidoreductase activity; Cellular component=cytoplasm; Biological process=metabolic process
  Homolog annotation: Hit_ID=Q93W57; Match level="QueryCoverage=90%, HitCoverage=66%, E-value=3e-64, Identity=52%"; Hit description =Steroleosin
  Pfam annotation: Domain name=adh_short; Domain location=48-217; Score= 79.4; E_value=1.1e-20; Accession=PF00106.15; Description=short chain dehydrogenase
MIEINKLLNFALPPLSLIVIFIFTPPLLLVKLLMCVKKFLYTENVAGKVVLITGAASGIGEQVAYEYARRGAKLSLVDIRKDKLVAVADKARSLGSPDVTIIGADVSKVQDCNRFVDETVNHFGRLDHLVNNAGISRKSVGVEDWLDVSEFTPIMDINFWGAVYGTLYAIPHLKINKGRIIVIASGCGWFPLPRISIYNASKAAVINFFETLRMELGWDIGITIATPGFVKTDLTLRAMEFEVGLVQRTCSGRRVG

SEQ ID NO: 163403 - protein, 124 aa, Glycine max
  Coding DNA Sequence Number=SeqID_46625
MNHFFRKVPGRGFSGSLPEEVFFRKTFGYFRKNPSSGNFLENVLPELPEEPLTGLPEVSAVSLLSPFFPASSPLVFYPKVTILSKGELGRLTSFAEKKKTRFALALPEKKKQFAEKGEEASRKE

SEQ ID NO: 163404 - protein, 172 aa, Glycine max
  Coding DNA Sequence Number=SeqID_46626
  Gene Ontology: Mol. function=oxidoreductase activity; Biological process=metabolic process
  Homolog annotation: Hit_ID=Q93W57; Match level="QueryCoverage=99%, HitCoverage=35%, E-value=4e-23, Identity=39%"; Hit description =Steroleosin
MDLIHKYLNIVASITTFFFLCLFLPPYWTFKFFLYITNYIFSENVAVKLFTSLLLPLLLARCLERASPGAAKQHLCICKGKAAYNIPSPYLRIAKSLWAMGYSLWAMGYHLAYEYAKRGACLALSARRETAVLREVADRTRDCGSPDVIIMRADVSKVEDCFRLVDETVNHF

SEQ ID NO: 163405 - protein, 146 aa, Glycine max
  Coding DNA Sequence Number=SeqID_46627
  Homolog annotation: Hit_ID=Q9LUF1; Match level="QueryCoverage=49%, HitCoverage=20%, E-value=1e-11, Identity=56%"; Hit description=11 -beta-hydroxysteroid dehydrogenase-like
NGILPEEASSGNIPDDVLPEIVWGESKPKIKPRSIVNGQQVNILVLPFVNLEGWMKEARSYWFKDARCGYFFKNFLTPVVSNIFLLGASLAVVLVDSVIYIILKLHSTSSGHNSLSKYVTLNHAGTVRYPINPQRAINYRFGAPTH

SEQ ID NO: 163406 - protein, 109 aa, Glycine max
  Coding DNA Sequence Number=SeqID_46628
  Gene Ontology: Mol. function=oxidoreductase activity; Biological process=metabolic process
  Homolog annotation: Hit_ID=Q9LUF1; Match level="QueryCoverage=99%, HitCoverage=46%, E-value=3e-23, Identity=37%"; Hit description=11 -beta-hydroxysteroid dehydrogenase-like
MPAPRRNLYNASKAALVSMYETLRVEVGSDVGITIVTPGYLTVPAWFKVTYLLKLLCPELVEWSFRMMYMTESTRTTAREAPSKKILDTTGVKKFFYPSSIQSPDVKTE

SEQ ID NO: 163407 - protein, 132 aa, Glycine max
  Coding DNA Sequence Number=SeqID_46629
MDPTQMKKIQAMNRILSSDSSSSTCVVYYDEYIQSCQTMKPQIPSPEVNESKTLLEKHVGENEDVNSVDFKGKWGIEKATEESKEEENLDGGYKQSLIPSSSYELNKRADDFVARVNRQRRLELSLLHYDSY

SEQ ID NO: 163408 - protein, 80 aa, Glycine max
  Coding DNA Sequence Number=SeqID_46630
MVPLVAPVQGSEGRTMLNGMPQNSPMISTYCIRVVSLEKWRLRNLCWGWCLVLDVQKAGLGADLGVAFVDDWVFLADRVV

SEQ ID NO: 163409 - protein, 195 aa, Glycine max
  Coding DNA Sequence Number=SeqID_46631
MKRKECALRCPYRTRAEARVMSEIKEVQEWMKADMEAMKEQMATMMEVMMSMKKIMEVNAAAVAATSVVAEVDPTPTSSLNQINHPTLDMVGQGGKELGSTGGPYFVYTPPNVAHTPDKNVNNSTPILMESQQPQSYHAHVSLPVGETHEAPRGHNLADFEPLLGYATKGQAFCGVPLPNSLGAPQYHPQPLHLV

SEQ ID NO: 163410 - protein, 238 aa, Glycine max
  Coding DNA Sequence Number=SeqID_46632
MWSKESRELEKNGIKEDDSKAKSLVNMQEGKKSIHSSEGTTTSEVVADEAAKPSKFSSSSSTQPFEVEGKDKIDASSDEESQVSNRDPEIDGQESTKSETDEEVEQRETLQPESPEDQQCINKDQEESHETHEIEEKVYEQVDEFDQEHSQLLEEQKECEEEATEGKKNGQKGSKKLFVSIIIAGSGLLASGIFLFIRHRRARKGVSVLLAVVSDTQSEQKFTLLIAFELKEIEWKSA

SEQ ID NO: 163411 - protein, 1582 aa, Glycine max
  Coding DNA Sequence Number=SeqID_46633
  Gene Ontology: Mol. function=heat shock protein binding; Cellular component=integral to membrane; Biological process=protein folding
  Homolog annotation: Hit_ID=Q06166; Match level="QueryCoverage=98%, HitCoverage=84%, E-value=3e-44, Identity=21%"; Hit description =Mature parasite-infected erythrocyte surface antigen
  Pfam annotation: Domain name=DUF1103; Domain location=467-496; Score =2.1; E_value=57; Accession=PF06513.2; Description=Repeat of unknown function (DUF1103)
  Pfam annotation: Domain name=DUF1103; Domain location=651-679; Score =6.7; E_value=8.2; Accession=PF06513.2; Description=Repeat of unknown function (DUF1103)
  Pfam annotation: Domain name=DUF1103; Domain location=695-724; Score =3.9; E_value=27; Accession=PF06513.2; Description=Repeat of unknown function (DUF1103)
  Pfam annotation: Domain name=DUF1103; Domain location=741-771; Score =0.5; E_value=1.1e+02; Accession=PF06513.2; Description=Repeat of unknown function (DUF1103)
  Pfam annotation: Domain name=DUF1103; Domain location=787-817; Score =1.6; E_value=71; Accession=PF06513.2; Description=Repeat of unknown function (DUF1103)
  Pfam annotation: Domain name=DUF1103; Domain location=880-909; Score =5.5; E_value=14; Accession=PF06513.2; Description=Repeat of unknown function (DUF1103)
  Pfam module annotation: Pfam domain module=DUF1103::DUF1103::DUF1103:: DUF1103::DUF1103::DUF1103; Domain location=467-496::651-679::695 -724::741-771::787-817::880-909
MPHNIEDTSHDKELEVQEMEDNGGFVEEEKVVSEKMLDDANGNKIGEVIQKQIEESKSGIKDGDGESVKEKIGKAGYKGMKTSEIEQNIGAHVAQNIGDTSQEVSKEFDIEQMGEAKRTAGKIEREESGDMRVEVNVSTEGETLEESKQKQFGEEPKPETEDRLKESVKESSMELMKAPKLDQNIDDHIPSNICGTSQEFKKSRIQQKEKTKSIEENMEGRETGRMSVEASKDSQKCIFGDSMKKDIKKPKIETKDGDQEHDGEKAGKEEFDSMTIREVFPKQLPEATNEENKGLSASKMQDTENVKEAMIKRKLKEIDSFVYKNEGEGPRKMHMEAKKDLTKDVKEAMVKREGKEIKYVVDNSGDDERERMHIEAKKDLTKETTQEGEDLKEEMVKREGKEIDYFLDVDEDKNPRRMHMEANKDFTTDTMQETKDVKEVMVKRKDKEIQNFADEGEGEKPKRMHMKAKDLTQGRMQESEEVNEAIDKRKGKEIQHFVDKGNGEELISMKIEAKQDLTKEAMQESEDVKETMFKREGKEIDYFLDENEGEEPRRMHMRAKKDLITETVQDSEDVKEEMVKRNDKENENFAENGEGEEPRRMHMEVKKDLKKETVHKSELAKDIMVKRKDKEIDNFADKGEGEEPKRMYIEANKDLAKEIMKKGDVKELTVKRKDKEFDNFVDKGEGEEPKRILMETKNLKKETMQESEDVKEEIAKRKDKDIEYSVNKGKGEEPKRMMDVEAKNDLTIEAMKEAKDVTEVMVKRKDKEIKNFVDKSEGKEPKRMHMEAKEHLAKETMQENKDVKEAMFKEKGKETEYFVIKGEGEEPTTMHMKAKKDLTTNTMQESEYVKEAMGKTKCEEEIDYFFNEGEGEEPNRMHMEAKDITTEIMQESEDIKEATIKRKGKETEYFVGQGEGKEIDYFVNKSEGEELKRTHMEAKKDIAKETMQEEIEKIKNGIKDSDQQNVLEKTGKGKFEVPTEELPKLIGRPDGSRGLKVANMEEQKEMIKEEMVETKSSMEKVKGEKSNTTSKVTEKNMATEIIQKETEESNIERMSRDGPYVPNNMVKVVFEVLGTFQAKLPKQVIEAISQNKKEKNEYVIVKLKGEGSIKMHVEPNDAFDEDEIEDINQKEIGKPKLKSSDQISETDDVDVGVFDGSKRPKFPKMGETKDVKEDSAKIEESVEKVNEDKYEKIQVEEKGGMRKDTTGESTQTEREGSKIQTMEKDQHCLQETISKGIFEASTAAKEEFPVITVDSLADKRKGLKGKKIDEAKVAKEELVKQTSEEKKIIIKEKGSRIEQFVKKVQGEKYEMIQAEAKEGLRKDITKGKDQQGLQEGTSRGRYEANTTREKTLKPEIPLEKQIKKGEPITRKDEFAKGQKFRETIQEEIEGHKDKIDVSDQHVQRDVVKGVGKVDTIGKEMIKKEYVAHLGPVAKRMETKKDLKATPEKEKYTIAQNVKDEKPRIYEENIKVDVEKVDKKGYQTKVVEEGMLKGEHKAEVVLEIKTERPKVAKREETKEASKLPFKREMGKTIQSAEDRRPKTGEITSEFEKVIEFKQAVEKMHESHNGEHQRDSKEVTPKKE

SEQ ID NO: 163412 - protein, 123 aa, Glycine max
  Coding DNA Sequence Number=SeqID_46634
MSRNFTDCLTMGVKFLKAVKRRLHAIKQWSPDEIRAINSWGSGLNGGGGMNSARQSIHRAPNKMMEDARTALDNQFVGLRTQWWRMHEWQSIHGLRIRFDGGGCTNSARQSIRGAPDSMVEDA

SEQ ID NO: 163413 - protein, 620 aa, Glycine max
  Coding DNA Sequence Number=SeqID_46635
  Gene Ontology: Mol. function=heat shock protein binding; Cellular component=integral to membrane; Biological process=protein folding
  Homolog annotation: Hit_ID=Q1T0K7; Match level="QueryCoverage=28%, HitCoverage=82%, E-value=1e-35, Identity=49%"; Hit description=Heat shock protein Hsp20
  Pfam annotation: Domain name=HSP20; Domain location=32-139; Score= -11.8; E_value=0.0068; Accession=PF00011.11; Description=Hsp20alpha crystallin family
MDLELGLKITKTRDDIASISEYRLAKAGPIFQSRETSTMFILSAHLKGYKRNKINIKISEDGSKISISGEKPVQNILMMGWLMHRKEVDVVGFNKVFKIPDGVKLDGIKAKYDEEEWTLNIFMPKLVKGICGVRIEEIKEESEKGRSELEKSEADQILGIVGEASQKGSKESNSKVQAMEDSESFMEKDGGESDKMLDDANREIIKEKIKKDVEESKLGGNGESSGEKGEIEGCEVMKTSELEQNIGRGTSQKIGDTSQKVIEESKLRIEDEGVKGMREEVGKTVYEAVKTSEKENNVGEGMPHNIGDTSHDKEFEVQEMEDNGGFEEEEKLVSEKMLDDANGNKIGEVIQKQIEESKIGIKDGDGESVKEKIRKAGYKRTKTSELEQNIGAHVTQNIGDTSQGEPKDSGIEQTGEAKRTVGKIERQESGEMCVEVNVSTEEEILEKSKQKQFGETKTETEVRLKESNMEPMKAPKLDQNIDVHIPSNIGGTSQEFRKARIQQKDKTKSIEENMDGRETGRMPVETSKNSQKCISGDSMKKDIKKPKIETEDGDQEHYGEKAGKLDSTTIWEEFPKQLPKATVEENKGLSASKMQQTEDVKEAMIKRKSKEIEYFVDKDE

SEQ ID NO: 163414 - protein, 46 aa, Glycine max
  Coding DNA Sequence Number=SeqID_46636
MSVEEFLALVAWPGGQPPPSGMEDEPVPPEPFIFETNPSVQEEAAA

SEQ ID NO: 163415 - protein, 88 aa, Glycine max
  Coding DNA Sequence Number=SeqID_46637
MGLDWNRVRTIQPNPHLGNRVGTTLDETNPKTMQDLGNHHGGWCAFSGRRCEIVIGAVATEGLPKARWRNQNKKKGELLVTVEHANKN

SEQ ID NO: 163416 - protein, 126 aa, Glycine max
  Coding DNA Sequence Number=SeqID_46638
MAGTAMPPLAAAGRGLTRRDEEAHTAIRISGTRLRRETRHWHWRDIPTFAPFKSICLEAVVGLDDPLAGLPTLACPASANSGSLSSALSHQYEWRYRLLHLSRSAAANGGIAVGVTSFMPVTMAAP

SEQ ID NO: 163417 - protein, 182 aa, Glycine max
  Coding DNA Sequence Number=SeqID_46639
GPPEPEVGPSAARVSTKESCVDPSRNDLDTGDLDKCRLYIEQNPPRLIALERDYEGSTTVHNIPLLHDQVKVGIEEVKDADAPVPVPTSEALNTFLAWPTHLVKRLSELGVVGPTKPADRPDHESIQRSAQSQFESESYMKNWMQNSKWDVYLGAYLNGALKGLDDTPQPKFKAGARWIVVK

SEQ ID NO: 163418 - protein, 109 aa, Glycine max
  Coding DNA Sequence Number=SeqID_46640
  Gene Ontology: Mol. function=transmembrane receptor activity; Cellular component=membrane; Biological process=defense response
  Homolog annotation: Hit_ID=Q5JBT4; Match level="QueryCoverage=98%, HitCoverage=12%, E-value=8e-27, Identity=49%"; Hit description =Candidate disease-resistance protein SR1
MVFYKVYPSDLQHQKGSYGEALAKHEERDGYEYEFIERIVKSVTRKINPVSLHVADYPVGLGSQVRLVWKLLDVGSDEGVHMIGIHGKGGLGKTTLALAIYNLIADQFD

SEQ ID NO: 163419 - protein, 126 aa, Glycine max
  Coding DNA Sequence Number=SeqID_46641
  Gene Ontology: Mol. function=transferase activity, transferring hexosyl groups; Cellular component=membrane; Biological process =carbohydrate metabolic process
  Homolog annotation: Hit_ID=Q1T0K1; Match level="QueryCoverage=61%, HitCoverage=19%, E-value=3e-33, Identity=84%"; Hit description =Probable UDP-glucose,sterol glucosyltransferase [imported] -Arabidopsis thaliana-related
MARNKGIIPSGPTEISIQRKQLKAIIDSLLPACISPDLETGVPFRAQAIISNPTACGHTHVAEALGVPLHIFFTMPWTFLVRTKSRSNGVSNIQINATVSYQIITHYPIVKESALSFKDRNTKWIP

SEQ ID NO: 163420 - protein, 129 aa, Glycine max
  Coding DNA Sequence Number=SeqID_46642
MVEEKEINDQEKEIEVEKEKENEEKEKVEKNKGGKEKSRSEKARMKKKEKVSNEDTEVPYPVVPYKKDKDRHLARFLDIFRKLEITMPFGEVLQQMPLYSKFLKDMLTRKNRYIHQKNIVVEGNCSVVI

SEQ ID NO: 163421 - protein, 217 aa, Glycine max
  Coding DNA Sequence Number=SeqID_46643
  Gene Ontology: Mol. function=transferase activity, transferring hexosyl groups; Cellular component=membrane; Biological process =carbohydrate metabolic process
  Homolog annotation: Hit_ID=Q1T0K0; Match level="QueryCoverage=93%, HitCoverage=83%, E-value=7e-56, Identity=60%"; Hit description =Glycosyl transferase, family 28
  Pfam annotation: Domain name=Glyco_transf_28; Domain location=135 -217; Score=3.1; E_value=0.0014; Accession=PF03033.10; Description =Glycosyltransferase family 28 N-terminal domain
MEECVKVRGAHEEKHRLRKWRRGKDSKRGLDHFILEPTGTERNLLVADHEIIFSRSMMEKCDSPRQDLILDRLSECEKQKLFNLVKIQSDGTVKVDLEKDAPLASELLKFQSFEESTMSGTIISESKKSAPWLQIVILVVGTRGDVQPFLAIAKKLQACLNISIQFILEYGHCVRLATHADFDTFVKSAGVNFYPLGGDPRALAECKRFLFNTAINI

SEQ ID NO: 163422 - protein, 71 aa, Glycine max
  Coding DNA Sequence Number=SeqID_46644
MAIGILPSYLSVETWLIIIILKTSLRASALKKGSLTEAIGLSGFAEWTLGSSNSYINIAICKLLRRQDSTL

SEQ ID NO: 163423 - protein, 672 aa, Glycine max
  Coding DNA Sequence Number=SeqID_46645
  Gene Ontology: Mol. function=cellulose synthase (UDP-forming) activity; Cellular component=membrane; Biological process=cellulose biosynthetic process
  Homolog annotation: Hit_ID=Q6XP45; Match level="QueryCoverage=93%, HitCoverage=68%, E-value=0.0, Identity=69%"; Hit description =Cellulose synthase
  Pfam annotation: Domain name=Cellulose_synt; Domain location=161-670; Score=489.6; E_value=3.6e-144; Accession=PF03552.5; Description =Cellulose synthase
  Pfam annotation: Domain name=PHD; Domain location=10-59; Score=7.5; E_ value=0.01; Accession=PF00628.19; Description=PHD-finger
  Pfam annotation: Domain name=zf-C3HC4; Domain location=11-56; Score =6.8; E_value=0.031; Accession=PF00097.15; Description=Zinc finger, C3HC4 type (RING finger)
  Pfam module annotation: Pfam domain module=Cellulose_synt::PHD::zf -C3HC4; Domain location=161-670::10-59::11-56
VAVTELSGQICQICGDELEVTVNGEPFVACNECAFPVCRPCYEYERREGNQVCPQCKTRYKRIKGSPRVEGDEEEDDSDDLESEFDIGSVFSARLNYGSQVNGSVIHAPSEFDAASVASEIPLLTYGQEDVGISADKHALILPPFTARGKRVHPMPFPDSSVPVSLFNVTINDGDAVQPRPMDPKKDIAVYGYGSVAWKERMEDWKKKQSEKLQVVRHEGGKDSDELDDPDLPKYEKEGKPSLLADIDVFVSTVDPMKEPPLITANTVLSILAVDYPVDKVACYVSDDGAAMLTFEALSETSEFARKWVPFCKKFCIEPRAPEWYFAQKVDYLKDKVDATFIRERRAIKREYEEFKVRINALVALAQKVPEDGWTMQDGTPWPGNNVRDHPGMIQVFLGQNGVRDIEGNELPRLVYVSREKRPGYDHHKKAGAMNALVRVSAIITNAPYVLNVDCDHYINNSKALREAMCFMMDPTSGKKICYVQFPQRFDGIDRHDRYSNRNVVFFDINMKGLDGIQGPIYVGTGCVFRRQAFYGYDAPTSKKAPRKTCNCWPKWCCCLCCGSKKKKIKAKSSVKKKIKNKDDIKQMHALENIEEGIEGIDNEKSSLMSQSKFEKKFGQSSVFIAFDTLGRWGCSKSSKFCYTLERGHPSLKLFSSSGLPVLRPLLHFVFQ

SEQ ID NO: 163424 - protein, 260 aa, Glycine max
  Coding DNA Sequence Number=SeqID_46646
  Gene Ontology: Mol. function=magnesium ion binding; Cellular component=integral to membrane; Biological process=photosynthesis, light harvesting
  Homolog annotation: Hit_ID=P09755; Match level="QueryCoverage=86%, HitCoverage=92%, E-value=1e-125, Identity=95%"; Hit description =Chlorophyll a-b binding protein 2, chloroplast precursor
  Pfam annotation: Domain name=Chloroa_b-bind; Domain location=45-213; Score=201.2; E_value=2.4e-57; Accession=PF00504.12; Description =Chlorophyll A-B binding protein
  Subcellular localization annotation: CTP_CleavageSite=31; ConfidenceScore=5.59e-01
MAASTMALSSSSLAGQAMKLAPSTPELGVGRVSMRKTAPKTVSSGSPWYGPDRVKYLGPFSGEAPSYLTETFAKNRELEVIHSRWAMLGALGCVFPELLARNGVKFGEAVWFKAGSQIFSEGGLDYLGNPSLIHAQSILAIWATQVILMGAVEGYRIAGGPLGEVTDPIYPGGSFGPLGLADDPEALAELKVKELKNGRLAMFSMFGFFVQAIVTGKGPLENLADHLADPVNNNAWAYATNFVLESSYKEEKSLALKEDE

SEQ ID NO: 163425 - protein, 120 aa, Glycine max
  Coding DNA Sequence Number=SeqID_46647
MGGRSKSECEISGTESDSDIMLDLILKSYIFVGQLHLRSIDFKIKYNMVSEQAHNLRPRLSSANTTHNLLLTHQAQVLCMRGCVEKHQSLTLKDNPMHQSVRPVFYKTIAKATERTEINQ

SEQ ID NO: 163426 - protein, 96 aa, Glycine max
  Coding DNA Sequence Number=SeqID_46648
MAIEMDIEPKFRENCKIHRKSHFDENISNGITHSPEESFRIEPPKCLYTVLSFEDLKVKQFEETQVEMQSRFAGDDHFSSGSYAHVQVWVGLNIWE

SEQ ID NO: 163427 - protein, 528 aa, Glycine max
  Coding DNA Sequence Number=SeqID_46649
  Gene Ontology: Mol. function=oxidoreductase activity; Cellular component=membrane; Biological process=electron transport
  Homolog annotation: Hit_ID=Q2PMD4; Match level="QueryCoverage=99%, HitCoverage=100%, E-value=0.0, Identity=86%"; Hit description=FAD -linked oxidoreductase 2
  Pfam annotation: Domain name=BBE; Domain location=464-521; Score =106.0; E_value=1.1e-28; Accession=PF08031.2; Description=Berberine and berberine like
  Pfam annotation: Domain name=FAD_binding_4; Domain location=75-214; Score=89.7; E_value=9.2e-24; Accession=PF01565.13; Description=FAD binding domain
  Pfam module annotation: Pfam domain module=BBE::FAD_binding_4; Domain location=464-521::75-214
MEFGYCAVFLILLLPISCADSTSVEKQFRECLLTQLDGNSEYIEKITFTSSSSLYPQVWDSLAQNPRWVSSTRKPLIILTPFHESEIQEAILCSKQLELQLRVRSGGHDYEGLSYLGKVPFVMVDLINIRSIDINLDDETAWVQAGASIGELYYKISKASKVHGFPAGTCPSVGIGGHISGGGQGLMLRKHGLSADHVLDAYLIDVNGKIRDRKSMGEDVFWAIRGGDAASFGVILAWKIRLVRVPPIVIGFNVGRTLEEGVTNLIHRWQYIAHDSHEDLVIRVIARISGHDKSKKFQATFNSIFLGGIDRLIPLMNESFPELGLQAKDCIEMSWIQSVMFIAGYDIEDPLELLLNRTTMFKRSFKAKSDFVKEPIPKSGLEGAWKLLLEEEIAFLILEPYGGRMNEISESEIPFPHRKGYLYNIQYLVNWEVNSDEASKRHLQWAKMVYKYMTPYVSKSPRAAYFNYKDLDLGKNKHDNTSYSKASVWGEKYFKGNFRRLAQIKTEFDPQDFFKNEQSIPLLNSQHS

SEQ ID NO: 163428 - protein, 46 aa, Glycine max
  Coding DNA Sequence Number=SeqID_46650
MGGRSSSSETTIGHHAPQCRQCAAYVVTNVSKWVVTLGLSAISMTT

SEQ ID NO: 163429 - protein, 61 aa, Glycine max
  Coding DNA Sequence Number=SeqID_46651
MKFGGVVPFLIPMTRGEGHNSLFEDSPSECGGGAATVRYGLISKGHSRNKIQAQGRVTCYH

SEQ ID NO: 163430 - protein, 222 aa, Glycine max
  Coding DNA Sequence Number=SeqID_46652
  Gene Ontology: Mol. function=nucleic acid binding; Cellular component= chromatin; Biological process=DNA integration
MQTDPKKRKISSKTFDCLYIGYLEHSAAYRLLVLKSDVLVVNTIVETKNVDFFEDIFPFKSRQSIEINSESGRTILGQTLENFSEFVVEDLRKNAPSLEQAIKIEIDSIKKNNIWTLPQGVKPIGCNWIFKKKYNPDGSINKYKARLVVKRFTQNQNVDYFDTFSLVTRISSIQMLIALSSIHKLVIHQMDVKTAFLNGDLEEEVYMTQLEGCVILGQEEKV

SEQ ID NO: 163431 - protein, 200 aa, Glycine max
  Coding DNA Sequence Number=SeqID_46653
  Gene Ontology: Mol. function=nucleic acid binding; Cellular component= chromatin; Biological process=DNA integration
MRYLRVIIEYGIGYNGFPNVLEGYNNANWIPDSDETKSTSGYVFTLGGGVVAWRPYKQSIIARSTMESGFVALELASSEAEWLKNFLAYIPLGMKPTSSMPMHCDNQSAIVIAINKTFNRKNRHIQLRHNMAKLLKHGTISIDCRWLFVTKFGWHGNPTFVIGDPMKKVVYNLQNTLDEITYMSVKWSHLHEIMAKSLEH

SEQ ID NO: 163432 - protein, 262 aa, Glycine max
  Coding DNA Sequence Number=SeqID_46654
  Gene Ontology: Mol. function=nucleic acid binding; Biological process= DNA integration
  Homolog annotation: Hit_ID=Q1S9I4; Match level="QueryCoverage=65%, HitCoverage=17%, E-value=2e-11, Identity=28%"; Hit description =Integrase, catalytic region; Zinc finger, CCHC-type
  Pfam annotation: Domain name=zf-CCHC; Domain location=158-172; Score =10.4; E_value=0.019; Accession=PF00098.13; Description=Zinc knuckle
MKQGETIADVQKRFTHIVNHLKGLGKIFEEEEINVKVLTSLNRTWQPKVTIIFESKNLMTHAELFRKLREYEIELTIMVEEEAIDKKNRGLALMTSIPSSDESEDHNAKGSDTENLNLLVRRFNKFLKKKKNNGNITFQPKKNLKEGESSSSNGYTWFECKETGHIKVDCPIYQKKQQGDKKNKGSFQKNKKTYISLDDDESTTSNDNSEDDEQNLCLMVNNEAESEVTVSDLEDDDNYDQLLDAFKSKNVVSTSRVLNFYI

SEQ ID NO: 163433 - protein, 152 aa, Glycine max
  Coding DNA Sequence Number=SeqID_46655
MEVGLLARQLKIGMPLVSSMVAEEITGEGSVPRDTSHGGDFATWGKATPVEGVGGRSEVEVRKHAPGLGKNSWVLPQNLPQSSLGIQNKLPSWHTQLGRNGLLDRAGESSVPLPPLELAIEFIIHPWCELHIPLPKNVPEINVILVADLGNL

SEQ ID NO: 163434 - protein, 241 aa, Glycine max
  Coding DNA Sequence Number=SeqID_46656
  Gene Ontology: Mol. function=nucleic acid binding; Biological process= DNA integration
MEMKNRSLEELARTMLNEYNLPKYFWANAVSIAFYVLNWVMIRPIMKLTSYEIYKGTKPNASHMKVYGSKCFILNNGKELLGKFDSKADEGSSKESSPTSEKVVNNNPLKGHSLQHNSLPKEWKKPKDLSVDNIIGDIAKYCKELLKKFDTEKSKEATTAMATNCYLSVDEKGELINQTKYKDAEITLVGYSDSDFVGCKLDRKSTSGTCHLLGHGLVSWNSKKQACVILSTTEAEYIAAT

SEQ ID NO: 163435 - protein, 44 aa, Glycine max
  Coding DNA Sequence Number=SeqID_46657
  Homolog annotation: Hit_ID=Q2PMD4; Match level="QueryCoverage=80%, HitCoverage=6%, E-value=2e-10, Identity=86%"; Hit description=FAD -linked oxidoreductase 2
MEFDSTSDEKQFRECLLTQLDGNSEYIEKITFTSSTSLYLKTRV

SEQ ID NO: 163436 - protein, 157 aa, Glycine max
  Coding DNA Sequence Number=SeqID_46658
  Gene Ontology: Mol. function=signal transducer activity; Cellular component=nucleus; Biological process=inner cell mass cell differentiation
  Homolog annotation: Hit_ID=Q6EE07; Match level="QueryCoverage=67%, HitCoverage=74%, E-value=6e-57, Identity=49%"; Hit description =Notchless-like protein
  Pfam annotation: Domain name=WD40; Domain location=1-33; Score=1.9; E_ value=22; Accession=PF00400.22; Description=WD domain, G-beta repeat
  Pfam annotation: Domain name=WD40; Domain location=37-75; Score=48.6; E_value=2.1e-11; Accession=PF00400.22; Description=WD domain, G-beta repeat
  Pfam annotation: Domain name=WD40; Domain location=79-122; Score =10.8; E_value=2; Accession=PF00400.22; Description=WD domain, G-beta repeat
  Pfam module annotation: Pfam domain module=WD40::WD40::WD40; Domain location=1-33::37-75::79-122
  Subcellular localization annotation: CTP_CleavageSite=64; ConfidenceScore=5.00e-01
MTGHQQLVNHVYFSPDGQWVASASFDKSVKLWNGTTGKFVTAFRGHVGPVYQISWSADSRLLLSGSKDSTLKVWDIRTRKLKQDLPGHADEVFSVDWSPDGEKVASGDLLHSSEQGLWMLLKEPRQPFFHQIVDDWLVEHLERIKVEATLVHPLDEE

SEQ ID NO: 163437 - protein, 1152 aa, Glycine max
  Coding DNA Sequence Number=SeqID_46659
  Homolog annotation: Hit_ID=Q4YPL9; Match level="QueryCoverage=39%, HitCoverage=73%, E-value=2e-10, Identity=20%"; Hit description =Antigen 332, putative
  Pfam annotation: Domain name=SAP; Domain location=5-39; Score=10.2; E_ value=0.094; Accession=PF02037.17; Description=SAP domain
MGMDFHGMKRKRLQALCKKHDIPANLKNKEMADRLSLIFKGKEIEDPVGSGNVGTMKDTPRCVSGKDINVEMIDLVTPGPGLEERSVVSVKNLKSSEIERLEFETNSSREITRGDFGICGVEEDMKSGLNEEQVVNSQGGLHSAPVIVAVEEFNKPLVEGEGEHLGGENNLLEDLCENGKERDEAVEQSNHNSPQGSNMKDVNVLHVSQEESGYPMVEEDEAAEQGHHNNPQANIKDVNVLHVSHEESGYPMVEEDEAAEQGHHNNPQASNIKDVNVLHVSHEESGYPMVDKEEAVEQGDNSSPQGSSSMKDVNVLHVSQEESGYPMVEEVQKSDDNIYNGSVYNLINKGFEVDAKDTDGKTNFTAEYCAHDVSFSLNIPGGTLDQFQGTYPENESNSSCLNIHQDTCEEELETPQKTGPIEDPGECIGFSPNNLEISAVKGFLAETYFDPSTLGDVEGTCNMKERTQSVKMEEVEHFIDEFHSSTFKDSYGTPVQFLTNDALNEVKSDLNIHEMIASVIVHKISPMISKNEVIISPTLTFYVIENADISDAKFVSSRKRSLRPTSETMIGFSPKQLNNSEIKVFQSEIISFPEPPAVDIGICDVEENMHIDVNKEQVDDNQQVIYVASSVMDLNKEDLVQVASVEVGDHSLEGEVEKSGLIADSEEIDIGFCDVEDNLQNDVIEEQADNEICNVEENMQNDVNEEQVDSGICDAEENLQNDVNEEQVDASQQVMHAASSVMVLKTEDHVQVASGEVRDHLLEVEKAGLIADSKEVDIGICDGEENIQIDVNKEQVIHAASVMVLNNEDLLQVASVEVRNHLLEGEVEKSGLINDSEEIDIGICDLEENMQINVNKEQVMHAASSVMDLNNEDLVQVASVEVGDNLLKEEVEKSGLLADSEECIGYMPNNLEPSATKGFQAATYFDSSTLGDVVGTCNIEESIESDQMEKEYSQEVLNMANELQRSMEESDPMEREVTRLFDNSDDHDDADGTEAEDKSHQHYIKSDMDSIEKYLLNDFQSIDDTDGQNSDEYAPTVPHSVEMKSCTFNLQQISASDTVSGDEGTFQEKLETPTKCTPIPSSEDSVVFYTNLESSMKKELIVKSLPMKRARDVLGASDMKENIKIAKKEQGGRIISRSAFPKRKPLQDLQQN

SEQ ID NO: 163438 - protein, 107 aa, Glycine max
  Coding DNA Sequence Number=SeqID_46660
  Gene Ontology: Mol. function=magnesium ion binding; Cellular component=membrane; Biological process=photosynthesis, light harvesting
  Homolog annotation: Hit_ID=Q43437; Match level="QueryCoverage=60%, HitCoverage=24%, E-value=1e-26, Identity=89%"; Hit description =Photosystem II type I chlorophyll a/b-binding protein precursor
  Pfam annotation: Domain name=Chloroa_b-bind; Domain location=4-68; Score=-41.8; E_value=0.026; Accession=PF00504.12; Description =Chlorophyll A-B binding protein
MAASTMALSSSSLAGQAMKLSPYCRWASCIDPLGLADDPEVFAELKVKEFKNRRLAMFSMFGFFVQAIVTGKGSLENLTNHLANPVNNNAWAYATMRNYECEFHVVI

SEQ ID NO: 163439 - protein, 257 aa, Glycine max
  Coding DNA Sequence Number=SeqID_46661
  Gene Ontology: Mol. function=protein binding; Cellular component =nucleus; Biological process=inner cell mass cell differentiation
  Homolog annotation: Hit_ID=Q6EE07; Match level="QueryCoverage=100%, HitCoverage=99%, E-value=1e-112, Identity=48%"; Hit description =Notchless-like protein
  Pfam annotation: Domain name=NLE; Domain location=17-67; Score=9.4; E_ value=0.0064; Accession=PF08154.2; Description=NLE (NUC135) domain
  Pfam annotation: Domain name=WD40; Domain location=115-153; Score =43.0; E_value=1e-09; Accession=PF00400.22; Description=WD domain, G -beta repeat
  Pfam annotation: Domain name=WD40; Domain location=158-201; Score =32.7; E_value=1.3e-06; Accession=PF00400.22; Description=WD domain, G-beta repeat
  Pfam annotation: Domain name=WD40; Domain location=213-250; Score =20.3; E_value=0.0071; Accession=PF00400.22; Description=WD domain, G- beta repeat
  Pfam annotation: Domain name=WD40; Domain location=73-111; Score =47.7; E_value=3.8e-11; Accession=PF00400.22; Description=WD domain, G-beta repeat
  Pfam module annotation: Pfam domain module=NLE::WD40::WD40::WD40::WD40 ; Domain location=17-67::115-153::158-201::213-250::73-111
MEDETETMVEKREIINNVMCLLTDPDGTPLGAPMYLPQNAGPQHLIQIVNKLLNNALPIVCQPQAIFRIRPVNRCTATISGHAEAVLSVAFSPDGRQLASGSGDTAVRFWDLTTQTPLYTCTGHKNWVLSIAWSPDGKYLVSGSKTGELICWDPQTGKSLGNPLIGHKKWITGISWEPVHLNAPCRRFVSASKDGDARIWDDCTIKVWETTQGKLIRELRGHGHWVNSLALSTEYVLRTGAFDHTGKQYSSPEEMKK

SEQ ID NO: 163440 - protein, 518 aa, Glycine max
  Coding DNA Sequence Number=SeqID_46662
  Gene Ontology: Mol. function=5-formyltetrahydrofolate cyclo-ligase activity; Cellular component=nucleus; Biological process=folic acid and derivative biosynthetic process
  Homolog annotation: Hit_ID=Q2QX67; Match level="QueryCoverage=63%, HitCoverage=90%, E-value=1e-104, Identity=60%"; Hit description=5 -formyltetrahydrofolate cyclo-ligase family protein, putative, expressed
  Pfam annotation: Domain name=5-FTHF_cyc-lig; Domain location=236-471; Score=73.1; E_value=9.1e-19; Accession=PF01812.10; Description=5 -formyltetrahydrofolate cyclo-ligase family
  Pfam annotation: Domain name=RRM_1; Domain location=138-206; Score =18.9; E_value=0.0025; Accession=PF00076.12; Description=RNA recognition motif. (a.k.a. RRM, R
  Pfam annotation: Domain name=RRM_1; Domain location=28-95; Score =27.6; E_value=4.4e-05; Accession=PF00076.12; Description=RNA recognition motif. (a.k.a. RRM, R
  Pfam module annotation: Pfam domain module=5-FTHF_cyc-lig::RRM_1::RRM_ 1; Domain location=236-471::138-206::28-95
MANAAAIAAAFGGGLPPGITGTNERCTVLVANLNPDRIDEDKMFNLFSIYGNIVRIKLLRNKPDHALIQMGDGFQAELAVHFLKGAMLFGKRLEVNYSKHANITQGADTHEYANSNLNRFNRNAAKNYRYCCSPTKMIHLSTLPQDITEEEIVSLLEEHGTIVNSKVFEMNGKKQALVQFETEEQATEALVEAAAGSQKNNSNKAFDAAAFEAERLALDAESRRAMAEAAYPKAWKWVIRKRIWDVMEARNFANNPRPVHHRIPNFVGASVAAEKMRELDVFQVAQCVKVNPDSPQKQVRFLTLSDGKKLLTPQPRPRTGFFSVLDSNMLTLDTIKEACTSVGVAKHGQPIGLDKKIKVDLIVIGSVAVDPRTVNLGATVRLLPCDLVLMDSNPTDSLSAYEGGAEYIYPPETSLVVSLVLELEYGMLRYMGAIDDSTPVVTSVHDCQLVDDIPVEKLLIHDVPVDIICTPTQLSPEKLGQIRILREFKKRIEQETGQKLPTGPSEKLPPIAQRSRRG

SEQ ID NO: 163441 - protein, 91 aa, Glycine max
  Coding DNA Sequence Number=SeqID_46663
  Gene Ontology: Mol. function=aminoacyl-tRNA ligase activity; Cellular component=mitochondrion; Biological process=tRNA aminoacylation for protein translation
  Homolog annotation: Hit_ID=Q9FYR6; Match level="QueryCoverage=78%, HitCoverage=13%, E-value=3e-20, Identity=62%"; Hit description =Prolyl tRNA synthetase
MIGRGQYDGALHGVPLKFEIGPHDVANESVVISKRDIPGKQGKLFGISIEPSNLETYVEHKLDEIQSSLLERAIAFRDRFILLMLLLACDS

SEQ ID NO: 163442 - protein, 96 aa, Glycine max
  Coding DNA Sequence Number=SeqID_46664
MAQGWWPEMMHPVPIEDTFSMNCSTDRMDPGGATTYEPGGAGVGVAEVEGASRVEEKGTLVGLTLAFLPPLKLTVTPLALHRVVIKAGNLSLEELL

SEQ ID NO: 163443 - protein, 56 aa, Glycine max
  Coding DNA Sequence Number=SeqID_46665
MPHVTRLHGSGRQKVQRTMLVSARQRARLPLVDERTTKGAEDDVSLRASTGSFAPG

SEQ ID NO: 163444 - protein, 231 aa, Glycine max
  Coding DNA Sequence Number=SeqID_46666
  Subcellular localization annotation: CTP_CleavageSite=17; ConfidenceScore=5.00e-01
MDMNIGGLISGQMTMIAQSNSSRLGFLALITAFCRSRGVGFDALTSYENLRPAIDLAYIINNCWNVNDQTVNFPETRKTKLRAADIPSSFTPIAGIPASSTSAPPLALADLSAQSPQTSDAKFQSFSLRRWPGKEPDLLLWGIMKVLQPRHLNSMSQNQKTITHLKPPSLELLSNEAAHHGPMPASANSPFPRVDPSSPQHVADSSIPVLKIHEGQTIPILPLDTSPPATP

SEQ ID NO: 163445 - protein, 530 aa, Glycine max
  Coding DNA Sequence Number=SeqID_46667
  Gene Ontology: Mol. function=transporter activity; Cellular component= integral to membrane; Biological process=transport
  Homolog annotation: Hit_ID=Q8X5J0; Match level="QueryCoverage=68%, HitCoverage=83%, E-value=1e-163, Identity=76%"; Hit description =Putative permease; hexosephosphate transport
GHRPARLAVLPELRPVEIRRRAVARRPRAAQVYGDRPVRHRLAERGVRLRRIADAAAGGLGAERLLSGLGLAALRAAADPLVFAQRARLLVGLLEYVDQPRRRDRAADQRLRRPALGLAGGDADPGRRQHGVGHLAHAAADGHAAGRRPAVGRPVAPRSAGAAPGTAKPADGAVADVAHHDAEEPDDLAARRLLRAGLPDPHRVERLGQSLADGKPRRQPAQRQRHGDAVRGRRPARRAVRRLGLGFAVRRAARADDFAVHARADGFRRRAVAGAGASLRAAGGLFLYGGLFCLRPTDADWPRRRGMRAQRRSGLHHRFSRPVRLPGGRAGGLAAVADHRRLRLVRHVQFAVDRRRSYGFIADAAADGERYHLYREKDKTMKKTLVTTLIASGIALATLSGAAHAKGRLVVYCSATNEMCEAETKAFGEKYDVKTSFIRNGSGSTLAKVDAEKKNPHADVWYGGTLDPQSQAGEMGLLQPYKSPNLEQVMPQFRDPAKLRGTTPRRSTSAFSAFGFNTQHLKREKPAGAQ

SEQ ID NO: 163446 - protein, 343 aa, Glycine max
  Coding DNA Sequence Number=SeqID_46668
  Gene Ontology: Mol. function=helicase activity; Biological process =viral genome replication
  Homolog annotation: Hit_ID=Q1SN45; Match level="QueryCoverage=98%, HitCoverage=20%, E-value=3e-81, Identity=45%"; Hit description=AAA ATPase
MMLTVCKGPTSFEDLRTVDNVQYSTYKEACFAMRFLQDDKEFIEAIKEAKDWGSAHYIRKLFVLLLLAATMSKPEQVWDQTWHWMADDIVYNYKKSSTSTTLQLDDRTLQNLVLLEIEQLLQANQRSLRDYPSMPYPEDANCPTYLDNSLILAELNYNNEELRSEFEHLFSHMTASICNQIVEAVNKDEGDMFFLYGYGGTGKTYIWKTLASSLRADNKIVIMVASSGIVSMLLPRGRTVHSKFKIPVPVFEDSTCNMHQGTQLAELLNQTSQIIWDEAPMAHKFCFEALDHSLRDIIKHNSKDSTIFGGKVMVFGGDFRQILPVIPRGSRNNSKLLSYLYTF

SEQ ID NO: 163447 - protein, 65 aa, Glycine max
  Coding DNA Sequence Number=SeqID_46669
MDTSELYTGAMKGTMHEPQVNLGAGQKAYTLREFPKRFAKDRMRLHELSPLSKIKSKSQNRERMS

SEQ ID NO: 163448 - protein, 77 aa, Glycine max
  Coding DNA Sequence Number=SeqID_46670
MTKKDAKKMADRVPGNGHFDDGDGGHQCRFWVREEVAPIGFGRRDCGNGGVWLEGFEQLREGTKVFEGARGRNDQIE

SEQ ID NO: 163449 - protein, 120 aa, Glycine max
  Coding DNA Sequence Number=SeqID_46671
  Gene Ontology: Biological process=steroid metabolic process
  Homolog annotation: Hit_ID=O80866; Match level="QueryCoverage=100%, HitCoverage=15%, E-value=1e-30, Identity=55%"; Hit description =Putative oxysterol-binding protein
VCSVRENSSDERRFSVSTGTKKRLHLRAESREDRASWVEAMSAVKDLFPRLPKSEAMSPFSSPLVSTQRLRDRLLMEGVRETAIREVEEIVKFEFSQLQKHIVALKQKQSLLMDTLRHLE

SEQ ID NO: 163450 - protein, 128 aa, Glycine max
  Coding DNA Sequence Number=SeqID_46672
MEEPSKKHKGSSSRSQRHSEAQDTPIPSSISSSSLFSSEEQHIRYTNRFSSRSIIDPKFINMDFFSDESFECIQAFQNSNLIPFISLKLPVYSELVKAFYSNLEIQESTLISEVYGIKMALTNPSSMI

SEQ ID NO: 163451 - protein, 52 aa, Glycine max
  Coding DNA Sequence Number=SeqID_46673
MDIPESACDRTPGAHLELEASNPEFFNEIVMHQARCLVFGLRVDTINVVWGH

SEQ ID NO: 163452 - protein, 47 aa, Glycine max
  Coding DNA Sequence Number=SeqID_46674
MMIVKKRLSFELQKVTVGLSAYPQLSAASACLAQRRIWQSISIKVAR

SEQ ID NO: 163453 - protein, 33 aa, Glycine max
  Coding DNA Sequence Number=SeqID_46675
MLDFDKVTKLIKFKAWSWLNAKEVGPLLRATEW

SEQ ID NO: 163454 - protein, 93 aa, Glycine max
  Coding DNA Sequence Number=SeqID_46676
MAEKGKIKWVFGVVESIWLEKRKLGLKDMAQLEAMDRKSQHIPVGPKSKSYPRRGSLDWSSVINGTNSFTHRVVSLTETRRCFAFHRGVGGPS

SEQ ID NO: 163455 - protein, 109 aa, Glycine max
  Coding DNA Sequence Number=SeqID_46677
GRGVVEPHCPVPFVKLNTDILEAESLNLLAEATVVDTLLTGIACFVRRGATCPLSATPPHPAGLHGGMFSHIFIYDNVVLVVLFEILATPTMQLRPARRKWQLRWLSNV

SEQ ID NO: 163456 - protein, 139 aa, Glycine max
  Coding DNA Sequence Number=SeqID_46678
MGFRVLGVSLLIFIYLINLAPAYPLQNKLFSACEAFLSEEVHFAVNTSTKYEDKGIYESKIEGGAGHGGSSHGNGNSRSPETRGGGAAVIPVYAAGAANKNHQHQTRHGAANCNLNKIRFSNMLMIILVYPLILSFLLM

SEQ ID NO: 163457 - protein, 51 aa, Glycine max
  Coding DNA Sequence Number=SeqID_46679
MVGWVDPWVTIHFYGSILLHVAASELTLLHEKIILAKLTVLFYVCNKKVPR

SEQ ID NO: 163458 - protein, 110 aa, Glycine max
  Coding DNA Sequence Number=SeqID_46680
MDIDYTIRKDEPPAIIDESNPVPIVLYEWWERSNRFSVMFIKTKISAGIHGFVDQHEKFITSDEALANTLIMKFSSLRLTSVKGRRKGCNGDGESALLTTVCGKNKATKS

SEQ ID NO: 163459 - protein, 120 aa, Glycine max
  Coding DNA Sequence Number=SeqID_46681
ECSEGNNNEVMIEEGEWSVDTGSYANNNRKIVKDEKSGVMGMEIMEFGRVVLAMLRVEIGGRMTMALQSDTLTRGEGILEGIPRELSTNGQTRTWLNNFKKLWSVELPIKTGKLAYLTYF

SEQ ID NO: 163460 - protein, 135 aa, Glycine max
  Coding DNA Sequence Number=SeqID_46682
  Subcellular localization annotation: CTP_CleavageSite=60; ConfidenceScore=5.18e-01
MEPEPIATRTTAAMWLARQPAATNGTPVGGTTVQQRRCFLVRRWRETTELRRQQHASCIRGNSSVGNLVPLDLEIEATCKRNDIERRRKILQERTVQPSFEEAQSSQSSSAFPELRESKVGASEAHIMVEDQPQR

SEQ ID NO: 163461 - protein, 339 aa, Glycine max
  Coding DNA Sequence Number=SeqID_46683
  Homolog annotation: Hit_ID=Q1SKD7; Match level="QueryCoverage=64%, HitCoverage=56%, E-value=1e-08, Identity=25%"; Hit description =Ankyrin
MKMLVMERCWIILSLLKRADALSARAFKTQTSYGHDKRNCALSAPYKNAKNYKSLDFQMNVLSATIALSAFIFSVELSVELTKHGCALSEYCMASRKRKSPASVSQARYDRSKFTSQDAWDRYADNILGRKILPERNVKLFYAEFDELRREVERRNWHKELTNFSEGSIDVAIVKEFYANLYDPEDKSLKQVRVRGNLIKFDVDALNTILKTPVVIEEGESLPAYSRFANQRPVPEELAAHLCLPGRGFELNADGLPLKILRKNLTTLAQTWSVLSFSNLATTSHTSDITLDMAKLICGLVMKMDIKLGSLISGQISLIAQHDSSRLGFPALITALCKV

SEQ ID NO: 163462 - protein, 288 aa, Glycine max
  Coding DNA Sequence Number=SeqID_46684
  Gene Ontology: Mol. function=protein binding; Cellular component =clathrin vesicle coat; Biological process=ER to Golgi vesicle -mediated transport
  Homolog annotation: Hit_ID=Q93Y22; Match level="QueryCoverage=69%, HitCoverage=38%, E-value=1e-82, Identity=73%"; Hit description =Coatomer delta subunit
  Pfam annotation: Domain name=Adap_comp_sub; Domain location=82-278; Score=97.5; E_value=3.9e-26; Accession=PF00928.11; Description =Adaptor complexes medium subunit family
MVVSVILMFKAHCLSKFLTKRMDIFKYRHADQKVKYKGVREKENTKRERDHIAVAIQLGKKMKIEREDNGGYNSCRVIIVPVPWFVHKVQTGDNQAVSFKTHPNMNKELFANDYILGLKDPNRPFPTGQASDAAGVGLLKWRMQSTDESMVPLTINCWPSSSGNETYVSIEYEASSMFDLQNVVISVPLPALREAPSVRQIDGEWRYDSRNSILEWSVLLIDNSNRSGSMEFVVPLADSSVFFPISVRFMATDTFSDLKVTNIIPLKGGNPPKFAQRTQLITDSYQVV

SEQ ID NO: 163463 - protein, 175 aa, Glycine max
  Coding DNA Sequence Number=SeqID_46685
  Gene Ontology: Cellular component=integral to membrane; Biological process=vesicle-mediated transport
  Homolog annotation: Hit_ID=Q9M376; Match level="QueryCoverage=96%, HitCoverage=72%, E-value=3e-69, Identity=80%"; Hit description =Vesicle-associated membrane protein 727
  Pfam annotation: Domain name=Synaptobrevin; Domain location=82-174; Score=29.3; E_value=1.3e-05; Accession=PF00957.11; Description =Synaptobrevin
FLVVADESAGRSVPFVFLERVKDDFMKRYGASIKNEGAHPLADDDDDDDLFEDRFSIAYNLDREFGPALKEHMQYCMNHPEEMSKLSKLKAQITEVKGIMMDNIEKVLDRGEKIELLVDKTENLQFQLPEAGQAAEKEDVAAESPNEADGGRRNPYLNYNSVGYCLSGFQMLIEP

SEQ ID NO: 163464 - protein, 51 aa, Glycine max
  Coding DNA Sequence Number=SeqID_46686
MVSWKGEGALEKKGVSRGERTEGRKRKAQADKPSPIMRKAQKATASWAATS

SEQ ID NO: 163465 - protein, 97 aa, Glycine max
  Coding DNA Sequence Number=SeqID_46687
MVEKSKNLIGGNVMVMARGLSGATLARAGVLNFLMGETFLNWLFAYNAIQETKGSQIDVDAMLGVALGTNRIAGALFTVIRQQVVIVAVVDLAINGE

SEQ ID NO: 163466 - protein, 118 aa, Glycine max
  Coding DNA Sequence Number=SeqID_46688
MRIIFFVGHWRVGLLLVVWWMVEEGHNSWKAKSAWSAQFAEPWYRIRLAIGSRYSQNQSQGIELDVHKEKMCAEMEGMSLIEVVADEWLCGEDATGRGGLVGGVELFDLREISEKYTG

SEQ ID NO: 163467 - protein, 372 aa, Glycine max
  Coding DNA Sequence Number=SeqID_46689
  Gene Ontology: Mol. function=protein tyrosine/serine/threonine phosphatase activity; Biological process=protein amino acid dephosphorylation
  Homolog annotation: Hit_ID=Q2QXL1; Match level="QueryCoverage=60%, HitCoverage=94%, E-value=4e-62, Identity=47%"; Hit description=Dual specificity phosphatase, catalytic domain containing protein, expressed
  Pfam annotation: Domain name=DSPc; Domain location=228-365; Score =9.4; E_value=3e-05; Accession=PF00782.11; Description=Dual specificity phosphatase, catalytic domain
MMISITTIVILVVIVAVRKVALAIPMSMVVGGAGTDNNGDSDNDDSNDSCSGGNDNNCGDSVHSNATSGGDNNNPMTKTKFRKPSSYALRSIAVIFFPFPSRGKRAANDRTSNSKDPSTQIKEYSLAPSTVLGFTFEHTLPNPATILFLCFAYLKNLGFTLFSLPFLYSSLISFLVSIASHPSINLPILLGKTTDGSFPLFSLIIFSPYIYFVRIFSLLRRLRSGEPAYTEVHEGLYVGGWPSSPQKLPPGDPAIVDCTCEFPRVKDFTTGLPYRCFPTWDTRSPQPADIESAVKWASRQRELNRPIFVHCAYGHGRSVAVMCALLVALGITEDWKNAEKLIRQKRPYIRMNALHRKALEEWSRHRLSAPKK

SEQ ID NO: 163468 - protein, 538 aa, Glycine max
  Coding DNA Sequence Number=SeqID_46690
  Gene Ontology: Mol. function=binding; Cellular component=microtubule; Biological process=beta-tubulin folding
  Homolog annotation: Hit_ID=Q8L5R3; Match level="QueryCoverage=96%, HitCoverage=41%, E-value=1e-179, Identity=62%"; Hit description =Tubulin folding cofactor D
  Pfam annotation: Domain name=HEAT; Domain location=382-417; Score =26.5; E_value=9.1e-05; Accession=PF02985.12; Description=HEAT repeat
MEANLEKVTMNQEDDELESKESVLQKYFLQEWNIVKSLLDDIVSNSRVSDPSSVHRIRSILDKYQEQGQLLEPYLETIVCPLMNILRSRTLELGVASDEILEIIKPICIIVYTLVTVCGYKSVIKFFPHQVSDLELAVSLLEKCHHTNSGTSLRQESTGEMEAKCVTLLWLYILVLVPFDISTVDTSIANNDNLTEFELSPLVLRIIGFCKDYLSTAGPMRTMAGLVLSRLLTRPDMPKAFTSFVEWTHTVMSSVTEDLLHHFQLLGVVEALAAIFKAGSRNLLLDAIPVVWNNTTMLYKSSDAARSPLLRKYLMKLTQRIGLTALPHRLPSWRYMGRVAKLNVSLNTSNKIDQSNLGVNSHDSNSNEMLDREEDEDMDVPENVEEIIEMLLSGLKDMDTVVRWSAAKGIGRISSHLTSSFSEEVLSSVLELFSPGEGDGSWHGGCLALAELARRGLLLPASLPKVVPVIVKALHYDVRRGPHSVGSHVRDAAAYVCWAFGRAYYHTDMRSILKEFAPHLLTVACYDREVLISFMSFS

SEQ ID NO: 163469 - protein, 695 aa, Glycine max
  Coding DNA Sequence Number=SeqID_46691
  Gene Ontology: Mol. function=binding; Cellular component=microtubule; Biological process=beta-tubulin folding
  Homolog annotation: Hit_ID=Q8L5R3; Match level="QueryCoverage=96%, HitCoverage=51%, E-value=0.0, Identity=60%"; Hit description=Tubulin folding cofactor D
  Pfam annotation: Domain name=HEAT; Domain location=143-179; Score =19.4; E_value=0.013; Accession=PF02985.12; Description=HEAT repeat
  Pfam annotation: Domain name=HEAT; Domain location=186-221; Score =11.7; E_value=1.6; Accession=PF02985.12; Description=HEAT repeat
  Pfam annotation: Domain name=HEAT; Domain location=370-406; Score =6.2; E_value=7.5; Accession=PF02985.12; Description=HEAT repeat
  Pfam annotation: Domain name=HEAT; Domain location=51-87; Score=2.1; E_value=24; Accession=PF02985.12; Description=HEAT repeat
  Pfam annotation: Domain name=HEAT; Domain location=579-615; Score =4.3; E_value=13; Accession=PF02985.12; Description=HEAT repeat
  Pfam module annotation: Pfam domain module=HEAT::HEAT::HEAT::HEAT::HEA T; Domain location=143-179::186-221::370-406::51-87::579-615
MKDIFFHLWMTCWIEKSVTGEIMHRREMTEDKSLRELAAEALSFLVKYDPQHFASTVMEKLIPCTLSSDLCMRHGATLATGEIVLALHQCNFALPSDKQRSLAGVAPAIEKARLYRGKGGEIMRAAVSRFIECISIYKVVLSEKIKKSLLDTLNENLRHPNSQIQNAAVKGLKHFIRAYLHASDNKGISDVTAKYLSMLTDPNVAVRRGSALAIGVLPYELLASQWRNVLLKLCGSCKIEENPEDRDAEARVNAVKGLTLVCETLINGREDTATSFVEDDFSLFILIKNEVMISLFKALDDYSVDNRGDVGSWVREAALDGLEKCTYMLCKIDKSVCLSGRSDGNEIEPIAYPSIDSMLKNNRELFLFNENLATNLVGGICKQAVEKMDKLREAAANVLCRILYNQMIHIPYIPFREKLEEIIPKEADAQWGVPSYSYPRFIQFLQFACYSRDVLSGLVISIGGLQDSLKRVSLLALLEYLEGVEYEDPSTRTSRVYMLSADILWVLQQYKKSDRVIVPTLKTIEILFSKKIFLNMEAHTPAFCGAVLDSLSFELKGSKDFSKLYAGIAILGYVASVQEPINMRAFSQLLNFLGHRYPKIRKASAEQLYLVLLENGDLVAEDKIDKALEIISETCWDGDMDSAKHQRLKFSEIVGLEVGSLGNNSDGTSRKTSSKKPTDLDENASYSSLVEASGF

SEQ ID NO: 163470 - protein, 140 aa, Glycine max
  Coding DNA Sequence Number=SeqID_46692
MAWGTKAPASPSIPEVRWKYKIGLVVKGEGKGRERTCVTFSFHHFRLSSSIHTKLDSNRKGITDNIVIIDSNKSLRSQELTKKGKYGEGEDEFSLVPGEGGWGAEEGVGGKREKRNGARIGNPTTVNGEGRSEESIGESH

SEQ ID NO: 163471 - protein, 228 aa, Glycine max
  Coding DNA Sequence Number=SeqID_46693
  Homolog annotation: Hit_ID=Q9FMQ6; Match level="QueryCoverage=76%, HitCoverage=14%, E-value=2e-31, Identity=44%"; Hit description =Arabidopsis thaliana genomic DNA, chromosome 5, P1 clone:MWD9
  Subcellular localization annotation: CTP_CleavageSite=43; ConfidenceScore=5.29e-01
MAGNTRFDLSAAKSDELAFKGSFTNGQRGNLTNGTLDRSTSFREGNEGQMFISGANMSRGNSTSAGDLASVAQCLMLDPITMGDQKYTRSGELRRVLGISFGNILEDCAFGTANLKAPPPVATEELKRFKASVQEASVRARYRSKRLDESLDKLNKCWEAVSLKKQLWNDLVPNERLGGSHFSKMGSQTHRRPSELVNQRPENRPKNVILNKRIRTSVAETRVCSQCF

SEQ ID NO: 163472 - protein, 126 aa, Glycine max
  Coding DNA Sequence Number=SeqID_46694
MVTIVQDEGFDDDTGQKEKGHERYRSFGSALNELAEGKDALELPNYAYYKELNVVLVKKMWILDKELNVVCDGEGVDIGQRVEYVVLVSKERYALWRLESATSFVMTIDFKSDATMAANYKGGERL

SEQ ID NO: 163473 - protein, 772 aa, Glycine max
  Coding DNA Sequence Number=SeqID_46695
  Homolog annotation: Hit_ID=Q9FMQ6; Match level="QueryCoverage=97%, HitCoverage=60%, E-value=1e-64, Identity=29%"; Hit description =Arabidopsis thaliana genomic DNA, chromosome 5, P1 clone:MWD9
MGKDRDNIKDGSRGCDIFEEKIRRLPGGETWDRKMKRKRSVGTVVARSIDGEGELKKVMHIRLANESGPQGSDAQGLRSGYSGSNSKLDGASVPATFTTANNEQEKVSRGSVDGSNKERVVLKGNKFNVRNNNYTGGIHTLTKGKASRPPRTGALMAGNSSSVPCSSEILDAEEQPSNVNKPHSVSGTINRKRPLPVGSSSSPMAQWVGQRPQKISRTRRANVVSPVPSSDEVHTSLEGCSPSDVITRKTTAATSGFLISNGAINGGIHPGKMKHESVSSPTKLSESEESGAGENGESKMEKGLESNEVDGSAINNSYNTSSSMLTSKKKKIPNKEEVGDGLRRQGRGSRGSSVLKNGISPMKEKLETPTLMKPIKNMKPASEKNGSKSGRPPLKKSCDRKSITRIGHPSTNNSPDIAVEDDDREELLAAANFASNASFLYLPVATFDIGCSSSFWKKLEPIFSPVSLKDMSYLKQLVKTTEADLRCLSQMLGIGSDALDRLTHTESPLSQSSISRARERSIVNQTDSKEISSMDDMVGQHLDVSILCQQMDSEGNKLVPLYQRVLTALIIDEEIVEDGNMPSLCERDDSPQVACHFQDVENQSSIRMDFEFNSDKVSCNGNATFTSCTDIHDQELGIFLQMNQGSLHLETERVSMLSENGNDESMGMHGVSCSASFSCHFEQMSMEDKLLLELQSVGLYPEPVPDLADGDCEAINQDIIQLQKGLFQQVNKKRECFMKLIQAVEQGREMEQGALEQVAMDKLVELAHKKKL

SEQ ID NO: 163474 - protein, 97 aa, Glycine max
  Coding DNA Sequence Number=SeqID_46696
  Gene Ontology: Mol. function=RNA polymerase II transcription factor activity; Cellular component=nucleus; Biological process=regulation of transcription factor activity
  Homolog annotation: Hit_ID=Q6S799; Match level="QueryCoverage=90%, HitCoverage=35%, E-value=5e-15, Identity=67%"; Hit description=TATA binding protein associated factor 6b isoform 4
  Pfam annotation: Domain name=TAF; Domain location=2-54; Score=55.6; E_ value=1.6e-13; Accession=PF02969.8; Description=TATA box binding protein associated factor (TAF)
MSFVPKETIEVIAQSIGITNLSPDVALALAPDLEYRIREIMQVPPSHYSRTLLRNFEFFAGIGKMHAPFNENFSYYRGCGYCTCIEKFGGDLLCYWN

SEQ ID NO: 163475 - protein, 263 aa, Glycine max
  Coding DNA Sequence Number=SeqID_46697
  Gene Ontology: Mol. function=lipid binding; Cellular component =membrane; Biological process=defense response to bacterium
  Homolog annotation: Hit_ID=Q9LTR5; Match level="QueryCoverage=96%, HitCoverage=20%, E-value=4e-40, Identity=34%"; Hit description =Similarity to bactericidal permeability-increasing protein
  Pfam annotation: Domain name=LBP_BPI_CETP_C; Domain location=47-261; Score=19.4; E_value=1.7e-07; Accession=PF02886.7; Description=LBP BPI  CETP family, C-terminal domain
MRLVDAFEGDIASAVEEGISEKIKEGIVNIDNLLQSLPEKISLDKTAALNVSFVGNPVLRKNEVLVPRGYQKGVKISAACGGLQKMLKVSIHENVFKSAFLVYYNAGKRKLIIDELPDQNILNTAEWRFIVPQLYKRYPNDDMQLNISISSPQVIQVTYQDIGATIFVDITIDVLEDDEVIPVACISVEISASSAVEVEGNNTAGWLRLQTFSEYLTWSKIGKLRVHLIQSLMSSVLKTVVLPYLNFKLKRGFPLPIIDGYGV

SEQ ID NO: 163476 - protein, 96 aa, Glycine max
  Coding DNA Sequence Number=SeqID_46698
MALTIVFSLLSLLLVSACCYVQPLEESSISGVISDKGLEYAKELLIEKGIASIVMLQLPEIENFVQVPLDVQVNSSSVKTGESGGIVLVVSGAMLI

SEQ ID NO: 163477 - protein, 511 aa, Glycine max
  Coding DNA Sequence Number=SeqID_46699
  Gene Ontology: Mol. function=transcription factor activity; Cellular component=nucleus; Biological process=regulation of transcription, DNA-dependent
  Homolog annotation: Hit_ID=Q8RZ73; Match level="QueryCoverage=73%, HitCoverage=71%, E-value=1e-123, Identity=58%"; Hit description =Gibberellin response modulator-like protein
  Pfam annotation: Domain name=GRAS; Domain location=112-420; Score =307.1; E_value=3.3e-89; Accession=PF03514.5; Description=GRAS family transcription factor
MAPPPYSAYNGEIDGENLPLAFDIWENLWAYGYYPHQPISEINSTSTLVDFPFCDGTIVRDNKRVKRTVCFPIYNSINCHSFFNTNNSSSRNSIPKLHFRDHIRTYTQRYLAAEPVEDTNSSESSGGEEDGCADGVRLVQLLIACAEAVACRDKSHASILLSELKANALVFGSSFQRVASCFVQGLIERLNLIQPIGPAGPMMPSMMNIMDVASDEMEEAFRLVYELCPHIQFGHYLANSTILEAFEGESFVHVVDLGMSLGLRHGHQWRGLIQNLAGRVGGERVRRLRITGVGLCERLQTIGEELSVYANNLGVNLEFSVVEKNLENLKPEDIKVREEEVLVVNSILQLHCVVKESRGALNSVLQMIHGLGPKVLVMVEQDSSHNGPFFLGRFMESLHYYSSIFDSLDVMLPKYDTKRAKMEQFYFAEEIKNIVSCEGPLRMERHERVDQWRRRMSRAGFQAAPIKMVAQAKQWLLKNKVCEGYTVVEEKGCLVLGWKSRPIVAVSCWKC

SEQ ID NO: 163478 - protein, 81 aa, Glycine max
  Coding DNA Sequence Number=SeqID_46700
  Subcellular localization annotation: CTP_CleavageSite=24; ConfidenceScore=5.06e-01
MVDVRLEFFTISIVSLSMRRSKLIASYKPDSPYQGVTMVVVRGRVRDSGSRLNGGCTRKVPRQWLHEGGTTMVARGGTVVV

SEQ ID NO: 163479 - protein, 221 aa, Glycine max
  Coding DNA Sequence Number=SeqID_46701
  Gene Ontology: Mol. function=nucleoside diphosphate kinase activity; Cellular component=chloroplast; Biological process=nucleotide metabolic process
  Homolog annotation: Hit_ID=Q01402; Match level="QueryCoverage=85%, HitCoverage=84%, E-value=1e-64, Identity=68%"; Hit description =Nucleoside diphosphate kinase 2, chloroplast precursor (EC 2.7.4.6) (Nucleoside ...
  Homolog annotation: Hit description=diphosphate kinase II) (NDK II) (NDP kinase II) (NDPK II) [Contains: Nucleoside diphosphate kinase 2 high-molecular-weight; Nucleoside diphosphate kinase 2 low-molecular -weight]
  Pfam annotation: Domain name=NDK; Domain location=78-212; Score =281.9; E_value=1.2e-81; Accession=PF00334.9; Description=Nucleoside diphosphate kinase
  Subcellular localization annotation: CTP_CleavageSite=56; ConfidenceScore=5.38e-01
MEAVCGSVWVTSSLPRSPKSTLSLFRSTHQHLTAFPSQSHLFLYHPPPYANAKTLRARTSSKPAIFLPHLIASLEQVDQTYIMVKPDGVQRGLVGEIISRFEKKGFKLTGLKLFQCSKELAEEHYKDLKQKSFFPKLIDYITSGPVVCMGVGVVASARKLIGATDPLQAEPGTIRGDLAVQTGRNVVHGSDSPENGKREIGKASYAIQFNPNTCNKHRCEL

SEQ ID NO: 163480 - protein, 159 aa, Glycine max
  Coding DNA Sequence Number=SeqID_46702
MYKIIYMFESQCHHYKKKKKKKKKQLDRHSNEEFRKHQSTATALLNNRIVILTPFNLLNKWMLSMSKFSCLDQNKLFDRVGTARTPKTSIGPLKCVKRIIDSSCPINLKGILFLVLISVDVVWSKAVKGLAFAGREGGDDRGGEAKGEEYKTGRRSGED

SEQ ID NO: 163481 - protein, 113 aa, Glycine max
  Coding DNA Sequence Number=SeqID_46703
MEGEGGRGRGRQHEVEGRGREEREGRTRWRGGVGKKDEITVEEIGGSSTKRKSRVTFAIEEDTHLISSWLNISINSIVGVGQGKEAFWLRVTKNYNKFRDELCERIVSQMKSR

SEQ ID NO: 163482 - protein, 320 aa, Glycine max
  Coding DNA Sequence Number=SeqID_46704
  Homolog annotation: Hit_ID=Q33BK6; Match level="QueryCoverage=48%, HitCoverage=19%, E-value=1e-10, Identity=28%"; Hit description=U-box domain containing protein, expressed
MEDVNRTPREAKDYYSRSIWLSETAQTFGNIKRSDRNVVDGRDSYGYNSQEIVTPEVSGAFDEIKGLIRVNDEGVGEESGDYGHYSRQSLTTEIVEIVEDGKSISNKDRRVDDLYVAVGKDDLDAVKWALDHAVSPGSRIFLIHVSSPITLIPTPVGKFERSKLTQQQVGIYVNEVNNKRKDLLQKYIQMSNEAKVTAETLLLESNDTEKAILDLISILNITNIVIGIKKLPYTRRKNKLSKGEFVKKHAPSSCEVTLVYNGEVLVSDPYMDGLVSYGLASQNKSHSKNNFFQCMCFSGKFCQLLIFSLNSCTSVVWGKV

SEQ ID NO: 163483 - protein, 266 aa, Glycine max
  Coding DNA Sequence Number=SeqID_46705
  Gene Ontology: Mol. function=ATP-dependent helicase activity; Cellular component=nucleus; Biological process=mRNA catabolic process, nonsense-mediated decay
  Homolog annotation: Hit_ID=Q8W4R3; Match level="QueryCoverage=77%, HitCoverage=34%, E-value=2e-86, Identity=75%"; Hit description=DEAD -box ATP-dependent RNA helicase 30
  Pfam annotation: Domain name=Helicase_C; Domain location=106-182; Score=124.0; E_value=4.2e-34; Accession=PF00271.21; Description =Helicase conserved C-terminal domain
MPLMLIWPSFSHEGIEIRPDRQTLLWSATWPREVETLARQFLRNPYKVIIGSPYLKANQSINQVVEVLTDMEKYNRLIRLLKEVMDGSRILIFMETKKGCDQVTRQMRVDGWPALSIHGDKNQAERDWVLAEFKSGRSPIMTATDVAARGLDVKDIKCVINYDFPSSLEDYVHRIGRTGRAGAKGTAYTFFTHANAKFARDLIKILQDAGQVVSPALSALVRSAGSGQFGSGGSFRSRGRGGYGNRGLTSGSNAIPLGSKRPWQCL

SEQ ID NO: 163484 - protein, 221 aa, Glycine max
  Coding DNA Sequence Number=SeqID_46706
  Gene Ontology: Mol. function=RNA-directed DNA polymerase activity; Cellular component=extracellular region; Biological process=RNA -dependent DNA replication
MAGRKVLIKSIVQSIPSYVRSCFLFLVTTCSQIDSMTSCFFWGGSLEPLIWLCCLNNGGEFFVLENSLLSVTLEVKYYPRTHPLCAKCRWVMEEGTFWRIGDGQTTRIWPDKWVPNLRDNRIHCVRPEDRDPDICVSFLFTKQESEWDDRNKTGFGVVFRDAEGRVLGGATDLRQVGYQPHIAEVLCFKWALKVASQMCFHMIILKLIMFKFIMLGIARMA

SEQ ID NO: 163485 - protein, 431 aa, Glycine max
  Coding DNA Sequence Number=SeqID_46707
  Gene Ontology: Mol. function=oxidoreductase activity; Cellular component=integral to membrane; Biological process=electron transport
  Homolog annotation: Hit_ID=Q9FGS9; Match level="QueryCoverage=93%, HitCoverage=59%, E-value=1e-122, Identity=50%"; Hit description=FRO1 and FRO2-like protein
  Pfam annotation: Domain name=FAD_binding_8; Domain location=290-396; Score=48.4; E_value=2.3e-11; Accession=PF08022.2; Description=FAD -binding domain
  Pfam annotation: Domain name=Ferric_reduct; Domain location=138-260; Score=90.7; E_value=4.4e-24; Accession=PF01794.9; Description=Ferric reductase like transmembrane component
  Pfam module annotation: Pfam domain module=FAD_binding_8::Ferric _reduct; Domain location=290-396::138-260
MACSTTLLAAILKLLIIFLFAGWVSLWLLKPTQIWTTKWKHAEDSANDTIFGYYGLSFAVYTFPIVAIAILGLLLLDLKAGYQRSRSARSPSKSNFFSNPLVHGPTTRISADFKKLMPYKSLKLNTWQLKYHKIAIRFGLLAEPCMALLLLPILRGLAVFRILGIQFEASVRYHTWVGTAMIIFATIHCASTLLVWGISHHIQDEIWKWQKTGRKYLAGEIACVVGLVIWVTSLPQIRRRKFEIFYYTHHLYAFFPVFFLFHAGDRHFYPVFPGIFLFSLDKLIRIIQSSPKTCMVSARIFPSRAVELILPEDPGMKYNPTCVIYLKIPTISHLQWHSFSIISSSRADDHILSVIIKCEGWWANSLYDLIHAELDKTADTRKGIPVAIEGPYGPASLDFLRYDSLLLVAGGSGITPFLSILAETDSSTSKS

SEQ ID NO: 163486 - protein, 1126 aa, Glycine max
  Coding DNA Sequence Number=SeqID_46708
  Gene Ontology: Cellular component=mitochondrion
  Homolog annotation: Hit_ID=Q2QXB9; Match level="QueryCoverage=84%, HitCoverage=86%, E-value=2e-96, Identity=29%"; Hit description =Expressed protein
  Pfam annotation: Domain name=DUF537; Domain location=54-196; Score =148.1; E_value=2.4e-41; Accession=PF04396.4; Description=Protein of unknown function, DUF537
  Subcellular localization annotation: CTP_CleavageSite=46; ConfidenceScore=5.39e-01
MATGSRLFLIPAARPVLCKNVFFISSYSTRTLELCESSSSSSSSALAEEESRNVRVWAWWDVKNCHVPPNFDASKVAPKIMEAVRANGIKGPLNITAFGDVQLLTRAHQEALAYTGVRFTHVNDGKSSADILFDLMYWVSQNPPPAHILLISGDRDFAGVLHRLRMSNYNVLLATPESAPGVLHSAATIAWQWSSMLKGENLTGKCFNHPPDGRYRSWYGSYKLTACLEKPAPVVAQEASAAASLPNVEAYEPSSSGLGSVPKSVVKQVRHILSLHPEGIGISVLRAELAKCGVRLDKGFFGHKRFSRFLLSLPHVQLQPSGDANFSVHLVPWEFPEPCESIPVASTMSGANSEEKGSAATPKVNGEDKRKVRVADEKFSITSILERSSDDNLKPVQPGLSQGRSNEEYMDGESSSPVLVEKHVCQPPNELQKSSVASDKVVNVANAQQSETQLPPKDNKDSETKMDSLKVTSQKSSVEDIVRSEVASHKSKGKNATSVNHSAGNGQSMAEDYVITNYESGDVEAENKYEDPTRMEVDEVVHSPSSSPVDGSPVVQTPAGSPETNNRSPTFFRWIRSLWPFGKSNEKYDDLIANQNKLVSHVEDSKLSELDPTVSQSEEPKLSELDQNVSYVEDSKLSELDQTVRQLEEPKLTELDQSVSHSGKPELFSSASFWNDMESFIFAPKGSLLFSQSRSREDVVHKLQNGGPLVLRSLPKEDFLQLVELLITEKKWLEESPSKTFPFKITQPVQKNSLVKSHGANALRSLFIGRRTSQLNLPKSLEHDVEKHNQSISLARVSAPATETKYTERSRNDILEDCKKLVSEILREHPEGYNIGAFGRLFVDRYGYHLDIQKLGYQKLAALLQIMPGVKLESTYIFPSVPAVCDSDLETSILKTQATTDIHAASNSDSELSESAPKDDNMESPWQELGPVSLDLKSSQKAIELDTSKSKHLDYEPVESDDEFSASEGDGSCLTQSAEQRKPKCNEQDSSFWQVMDLRHSSKEKENSGKKSDNVDSLGISLAGILDSSTESTGDTLSEIPSLKYRENNGKKSDNVDSLDASLTDLFNSSTESTRGTLSKIPSSNYREKQRSRKNYSFVADPVLPNKDKLVDDFKNKKANGSKMQN

SEQ ID NO: 163487 - protein, 342 aa, Glycine max
  Coding DNA Sequence Number=SeqID_46709
  Gene Ontology: Cellular component=plastid; Biological process =peroxisome organization and biogenesis
  Homolog annotation: Hit_ID=Q9LRB5; Match level="QueryCoverage=88%, HitCoverage=69%, E-value=1e-122, Identity=67%"; Hit description =Amino acid transporter-like protein 2
  Pfam annotation: Domain name=Aa_trans; Domain location=16-326; Score =232.1; E_value=1.2e-66; Accession=PF01490.8; Description =Transmembrane amino acid transporter protein
  Pfam annotation: Domain name=Trp_Tyr_perm; Domain location=16-320; Score=-276.7; E_value=0.052; Accession=PF03222.4; Description =Tryptophantyrosine permease family
  Pfam module annotation: Pfam domain module=Aa_trans::Trp_Tyr_perm; Domain location=16-326::16-320
MEGKNMNDWLPITKSRNAKWWNSAVHNVAAMVGAGVLGFPYAMSELGWCWGVTILIVSWICTLYTAWQMIQMHEPEPGKRLDRYYELGQYAFGEKLGVWIVVPQQLMVEVSINIIYMITGGNSLMKIHQILCDNCEPIKRTYFIMMFASVQFVLSHLPGFNSISGISLAAAVMSLSYSAIAWIASFHRGVVPGVEYGSRFSTDAGNVFGFLGGLGTMAFGYAGHNVVLEIQATMPSTPEKPSKIAMWRGFFVAYLIVAMLYFPIAVCGYWAFGNTVEDNILMSLEKPRWLIVAANVFVVVHVTGSYQICIAFGVLLLVLAPIGGLRLHDFTHDPSFCTKEAA

SEQ ID NO: 163488 - protein, 102 aa, Glycine max
  Coding DNA Sequence Number=SeqID_46710
MAKRAQNDHNLSLRAIGHDPIGMAKGSPPLDEKRAQNDHNLSLRAIGHDCLRMAKRAQNDHNFSLHAIGHDRIWMAKDTIVSEWRKGVRNDHNFSPHVTRPQ

SEQ ID NO: 163489 - protein, 646 aa, Glycine max
  Coding DNA Sequence Number=SeqID_46711
  Gene Ontology: Mol. function=kinase activity
  Homolog annotation: Hit_ID=Q9FGW9; Match level="QueryCoverage=69%, HitCoverage=92%, E-value=6e-97, Identity=46%"; Hit description =Similarity to kinase
  Pfam annotation: Domain name=Bromodomain; Domain location=170-259; Score=101.0; E_value=3.6e-27; Accession=PF00439.15; Description =Bromodomain
MGKSRKYSKGHATGFVPDFRHAVETMGESEGLGNLGRVDNELTMSEISCAPKRKRVDESFDVPFQLLSLTKMARSGRKDLTLRLKSELEEVRKLQKKIAGMSSITTELSPYSDIRSCSVGEKRPPLESLALHGKKRPLLKHNGPKTKRSISGRFISAKSAAPVTPSYAVLMKQCETLLKRVMSHQFGKVFDKPVDIVKWNIPDYFTIIKHPMDLGTVKSKLISCEYTSLMDFAADVRLTFSNAMSYNPPGNDVHVMAETLSKYFETRWKPIEKILAIDDVPSEPSKPTTCIEKSEIVDPPVKKKKITPNGTNVKPEPIKRIMTGEEKQKLSMELDASVVELPENIIDFLKEQSYNASQINDDEIEIDIDALSDDTLFKLRKLLDDFMLEKQKTLAKPGPCEIQPANESGFSNSLQQCEGNEPIEEEVDIVGGDDPPLPSYPPAEIENGGTNKTSEHSSSSSSSESGSSSSDSESDSEPGIAKASDHFNPMKEKVGSGLSIDQKEGNLDNSETEIDSMNAAGHVEQSSQTDSVSDEPENHQEGENAPSKKQVSPDKLYRAALLRSRFADTILKAQEKTLEKGDKWDPEKLRMERKELERRQKEEKARLQAEAKAAEEVRRKAEAEAATEAQSKRELEREAARQALPK

SEQ ID NO: 163490 - protein, 109 aa, Glycine max
  Coding DNA Sequence Number=SeqID_46712
  Subcellular localization annotation: CTP_CleavageSite=27; ConfidenceScore=5.07e-01
MADADAKPFTASLDRLKATMATLAAAQASMDSNLSQLRFAMTQAFMLFKLDLIILKPDIMIFRQGSPFPSSVQPPPSSPSPSSPAPPSNAYSYHPSQYPPPPRPHVPPP

SEQ ID NO: 163491 - protein, 191 aa, Glycine max
  Coding DNA Sequence Number=SeqID_46713
  Subcellular localization annotation: CTP_CleavageSite=29; ConfidenceScore=5.10e-01
TLPSTTTTKKVWRAPNWMRHSTSQRTFVVAADANRLLQKMSSEEEEEEEEEEEEEEEEEEEEEEEEEEEEEEEEEEEEEEEEEEEEEEEEEEEEEEEEEEEEEEERKKERKMHFERCSATLHSVAMLLLQSIPTVGKNNLVLKVGQQKQAEIGDWVCDPHRGAIEEGVKDGGGDDGGGGDFEGGCGCGGGR

SEQ ID NO: 163492 - protein, 111 aa, Glycine max
  Coding DNA Sequence Number=SeqID_46714
MEEYTQSVGFIGIVKGTRVRIEGSEWGRALVGAGNVSCVGRRKGWDKEEIVPDGGDHHVCVPMAVRLEIEPGGWLIRIKPPSFGPLYLVLAAYASTLLPYHNCERSNRCAT

SEQ ID NO: 163493 - protein, 289 aa, Glycine max
  Coding DNA Sequence Number=SeqID_46715
  Homolog annotation: Hit_ID=Q2QV61; Match level="QueryCoverage=79%, HitCoverage=74%, E-value=1e-14, Identity=32%"; Hit description =Expressed protein
MDLRGGCCIARYVPGASHVSTVDKIMLRFRPIAPKPAAGATASDGSSSETSDAFLRNGNTKRKYVRDSNYTSKRRICRRKNSNSSPEQKQKQTTPAVTLPLLPETPDRKDFPAKDLTPSPVRNNNNNNSSNKSKKLNIINKNVPVWVSFANRSLTMMGGWCSCVTVESLTDTWVEGEWLGSTDEERRVNLSKDTCPGFISDGYGRVTGTNEAYEKMMEGDEGQGPVLLVNKVNTVVPHASFTCLVRVVQYACGRERSSLTVPCDVWRMDSGGFAWRLDVETALSLRLGY

SEQ ID NO: 163494 - protein, 126 aa, Glycine max
  Coding DNA Sequence Number=SeqID_46716
  Gene Ontology: Mol. function=protein binding
  Homolog annotation: Hit_ID=Q9FFJ3; Match level="QueryCoverage=97%, HitCoverage=24%, E-value=1e-18, Identity=42%"; Hit description =Arabidopsis thaliana genomic DNA, chromosome 5, P1 clone:MJJ3
  Subcellular localization annotation: CTP_CleavageSite=59; ConfidenceScore=5.55e-01
MAFSFSATWARQRGSSISGGLGRPTISWSWRERWASRSASLALASSTCSWVGRAPMSLRTDRVWETSEMARVMEANISGSARLGIWPTTDEGEEEEGGCSMSKLWEWEGETAVGVLAPKEGRRDMT

SEQ ID NO: 163495 - protein, 847 aa, Glycine max
  Coding DNA Sequence Number=SeqID_46717
  Gene Ontology: Mol. function=zinc ion binding; Cellular component =cytoplasm
  Homolog annotation: Hit_ID=Q6ZH84; Match level="QueryCoverage=49%, HitCoverage=49%, E-value=1e-102, Identity=47%"; Hit description =Putative ubiquitin-associated (UBA) protein
  Pfam annotation: Domain name=UBA; Domain location=759-799; Score =19.7; E_value=0.011; Accession=PF00627.21; Description=UBATS-N domain
  Pfam annotation: Domain name=UBA; Domain location=806-846; Score =33.2; E_value=9.3e-07; Accession=PF00627.21; Description=UBATS-N domain
  Pfam annotation: Domain name=ZZ; Domain location=426-463; Score=31.7; E_value=2.6e-06; Accession=PF00569.8; Description=Zinc finger, ZZ type
  Pfam module annotation: Pfam domain module=UBA::UBA::ZZ; Domain location=759-799::806-846::426-463
MVGLRAKICSIFSFSADENLILRYVDEDGDLVTLVDDDDLRDVMRQQLKFLRIDVHMNNDGGDKSNAGSSGSATPSETCPVTSPFLLRNAMVREHLSKKAASSSPVVDNLANSILKMGLNSHFQPPDTAGKSSKTGVPEEPITKAMGPQSSHVDSASNASVNSDSATPIRSPIPNPYLSGNAVKVDVSCSVPEPVRQFFSKSSSSNAAASSSQLPANLADLISLVPEPVREFLSNLSHSNAASSNQLPVNLTDLVSLLGQSILNSHCQPHVATGPFAKNGVTEEPITSEARGQQIPSADSASNATQQVEAGVATIDLNAPPFDPFLAQFTCENKAPLSSEAPNGHGKKGKMPTVDSSAGKGDSSGISSSFAAPNNSTQTTSLTSGAFIECPFAGTYINSWTPLPGNSQMPPFKRSHSHTDAMSGMFHKGVRCDGCGVYPITGPRFKSKVKENYDLCNICFNEMGNGTDYIRMDRPASARAPRYLHGHTKNFPTLPPHIFKKGAILKHAKPKLDSRFILDVNVIDGTMMAPSTAFTKIWRMRNNGTIVWHKGTQLVWIGGDKFSDSHSVDLEVPEDGVPLEKELDIAVDFTAPPLPGRYISYWRMTTPSGHQFGQRVWVLIQVDASLKDSFYDNSQGLNLNIPLDISGSKGPHIIDINVQPTEDDTVLQTRKPNAPIEPLNQMVDEEPRLELENEFPINEATFVAPVASAPAATSVASSSVPCPIIDLSETTPAVPSNQQSPTVDVPSSSMGTGGGINSVEENLLKELEEMGFKQVDLNKEILRKNEYDLDQSLDALCGVDVCGVSEWDHMLEELQEMGFRDKEMNKRLLEKNNGSLKRVVMDLINGE

SEQ ID NO: 163496 - protein, 130 aa, Glycine max
  Coding DNA Sequence Number=SeqID_46718
  Homolog annotation: Hit_ID=Q5JME8; Match level="QueryCoverage=83%, HitCoverage=55%, E-value=3e-10, Identity=34%"; Hit description =Putative drought-induced protein DI
  Pfam annotation: Domain name=Di19; Domain location=1-128; Score= -69.5; E_value=0.0031; Accession=PF05605.3; Description=Drought induced 19 protein (Di19)
MAVPVLCSNLEEEHCSALKNVVCPVCEENIGKDAIMQFTHSSSRRWAWKPEKSSIWPGNSAMLGKKLATRGNKQESITDPLLSPFICNVPIPNSNNFHPDENSRSSNKDIDIPDAKRKLEKLIVGSAWAA

SEQ ID NO: 163497 - protein, 180 aa, Glycine max
  Coding DNA Sequence Number=SeqID_46719
MKKRPELQQHQDFEVLKAVAQAWYSHSGTCKPMSEFEAHRRNFRGKPSRFKLEALNKPQASSSSSRDTSTYWDFQQSLWDSYELVTVSRRIETGLTLDNPFDELCGSPPIQQKRKPESKNSLRNLSSTCAIQSDPYLLVGALIPFNIHDFTTLCLSRSGFIIPNPCIRKDLVMAVLVVEG

SEQ ID NO: 163498 - protein, 353 aa, Glycine max
  Coding DNA Sequence Number=SeqID_46720
  Gene Ontology: Mol. function=protein binding; Cellular component =intracellular; Biological process=small GTPase mediated signal transduction
  Homolog annotation: Hit_ID=Q9FFJ3; Match level="QueryCoverage=99%, HitCoverage=70%, E-value=1e-102, Identity=56%"; Hit description =Arabidopsis thaliana genomic DNA, chromosome 5, P1 clone:MJJ3
  Pfam annotation: Domain name=LRR_1; Domain location=122-143; Score =14.4; E_value=0.41; Accession=PF00560.23; Description=Leucine Rich Repeat
  Pfam annotation: Domain name=LRR_1; Domain location=145-167; Score =6.7; E_value=16; Accession=PF00560.23; Description=Leucine Rich Repeat
  Pfam annotation: Domain name=LRR_1; Domain location=169-190; Score =8.5; E_value=7.2; Accession=PF00560.23; Description=Leucine Rich Repeat
  Pfam annotation: Domain name=LRR_1; Domain location=192-213; Score =10.2; E_value=3.5; Accession=PF00560.23; Description=Leucine Rich Repeat
  Pfam annotation: Domain name=LRR_1; Domain location=215-238; Score =8.4; E_value=7.8; Accession=PF00560.23; Description=Leucine Rich Repeat
  Pfam annotation: Domain name=LRR_1; Domain location=240-261; Score =17.8; E_value=0.038; Accession=PF00560.23; Description=Leucine Rich Repeat
  Pfam annotation: Domain name=LRR_1; Domain location=263-284; Score =6.6; E_value=17; Accession=PF00560.23; Description=Leucine Rich Repeat
  Pfam annotation: Domain name=LRR_1; Domain location=53-74; Score=3.1; E_value=75; Accession=PF00560.23; Description=Leucine Rich Repeat
  Pfam annotation: Domain name=LRR_1; Domain location=76-97; Score =11.4; E_value=2.1; Accession=PF00560.23; Description=Leucine Rich Repeat
  Pfam annotation: Domain name=LRR_1; Domain location=99-120; Score =17.2; E_value=0.058; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=122 -143::145-167::169-190::192-213::215-238::240-261::263-284::53-74::76- 97::99-120
MHDSYEKLLKDAEKRLVKIYEGDGESDNDNNNDNEGEVKEEVEEILHEAHGKGIERVDLSGKRLKLLPPAFGHIPALVVLDVSTNQLSVIPDSISGLANLEELNLSSNALESLPDSIGLLQKLKFLNVSGNKLSALPDSISQCRSLVELDAGFNSLTYLPTNIGYELLNLQKLMIQLNKIRSLPSSVCEMKSLRYLDAHFNELRGLPIAIGKLTNLEVLNLSSNFSDLRELPETFGDLISLRELDLSNNQIHALPDTFGRLDSLTKLNLDQNPVEVPPMEIVNQGVQAVKSFMVQRWIDILAEEERKSTQVLQEGENDWLTRSTSWLKNVSENVTEMIMSPRTPKESFLDQQL

SEQ ID NO: 163499 - protein, 278 aa, Glycine max
  Coding DNA Sequence Number=SeqID_46721
MIQKNGSIRKGDGYNEMLNRYQSPRIHSMPPRGKYQENNLVGVKTQPMEPYASSSNNNINASLTTPTIYNQMLPLVFPSAPQEQTGHRSIDLLIPPSQIDSIKNFSLNDVSLKGHTSGFPNPSIGTIFHDPKNLPSYPNGANSLYPNHQRNKSSDFHYLKPHPRVIVNNSHGVKDVAKPSLLPPNQIQKLDLLSYKGVARERAMKRPLREFQEFDIMTSASKRPRMNFTPLNYYEGVQSRMEKIFPFKDENNQVSTFKIKTDAKENIDKDNLDLSLHL

SEQ ID NO: 163500 - protein, 585 aa, Glycine max
  Coding DNA Sequence Number=SeqID_46722
  Gene Ontology: Mol. function=magnesium ion binding; Cellular component=cytoskeleton; Biological process=Mo-molybdopterin cofactor biosynthetic process
  Homolog annotation: Hit_ID=Q39054; Match level="QueryCoverage=99%, HitCoverage=86%, E-value=0.0, Identity=67%"; Hit description =Molybdopterin biosynthesis protein CNX1
  Pfam annotation: Domain name=MoCF_biosynth; Domain location=179-324; Score=129.8; E_value=7.4e-36; Accession=PF00994.14; Description =Probable molybdopterin binding domain
  Pfam annotation: Domain name=MoCF_biosynth; Domain location=456-583; Score=57.8; E_value=3.5e-14; Accession=PF00994.14; Description =Probable molybdopterin binding domain
  Pfam annotation: Domain name=MoeA_C; Domain location=337-415; Score =61.7; E_value=2.4e-15; Accession=PF03454.5; Description=MoeA C -terminal region (domain IV)
  Pfam annotation: Domain name=MoeA_N; Domain location=1-166; Score =232.6; E_value=8.3e-67; Accession=PF03453.7; Description=MoeA N -terminal region (domain I and II)
  Pfam module annotation: Pfam domain module=MoCF_biosynth::MoCF _biosynth::MoeA_C::MoeA_N; Domain location=179-324::456-583::337 -415::1-166
MISVIDALQTVLNASKRLPPLTVPLHDALGKVLAQDVRAPDPLPPYPASVKDGYAVVSADGPGEYPVVAESRAGDDALGLTLSPGTVAYVTTGGPIPDGADAVVQVENTEIVNNASDGTKRVRILLQTTKGNDIRPVGVDIKKDAVVLTSGERLGASEIGLLATVGVTMVKVYPTPTVAVLSTGDELVEPTTGHLNRGQIRDSNRAMLLAAAVQHQCKVLDFGIAKDDKEYQGRILDKAFASGIHILLTSGGVSMGDKDFIKPLLEKRGKVHFDKVCIKPGKPFTFAEIDFQSTESKILAFGLPGNPVSSLVCFHLFVVPAIRYLAGWTNPHHFRVQARLRQPIKTDPIRPEYHRASVIWTDNDGSGNPGFVAVSTGHQVSSRLLSMKSANALLEFPATGSVVSAGTAVSAIIISDLRPMACDENHKSSDSAFALPGIKSNKITTDSSGDAEVKVAILTVSDTVAMGAGPDRSGPRAVSVINSSSERLGGARVVATAVVPDDVAKIQDILRRWSDIEQMDLIITLGGTGFTSRDLTPEATKPLIEKETPGLLHVMMQESLKVTKSAMLSRSAAGIRGSTLVRQKC

SEQ ID NO: 163501 - protein, 83 aa, Glycine max
  Coding DNA Sequence Number=SeqID_46723
  Gene Ontology: Mol. function=DNA binding; Cellular component =mitochondrion; Biological process=DNA integration
  Homolog annotation: Hit_ID=Q1RSZ9; Match level="QueryCoverage=95%, HitCoverage=5%, E-value=6e-15, Identity=54%"; Hit description =Polynucleotidyl transferase, Ribonuclease H fold
MANLLSQKSMADGMVISKCSKSHLSQMTSLETEESVRYSASIEDLDTVGYFFDFHDIKASPRNTQEPDVDLRVSKHPPQSASA

SEQ ID NO: 163502 - protein, 252 aa, Glycine max
  Coding DNA Sequence Number=SeqID_46724
  Gene Ontology: Mol. function=DNA binding; Cellular component=beta -galactosidase complex; Biological process=DNA integration
  Homolog annotation: Hit_ID=Q1S3I6; Match level="QueryCoverage=96%, HitCoverage=18%, E-value=1e-33, Identity=35%"; Hit description =Integrase, catalytic region
MVKTQFAASIKCLRSDNAQELALTDFLASQGTLHQFSCVERPYKILLLRGNISIYLMLLEHYFSSPRLPSPLLKQNTPYQVLYGSAPDYSILRSFGYLAFATTLNSERNKFSPRTVPSVFVGYPQGVKGYRLYNLHTRKFYVSRDLVFHESIFLFQTLPNSSQEPDFLSELAISLPIPESISSTIPPRAIETNISEPNISPHTNNLPIQLSDSAVDTTINASSTFPSPPLRRSIRTSNPPPYLLDYIRLQPR

SEQ ID NO: 163503 - protein, 256 aa, Glycine max
  Coding DNA Sequence Number=SeqID_46725
  Homolog annotation: Hit_ID=Q9ZVC6; Match level="QueryCoverage=46%, HitCoverage=56%, E-value=1e-17, Identity=39%"; Hit description =Expressed protein
  Pfam annotation: Domain name=HSP20; Domain location=20-119; Score= -23.0; E_value=0.083; Accession=PF00011.11; Description=Hsp20alpha crystallin family
MGSRTQPAASDRVYEDFVPLYEWDRNERLVNVMLPGFRRDQLKVQVTSKPTLRLMGERLITENRWRRFNLELPLLSDYDTDSVTAKFEGAKLSIKFGELSLTKPKETLITPPSQKIEQQKAPAPEAKTNGEVSDQKTPQNKEETNKTETTHGTDKGAQEAKTNDLSETKEALTPTAPKTRPVSRSKTRLIDFGLGSGSNHVDDQVIEDLEAGKNKCKRLVKWMVIIYLVVALVGLGVYYGKNALTSYPEESYFQEL

SEQ ID NO: 163504 - protein, 204 aa, Glycine max
  Coding DNA Sequence Number=SeqID_46726
  Gene Ontology: Mol. function=protein serine/threonine kinase activity; Cellular component=beta-galactosidase complex; Biological process=protein amino acid phosphorylation
  Homolog annotation: Hit_ID=UPI000034F0FA; Match level="QueryCoverage =99%, HitCoverage=21%, E-value=3e-54, Identity=51%"; Hit description =kinase
MTAEIKALESNNTWTLVPLPVGKQCIGCRWVYKAKFKPDGIVDRHKARLVVKGYTQQAGIDFSDTFSPIAKLTSEVNMELPKGYNSVDKNLVCKLKKSIYGLRQASRQWFCKFSTTLIANGFSQSKNDYSLFTIGKGQTSSSVQTEDPWFLEIFSGFGSCKIQQGHCPNLAKICSFSVRRYWLPWLQTIFSSNGSKFKAQHAQW

SEQ ID NO: 163505 - protein, 64 aa, Glycine max
  Coding DNA Sequence Number=SeqID_46727
  Gene Ontology: Mol. function=2 iron, 2 sulfur cluster binding; Biological process=electron transport
  Homolog annotation: Hit_ID=Q1MX17; Match level="QueryCoverage=76%, HitCoverage=3%, E-value=2e-11, Identity=65%"; Hit description =Aldehyde oxidase
MELELKTPTSLIFGVNGEKFELYNVDPSITLLEFLRNHTSFKSVKLGCGEGLGMVFQFQIIFWS

SEQ ID NO: 163506 - protein, 221 aa, Glycine max
  Coding DNA Sequence Number=SeqID_46728
  Gene Ontology: Mol. function=2 iron, 2 sulfur cluster binding; Biological process=electron transport
  Homolog annotation: Hit_ID=Q2PHF4; Match level="QueryCoverage=99%, HitCoverage=20%, E-value=7e-38, Identity=61%"; Hit description =Aldehyde oxidase 1
MRGPGEVQGSFTAEAIIENVAATLSMDVDSVRSINLHTYKSLLQSFSEYYHGEPYEYTLPSIWSETDGCVYALGAIQCDGTEGLLDKIWVVQSDTVSLIQGGFTAGSTTSESSCEAVRLSCNVLVKRLKPLKEKLQEEMDSIKWETLILQAYMQAVNLSASSFYVPSNDSSSYLNYGAATSHATEVTDLSYIGMLNNGNYFSGRNRSSEWRNQISANRYYL

SEQ ID NO: 163507 - protein, 1313 aa, Glycine max
  Coding DNA Sequence Number=SeqID_46729
  Gene Ontology: Mol. function=2 iron, 2 sulfur cluster binding; Cellular component=peroxisome; Biological process=electron transport
  Homolog annotation: Hit_ID=Q9FV23; Match level="QueryCoverage=99%, HitCoverage=96%, E-value=0.0, Identity=61%"; Hit description =Aldehyde oxidase
  Pfam annotation: Domain name=Ald_Xan_dh_C; Domain location=564-674; Score=126.7; E_value=6.4e-35; Accession=PF01315.12; Description =Aldehyde oxidase and xanthine dehydrogenase, ab hammerhead domain
  Pfam annotation: Domain name=Ald_Xan_dh_C2; Domain location=685-1220; Score=776.5; E_value=1.6e-230; Accession=PF02738.8; Description =Aldehyde oxidase and xanthine dehydrogenase, molybdopterin binding domain
  Pfam annotation: Domain name=CO_deh_flav_C; Domain location=384-497; Score=129.4; E_value=1e-35; Accession=PF03450.7; Description=CO dehydrogenase flavoprotein C-terminal domain
  Pfam annotation: Domain name=FAD_binding_5; Domain location=185-367; Score=169.0; E_value=1.2e-47; Accession=PF00941.11; Description=FAD binding domain in molybdopterin dehydrogenase
  Pfam annotation: Domain name=Fer2_2; Domain location=41-128; Score =170.1; E_value=5.5e-48; Accession=PF01799.10; Description=[2Fe-2S] binding domain
  Pfam module annotation: Pfam domain module=Ald_Xan_dh_C::Ald_Xan_dh _C2::CO_deh_flav_C::FAD_binding_5::Fer2_2; Domain location=564 -674::685-1220::384-497::185-367::41-128
GCGACVVLISKYDPVHDRVEDFTASSCLTLLCSIHGCSITTSEGIGNSKDGFHPIHERIAGFHATQCGFCTPGMCVSLYGTLVNAEKTNRPEPPSGFSKVTAAEAEKAIAGNLCRCTGYRPIADACKSFAADFDIEDLGLNSFWRKGEGKDLKLSRLPQYDKNHNSIRFPLFLKEIKPIVSLASEKYCWYSPTSLEELQRILALNQVNGTRMKLVVSNTGMGYYKDNEVYDMYVDLRGISELSKIRKDWKGIEIGATVTISKAIEALKEESKGDFLSDYVMILEKIADHMNKVASGSIRNTASVGGNLVMAQKHHFPSDIATILLAVDSMVHIMTGTQFEWLTLEEFLERPPLSLDSVLLSIKVPSLELNKRESSEPESRFFFESYRASPRPLGNALPYLNAAFLAKVSPCKDSGGTVIDSCRLSFGAYGTKHAIRAKKVEKFLTGNLLSVSILYDAINLVTDTIVPDDDTSQTAYRSSLSAGFIFQFFNLLIGSPERITNGYLKGHTNLSSVEAFELSKNQKQVHHGKFPALLSSGEQVLEAGTKYEPIGEPVIKSGAALQASGEAVFVDDIPSPKNCLHGAYIYSSKPLARVKSIKLSPELELDGVRDIISSKDIPNGGQNLGSKTRFGDEPLFAEEIARCVGDRLAFVVADTQKNADIAANSAIVDYGLENLEPPILTVEDAVKRSSIFKLPPFLSPSQVGDVPKGMAEADHKILSAELTLGSQYYFYMETQAALAVPDEDNCIVVYISSQSPEYVHSNVARCLGIPENNVRVITRRVGGGFGGKALRATACATSCALAAHKLRRPVRMYLNRKTDMIMAGGRHPMKITYSVGFKNDGKITALDLKILVNAGIYVDVSPIIPRNMIGALKKYDWGALSFDIKLCKTNHPSRAAMRAPGDAQGSYIAEAIIEKVAATLSIDVDSVRSINLHTYTSLKAFYEDSSGEPHEYTMPLIWSKLNVSANYEVRVEMVKEFNRINTWKKRGISRVPVLYEVNVKPTTGKVSIFSDGSVVVEVGGIELGQGLWTKVKQMAAFALGAVQCDRIDSLLDKVRVVQTDTVSLIQGGLTAGSTTSESSCEAVRLCCDILVERLKPLKEKLQEEMGSVKWETLIQQAYAQPVNLSASSFYVPGNNSIRYINYGAAVEIDLLTGETRCLQTDIIYDCGQSLNPAVDLGQIEGSFIQGLGFFMLEEYETNLDGLILVDGTWNYKIPTLDTIPQKFNVQILNSEHHQQRVLSSKASGEPPLLLAASVHCATRAAAKEAKKQLLSWSNLDGPDSTFQLKVPATMPVVKELCGLDIVQTYLKWKMGNK

SEQ ID NO: 163508 - protein, 1363 aa, Glycine max
  Coding DNA Sequence Number=SeqID_46730
  Gene Ontology: Mol. function=2 iron, 2 sulfur cluster binding; Cellular component=peroxisome; Biological process=electron transport
  Homolog annotation: Hit_ID=Q9FV23; Match level="QueryCoverage=99%, HitCoverage=99%, E-value=0.0, Identity=61%"; Hit description =Aldehyde oxidase
  Pfam annotation: Domain name=Ald_Xan_dh_C; Domain location=613-723; Score=126.6; E_value=7e-35; Accession=PF01315.12; Description =Aldehyde oxidase and xanthine dehydrogenase, ab hammerhead domain
  Pfam annotation: Domain name=Ald_Xan_dh_C2; Domain location=734-1272; Score=813.6; E_value=1.1e-241; Accession=PF02738.8; Description =Aldehyde oxidase and xanthine dehydrogenase, molybdopterin binding domain
  Pfam annotation: Domain name=CO_deh_flav_C; Domain location=434-547; Score=126.7; E_value=6.5e-35; Accession=PF03450.7; Description=CO dehydrogenase flavoprotein C-terminal domain
  Pfam annotation: Domain name=FAD_binding_5; Domain location=235-417; Score=162.8; E_value=8.6e-46; Accession=PF00941.11; Description=FAD binding domain in molybdopterin dehydrogenase
  Pfam annotation: Domain name=Fer2; Domain location=12-83; Score=36.7; E_value=7.9e-08; Accession=PF00111.17; Description=2Fe-2S iron-sulfur cluster binding domain
  Pfam annotation: Domain name=Fer2_2; Domain location=91-178; Score =161.6; E_value=2.1e-45; Accession=PF01799.10; Description=[2Fe-2S] binding domain
  Pfam module annotation: Pfam domain module=Ald_Xan_dh_C::Ald_Xan_dh _C2::CO_deh_flav_C::FAD_binding_5::Fer2::Fer2_2; Domain location=613 -723::734-1272::434-547::235-417::12-83::91-178
MELKKTPTSLVFAVNGERFDLSHVDPSTTLLEFLRTRTRFKSVKLGCGEGGCGACVVLISKYDPVHDQVEDFTASSCLTLLCSIHGWSITTSEGIGNTKEGFHPIHERFAGFHATQCGFCTPGMCVSLYGTLVNAEKTSSPKPPAGFSKVTVTEAEKAIAGNLCRCTGYRAIADVCKSFSADVDMEDLGLNSFWRKGDSQDSKLSRLPQYDHTQSISRFPMFLKEIKHDVFLASDKHSWHRPISLTELQNLLKLNHANSTRIKIVVSNTGMGYYKDKEGYDKYIDLRGISELSKIRKDQTGIEIGAAVTISKAIQTLKEESRNDFLSDYVMILEKIADHMSKVASGFIRNTASVGGNLVMAQKNNFPSDIAVILLAVDAMVHIMTDTQFEWLALEEFLERPTLGFESVLLSIKIPSLELNKSESSEPESRFLFETYRAAPRPLGNALPYLNAAFLAKVFPCKDSGGTVIDTCRLSFGTYGIKHAIRAKNVEEFLAGKLLNVSILHDAVNLVTETIVPKDDTSKTAYRSSLAAGFIFQFLNPLFNTSVITNSYLNGHINLPLVKDLELKENQKQVHHDNVPTLLSSGKQVLEAGCEYHPVGEPIMKSGAALQASGEAVFVDDIPSPSNCLHGAYIHSAKPLARVRSIKLTPELQLDGVRDIISSKDIPNGGENIGSKTIFGIEPLFAEEITRCVGERLAFVVADTQKLADMAANSAVVDYDNENLEPPILSVEDAVERSSFFEVPPFLYPKHVGDISKGMAEADHKILSAEMKLGSQYYFYMETQTALAVPDEDNCITVYSSSQCPEFTHSIIARCLGIPENNVRVITRRVGGGFGGKAIKAMPVAISCALAAQKLQRSVRMYLNRRTDMIMAGGRHPMKITYSVGFRNDGKITALDLQILVNAGIYVDISAIMPHNIVCALKKYDWGALSFDIKVCRTNHPSRSSMRGPGEVQGSFIAEAIIENVAATLSMDVDSVRSINLHTYKSLQSFYEYSHGEPYEYTLPSIWSKLAVSANYDQRNKLVQEFNRVNTWKKRGISRVPVVIQLMLRPTPGKVSIFSDGSIVVEVGGIELGQGLWTKVKQTTAYALGVIQCDGTEGLLDKVRVVQSDTVSLIQGGFTAGSTTSESSCEAVRLCCNVLVERLKPLKEKLQEEMGSIKWETLIHQAYMQAVNLLASSFYAPSVNSMSYLNYGAAVSEVEIDLLNGETRFLQTDIIYDCGQSLNPAVDLGQIEGAFVQGLGFFMLEEYETNLDGLVLQDGTWNYKIPTIDTIPKQFNVQILNSGHHQQRVLSSKASGEPPLLLAASIHCATRAAVKEARKQLLSWSNQDGEDSTFQLGVPATMPVVKELCGLDIVERYLKWKMG

SEQ ID NO: 163509 - protein, 74 aa, Glycine max
  Coding DNA Sequence Number=SeqID_46731
MKNKLVRTSINYFQYVDVVYTNKYILKAYSAQWWPLGNEATIPPFDDSWTLIPDPTTIRAKCWPKSTRIRNKMD

SEQ ID NO: 163510 - protein, 301 aa, Glycine max
  Coding DNA Sequence Number=SeqID_46732
MSQHLCCTNVCVARVGITIKQYFKPAPKSSCTSTSMTPEDLKQLTQKIKDQLEESPKVDPFASCVSTKGSCVDPSRVHEGSTIIHNVLLPNDQVKVDVEEIQDVDACVLIPLQEENQGAEEPTKLVDRPELDDDPLYQMTLMIPQLFLRPLQVSWDATVSQHLCCTNVCAARADMQSQMQSQGLALPPKPEDPDTGDSMKCGLYVDENPSSPVALGRVYEGSTIIRNVPLTNDQVKVDVDEVQDVDACVPIPIQEENQGAEGPMKLVDRPELDDEPLYQMTLTIPHLFLKPLQVPWDATVL

SEQ ID NO: 163511 - protein, 953 aa, Glycine max
  Coding DNA Sequence Number=SeqID_46733
  Gene Ontology: Mol. function=ATPase activity; Cellular component =chromosome; Biological process=chromosome organization and biogenesis
  Homolog annotation: Hit_ID=Q8H2D2; Match level="QueryCoverage=98%, HitCoverage=74%, E-value=0.0, Identity=49%"; Hit description=SMC3 protein
  Pfam annotation: Domain name=SMC_N; Domain location=6-953; Score= -65.5; E_value=7.3e-07; Accession=PF02463.9; Description=RecFRecNSMC N terminal domain
MKVEIKIEMKPLKVRIEDARAKVSDTSARKYNDVLDAHEKSKDLENTLKDVTKELQNFNKEKEVIEKRRTVALKKHTELELDVKDLQEKISGNTRAKEDAARQLEILEKEIQDSTAELGKIVPLHEDQVQKEKDIVKRAEHHYEKTVFLTELAHTLLLFKLDYFFFMHLFINYASLLIGFLPNTPAQFGLAVDFWKLLVEAKEKPVTTQSQTQLNGTFYAAYFKMNWEQKLLDEIDRLKEELQDCDENINRRKSEITTLESLIAQSREGLNRYKEERDKLHGERKSLWGKENELTAEIDKLRAEVEKAEKSLDHAIPGDVRRGLNSVRKICREYNISGVHGPIIELLNCDEKFFTAVEVTAGNRVKGPRITYPQSSDVIPLLKKLNFKHDYTPAFSQTSFALHFRVVVGVVVIALLILKPKDDSFSHGWHELTKNMVSDGLGLKVICKNLDVASRVARSDGLDCITLDGDQVSKKGSMTGGFYDHRRSRLRFMNIIKQNADTIHIREEELEKIDQKINEIVAEQQKIDAKCAHDKSVIEQLKQDIANANKQKLLISKALTKKEKSVGDVQNQIEQLNASIAMKKAEMGTELIDHLTPEEKKLLSDLNPEIKDLKEKLVACKTDRIETEARRAELDTNLTTNLRRRKQELEAVISSADADSLVADAESKWQELSDAKILVDDAIGQLRSVTESINDRTRQIKKIKDELNKLKDEYERKLQEDAKELEQLQSKKNTYAAKEEEYAKKIRELGPLTSDAFEACNEQLQQFSHVNKKALDQYINFTEQREELQKRQAELDAGDEKIKELITVLDQRKDESIERTFKGVARHFREVFSELVLGGHGHLVMMKKKDGDHDDDEDEDGPREANPEGRVEKYIGVKVKARFVNLTRWDESIVVCIRMLEGETQSMKQLSGGQKTVVALTLIFAIQRCDPAPFYLFDEIDAALDPQYRTAVG

SEQ ID NO: 163512 - protein, 85 aa, Glycine max
  Coding DNA Sequence Number=SeqID_46734
  Homolog annotation: Hit_ID=Q1SDL2; Match level="QueryCoverage=72%, HitCoverage=5%, E-value=4e-07, Identity=40%"; Hit description=Von Willebrand factor, type C; Zinc finger, RING-type; Zinc finger, C6HC- type; Zinc finger,...
  Homolog annotation: Hit description= C2H2-type; ATP-dependent helicase HrpA
MACGFDLTSKRLVELGARVEKHDFMPMLGSNVAVKDDVEGCLQPVLARHVEGLMEGKEVKWWVEESERLKRFVDEKNLVERRLNC

SEQ ID NO: 163513 - protein, 84 aa, Glycine max
  Coding DNA Sequence Number=SeqID_46735
MAVEGGVWHFVGKFFKLGGLFLKGTHQWGWRVGHVAAPGGLASGVGELLSTWRVPPLECPFEAHNMSKCSKLNEESLGKFPKGI

SEQ ID NO: 163514 - protein, 415 aa, Glycine max
  Coding DNA Sequence Number=SeqID_46736
  Gene Ontology: Mol. function=protein serine/threonine kinase activity; Cellular component=cytoplasm; Biological process=protein amino acid phosphorylation
  Homolog annotation: Hit_ID=Q6RK06; Match level="QueryCoverage=100%, HitCoverage=59%, E-value=0.0, Identity=82%"; Hit description=Tousled- like kinase 2
  Pfam annotation: Domain name=Pkinase; Domain location=168-410; Score =142.6; E_value=1.1e-39; Accession=PF00069.15; Description=Protein kinase domain
  Pfam annotation: Domain name=Pkinase_Tyr; Domain location=168-412; Score=-39.3; E_value=4.7e-10; Accession=PF07714.7; Description =Protein tyrosine kinase
  Pfam module annotation: Pfam domain module=Pkinase::Pkinase_Tyr; Domain location=168-410::168-412
MKIISDLLISVSKAERQEARLKVRQDSLRLGNVGVISSIMNCRAGTVISETWEDGQALKDLNAQLKQLIETKEAIERQRKLLKKKQSDKGDGTADAEAGLPEDILIHDEIYKSRLASLKRENVQEEENILRERERYEIEKGRLIREMKRIRDEDGSRFNNFQILNHRYALLNLLGKGGFSEVYKAFDLVEHRYVACKLHGLNAQWSEEKKQSYIRHAIREYNIHKTLVHRHIVRLWDIFEIDQNTFCTVLEYCSGKDLDAVLKATPILPEREAKVIIVQIFQGLIYMNKRAQKIIHYDLKPGNVLFDELGVAKVTDFGLSKIVEDDVGSQGMELTSQGAGTYWYLPPECFELSKTPLISSKVDVWSAGILYYQILFGRRPFGHDQTQERILREDTIIKARKVEFPSRPTISNEAK

SEQ ID NO: 163515 - protein, 374 aa, Glycine max
  Coding DNA Sequence Number=SeqID_46737
  Gene Ontology: Mol. function=metal ion binding; Cellular component =integral to membrane; Biological process=ubiquitin cycle
  Homolog annotation: Hit_ID=Q84KA9; Match level="QueryCoverage=73%, HitCoverage=75%, E-value=2e-58, Identity=46%"; Hit description =RING/C3HC4/PHD zinc finger-like protein
  Pfam annotation: Domain name=DUF855; Domain location=117-242; Score= -53.3; E_value=0.018; Accession=PF05883.2; Description=Baculovirus protein of unknown function (DUF855)
  Pfam annotation: Domain name=zf-C3HC4; Domain location=139-180; Score= 25.9; E_value=0.00014; Accession=PF00097.15; Description=Zinc finger, C3HC4 type (RING finger)
  Pfam module annotation: Pfam domain module=DUF855::zf-C3HC4; Domain location=117-242::139-180
MGIHTDCRAPLLMNLDHDHVCFLLLILLVPSITAQLQNSPPPPPPSSDPFTRLRFDKTMAAVLVILVVVFFALGFVSIYTRQCAERRIRGRLDLAVEIAAGMERRQPRGLDAAVVDTFPTFVYSEVKALKIGRVTTLECAVCLNEFLDDETLRLIPKCCHVFHPDCIDAWLVNHSTCPVCRANLAPKPEDAPSSVEIHVPDPARPIGPNDINRVEEEHEGEQNRIVTEPPRVLDDLNRARPVRSKSTGIGNARLFPRSLSTGHSLVRPGDDCERFTLRLPEEVKDRLVRSATLNRTKSCGVTWQRQSSGRRGYRTRSVGRYERFGGEGRLDRWGFMWTPPFWGRTGSVKSPKPTRVKDEVDVGERSSDRLFSKD

SEQ ID NO: 163516 - protein, 510 aa, Glycine max
  Coding DNA Sequence Number=SeqID_46738
  Gene Ontology: Mol. function=RNA-directed DNA polymerase activity; Cellular component=intracellular; Biological process=RNA-dependent DNA replication
  Homolog annotation: Hit_ID=Q1SRK0; Match level="QueryCoverage=80%, HitCoverage=85%, E-value=6e-55, Identity=28%"; Hit description =Peptidase S8 and S53, subtilisin, kexin, sedolisin; Tetratricopeptide - like helical
  Pfam annotation: Domain name=PPR; Domain location=102-136; Score =11.7; E_value=0.3; Accession=PF01535.11; Description=PPR repeat
  Pfam annotation: Domain name=PPR; Domain location=138-172; Score=2.3; E_value=4; Accession=PF01535.11; Description=PPR repeat
  Pfam annotation: Domain name=PPR; Domain location=208-242; Score =40.5; E_value=5.7e-09; Accession=PF01535.11; Description=PPR repeat
  Pfam annotation: Domain name=PPR; Domain location=288-322; Score =26.2; E_value=0.00011; Accession=PF01535.11; Description=PPR repeat
  Pfam annotation: Domain name=PPR; Domain location=323-357; Score =39.1; E_value=1.5e-08; Accession=PF01535.11; Description=PPR repeat
  Pfam annotation: Domain name=PPR; Domain location=358-392; Score =19.9; E_value=0.009; Accession=PF01535.11; Description=PPR repeat
  Pfam annotation: Domain name=PPR; Domain location=394-428; Score =20.5; E_value=0.0061; Accession=PF01535.11; Description=PPR repeat
  Pfam annotation: Domain name=PPR; Domain location=429-463; Score =27.9; E_value=3.7e-05; Accession=PF01535.11; Description=PPR repeat
  Pfam module annotation: Pfam domain module=PPR::PPR::PPR::PPR::PPR::PP R::PPR::PPR; Domain location=102-136::138-172::208-242::288-322::323 -357::358-392::394-428::429-463
MAFPKPRQSHHLSFLSPPLLRRFCSLPPPSPRDESDAELISKLLLQHHNPFHATESPLQLHGITLTPTLLFHTLLRLKNHSKIALSLFHYAKTLPNPPLSHSSFTLLIDTMAKVRQFDVAWQLIVEMDQRHHLTPTPSTFLTLIRRLICAGLTRQAVRAFHDIDAFSETKTTPQDFCVLLDTLCKYGHVRLAVEVFNKNKHTFPPTVKMYTVLIYGWCKIGRIKTAQSFLNEMIDKGIEPNVVTYNVLLNGVCRKVSLHPEERFERTIRNAEEVFDQMRESGIEPDVTSFSILLHVYSRAHKPQLVLDKLSLMKEKGICPNVVMYTSVIKCLASCGWLEDAERLLGEMVRDGVSPCAATYNCFFKEFRGRKDGESALRMFKRMKEDGLCMPSSHTYVILIRMFLRLDMIKVVKEIWQDMKETGAGPDLDLYTVLIHGLCERQRWREACHYFVEMIENGFLPLKGTFESLYRGLIQADMLRTWRRLKKKLDEESITFGSEFQNYQLKPYRR

SEQ ID NO: 163517 - protein, 122 aa, Glycine max
  Coding DNA Sequence Number=SeqID_46739
  Subcellular localization annotation: CTP_CleavageSite=53; ConfidenceScore=5.52e-01
MSDDMLIHFSSNSSNQSDQSLPTKIAKLEARMVGKGSSTAAQQSGWSSASVPSAGKFGGAAENLAEPSTSSDSDDDLICLRFKYRSRSPLHWTNAADAVPIGGSRCGRGQLKNLDFAARTVF

SEQ ID NO: 163518 - protein, 84 aa, Glycine max
  Coding DNA Sequence Number=SeqID_46740
  Homolog annotation: Hit_ID=Q2QQM3; Match level="QueryCoverage=89%, HitCoverage=6%, E-value=2e-36, Identity=92%"; Hit description =Ubiquitin-specific protease 12, putative, expressed
MTIRYKFDDERVTKEDTKRALEEQYGGEEELPQTNPGFNNTPFKFTKYSNAYMLVYIREADKDKVICNVDEKDIAEHLRMANLF

SEQ ID NO: 163519 - protein, 46 aa, Glycine max
  Coding DNA Sequence Number=SeqID_46741
  Homolog annotation: Hit_ID=Q2R2A3; Match level="QueryCoverage=95%, HitCoverage=3%, E-value=2e-15, Identity=82%"; Hit description =Ubiquitin carboxyl-terminal hydrolase family protein, expressed
DEVAKEFGIPVQFQRFWLWAKRQNHTYRPNRPLTHMEEAQSVNSLA

SEQ ID NO: 163520 - protein, 69 aa, Glycine max
  Coding DNA Sequence Number=SeqID_46742
MQQPVYLIQKCAIGFTCIIASTFAYGSVWVIRCLVSAVVATALCQEYDEHFKILGARISLFMCINTGLI

SEQ ID NO: 163521 - protein, 602 aa, Glycine max
  Coding DNA Sequence Number=SeqID_46743
  Gene Ontology: Mol. function=ubiquitin thiolesterase activity; Cellular component=nucleus; Biological process=ubiquitin-dependent protein catabolic process
  Homolog annotation: Hit_ID=Q2QQM3; Match level="QueryCoverage=73%, HitCoverage=40%, E-value=0.0, Identity=80%"; Hit description =Ubiquitin-specific protease 12, putative, expressed
VGQLREVSNKVHNAELKLFLEVELGLDVCPIAPPDKTKDDILLFFKLYDPEKEELRYAGRLFVKSTGKPSEILTRLNKMAGYDPDEEIGLYEEIKFEPNVMCEPIDKKVTFRASQLEDGDIICFQKAPAIDNEHVRYPDVPSYLEYVHNRQVVHFRSLEKPKEDDFCLEMSRLYTYDDVVEKVAQQLGLDDPSIIRLTPHNCYSQQPKPQPIKYRGVEHLSDMLVHYNQTSDILYYEVLDIPLPELQGLKTLKVAFHHATKDEVVIHTIRLPKQSTVGDVLNDLKTKVELSDPEAELRLLEVFYHKIYKVFPPNEKIESINDQYWTLRAEEIPEEEKNLGPHDRLIHVYHFTKDTAQNQMQIQNFGEPFFLVIHEGETLAEIKVRIQKKLQVPDDEFVKGVLNTFRILTLCPVVFRRDVYGAWEQYLGLEHTDNAPKRSYAVNQAQKLVALEQSDHDMISYVSKAQSVVEEMKIYLEADTLKEMKKKLDNVYVMLVLQGMHPDYKHVHDQILTTNKRTRAGFNAAVFAMQCFEILVDAKIKATPDFSRASLSCTLLNSNPLCYTKGKLSSNESQGDVVALYGILTGVGGGGLRLKVSAKAEE

SEQ ID NO: 163522 - protein, 62 aa, Glycine max
  Coding DNA Sequence Number=SeqID_46744
MKNLKAKEERKSNGGQNTDSDDKCLRVEIESGGDAVKEQNGVDDRQQPRLDGIKVRRREIER

SEQ ID NO: 163523 - protein, 149 aa, Glycine max
  Coding DNA Sequence Number=SeqID_46745
TNVETLQKVRKAWEVVRKKDKELRGSNNGPIGGYRKWLRALVQGLDWLPSLRTAKREEFEALKEDEEVQTLRAELKQAQIVKERFKSAALKIQKENTELRDVNVATTKALERETKRACREEHGRNKFRGALWGSNIELKLRREERANHE

SEQ ID NO: 163524 - protein, 82 aa, Glycine max
  Coding DNA Sequence Number=SeqID_46746
  Subcellular localization annotation: CTP_CleavageSite=56; ConfidenceScore=5.45e-01
LSSLVTDVWGANTFPARKYNSRAFHLKVRRSRLFRFFRRLPQINVGGDSARIPFVEHASRESRVALPPKGRLRHYCLLLKHP

SEQ ID NO: 163525 - protein, 99 aa, Glycine max
  Coding DNA Sequence Number=SeqID_46747
VDGGIGEGVRCEGVDRDDTRLGVAGEIHGAEFDGGVTGGLKEHGDELTGGGEGVKVGPGGGRGSEGWWQGWPGRGGGQQLGRHWGRREWRRRSDLRDPR

SEQ ID NO: 163526 - protein, 201 aa, Glycine max
  Coding DNA Sequence Number=SeqID_46748
  Gene Ontology: Mol. function=protein binding; Cellular component =integral to membrane; Biological process=protein amino acid phosphorylation
  Homolog annotation: Hit_ID=Q4VSU4; Match level="QueryCoverage=99%, HitCoverage=46%, E-value=4e-24, Identity=31%"; Hit description=Hcr9 -OR2B
  Pfam annotation: Domain name=LRR_1; Domain location=152-173; Score =5.5; E_value=27; Accession=PF00560.23; Description=Leucine Rich Repeat
  Pfam annotation: Domain name=LRR_1; Domain location=30-49; Score=4.9; E_value=35; Accession=PF00560.23; Description=Leucine Rich Repeat
  Pfam annotation: Domain name=LRR_1; Domain location=54-76; Score=9.3; E_value=5.3; Accession=PF00560.23; Description=Leucine Rich Repeat
  Pfam annotation: Domain name=LRR_1; Domain location=6-28; Score=1.6; E_value=1.5e+02; Accession=PF00560.23; Description=Leucine Rich Repeat
  Pfam annotation: Domain name=LRR_1; Domain location=78-100; Score =18.8; E_value=0.02; Accession=PF00560.23; Description=Leucine Rich Repeat
  Pfam module annotation: Pfam domain module=LRR_1::LRR_1::LRR_1::LRR _1::LRR_1; Domain location=152-173::30-49::54-76::6-28::78-100
MCNASSLLILNFAHKNLTGQIPQCLGTFPSLYVLDLQVNNLHGNMPWNFSKGNSFETIKLNENRLVGQLPQSLANCTKLEVLDLGNNNIEDTFPHWLETLQEFQEKFRKSLENCILSKGLTFHTIVSLKFGIVGPLMESVEGRDSLGFDKFEFSVLNLSQNQFEGIIPTGRQFNTLGNDSYAGNPMLCGFPLSKSCNEDEE

SEQ ID NO: 163527 - protein, 183 aa, Glycine max
  Coding DNA Sequence Number=SeqID_46749
  Gene Ontology: Mol. function=RNA-directed DNA polymerase activity; Biological process=RNA-dependent DNA replication
  Homolog annotation: Hit_ID=Q1T193; Match level="QueryCoverage=49%, HitCoverage=58%, E-value=3e-14, Identity=32%"; Hit description=RNA -directed DNA polymerase
MGSWGSYWILNSESSIDQATILPASSSFCKTCFMGTDNVAMVFLKAKKAYSQAKGHDLVVEVGISSDEYHFLLVWSVHPNLVVSRISIVGAHMPFAVGLFDHDDIGEPGVIFDFSDEVDDKLVEDNAWVDFGHVRWLPSEQGEGKIDKPNSSSPRENTSEVTTNVYSRKMVDKGVSLAPTYLQ

SEQ ID NO: 163528 - protein, 494 aa, Glycine max
  Coding DNA Sequence Number=SeqID_46750
MVKAYEILCPFFNIWPSVPVFMFFFLTKLTNKIGWVLAANVGVDGLPLMFNRDGDPRFPFYWQFDPTRPFLKQDELVGGTVPPSMVPPTIGEGGQPSGEVGPVVGIVEVTPNAPSSVLAKRNQDDDVGVSGHKKVDAWFGSPFKFTRCAFNSAQGGVLGGGECPKVANTTIAFAEAVRSNHQLSSKVGSVLAKLLRQGIATEMEKLAKVVAELEAGLKELESKMGESELWVSKEREASKELEGELIDIRQAGFFANDIDLGLFDPFKDVKDDVLLDEEDIAVEEEAVKEEASEEAQDVGANEADLGDLGSKALVVLCEVKSVICTRLKVLPNSLVVVRFVELGLLNVVFMVLKETYFGFYEPVKLTKDVSVLDFGETRQGQTLDLMSLVCVVYVSCSCIHVTHGAVCPGDVVLCSCICVTTEVSCTGDMMSCSCIRVTHGVTRTRGLTKGEPWVLQALWRNDQRRVHHGFWQDSPRENLGFDEPVELGPWMYLS

SEQ ID NO: 163529 - protein, 287 aa, Glycine max
  Coding DNA Sequence Number=SeqID_46751
MWDKGTKTTNSNTYELMLAWASWSSLGRAAGEVPIELHTLPWFGSELQLDELFDRLWAFVSSFIMRIYIEFVVQACLVNRQGSNWRPFIRAHDLSGTIRCGVRFGRFPVTITPVKVGNFIFRCSVETMAPTLGELALTKGGHKVDIASGLYSFLCEAEEWIDVRLNGVLGQHEVGDYDGDNHGVVLVDGVDTLEVSVVDHILNGCVSVFLNCLLCLFFCSRHDSCANPLGVLRGLAVFYVVTNAAMVFVVFGRSNLVQGGFIGGSLMGTSMLKASSRIVVQLAVRGV

SEQ ID NO: 163530 - protein, 48 aa, Glycine max
  Coding DNA Sequence Number=SeqID_46752
ALASVESLSTKEYMRKLVEDARLAALGSKATMMEIDGDPIPKNLFLNL

SEQ ID NO: 163531 - protein, 213 aa, Glycine max
  Coding DNA Sequence Number=SeqID_46753
  Gene Ontology: Mol. function=protein serine/threonine kinase activity; Cellular component=membrane; Biological process=protein amino acid phosphorylation
  Homolog annotation: Hit_ID=Q70KR7; Match level="QueryCoverage=98%, HitCoverage=34%, E-value=4e-85, Identity=76%"; Hit description=Nod -facor receptor 1b
  Pfam annotation: Domain name=Pkinase_Tyr; Domain location=1-187; Score=-159.9; E_value=0.012; Accession=PF07714.7; Description =Protein tyrosine kinase
MIPGKDPLPWSGRVQIALDSARGLEYIHEHTVPVYIHRDVKSANILIDKNIRGKVALLSFFMILTPHPDFSYFFRLNRDITRYAQYGDISPKVDVYAFGVVLYELISAKNAVLKTGESVAESKGLVALFEEALNQSNPSESIRKLVDPRLGENYPIDSVLKIAQLGRACTRDNPLLRPSMRSIVVALMTLSSPTEDCDTSYENQTLINLLSVR

SEQ ID NO: 163532 - protein, 459 aa, Glycine max
  Coding DNA Sequence Number=SeqID_46754
  Homolog annotation: Hit_ID=Q2R320; Match level="QueryCoverage=90%, HitCoverage=90%, E-value=2e-59, Identity=34%"; Hit description =Expressed protein
  Pfam annotation: Domain name=DUF247; Domain location=25-424; Score =390.4; E_value=2.8e-114; Accession=PF03140.6; Description=Plant protein of unknown function
MEETKWVVQINEELKSDGTSVPEKEQWKRHSIYKIPSRVTALNQKAYKPQAVSFGPYHHGEEHLKDMEYHKHRALIHFLKRCKKPIELIFHCMDQVVDELRGSYNPLDQIWMQDTPRFLQMMILDGCFVLEILRAHDGVPDDYADNDPVFGEHGKLNVVPYIKRDMLMLENQLPLMVLRILIEIETDTTQGDELLIKQILKFFSPGTPETGTNGKCMHVLDVYRKSLIQQGPTKRTRVSKAKRRRLWLSIEEHDDDEIIRSAMELQDAGIRFKKSRTHSLGDISFVYGVLRLPALVVDDTTEYMFLNLIAFERLHAGAGNEITSYIFFMDTIIDSEMDVALLHRNGILVNALGCDRAVAKLFNSLSKDIAVDRQGVLDVVRMSMSNYCKKPWNLWRANLIHTYFRNPWAIVSLVAAIFLFALTIVQTVYTIAQYYQPPTTPSDSSSPFVIPSPRPWFRP

SEQ ID NO: 163533 - protein, 849 aa, Glycine max
  Coding DNA Sequence Number=SeqID_46755
  Gene Ontology: Mol. function=protein serine/threonine kinase activity; Cellular component=membrane; Biological process=protein amino acid phosphorylation
  Homolog annotation: Hit_ID=Q6UD74; Match level="QueryCoverage=99%, HitCoverage=98%, E-value=0.0, Identity=58%"; Hit description=LysM domain-containing receptor-like kinase 7
  Pfam annotation: Domain name=LysM; Domain location=621-666; Score =7.4; E_value=0.096; Accession=PF01476.10; Description=LysM domain
  Pfam annotation: Domain name=Pkinase; Domain location=301-529; Score =63.1; E_value=8.8e-16; Accession=PF00069.15; Description=Protein kinase domain
  Pfam annotation: Domain name=Pkinase_Tyr; Domain location=301-529; Score=38.0; E_value=8.4e-15; Accession=PF07714.7; Description =Protein tyrosine kinase
  Pfam module annotation: Pfam domain module=LysM::Pkinase::Pkinase _Tyr; Domain location=621-666::301-529::301-529
MEHSFRLPVFFLLCASIAFSAESKCSRGCDLALASYYLSQGDLTYVSKLMESEVVSKPEDILSYNTDTITNKDLLPASIRVNVPFPCDCIDEEFLGHTFQYNLTTGDTYLSIATQNYSNLTTAEWLRSFNRYLPANIPDSGTLNVTINCSCGNSEVSKDYGLFITYPLRPEDSLQSIANETGVDRDLLVKYNPGVNFSQGSGLVYIPGKGLAGGVIAGISIGVVTGLLLLAFCVYVTYYRRKKVWKKDLLSEESRKNSARVKNDEASGDSAAEGGTNTIGIRVNKSAEFSYEELANATNNFSLANKIGQGGFGVVYYAELNGEGSLFLVYEYIENGNLGQHLRKSGFNPLPWSTRVQIALDSARGLQYIHEHTVPVYIHRDIKSENILIDKNFGAKVADFGLTKLIDVGSSSLPTVNMKGTFGYMPPEYAYGNVSPKIDVYAFGVVLYELISGKEALSRGGVSGAELKGLFDEVFDQQDTTEGLKKLVDPRLGDNYPIDSVCKMAQLARACTESDPQQRPNMSSVVVTLTALTSTTEDWDIASIIENPTLANLMSAFASYYVSPDLSLENIARLMESSIEVIISFNEDNISNGYPLSFYRLNIPFPCDCIGGEFLGHVFEYSASAGDTYDSIAKVTYANLTTVELLRRFNGYDQNGIPANARVNVTVNCSCGNSQVSKDYGMFITYPLRPGNNLHDIANEARLDAQLLQRYNPGVNFSKESGTVFIPGRGLARGAAVGISIAGICSLLLLVICLYGKYFQKKEGEKTKLPTENSMAFSTQDGTVSGSAEYETSGSSGTASATGLTGIMVAKSMEFSYQELAKATNNFSLENKIGQGGFGAVYYAELRGE

SEQ ID NO: 163534 - protein, 82 aa, Glycine max
  Coding DNA Sequence Number=SeqID_46756
MKGSPSKISLIKLDVLLSLKRSVLGTMVHTLFFWGTTCHDALSNKGIVNRKEVIISLVTIVAMYGCLEEGLVFGKDWKKDIS

SEQ ID NO: 163535 - protein, 181 aa, Glycine max
  Coding DNA Sequence Number=SeqID_46757
  Homolog annotation: Hit_ID=Q1RZ71; Match level="QueryCoverage=23%, HitCoverage=3%, E-value=2e-07, Identity=60%"; Hit description =Peptidase aspartic, catalytic; Polynucleotidyl transferase, Ribonuclease H fold
MEAQEGIAIIHIPVIFPLPMPPKATLPPSTSLRTRNIDFSPVMCHEQPLSRSHICLNQTVTWRMMPLLLSLSQTYDVEVKTWDNEQVNSFLMANTNEQVEISLVRKGRSLCWYLDSVCSQHMTRERSMFLGLKLVEVGTINFGGMGKGKITGIAYTSAYSRQKTSIPSLPLDNITICMILI

SEQ ID NO: 163536 - protein, 173 aa, Glycine max
  Coding DNA Sequence Number=SeqID_46758
  Gene Ontology: Mol. function=DNA binding; Biological process=DNA integration
  Homolog annotation: Hit_ID=Q2HSF6; Match level="QueryCoverage=48%, HitCoverage=6%, E-value=1e-21, Identity=54%"; Hit description =Glycoside hydrolase, family 1; Zinc finger, CCHC-type; Polynucleotidyl transferase, Ribonuclease H fold
MAKGTNATGPKKIWVPKSHIVPIVDILSRKRLKFKLEEVLPLEAWAKERSPAVTTMHMDLFGPTKTLSLGGKKYGSRIVDDYSRYIGIYFLAHKHEAFKVFEIFYKRFENEKGFCISSIRSDHGTEFENDDFKSLYEKSGYIYLGLTENKRGYISCGSVLVEGTSTRFKENKG

SEQ ID NO: 163537 - protein, 59 aa, Glycine max
  Coding DNA Sequence Number=SeqID_46759
MVMPILGSRDFVSDRDMFCMYKVVMGEKLKGMTFLKIGIVDNFQKHIKRKIKKEPNEEP

SEQ ID NO: 163538 - protein, 106 aa, Glycine max
  Coding DNA Sequence Number=SeqID_46760
MDGAKPMKTPMHASNPLSKDKLGKPIVMQSYPPRALDRRIQEDWARDAREVPKASTTKMMPRECFQRILSSVDAGGTVKAKEVIISLETLVATSGCLEEGLVFDKE

SEQ ID NO: 163539 - protein, 50 aa, Glycine max
  Coding DNA Sequence Number=SeqID_46761
MVFKNQHAHTKKAIAGAGGALGGRPVTRITINGYLTQCIQGLGPMTPEEV

SEQ ID NO: 163540 - protein, 71 aa, Glycine max
  Coding DNA Sequence Number=SeqID_46762
MKLREKVGKAFAVATAFIFGGAALVFGVVASKLELHNAENMSRKWHMERDDVKQKTIVKELSKIWGAKRTD

SEQ ID NO: 163541 - protein, 165 aa, Glycine max
  Coding DNA Sequence Number=SeqID_46763
MERREQSTSWKMSFLAGRLAGKEAAYFFQESKQAVGKLAQKNPLPKTNNNNNLNFHEVHDCSDVLPEVLRHSLPSKVFRNDEATSFSFSASKWVLRSDPKTQSSVSPDALNPLRAYLSLPQVSFGPKRWQLPEAANTVSASTANESRQDRSFYLATWSHQFELMR

SEQ ID NO: 163542 - protein, 110 aa, Glycine max
  Coding DNA Sequence Number=SeqID_46764
MEALWESLLPQPLCARGLRVVIVERNVLKGVISASLTEISAFYPTQKRVDKFFEGEQEWNISTTELLELVEVGVLEEDDIERATAVKFNPVIPELLEFSCQSLCSKNHLD

SEQ ID NO: 163543 - protein, 616 aa, Glycine max
  Coding DNA Sequence Number=SeqID_46765
  Gene Ontology: Mol. function=isocitrate lyase activity; Cellular component=glyoxysome; Biological process=carboxylic acid metabolic process
  Homolog annotation: Hit_ID=P45456; Match level="QueryCoverage=95%, HitCoverage=98%, E-value=0.0, Identity=89%"; Hit description =Isocitrate lyase 1
  Pfam annotation: Domain name=ICL; Domain location=21-546; Score =1345.2; E_value=0; Accession=PF00463.11; Description=Isocitrate lyase family
MAASLFMPSSIVEEEARFEAEVAEVQAWWNSERFRLTKRPYTARDVVSLRGNLRQTYASNEMAKKLWRLLKNHQANGTASRTFGALDPVQVTQMAKHLDTIYVSGWQCSATHTTSNEPGPDLADYPYDTVPNKVEHLFFAQQYHDRKQKEERMRMSREERARTPYVDYLRPIIADGDTGFGGTTATVKLCKLFVERGAAGIHIEDQSSVTKKCGHMAGKVLVAISEHINRLVAARLQFDVMGVETVLVARTDAEAANLIQSNIDTRDHQFILGVTNPNLKGKSLATLMQQGMAAGKNGAELQALEDEWLSKAQLKTLSEAVVEAIERQNNIGEEEKRRKLNEWMHHSSYERCLSNEEGREIAEKLGVRNLFWDWDLPRTREGFYRFKGSVTASVVRGCAFSPHADVIWMETASPNVVECTEFSEGVRSKHPQMMLGYNLSPSFNWDASGMSDEQMKDFIPKIAKLGYVWQFITVGGLHSNALITSTFARDFANRGMLAYVERIQREERNNGVDTLAHQKWAGANYYDRYLKTVQGGVASTAAMGKGKSYIFTHLVTNNNVPCFNFLMQTMVLKCGYSKLENLYIAGVTEEQFKESWTRSGAVNIDRGSIVVAKARM

SEQ ID NO: 163544 - protein, 408 aa, Glycine max
  Coding DNA Sequence Number=SeqID_46766
  Gene Ontology: Mol. function=lipid binding; Cellular component =nucleus; Biological process=Golgi organization and biogenesis
  Homolog annotation: Hit_ID=Q9AXJ6; Match level="QueryCoverage=99%, HitCoverage=100%, E-value=1e-143, Identity=69%"; Hit description =Phosphatase-like protein Psc923
  Pfam annotation: Domain name=SEP; Domain location=222-296; Score =149.8; E_value=7.4e-42; Accession=PF08059.3; Description=SEP domain
  Pfam annotation: Domain name=UBX; Domain location=329-408; Score =90.8; E_value=4.1e-24; Accession=PF00789.11; Description=UBX domain
  Pfam module annotation: Pfam domain module=SEP::UBX; Domain location =222-296::329-408
MEGEKENPDGNAALVNSFCEITSSSKEEALFFLESHNFDLDAAVSTFLDNANNPLIPLNDDLAIPNPNAVSPPSDSHSPDFNPSRSPSPSPSPTRTPYELRSRRSLGKKPSTSRQGKIRTLGDLKRPSRDDDDSGSDPDFEPDEYYTGGEKSGMLVRDPTRGNNNNNLDDIFDQARQVAVDAPPENPRSSSRSRSFSGTARLLSGETVPSAPQRVEEVTHTVIFWRNGFSVNDGPLRRLDDPQNAPFLESIKKSECPKELEPADRRTAVHVNLTRRDEDYPEPVKPRQRAFQGVGRTLGSTSSSNDEPIQTTGASPNTAPMPTMGLVVDESQPVTSIQLRLADGTRMVSRFNHHHTIRDVRAFIDASRPGGVRSYQLQTMGFPPKQLTDLDQSIEQAGIANSVVIQKL

SEQ ID NO: 163545 - protein, 114 aa, Glycine max
  Coding DNA Sequence Number=SeqID_46767
  Gene Ontology: Mol. function=zinc ion binding; Cellular component =nucleus; Biological process=ubiquitin cycle
  Homolog annotation: Hit_ID=A0ELV2; Match level="QueryCoverage=69%, HitCoverage=68%, E-value=9e-28, Identity=73%"; Hit description=RBX1 -like protein
MATLDSDVPMVPAGEPSSSAGPSSKKPKRFEIKKWNAVALWAWDIVVDNCAICRNHIMDLCIECQANQASATSEECTVAWVRVLQSQLQGCYWAMVAAIVSLILLSEANGVIHS

SEQ ID NO: 163546 - protein, 85 aa, Glycine max
  Coding DNA Sequence Number=SeqID_46768
MEKYHKSRLQSSHKEYEQKTLKNIFKLVSKHIDNFNKEEEIKEVEVEEIFAEEDMAISTKGENNFNSPDQGKCGNNFGLQIKEKE

SEQ ID NO: 163547 - protein, 604 aa, Glycine max
  Coding DNA Sequence Number=SeqID_46769
  Gene Ontology: Mol. function=sequence-specific DNA binding; Cellular component=nucleus; Biological process=regulation of transcription, DNA-dependent
  Homolog annotation: Hit_ID=Q40988; Match level="QueryCoverage=94%, HitCoverage=76%, E-value=0.0, Identity=71%"; Hit description =Homeobox protein
  Pfam annotation: Domain name=Homeobox; Domain location=79-135; Score =84.5; E_value=3.3e-22; Accession=PF00046.19; Description=Homeobox domain
  Pfam annotation: Domain name=START; Domain location=270-490; Score =322.8; E_value=6.2e-94; Accession=PF01852.10; Description=START domain
  Pfam module annotation: Pfam domain module=Homeobox::START; Domain location=79-135::270-490
  Subcellular localization annotation: CTP_CleavageSite=49; ConfidenceScore=5.00e-01
MPSMIARNNNNVGGFFGSSSSPFTLAQPNLMDALEMGQNTPESEIPRIREDEFDSATKSGSENHEGASGEDQDPRPNKKKRYHRHTQHQIQEMEAFFKECPHPDDKQRKELSRELGLEPLQVKFWFQNKRTQMKTQHERHENTNLRTENEKLRADNMRYREALSNASCPNCGGPTAIGEMSFDEHHLRLENARLREEIDRISAIAAKYVGKPVVNYSNISPSLPPRPLEIGVGGAGFGGQPGIGVDMYGAGDLLRSISGPTEADKPIIIELAVAAMEELIGMAQMGEPLWLTTLDGTSTMLNEDEYIRSFPRGIGPKPSGFKCEASRETAVVIMNHVNLVEILMDVNQWSTVFSGIVSRAMTLEVLSTGVAGNYNGALQVMTAELQLPTPLVPTRESYFVRYCKQHGDGTWAVVDVSLDNLRPSPSARCRRRPSGCLIQEMPNGYSKVTWVEHVEVDDRGVHNLYKQLVSSGHAFGAKRLVATLDRQCERLASAMATNIPTVDVGVITNQEGRKSMMKLAERMVISFCAGVSASTAHTWTTLSGTGADDVRVMTRKSVDDPGRPPGIVLSAATSFWLPVPPKRVFDFLRDENSRNEVCAKIPKS

SEQ ID NO: 163548 - protein, 588 aa, Glycine max
  Coding DNA Sequence Number=SeqID_46770
  Gene Ontology: Mol. function=transporter activity; Cellular component= membrane; Biological process=oligopeptide transport
  Homolog annotation: Hit_ID=Q8LG02; Match level="QueryCoverage=96%, HitCoverage=96%, E-value=0.0, Identity=65%"; Hit description=Nitrate transporter
  Pfam annotation: Domain name=MFS_1; Domain location=41-513; Score =33.8; E_value=6e-07; Accession=PF07690.6; Description=Major Facilitator Superfamily
  Pfam annotation: Domain name=PTR2; Domain location=103-497; Score =399.5; E_value=4.9e-117; Accession=PF00854.12; Description=POT family
  Pfam module annotation: Pfam domain module=MFS_1::PTR2; Domain location=41-513::103-497
MVLVASHGEEEKGAEGIATVDFRGHPVDKTKTGGWLAAGLILGTELAERICVMGISMNLVTYLVGVLNLPSADSATIVTNVMGTLNLLGLLGGFIADAKLGRYLTVAISAIIAALGVCLLTVATTIPGMRPPVCSSVRKQHHECIQASGKQLALLFVALYTVAVGGGGIKSNVSGFGSDQFDTTDPKEERRMVFFFNRFYFFISIGSLFSVVVLVYVQDNIGRGWGYGISAGTMVIAVAVLLCGTPFYRFKRPQGSPLTVIWRVLFLAWKKRSLPNPSQHSFLNGYLEAKVPHTQRFRFLDKAAILDENCSKDENKENPWIVSTVTQVEEVKMVLKLLPIWSTCILFWTIYSQMNTFTIEQATFMNRKVGSLVVPAGSLSAFLIITILLFTSLNEKLTVPLARKLTDNVQGLTSLQRVGIGLVFSSVAMAVAAIVEKERRVNAVKNNTTISAFWLVPQFFLVGAGEAFAYVGQLEFFIREAPERMKSMSTGLFLSTLSMGYFVSSLLVAIVDKASKKRWLRSNLNKGRLDYFYWLLAVLGVQNFIFFLVLAMRHQYKVQHSTKPNDSAEKELVSANDVKVGVGGKEEA

SEQ ID NO: 163549 - protein, 444 aa, Glycine max
  Coding DNA Sequence Number=SeqID_46771
  Homolog annotation: Hit_ID=Q1ZY19; Match level="QueryCoverage=74%, HitCoverage=76%, E-value=1e-38, Identity=30%"; Hit description =Fgenesh protein 60
  Pfam annotation: Domain name=DUF247; Domain location=25-374; Score =275.5; E_value=1.1e-79; Accession=PF03140.6; Description=Plant protein of unknown function
  Pfam annotation: Domain name=GRP; Domain location=362-440; Score= -23.4; E_value=0.018; Accession=PF07172.2; Description=Glycine rich protein family
  Pfam module annotation: Pfam domain module=DUF247::GRP; Domain location=25-374::362-440
MAYDGDVVEINIEEMLKGAWAPVITECCIYKVPFSIRRHNEEAYTPKVISIGPFHHGHPRLRDMEEHKIYYSKAFLERSQTTLDSFIGWIDEMEPKFRRCYSHTLEFSKEQLVKIIFVDCAFILELFCRDHDQGLNQDSLYNLSFRLLNDDRSLLERTFHFFRHFNRSQLDMGNIQKISHFTDLIRTFHLQDPLPSRIDGNIIKHLPSATELSEAGLRFKVLESESCLLKLDFSGRVLEIPQLVVEDPTETLFRNMVALEQCHYHFQSYITDYVCFLDFLVNTNRDVDILVQERVFINWLGDTDSVAMMINGLMKNITTSNNISSQYFDVSEKLNAFHKNPCRKLISALRRDYCRGPWQTAASIAAIILLILSFVQTALSQRPAARRRIPPAAEERAMPAAACCTWHWWACFRSRGGYGGGRGGGTAGAGKRGGGTVAGGWRNG

SEQ ID NO: 163550 - protein, 343 aa, Glycine max
  Coding DNA Sequence Number=SeqID_46772
  Homolog annotation: Hit_ID=Q6ASU1; Match level="QueryCoverage=77%, HitCoverage=73%, E-value=4e-56, Identity=45%"; Hit description =Expressed protein
MSGDEATTVSAADSPEKVQTAIESLSSIVPSLSITTPTSLLSNPEIYSHISSLLRRPNSGAGDNNLCRWLYDTFQSGVTELQLLVLRFLPVIAGVYLSRVADRKPQAGFEAVLLALYAHETTSRAGQAVSVTIPDLAQPSLYHDPKALTPNNNKNINSSTELNVAVVSPSLEPHGTVRSTRRARIVGVALELFYAKIPHMPVSSKIDFCEFCKLWAGQDGDMYKNLEEEEDNGEESVVFVDAEAELEEKEKGKVESRVPLPWELLEPVLRILGHCLLGQNKRDVELFEAASEACRCLFARSMHDVNAKAILPIRSLLRLSKTLVQNNNELDPTELPFTDVISL

SEQ ID NO: 163551 - protein, 986 aa, Glycine max
  Coding DNA Sequence Number=SeqID_46773
  Gene Ontology: Mol. function=zinc ion binding; Cellular component =nucleus; Biological process=transcription
  Homolog annotation: Hit_ID=Q1S9M8; Match level="QueryCoverage=75%, HitCoverage=96%, E-value=0.0, Identity=71%"; Hit description=FAR1; Zinc finger, SWIM-type
  Pfam annotation: Domain name=FAR1; Domain location=162-381; Score =169.5; E_value=8.3e-48; Accession=PF03101.5; Description=FAR1 family
  Pfam annotation: Domain name=SWIM; Domain location=658-694; Score =48.4; E_value=2.4e-11; Accession=PF04434.8; Description=SWIM zinc finger
  Pfam module annotation: Pfam domain module=FAR1::SWIM; Domain location=162-381::658-694
  Subcellular localization annotation: CTP_CleavageSite=30; ConfidenceScore=5.37e-01
MQHYIHPLSRSRSFLLPLCNRSELRNPNSLQNAVVSFPHRSRVSVIPQPLIFSTLIISRALLAPHLVFVAHCFWRCKISDDACNLRQPIFLPDRIKTCNFGYIQVISMGEGSDHQAMADNGNAESSEGGVSSAENNSGSHVRVGVSEPYVGREFDSEDAAKAFYIEYGKRVGFSCKAGLYGGCSTADGANMYREFVCGREDSKRKPPESCNAMIRIEQKGQNKWVVTKFIKDHSHSLGNLSKVHNIRPRKPFSSVGRTMPETYQGVGLVPSGVMYVSMDKNCIPTKNIQGIKNIPAAAAVAETNQPVKSPTMMNYAVRPPSRKRTLGKDAQNLLEYFKKMQAENPGFFYAIQLDEDNHMSNVFWADARSRTSYSHFGDAVTLDTTYRINQYGVPFAPFTGVNHHGQMILFGCALLLDDSEASFVWLFKTFLTAMNDRYPVSITTDQDRAIQTAVSQVFPQTRHCISKWHVLREGHEKLAHVCNMHPNFQIELYNCINLTETIEEFDSSWNFIINKYELTKNDWLQSLYSARAQWVPAYFRDSFFAAISPNQGFDGSYFYGFVNHQTTLPLFFRQYEQALECWFEKELESDYETICTTPVLKTPSPMEKQAANLYTRKIFSKFQEELVETFAYTANRIEEDGENSIFRVAKFEDDQKAYVVTLNLSELRANCSCQMFEYSGILCRHVLTVFTVTNVLTLPSHYILKRWTRNAKSSAGSVELAGESLGHESLTSRYSNLCWEAIKYAEEGALTVEIYDTAISALRESGKKISFMRRSVAKVAPPSHPASGTAYDDRKSPTSTVDTNPLLWPLQDETTQRFNLNDASTPVQSVADLNLPQMTPVSLQRDDGPPENMVVYPCLKSLTWVMENRNSTPGNRVAVISLKLQDYSRIPSTESEVKFNLSKVSLEPLFNHMVNISDQLSTPTRKFAVLNLKLPVAETTSGASEVKFQVSKDTLGAVLRSMAYIREQLLGPGDAQTEPLSKRPRK

SEQ ID NO: 163552 - protein, 407 aa, Glycine max
  Coding DNA Sequence Number=SeqID_46774
  Gene Ontology: Mol. function=oxidoreductase activity; Cellular component=mitochondrion; Biological process=retinoid metabolic process
  Homolog annotation: Hit_ID=Q1S9K7; Match level="QueryCoverage=97%, HitCoverage=97%, E-value=1e-174, Identity=74%"; Hit description =Alcohol dehydrogenase superfamily, zinc-containing
  Pfam annotation: Domain name=ADH_N; Domain location=40-169; Score =113.0; E_value=8.9e-31; Accession=PF08240.2; Description=Alcohol dehydrogenase GroES-like domain
  Pfam annotation: Domain name=ADH_zinc_N; Domain location=200-364; Score=79.4; E_value=1.1e-20; Accession=PF00107.16; Description=Zinc -binding dehydrogenase
  Pfam module annotation: Pfam domain module=ADH_N::ADH_zinc_N; Domain location=40-169::200-364
MEHKVATTTEGQSIRCKAAICRKAGEPLSIEEIIVAPPMPGEARIRIICSSLCQTDISFRNMQDHPAIYPRILGHEAIGVVESVGEDVTEVTKGDVVVPIFLPDCGECIDCKSSKSNLCSKFPFEVSPWMPRYATSRFTDLKGEIIHHFLSVSSFSEYTVVDIAHLIKIDPAIPPNRACLISCGISAGIGAAWRAAGVEPGSTVAIFGLGSIGLAVAEGARLCGATKIIGVDVNPERYEIGKRFGLTDFVHSGECENKSVSQIFFSYGVVKQVIIEMTGGGADYCFECVGMASLMHEAYASCRKQLLKLMLCVQGWGKTIVLGVDKPGSKLNLSCSEVLVSGKSLRGCLFGGLKPKSHVPILLKRYMDKELNLDEFVTHEMEFKDINKAFDLLIEGQCLRCVIWMDK

SEQ ID NO: 163553 - protein, 448 aa, Glycine max
  Coding DNA Sequence Number=SeqID_46775
  Gene Ontology: Mol. function=geranylgeranyl reductase activity; Biological process=chlorophyll biosynthetic process
  Homolog annotation: Hit_ID=Q9ZS34; Match level="QueryCoverage=95%, HitCoverage=94%, E-value=1e-145, Identity=60%"; Hit description =Geranylgeranyl reductase
  Pfam annotation: Domain name=DAO; Domain location=42-262; Score= -57.9; E_value=0.042; Accession=PF01266.14; Description=FAD dependent oxidoreductase
  Pfam annotation: Domain name=FAD_binding_3; Domain location=40-344; Score=-110.4; E_value=0.00024; Accession=PF01494.9; Description=FAD binding domain
  Pfam annotation: Domain name=Thi4; Domain location=27-243; Score= -139.3; E_value=0.072; Accession=PF01946.7; Description=Thi4 family
  Pfam module annotation: Pfam domain module=DAO::FAD_binding_3::Thi4; Domain location=42-262::40-344::27-243
  Subcellular localization annotation: CTP_CleavageSite=42; ConfidenceScore=5.63e-01
MAAKIQTSFCLPTFSIPTSKPKPYLKSFTIKASKSISGRKLRAAVIGGGPAGSSAAEALASGGVETFLFERNPPSVAKPCGGAIPLCMLEEFDIPNHLIDRHVTHMRIFSPSNIAVDFGKTLKPHEFIAMLRREVLDSFLRSRAHAAGATAISGLVTALDLPASPDAPYTVHYTANGSSRRSLAVDVVIGADGANSRVAKAIGAGDYACAIAFQERIKLPDEKMAYYENLAEMYVGDDVSPDFYAWVFPKCDHVAVGTGTVRSKKDIKLYQRGIRERVKPKINGGKVIKVEAHPIPEHPRPVRVRGRVALVGDAAGYVTKCSGEGIYFAAKSGRVCGNGVVRASEGGDRMIDECDLRREYLKPWDAEYANTFRFLDLLQRVFYGSNACREALVELCGDEYVQRMTFESYLYKKLARGRVLDHAKLFMNTLGSLVRSKVVQTSMESFIL

SEQ ID NO: 163554 - protein, 436 aa, Glycine max
  Coding DNA Sequence Number=SeqID_46776
  Gene Ontology: Mol. function=hydrolase activity, acting on ester bonds; Biological process=lipid metabolic process
  Homolog annotation: Hit_ID=Q6K877; Match level="QueryCoverage=68%, HitCoverage=76%, E-value=5e-43, Identity=30%"; Hit description =Putative GDSL-lipase
  Pfam annotation: Domain name=Lipase_GDSL; Domain location=45-413; Score=77.9; E_value=3.2e-20; Accession=PF00657.12; Description=GDSL -like LipaseAcylhydrolase
MRRSIVVHSVPEVLLIGILSIVHGQFTDTPTTNAHVTNSSRVSALYVLGDSSVDCGDNTLFYPLLHGRLSLYPCNGSDATLLPQLLGTSLYLFSSSFGLCIRDSSKLDRTTEIPHAGSYNLEPLHSCQDKRKLSFSDSYKFCQYHAEKIGLTSIRPFYGQNGSLEEVLGGLNFGSTQATIMNQGSYSHQSLNQQLRQVSETMQLLQLQLNEDTALQFIKSSIFFLSFGKEDYIELFLHNSSSSSGMMFRNSSQYFATILVNQVANAARYLYNANARKIICLGIMPLGCTPRMAWELNHTSAGDYNASSCVEHVNDLVFEYNRLLDEQIGKLNSEFSDAQMVFCDVYNGMMEIINEPRLYGFEDVKSACCGLGLNGAMIGCVSMDMACDQASTHVWWDLFNPTQAVNKILADAAWSGQPIPDLCRPITIHELVNMKV

SEQ ID NO: 163555 - protein, 56 aa, Glycine max
  Coding DNA Sequence Number=SeqID_46777
MTMRCRFHCSEGLPSSFLEKEFWHEMAHGEKETVDLSIESMLRAVPFHEILMIGLE

SEQ ID NO: 163556 - protein, 340 aa, Glycine max
  Coding DNA Sequence Number=SeqID_46778
  Gene Ontology: Mol. function=protein kinase activity; Cellular component=extracellular region; Biological process=protein amino acid phosphorylation
  Homolog annotation: Hit_ID=Q69TY6; Match level="QueryCoverage=93%, HitCoverage=47%, E-value=1e-80, Identity=51%"; Hit description =Putative receptor protein kinase PERK1
  Pfam annotation: Domain name=Pkinase; Domain location=39-307; Score =97.7; E_value=3.4e-26; Accession=PF00069.15; Description=Protein kinase domain
  Pfam annotation: Domain name=Pkinase_Tyr; Domain location=44-310; Score=23.7; E_value=6.4e-14; Accession=PF07714.7; Description =Protein tyrosine kinase
  Pfam module annotation: Pfam domain module=Pkinase::Pkinase_Tyr; Domain location=39-307::44-310
ATIPTTQSWSLSSEGVRYAIESLSVYKFEELQKATGFFGEENKIKGSVYRASFKGDYAAVKILKGDVSGEINLLRRINHFNIIRLSGFCVYKGDTYLVYEFAENDSLEDWLHSGSKKYENSTSLSWVQRVHIAHDVADALNYLHNYTSPPHVHKNLKSGNVLLDGNFRAKVSNLGLARAVEDHGDDGGFQLTRHVVGTHGYMAPEYIENGLITPKMDVFAFGVVLLELLSGREAVVGGDQNGSGEKMLSATVNHVLEGENVREKLRGFMDPNLRDEYPLELAYSMAELAKLCVARDLNARPQISEAFMILSKIQSSTLDWDPSDELERSRSVGQISDSSR

SEQ ID NO: 163557 - protein, 458 aa, Glycine max
  Coding DNA Sequence Number=SeqID_46779
  Gene Ontology: Mol. function=alkaline phosphatase activity; Biological process=metabolic process
  Homolog annotation: Hit_ID=Q9FII0; Match level="QueryCoverage=84%, HitCoverage=86%, E-value=1e-161, Identity=68%"; Hit description =Arabidopsis thaliana genomic DNA, chromosome 5, P1 clone:MDH9
MGIDQRRWRWWNAVVFIGMVGVTGSNSQEKQKQVVSRIAFGSCSNQSAPQPIWDAVVDFHPQVFIWLGDNIYGDFKRPFKIFGQERTVGPWKNVPRFVPSSEQEMKTRYEKAKSNPGYARLQQNAEVIGTWDDHDYGLNDAGKEFHGKITNQKLLLDFLDEPQDSPRRKQAGVYASYMYGPVGRDIKIVLLDTRYHRDPVGSDGTILGNSQWLWLEKELKGPPTALTIIGSSIQVISNLSATIRPLFAMESWARFPKERDRLFKLIADSKRAGVFFISGDVHFGEITRYDCALDYPLYDLTSSGVTQSVEEVVPHFLRSFVRFVAWLTPSTMRVKDQNCRYKSCIYGQTNFGTIEIDWDSHPVTLKFKVRDKDSIMVTGVDVSLMELQPSNSEVLDRAKTEHNNSKHCTLEVSLPWIVRHRLAILFFSALFVLLVVFVVLVYTCFRFCRLESCKRKHD

SEQ ID NO: 163558 - protein, 85 aa, Glycine max
  Coding DNA Sequence Number=SeqID_46780
MMLAFTSKLQLRCPFEYQTTCMKLINDDDVNTMLMSNDQFSCVGPIELLCTVGRTPDGIINLLQRTRPRTHDAILYYNEKWNMPP

SEQ ID NO: 163559 - protein, 72 aa, Glycine max
  Coding DNA Sequence Number=SeqID_46781
MAHEHKVVDEYARVYAKKEARGRKMASMMDAMLGMRQLMESNAATATAVSSAAEANPTLPTTAHHPIPNVVG

SEQ ID NO: 163560 - protein, 159 aa, Glycine max
  Coding DNA Sequence Number=SeqID_46782
  Gene Ontology: Mol. function=trans-hexaprenyltranstransferase activity; Cellular component=chloroplast; Biological process =isoprenoid biosynthetic process
  Homolog annotation: Hit_ID=Q42866; Match level="QueryCoverage=87%, HitCoverage=45%, E-value=2e-51, Identity=67%"; Hit description =Geranylgeranyl pyrophosphate synthase
  Pfam annotation: Domain name=polyprenyl_synt; Domain location=24-159; Score=-40.2; E_value=9e-07; Accession=PF00348.8; Description =Polyprenyl synthetase
MIAKAHTVNQALDTAIALRDPHKIHEAMRYSLLAGGKRVCPMLCITTCELVGGTEATAIPAACTVEMIHTMSLIHDNLPCMENDDLRPEKPTKHDVAVLTGDVLLAFAFEHVAASTEGVSLSPVVRAIEELAKSVGTEGIAFISRRSFGYPFSLNQMVH

SEQ ID NO: 163561 - protein, 236 aa, Glycine max
  Coding DNA Sequence Number=SeqID_46783
  Gene Ontology: Mol. function=hydrolase activity, hydrolyzing O -glycosyl compounds; Cellular component=cellulose and pectin -containing cell wall; Biological process=polysaccharide catabolic process
  Homolog annotation: Hit_ID=O48766; Match level="QueryCoverage=94%, HitCoverage=42%, E-value=1e-105, Identity=78%"; Hit description =Endoglucanase 11 precursor
  Pfam annotation: Domain name=Glyco_hydro_9; Domain location=8-236; Score=135.9; E_value=1.1e-37; Accession=PF00759.9; Description =Glycosyl hydrolase family 9
MTQLFKFLSFTLLVDLVGGYYDAGDHVKFGLPMAFTITMLSWSAIEYRQQIEDAGELEHTMEAIKWGTDYFIKAHTSPNVLWAEVGDGDTDHYCWQRPEDMTTSRRAFKIDENNPGSDLAGETAAAMAAASILFRKTNPHYSHLLLHHALQLFEFGDKYRGNYDASVGVVKSYYASVSGYMDELLWAATWLYKATDNKMYLQYVISNAHTFGGTGWSISEFIWDVKYAGLQLMVSK

SEQ ID NO: 163562 - protein, 155 aa, Glycine max
  Coding DNA Sequence Number=SeqID_46784
MTFGGKGTSWSRHGSSQGQEESHPTTDGRSPTQKGGTLVVFQFTIKVDVSFLGDQQRRSDLAVNKEQTLKGGQSIRHQYLKQYLDSFSKEIIQETNQHGRDMSEGKKHVKAEEEEVDQRHKEQTNVKLDDHHHMVGRLSFEGRLKDMGEKNKRHF

SEQ ID NO: 163563 - protein, 99 aa, Glycine max
  Coding DNA Sequence Number=SeqID_46785
MKSAWNGRSCLCLSMKMRKWRRWLCSSLSENDDMIVFFKAMIVLAEIESLKVRALYQKGLALAEIESLKVRAIGFFKAMIVHYQQLQYPFMQNRETPCR

SEQ ID NO: 163564 - protein, 38 aa, Glycine max
  Coding DNA Sequence Number=SeqID_46786
MATAQKEPSLIMLTCQIKNLPSLGTVECKESEREHPLQ

SEQ ID NO: 163565 - protein, 70 aa, Glycine max
  Coding DNA Sequence Number=SeqID_46787
  Gene Ontology: Mol. function=small conjugating protein ligase activity; Biological process=protein modification process
  Homolog annotation: Hit_ID=Q6PQ37; Match level="QueryCoverage=69%, HitCoverage=33%, E-value=3e-17, Identity=79%"; Hit description =Ubiquitin-conjugating enzyme family protein
MAIPRNFRLLEELERGEKGIGDGTVSYGMDDGDDIYMRSWTGTIIGPHNLSVACKRLPPKRLNWNFLFQR

SEQ ID NO: 163566 - protein, 72 aa, Glycine max
  Coding DNA Sequence Number=SeqID_46788
  Homolog annotation: Hit_ID=Q1SJP8; Match level="QueryCoverage=92%, HitCoverage=3%, E-value=6e-19, Identity=68%"; Hit description=D -galactoside/L-rhamnose binding SUEL lectin; Integrase, catalytic region; ...
  Homolog annotation: Hit description=Galactose-binding like; Peptidase aspartic, catalytic
MPSGTQNEGAAMAMKMSSNSKKENRKCTHCNGTNHIVDTYFKLHGYPEWHPKGKNWSLPRTTPPLQLDLLLS

SEQ ID NO: 163567 - protein, 507 aa, Glycine max
  Coding DNA Sequence Number=SeqID_46789
  Gene Ontology: Mol. function=ribonuclease H activity; Cellular component=membrane; Biological process=defense response
  Homolog annotation: Hit_ID=Q2HRG4; Match level="QueryCoverage=74%, HitCoverage=29%, E-value=4e-58, Identity=35%"; Hit description =Ribonuclease H
  Pfam annotation: Domain name=LRR_1; Domain location=122-144; Score =15.0; E_value=0.27; Accession=PF00560.23; Description=Leucine Rich Repeat
  Pfam annotation: Domain name=LRR_1; Domain location=146-170; Score =8.8; E_value=6.3; Accession=PF00560.23; Description=Leucine Rich Repeat
  Pfam annotation: Domain name=LRR_1; Domain location=214-237; Score =9.4; E_value=4.9; Accession=PF00560.23; Description=Leucine Rich Repeat
  Pfam annotation: Domain name=LRR_1; Domain location=239-261; Score =9.2; E_value=5.3; Accession=PF00560.23; Description=Leucine Rich Repeat
  Pfam annotation: Domain name=LRR_1; Domain location=263-288; Score =9.6; E_value=4.5; Accession=PF00560.23; Description=Leucine Rich Repeat
  Pfam annotation: Domain name=LRR_1; Domain location=51-70; Score=1.8; E_value=1.3e+02; Accession=PF00560.23; Description=Leucine Rich Repeat
  Pfam annotation: Domain name=LRR_1; Domain location=74-95; Score =12.1; E_value=1.5; Accession=PF00560.23; Description=Leucine Rich Repeat
  Pfam annotation: Domain name=LRR_1; Domain location=98-120; Score =3.6; E_value=61; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=122-144::146-170::214- 237::239-261::263-288::51-70::74-95::98-120
AFAKLKFIDLSYSEDLIQTPIVSGAPCLERMLLIGCINLVEVHPSVGQHKRLVVLCMKNCKNLQIMPRKLEMDSLEELILSGCSKVKKLPEFGKNMKSLSLLSVENCINLLCLPNSICNLKSLRKLNISGCSRLSTLPNGLNENESLEELDVSGTAIREITLSKVRLEKLKELSFGGRKELAPNSQNLLLWISKFMRQPNLKESTMPPLSSLLALVSLDLSYCDLNDESFPSHLGSLSLLQDLDLSGNNFVNPPAQCIINLSMLQNLSFNDCPRLESLPVLPPNLQGLYANNCPKLKPFNLDEEMLWKIYETQSRPEVWFIIPGNEIPCWFDNQNCLAIDSSHHPYDKLGCDSVTSITVDVPKDCQLSKWWGIAVCLVLEPSNMEEEDSSRSYVRPTSTGNEEMCIYYWVCKAPDRDPDPKFPIASKFGHLVYKLNDPYIHIIFLSADHEKIEEWRKHSDGLNISRLTEVNDDEEFRRELVVEEPTSPNTFSSTDKTAVNTALGKMI

SEQ ID NO: 163568 - protein, 1040 aa, Glycine max
  Coding DNA Sequence Number=SeqID_46790
  Gene Ontology: Mol. function=protein-tyrosine kinase activity; Cellular component=integral to membrane; Biological process=protein amino acid phosphorylation
  Homolog annotation: Hit_ID=Q1SX72; Match level="QueryCoverage=91%, HitCoverage=97%, E-value=0.0, Identity=47%"; Hit description =Tyrosine protein kinase, active site
  Pfam annotation: Domain name=LRRNT_2; Domain location=74-114; Score =34.8; E_value=2.9e-07; Accession=PF08263.3; Description=Leucine rich repeat N-terminal domain
  Pfam annotation: Domain name=LRR_1; Domain location=143-165; Score =11.5; E_value=2; Accession=PF00560.23; Description=Leucine Rich Repeat
  Pfam annotation: Domain name=LRR_1; Domain location=167-189; Score =5.3; E_value=30; Accession=PF00560.23; Description=Leucine Rich Repeat
  Pfam annotation: Domain name=LRR_1; Domain location=191-213; Score =17.9; E_value=0.035; Accession=PF00560.23; Description=Leucine Rich Repeat
  Pfam annotation: Domain name=LRR_1; Domain location=215-237; Score =11.3; E_value=2.2; Accession=PF00560.23; Description=Leucine Rich Repeat
  Pfam annotation: Domain name=LRR_1; Domain location=239-261; Score =7.0; E_value=14; Accession=PF00560.23; Description=Leucine Rich Repeat
  Pfam annotation: Domain name=LRR_1; Domain location=263-285; Score =17.0; E_value=0.07; Accession=PF00560.23; Description=Leucine Rich Repeat
  Pfam annotation: Domain name=LRR_1; Domain location=287-309; Score =16.7; E_value=0.084; Accession=PF00560.23; Description=Leucine Rich Repeat
  Pfam annotation: Domain name=LRR_1; Domain location=311-333; Score =14.1; E_value=0.52; Accession=PF00560.23; Description=Leucine Rich Repeat
  Pfam annotation: Domain name=LRR_1; Domain location=335-357; Score =5.8; E_value=23; Accession=PF00560.23; Description=Leucine Rich Repeat
  Pfam annotation: Domain name=LRR_1; Domain location=359-382; Score =14.6; E_value=0.35; Accession=PF00560.23; Description=Leucine Rich Repeat
  Pfam annotation: Domain name=LRR_1; Domain location=406-428; Score =10.1; E_value=3.6; Accession=PF00560.23; Description=Leucine Rich Repeat
  Pfam annotation: Domain name=LRR_1; Domain location=430-452; Score =7.4; E_value=12; Accession=PF00560.23; Description=Leucine Rich Repeat
  Pfam annotation: Domain name=LRR_1; Domain location=454-476; Score =7.9; E_value=9.6; Accession=PF00560.23; Description=Leucine Rich Repeat
  Pfam annotation: Domain name=LRR_1; Domain location=478-500; Score =20.4; E_value=0.0063; Accession=PF00560.23; Description=Leucine Rich Repeat
  Pfam annotation: Domain name=LRR_1; Domain location=502-524; Score =15.5; E_value=0.2; Accession=PF00560.23; Description=Leucine Rich Repeat
  Pfam annotation: Domain name=LRR_1; Domain location=526-548; Score =12.8; E_value=1.1; Accession=PF00560.23; Description=Leucine Rich Repeat
  Pfam annotation: Domain name=LRR_1; Domain location=550-572; Score =13.5; E_value=0.75; Accession=PF00560.23; Description=Leucine Rich Repeat
  Pfam annotation: Domain name=LRR_1; Domain location=574-596; Score =15.0; E_value=0.27; Accession=PF00560.23; Description=Leucine Rich Repeat
  Pfam annotation: Domain name=LRR_1; Domain location=598-620; Score =16.5; E_value=0.098; Accession=PF00560.23; Description=Leucine Rich Repeat
  Pfam annotation: Domain name=LRR_1; Domain location=622-644; Score =13.5; E_value=0.77; Accession=PF00560.23; Description=Leucine Rich Repeat
  Pfam annotation: Domain name=Pkinase; Domain location=747-1017; Score= 144.0; E_value=3.9e-40; Accession=PF00069.15; Description=Protein kinase domain
  Pfam annotation: Domain name=Pkinase_Tyr; Domain location=747-1017; Score=105.3; E_value=1.8e-28; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::Pkinase::Pkinase _Tyr; ...
  Pfam module annotation: Pfam domain module=Domain location=74 -114::143-165::167-189::191-213::215-237::239-261::263-285::287 -309::311-333::335-357::359-382::406-428::430-452::454-476::478 -500::502-524::526-548::550-572::...
  Pfam module annotation: =574-596::598-620::622-644::747-1017::747-1017
MALHNAASRTIICEHSSLTSEANMMMSTKLVSFQLIIIFTFFCSLLRLSYLEVSGISFANATVMVGYEAAEDEDIEAISALLKWKANLDNQSQAFLSSWSTFTCPCKWKGIVCDESNSVSTVNVSNFGLKGTLLSLNFPSFHKLLNLDVSHNFFYGSIPHQIGNMSRISQLKMDHNLFNGFIPPTIGMLTNLVILDLSSNNLSGAIPSTIRNLTNLEQLILFKNILSGPIPEELGRLHSLTIIKLLKNDFSGSIPSSIGDLANLRTLQLSRNKLHGSIPSTLGNLTNLNELSMSRNKLSGSIPASVGNLVYLQKLHLAENELSGPIPSTFRNLTNLTFLLLHMNNLSGSFSTAISNLTNLINLQLSSNHFTGPLPQHIFGGSLLYFAANKNHFIGPIPTSLKNCSSLVRLNLAENMLTGNISNDFGVYPNLNYIDLSSNCLYGHLSSNWAKSHDLIGLMISYNSLSGAIPPELGQAPKLQKLELSSNHLTGKIPKELGNLTSLTQLSISNNKLSGNIPIEIGSLKQLHRLDLATNDLSGSIPKQLGGLLSLIHLNLSHNKFMESIPSEFSQLQFLQDLDLSGNFLNGKIPAALGKLKVLEMLNLSHNSLSGSIPCNFKHMLSLTNVDISNNQLEGAIPNSPAFLKAPFEALEKNKRLCGNASGLEPCPLSHNPNGEKRKVIMLALFISLGALLLIVFVIGVSLYIHWQRARKIKKQDTEEQIQDLFSIWHYDGKIVYENIIEATNDFDDKYLIGEGGFGCVYKAILPSGQIVAVKKLEAEVDNEVRNFKAFTSEVQALTEIKHRHIVKLYGFCAHRHYCFLVYEFLEGGSLDKVLNNDTHAVKFDWNKRVNVVKGVANALYHMHHGCSPPIVHRDISSKNVLIDLEFEARISDFGTAKILNHNSRNLSSFAGTYGYAAPELAYTMEVNEKCDVFSFGVLCLEIIMGNHPGDLISSMCSPSSRPVTSNLLLKDVLDQRLPLPMMPVAKVVVLIAKVAFACLNERPLSRPTMEDVYNMFVMHKSPLMKETLDTIALGQLQNH

SEQ ID NO: 163569 - protein, 548 aa, Glycine max
  Coding DNA Sequence Number=SeqID_46791
  Gene Ontology: Mol. function=transporter activity; Cellular component= integral to membrane; Biological process=transport
  Homolog annotation: Hit_ID=Q9SHZ3; Match level="QueryCoverage=99%, HitCoverage=92%, E-value=0.0, Identity=68%"; Hit description =Putative membrane transporter
  Pfam annotation: Domain name=Xan_ur_permease; Domain location=85-462; Score=94.6; E_value=2.9e-25; Accession=PF00860.11; Description =Permease family
MLGTSVMIPSWIVHAMGGSDGDKARVIQALLFVAGINTLLQTLFGTRLPTVVGGGSSAYIYPIAYIITDSSLQQISDSHELLSKLSTTSLSCKQATQVVASALQCCSWTSQRTSTLQARMGAGTVECGVMLGSNCKIWDLSPTLERFIQTMRAIQGALIVASSIQIILGYSQVWGLFSRFFSPLGMAPVVGLVGLGLFQRGFPVLGDCVEIGIPMLLLVIGLSQYLKHVRPFRDIPIFERFPVLICVPFVWIYAVILTAGGAYRHKSDITQHSCRTDRANLISTAPWFMFPYPFQWGPPTFSAGHSFAMMSAVIVSMVESTGAYMAASRLAIATPPPAYVLSRGIGWQGIGVLLDGLYGTVIGSTVSVENVGLLGLTRVGSRRVVQISAGFMIFFSILGKFGAVFASIPFPIFAALYCILFGLVASIGISFLQFTNMNSMRNLIIIGLTLFLGISVPQFFNQYWTLSRHGLVHTNAGWFNAFLNTLFSSPPTVGLIVAVLLDNTLEVERSKKDRGMPWWVKFRTFKGDNRNEEFYTLPFNLNRFFPPT

SEQ ID NO: 163570 - protein, 494 aa, Glycine max
  Coding DNA Sequence Number=SeqID_46792
  Gene Ontology: Mol. function=protein-tyrosine kinase activity; Cellular component=intracellular; Biological process=protein amino acid phosphorylation
  Homolog annotation: Hit_ID=Q1RXR7; Match level="QueryCoverage=92%, HitCoverage=69%, E-value=1e-45, Identity=32%"; Hit description =Tyrosine protein kinase, active site
  Pfam annotation: Domain name=LRR_1; Domain location=107-129; Score =10.6; E_value=3; Accession=PF00560.23; Description=Leucine Rich Repeat
  Pfam annotation: Domain name=LRR_1; Domain location=131-153; Score =17.8; E_value=0.038; Accession=PF00560.23; Description=Leucine Rich Repeat
  Pfam annotation: Domain name=LRR_1; Domain location=155-177; Score =13.1; E_value=1; Accession=PF00560.23; Description=Leucine Rich Repeat
  Pfam annotation: Domain name=LRR_1; Domain location=48-70; Score =10.3; E_value=3.3; Accession=PF00560.23; Description=Leucine Rich Repeat
  Pfam annotation: Domain name=Pkinase_Tyr; Domain location=307-449; Score=-174.3; E_value=0.089; Accession=PF07714.7; Description =Protein tyrosine kinase
  Pfam module annotation: Pfam domain module=LRR_1::LRR_1::LRR_1::LRR _1::Pkinase_Tyr; Domain location=107-129::131-153::155-177::48 -70::307-449
MFEVSLADNELSGNIPTKIGALSSLENLELAPNNMGGPIPNQVGALLNLVHLNLSKNNFTESIPDSTQQHHLSPQHSRPQRETNKPAYLRDYVDACRLCFCARSAYVIEVLDLSWNLLNGEIPAALATMQRLETLNLWHNNLSGAIPSNFKDMVSLTSLNISNNQLEGSYPNNPGFLKAPFDALKNNKGLCGNASGLVSCPELSHNPHGKMRSVIMATKAKKEEVKEEKTQDHYSLWSYGGKIVYENIIEATEDFDDKSHWRRRDCICLKIKTSYPIVQRLFAMRRYGGGILYAALPLHMQRGCFRIRTHDQQVTKAQLYRCTRTASVYKEKLPTGQIVAVKKLHAAPNEETLDLKALQLRGGSLDEVLNNVRVQQYLIGKGGEENEKCDVFSFGVLCLEIMMGKHPGDLISSLFSGSASNLLLKDVLDQRLPHPEKPDVEEVILIAKIAFACLTEIKSMVLSPKRRDYNGTKRGTDTPSASACNKRLRKAEGC

SEQ ID NO: 163571 - protein, 65 aa, Glycine max
  Coding DNA Sequence Number=SeqID_46793
MLPEDNVDSTSDWLPFNFMISTSTINLKVSCIPYSVACFSAMLVFYYSLLNPPPEPPSTQHFHVM

SEQ ID NO: 163572 - protein, 523 aa, Glycine max
  Coding DNA Sequence Number=SeqID_46794
  Gene Ontology: Mol. function=hydrolase activity, hydrolyzing O -glycosyl compounds; Cellular component=membrane; Biological process =carbohydrate metabolic process
  Homolog annotation: Hit_ID=Q1SPW5; Match level="QueryCoverage=85%, HitCoverage=93%, E-value=0.0, Identity=80%"; Hit description =Glycoside hydrolase, family 17
  Pfam annotation: Domain name=Glyco_hydro_17; Domain location=82-401; Score=440.8; E_value=1.8e-129; Accession=PF00332.9; Description =Glycosyl hydrolases family 17
  Pfam annotation: Domain name=X8; Domain location=444-522; Score =150.2; E_value=5.3e-42; Accession=PF07983.3; Description=X8 domain
  Pfam module annotation: Pfam domain module=Glyco_hydro_17::X8; Domain location=82-401::444-522
  Subcellular localization annotation: CTP_CleavageSite=70; ConfidenceScore=5.28e-01
MNLIIKTWKSRSKKHTLCTPHSQKHPQQHIRKQTQNAKPEPLSLSRSVSLHRSRECIASSSSPFSSPSPSQAMLTSTNGGSIGVNYGRIANNLPSAVKVVHLLKSQGLTRVKVYDTDPAVLRALSGSGIRVTVDLPNQQLFAAAKAPSFASSWVERNVAAYYPHTQIEAIAVGNEVFVDPHNTTKFLVPAMKNIQKALTKHNLDKDIKVSSPIALSALANSYPSSAGSFRPELVEPVFKPMLDFLRETGSYLMVNVYPFFAYESNADVISLDYALFRDNPGVVDPGNGLRYYNLFDAQIDAVFSALSALKYDDVKIVVTETGWPSKGDSNEVGASVDNAAAYNGNLVRKILTAGGTPLRPKADLIVFLFALFNENQKPGPTSERNFGLFYPDERRVYNVPLTTEELKDYHDRPAPVSGGGQQKGTPAPAPVVSGGVSKSTTGNTWCVANPDADKVKLQAALDFACGEGGADCRPIQRGSTCYDPNTLVAHASFAFNSYYQKQSRKGGSCYFGGTSYVVTQEPI

SEQ ID NO: 163573 - protein, 258 aa, Glycine max
  Coding DNA Sequence Number=SeqID_46795
  Homolog annotation: Hit_ID=Q513P3; Match level="QueryCoverage=71%, HitCoverage=10%, E-value=9e-08, Identity=22%"; Hit description=Viral A-type inclusion protein repeat, putative
  Pfam annotation: Domain name=zf-CCHC; Domain location=220-237; Score =7.2; E_value=0.065; Accession=PF00098.13; Description=Zinc knuckle
MDDTSSNRETKEEANFAYKSLRKDFKNLSKDHTELKKAHQDIILLTEPNQDKKDYDTLKEKESQLLLENDNLSKERDTLMENFKILEEMVQSLQTEMKQLNELQDHLEEERYDLWKECSQSLHDYENLGISKHNLWVKCENYKKTPKFLNDKLEKNDNLKGQPQDVTKLHQEIESLRETISKFVGSIENIDKLLRYNIFPSNKFEYGYKRNTCVHDKETTICYLYGKIRHITSKCRNLLKTRSSNSFKSNKKRPKRIW

SEQ ID NO: 163574 - protein, 556 aa, Glycine max
  Coding DNA Sequence Number=SeqID_46796
  Gene Ontology: Mol. function=transmembrane receptor activity; Cellular component=membrane; Biological process=defense response
  Homolog annotation: Hit_ID=Q70WI0; Match level="QueryCoverage=97%, HitCoverage=72%, E-value=1e-135, Identity=44%"; Hit description =Putative resistance gene analogue protein
  Pfam annotation: Domain name=NACHT; Domain location=214-367; Score= -7.1; E_value=0.0002; Accession=PF05729.3; Description=NACHT domain
  Pfam annotation: Domain name=NB-ARC; Domain location=176-471; Score =140.2; E_value=5.7e-39; Accession=PF00931.13; Description=NB-ARC domain
  Pfam annotation: Domain name=TIR; Domain location=17-151; Score =141.3; E_value=2.6e-39; Accession=PF01582.10; Description=TIR domain
  Pfam module annotation: Pfam domain module=NACHT::NB-ARC::TIR; Domain location=214-367::176-471::17-151
MLRGESSSNSWRWTYHVFLSFRGEDTRLDFTDHLYAALVRKGIIAFRDDKQLEKGDAIAEELPKAIEESLGAIVILSENYASSSWCLDELNKILESNRVLGREVFPVFYGVSPGEVQHQKTQSFYEAFKKHERRSGKDTEKVQKWRDSLKELGQIPGWESKHYQHQTELIENIVESVWTKLRPKMPSFNDGLIGIGSRVKKMDSLLSIESEDVRFIGIWGMGGIGKTTVARVVFQKIKDQFDVSCFLDNVREISRETNGMLRLQTKLLSHLAIKGLEIIDLDEGKNTIINLLSEKKVLLVLDDVDDTSQLGNLAKRVEWFGRGSRVIITTRDTQVLISHGVVENYNIEFLNSDESLQLLSQKAFKRDEPLEHYLELSKVVAKHAGGLPLALELLGSFLCGRSEFQWREVVDMIKEVSASHIVMKSLRISYNGLPRCHKALFLDIACFFKGRVKELATQTLEICDRYPAVGIELLVEKSLATYDGFTIGMHDLLQETAREIVIEESHVDAGKRSRLWSLEDTNQVLKYSRENESIEGIALNSPEKDEANWDPEAFSR

SEQ ID NO: 163575 - protein, 135 aa, Glycine max
  Coding DNA Sequence Number=SeqID_46797
MYYEGWEKAYNSHVPRALYAKNADKVNMLNKSILHKVSSKTTLPDLQNFLLFHLMENLQFDLSNTIYINIVCILRNLRGMDDIYYIVLINKILWDQGVYHVFNKLNDESKHNIMVKGSIVFNKTNLKAIKITMEE

SEQ ID NO: 163576 - protein, 512 aa, Glycine max
  Coding DNA Sequence Number=SeqID_46798
  Gene Ontology: Mol. function=transferase activity, transferring hexosyl groups; Cellular component=integral to membrane; Biological process=metabolic process
  Homolog annotation: Hit_ID=Q59J81; Match level="QueryCoverage=93%, HitCoverage=96%, E-value=1e-143, Identity=54%"; Hit description =Cyclo-DOPA 5-O-glucosyltransferase
  Pfam annotation: Domain name=UDPGT; Domain location=30-491; Score= -61.0; E_value=1.5e-07; Accession=PF00201.9; Description=UDP -glucoronosyl and UDP-glucosyl transferase
MTPKSYAQCSALTKSSLYLELAPMAAGKKGHIVMIPFMAQGHIIPFLALARQIQQRTTSFTITIANTPLNIQYLRSSLSSPNEIHLAELPFNSTQHGLPPNIENTEKLPLTHIAKLFLSTLSLEAPLRSLISQITEQEGHPPLCIISDVFLGWVNNVAKTLGIRNLSFTTCGAYGTLAYISIWSNLPHRKTDSDEFHVPGFPQNYKFHRTQLHKFLRAADGTDEWSQFFIPQIALSIKSDGWICNTVEEIEPLGLHLLRNYLQLPVWNVGPLLPPVSLSGSKHRAGKEPGIALEACMEWLDLKDENSVVYISFGSQNTISASQMMALAEGLEESGISFIWVIRPPFGFDINREFIAEWLPKGFEERMRDTKRGLLVNKWGPQLEILSHSSTGAFLSHCGWNSVLESLSYGVPMIGWPLAAEQAYNVKMLVEEMGVAIELTRTVETVISGEQVKKVIEIAMEQEGKGKEMKEKANEIAAHMREAITEKGKEKGSSVRAMDDLVTTILSPNKAV

SEQ ID NO: 163577 - protein, 108 aa, Glycine max
  Coding DNA Sequence Number=SeqID_46799
FGGLLTAGILAFSGTVSHCHIDVEDEEFISLSWLHVYKLGWVSQILSEVLGIIAFTKSKSGSKLYKNQITNFRVWDVNQGMVNLVLQKMSRAPAIFTELCSNYIISNG

SEQ ID NO: 163578 - protein, 178 aa, Glycine max
  Coding DNA Sequence Number=SeqID_46800
MASFRDLTRLLNGLSLIANEFAKRSLPATTSDFETLIKKTLVSATDLSGITRGKVRHFPDTPPSSNTTQHDHAAASSSVVFFADDNPSSQSHSTPATTTVTNIDDVAYSSSDANHRQASDANVCAAEEEKSEVVTSAETVNQGASRELAPAPEPPPSPLRKRRPRERKVPATPFSRAL

SEQ ID NO: 163579 - protein, 168 aa, Glycine max
  Coding DNA Sequence Number=SeqID_46801
  Gene Ontology: Mol. function=transcription factor activity; Cellular component=nucleus; Biological process=regulation of transcription, DNA-dependent
  Homolog annotation: Hit_ID=Q9LTC6; Match level="QueryCoverage=87%, HitCoverage=87%, E-value=3e-20, Identity=38%"; Hit description =Similarity to ethylene response element binding protein EREBP
  Pfam annotation: Domain name=AP2; Domain location=19-84; Score=148.5; E_value=1.8e-41; Accession=PF00847.10; Description=AP2 domain
MDEEGGSRVKANKDEDQEHVKYRGVRRRPWGKFAAEIRDSMRQGQRLWLGTFNTAEEAARAYDRAAYAMRGPFAVLNFPNEYPPLAIGASSSSSSSSSSSSSSSSSSSSSSSSSSNASSASALASPSSSHVEGSGRSEQANQVIEFEYFDDKLLEELLGYEDKNKPDK

SEQ ID NO: 163580 - protein, 308 aa, Glycine max
  Coding DNA Sequence Number=SeqID_46802
  Gene Ontology: Mol. function=transferase activity
  Homolog annotation: Hit_ID=Q1SPY9; Match level="QueryCoverage=93%, HitCoverage=37%, E-value=8e-76, Identity=53%"; Hit description =Ankyrin
MCVEIIGRENERMYLASRKNKHGETPLFQAAINGRKEAFAYLSNISDNSAPLQDLVGNDGDTILHCAIRNEYFDLAVIILHYYDFLSIFMNKDGEYPLHVLATRPSAFKSSTYLSFWERILYPCIHVEQLDARSSMEALLEKTKNHHNSDEVNYPKNYTVLIAVFTLLKDQFFTILCGIGKLRMQRKNQGDLENLSNRIGLGTRQVGFLPPNHQTILQFVKYHFVLILGLLGQDIKEVRNTKKKHECSRQVFKALMQRADEALTGSGGVPTDVEIDPDMYNVYSQWQQDDTGYKGYPTHTNRANDTVL

SEQ ID NO: 163581 - protein, 766 aa, Glycine max
  Coding DNA Sequence Number=SeqID_46803
  Homolog annotation: Hit_ID=Q1SPY9; Match level="QueryCoverage=97%, HitCoverage=97%, E-value=1e-149, Identity=41%"; Hit description =Ankyrin
  Pfam annotation: Domain name=Ank; Domain location=131-167; Score =10.3; E_value=1; Accession=PF00023.20; Description=Ankyrin repeat
  Pfam annotation: Domain name=Ank; Domain location=52-84; Score=5.2; E_ value=5.5; Accession=PF00023.20; Description=Ankyrin repeat
  Pfam annotation: Domain name=Ank; Domain location=94-130; Score=23.3; E_value=0.00087; Accession=PF00023.20; Description=Ankyrin repeat
  Pfam module annotation: Pfam domain module=Ank::Ank::Ank; Domain location=131-167::52-84::94-130
MNPRGLEGAGRGRGRGRVTTLLIKCTLAGKWEGVIDMYRNFPTCQITKITESLGTALHVAVDMNKEDAVEALVNQIIEHLHHAETNPLEVKNKSGDTPLHVAASRGFAKICKIIIGKHNERKSLVSQRNNRGETPLFQAVINGHSQAFCYLSSISHDNMADLVRDNKDTILHCAISNEYFGILVEPRLDVERQIEANLAEMDKPTESDELNYPKNYATLYEFFARSLSLAIGKMSWQNKQVDTENPPINEQFGFGLLPPNYNTFQQFVRSGFVHILGLSGSGVDINEVKKTKERHQWGYQLFEELMMKMIAEGDLLPDREFDPAIFNMYSEYTPEQGECSHSQELEEETRPQVDGNTDTLSQNDTKNETDQHFDEQNIVIIRREITRSEVLEEKRKPKVDGRIETLCQSEARKEVEQHADEKNIFIIRRETKCLELLEEERKPKAKTSSDILDDDTVLVAARNGIVEIVNEILTQFISVFYTTNSQEENILLVAVRNKKPLVVENLRKKFQKEYPEVWNTLTLAVNKDGKTMLHMAAYASEEYKPWQISGSALQLMWDVNWFQQYIKSLVPEHYHLRSDKNNQTADEIFKEEHKELRKESSEWLKETSESCSVVAALVAGVSFATAATIPGGNDDKGYPHLEDKPAFHAFVISSVVGLGFSLTGLIMFLTILTSRKLYRAFRIDLPLKLLLGLSSLFVSIVALILSFCTSHSFLFTHKYKTVIFPIYVATCLPVTFYAVAQLPLYLDLLTFILFKVPKATSEGDSL

SEQ ID NO: 163582 - protein, 46 aa, Glycine max
  Coding DNA Sequence Number=SeqID_46804
MGKTRGSGPNRLPRSKGTCTKKDHWTLVDLTLCTLYLCKCEVGYMA

SEQ ID NO: 163583 - protein, 180 aa, Glycine max
  Coding DNA Sequence Number=SeqID_46805
  Homolog annotation: Hit_ID=Q1SPY9; Match level="QueryCoverage=68%, HitCoverage=16%, E-value=3e-23, Identity=47%"; Hit description =Ankyrin
MKFQDLAVIIVHYYDFLSTRIRIKRDSLLSQSLPLRPSAFRSASKLSWWKQILYHCILVEPLDTERQMKENLAKMEKQPESDKLNYPKDYATLYDFFAGSSSVTALIGKMPTKNIDHSLQAAALDGIYMEQNILIFLFYLFFSLLLSQKVTQLASSESTVPEKEEDNGSRVARHDSLLAS

SEQ ID NO: 163584 - protein, 120 aa, Glycine max
  Coding DNA Sequence Number=SeqID_46806
  Homolog annotation: Hit_ID=O65576; Match level="QueryCoverage=42%, HitCoverage=8%, E-value=4e-15, Identity=80%"; Hit description=ABC1 protein
MKVGHTIACFDDKHTLEEPYPVVLPVIELPYILSTLLAWTFTGLLYICPDKPPKMSSPVRHASFLQMVKILAALEIVRQGADVMPKSQLNQVLNAELGPGWSSKLISFDYEPIAAASIGQ

SEQ ID NO: 163585 - protein, 97 aa, Glycine max
  Coding DNA Sequence Number=SeqID_46807
  Homolog annotation: Hit_ID=O65576; Match level="QueryCoverage=54%, HitCoverage=8%, E-value=2e-15, Identity=68%"; Hit description=ABC1 protein
  Pfam annotation: Domain name=ABC1; Domain location=1-58; Score=-39.4; E_value=0.076; Accession=PF03109.7; Description=ABC1 family
GLDPLAPLFFSLSDMPSNLSVAKEELSRECDYKLEAANQKRFRDLLTGTDGFYVPIVVDNISSKRVLTTELVRAAAAFDILFRWQCSQYVVLFAWKI

SEQ ID NO: 163586 - protein, 75 aa, Glycine max
  Coding DNA Sequence Number=SeqID_46808
MEKVFPAQKEINKSVLEKKRRQEEIDIVVPGGAFDNDLVVEVKVEDAKGGRGVRVQEVQWGISMGGRVLFHGIGW

SEQ ID NO: 163587 - protein, 106 aa, Glycine max
  Coding DNA Sequence Number=SeqID_46809
LSIEGDDEFSDGKEFLYSSDEKELSRPYPLPATPPRGNEARNTKEKEVKACRDTLSSFSNSTLDTSSGVTSPICCISSPGDDPKDVKARLKLWAQAVAASASRYGT

SEQ ID NO: 163588 - protein, 141 aa, Glycine max
  Coding DNA Sequence Number=SeqID_46810
  Gene Ontology: Mol. function=metal ion binding; Cellular component =nucleus; Biological process=red or far red light signaling pathway
  Homolog annotation: Hit_ID=P93471; Match level="QueryCoverage=56%, HitCoverage=12%, E-value=2e-25, Identity=67%"; Hit description=E3 ubiquitin ligase protein COP1
MEMMRANHRLKTTTLKSATLQEEAITNYKQALRNHKIDGDDDEREGTNLVEQQVREEVGVGEVVAAARAIALVAEVRDDAHVAEAVAARGEERVLDDLHANRTEEVLVRLRRGGRERAAGGSGGGAFGRFRFDDGGDERPR

SEQ ID NO: 163589 - protein, 73 aa, Glycine max
  Coding DNA Sequence Number=SeqID_46811
MTPMLPKTGSTLLNWISLNSKAKKDQELAKKDIELQVKDWIIQELKDKIEKKNRKIQRRDKRISRQDESIQKL

SEQ ID NO: 163590 - protein, 440 aa, Glycine max
  Coding DNA Sequence Number=SeqID_46812
  Gene Ontology: Mol. function=hydrolase activity, hydrolyzing O -glycosyl compounds; Biological process=carbohydrate metabolic process
  Homolog annotation: Hit_ID=UPI0000196E3D; Match level="QueryCoverage =99%, HitCoverage=87%, E-value=1e-104, Identity=58%"; Hit description= alpha-galactosidase/ hydrolase, hydrolyzing O-glycosyl compounds
MQYAIVDYLWYRSLKGDSNSLGFDMIDKWGRMLPDPERWPSSRGGGGFTEVANKVHSMGLKFGIHLMAGISTQAYNKNTPILDTATGQPYMESGRVWNAKDIGIPSRACKWMTNGFMAINAKTGAGKAFLRSIYELYASWGVDFVKLDCVFGEDLDLDEITFVSEFFNGLERPIVFSLSPGVSATPLMANSVSSLVNTYRVTGDDWDEWSAILAHFNVARDFAASNLIGGKGLKGKSWPDLDMLPFGWLTDPAAHEGPHSATRLTQDEQRTQFLDITTLNDVKTEGHNVTKVPFTYSLAITECTDPKVSGWSSEKKQSSIQSEQIWKLKSNGTLVNGYSGKCATVGRVLDVGDLNPIRSWVATHTERGKIYVAFFNLNKETTTISANIADLPAVSRLGTRRKLKICAGTEIWSRSIVRTKTTFSAQVPGHGSALFVLSCL

SEQ ID NO: 163591 - protein, 89 aa, Glycine max
  Coding DNA Sequence Number=SeqID_46813
  Gene Ontology: Mol. function=hydrolase activity, hydrolyzing O -glycosyl compounds; Biological process=carbohydrate metabolic process
  Homolog annotation: Hit_ID=Q2HU62; Match level="QueryCoverage=40%, HitCoverage=5%, E-value=2e-10, Identity=77%"; Hit description =Glycoside hydrolase, clan GH-D; Ricin B lectin
MAFFKRGRGFTDVANKVHSTGLKFGIHLMAGISTQAFNNKRDFATSNLIGGKGLKGKSWPDLDMLPFGWLTDPGKVQNTLIATNVYIYV

SEQ ID NO: 163592 - protein, 73 aa, Glycine max
  Coding DNA Sequence Number=SeqID_46814
MSNAQPLPHSLSCLFRGNEGICDYGSSPRRAGACPGELMLSPEETGSPSFLTWNTFPREILISYVAENMLLLI

SEQ ID NO: 163593 - protein, 659 aa, Glycine max
  Coding DNA Sequence Number=SeqID_46815
  Gene Ontology: Mol. function=unfolded protein binding; Cellular component=chaperonin-containing T-complex; Biological process =cellular protein metabolic process
  Homolog annotation: Hit_ID=Q653F6; Match level="QueryCoverage=80%, HitCoverage=94%, E-value=0.0, Identity=90%"; Hit description =Putative t-complex protein 1 theta chain
  Pfam annotation: Domain name=Cpn60_TCP1; Domain location=35-530; Score=612.7; E_value=3.1e-181; Accession=PF00118.14; Description=TCP- 1cpn60 chaperonin family
MSAMLQPQIILLKEGTDTSQGKPQVVSNINACTAVADVVRTTLGPRGMDKLIHDDKGTVTISNDGATIMKLLDIVHPAARILVDIAKSQDSEVGDGTTTVVLLAAEFLREAKPFIEDGVHSQNLIRSYRTACSLAIEKIKDLAVSIEGKSLEEKKNLLAKCASTTLSSKLIGGEKEFFAPMVVDAVISIGNEDRLNMIGIKKVPGGTMRDSFLVNGVAFKKTFSYAGFEQQPKKFLNPKILLLNVELELKSEKENAEIRLSDPAQYQSIVDAEWNIIYDKLDKCVSSGAKVVLSRLAIGDLATQYFADRDIFCAGRVAEEDLKRVAAATGGTVQTSVNNVIDEVLGTCEVFEERQVGNERFNIFSGCSSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGGPYGVDIATGGIADSFANFVWEPAIVKINAINAATEAACLILSVDETIKNPKHIIGILSPYGICLYNLAKRTGLDPDNIQRITAHILELEILVKLEVATYLRDTHLRVHKEMLLQVPWAEVVEVHSVVEDEECEDDEKCILWVECLFIVCLIREANACLFLLLDVARSMPIFELTNHEMKM

SEQ ID NO: 163594 - protein, 218 aa, Glycine max
  Coding DNA Sequence Number=SeqID_46816
  Gene Ontology: Mol. function=hydroxymethylglutaryl-CoA reductase (NADPH) activity; Cellular component=endoplasmic reticulum; Biological process=isoprenoid biosynthetic process
  Homolog annotation: Hit_ID=P48021; Match level="QueryCoverage=92%, HitCoverage=34%, E-value=8e-92, Identity=85%"; Hit description=3 -hydroxy-3-methylglutaryl-coenzyme A reductase
  Pfam annotation: Domain name=HMG-CoA_red; Domain location=1-209; Score=261.3; E_value=1.9e-75; Accession=PF00368.9; Description =Hydroxymethylglutaryl-coenzyme A reductase
VLSDLNRRLVSHIGVIVDVHHTGGNYCSDKKPAAVNWIEGRGKSVVCEAIIKEEVVQKVLKTNVSALVELNMLKNLAGSAVAGALGGFNAHASNIVSAIFIATGQDPAQNVESSHCITMMEAINDGRDLHISVTMPSIEVGTVGGGTQLASQSACLNLLGVKGASKESPGSNSRLLATIVAGSVLAGELSLMSAIAAGQLVNSHMKYNRSSKDVTKIS

SEQ ID NO: 163595 - protein, 342 aa, Glycine max
  Coding DNA Sequence Number=SeqID_46817
  Gene Ontology: Mol. function=3-oxo-5-alpha-steroid 4-dehydrogenase activity; Cellular component=integral to membrane; Biological process=sphingolipid metabolic process
  Homolog annotation: Hit_ID=Q8GTD7; Match level="QueryCoverage=82%, HitCoverage=88%, E-value=1e-135, Identity=82%"; Hit description =Steroid 5-alpha reductase
  Pfam annotation: Domain name=Steroid_dh; Domain location=179-313; Score=87.6; E_value=3.8e-23; Accession=PF02544.7; Description=3-oxo -5-alpha-steroid 4-dehydrogenase
MHSNSNLENTDQHPAKEREPKDELEPPATSAMQMAACRKLFMRRKMHLVLGLLFVSPSAKKYPSRQRLTLPVQPGSKERPVVLNYKKSLKDYTIGNSETLTVVFKDLGPQVSYRTLFFCEYLGPLLLYPVFYYLPVYQYFGYKGERVIHPVQTYALYYWCFHYAKRILETFFVHCFSHATSPLSNVFRNCAYYWTFGSYIAYYVNHPLYTPVNDLQMKIGFGFGILCQISNFYCHIILKNLRSPGGEGGYQIPRGFLFNIVTCANYTTEIYQWLGFNIATQTVAGYIFLVVATFIMTNWALAKHRRLKKLNIWIQKALLLLFDGKEGRPRYPRRWVILPPFL

SEQ ID NO: 163596 - protein, 240 aa, Glycine max
  Coding DNA Sequence Number=SeqID_46818
MEANAVAVAATRAIAKHAFPPYGLPPNYTPPDVAYTPNENVNNSTPILVESRKTQTNHAYVSQTVEETHEIPHHNLADSKPCLGYATEGQAIGDIPLQNTLEGPQYHPQPHPLHSTAIKNPHAMAELGKVDHLKESLRAIEGGKDYAFANLEELFLVLEHWPFPSSRCQTLTSTRGLLALRNHLKMCCRKMVTYANDEELLIHSFQESLTGVAVTWYTNLEPSRVHSWKDLMVAFWYGSR

SEQ ID NO: 163597 - protein, 84 aa, Glycine max
  Coding DNA Sequence Number=SeqID_46819
MEVEEPWLALWLPLNYQVDNGASQHRTPKFGTGFMVDLGMAFVDNWVVGKERTRFDPFPDEDQIRKASKVPLELSDPSTFGCIL

SEQ ID NO: 163598 - protein, 85 aa, Glycine max
  Coding DNA Sequence Number=SeqID_46820
MASPMTCEGTLWLSAPFVNQRQASPDDESDDVRGYLMVIRTFCHPEMASPMTCGGTLGFYFLHPETFKPDDTQDSSLLGRDDRAR

SEQ ID NO: 163599 - protein, 304 aa, Glycine max
  Coding DNA Sequence Number=SeqID_46821
MMENQIPLIVLKRISGILFPEIFTDGGTDKLIQNLALSILGYNAPDSDFKASHLLEFVHQDLKSSISSGEVPNTRHGKQNLQRCATRLEAAGVTIGPPQAQSENANMEAGVTAEPAEAQSEVTTQPSEALSEAANMEDGVTDKPPKAQSEVTTQSPEALSKAANMEVVVNVRPRVAAETRFDLKVTFSDGKLEIPQLHITETTEAKWRNFIAWELNRTTLEKQRGVIENLNSHPTTVDRVTTTSKIMWHIFICFLTWSWYQCRGTYRGLRRVYFPSGWKLIALLAAALGLGLTIAQTVFSALGQ

SEQ ID NO: 163600 - protein, 85 aa, Glycine max
  Coding DNA Sequence Number=SeqID_46822
MPSFLFLEQKWAPKVEALLGNNGGWEKRRRRLREREGELLNFSVLLSEEREQLLLCHTSPFEWSKKGPLSLLMVTHTQPQKVRKI

SEQ ID NO: 163601 - protein, 58 aa, Glycine max
  Coding DNA Sequence Number=SeqID_46823
  Gene Ontology: Mol. function=zinc ion binding
  Homolog annotation: Hit_ID=Q1RSJ8; Match level="QueryCoverage=50%, HitCoverage=8%, E-value=1e-09, Identity=83%"; Hit description=Zinc finger, RING-type
MPAATSQTKMFKATKVWAYVLLYNLFFTLDQLSSMPATDREGCEDFPSLSVEHTWHTW

SEQ ID NO: 163602 - protein, 520 aa, Glycine max
  Coding DNA Sequence Number=SeqID_46824
  Homolog annotation: Hit_ID=Q1RSI8; Match level="QueryCoverage=81%, HitCoverage=96%, E-value=1e-134, Identity=62%"; Hit description=IMP dehydrogenase/GMP reductase
MLQKLCLMASHGCPPGLSLQQELAMVGCTITKVVKDSVLSLTFFMGVYSNLPEGCKPLLPSPVLKLEIIRYGSSLNPFEESSKSQKEWFNSNQIVNMNLSTQRPMLIDVQETYPSPVDFGFGIVEQCSEHDKILQCIMSESAEAGIGGVHISLLSDLMGLQLPGIDEPQKPLTPLIPKSKFFIPKLLLDIFQDSAFSSKITVHPDGQVTFMGTAIEMKDLLSVVADSYLLRKGEKQSMLVPHFSRMSINEVEVTSLSSTLDIHSTLTVPLKSPEKVKVKPSQKKNKKVARERDLFKKNYLHACESLLSLMVDKRRQRKTAILSLKKSGPELPELLTQFSAGIAGTGLAVLLSVICKLACGRGVSFCAYKLLNTGFGFGLVWLSWAVNKLRDTIVSMNKNTGKLGLKDEEMIQKVDKSLREVYFRAATLLAVAVLRAVSFARPHIGTTIIPDQLDHKIVDDWLDQHLDGVLTVWLVPHFNKQSKQHTRMLGIRARMDYLCKRLTHAVMLVPLIFITYSSNL

SEQ ID NO: 163603 - protein, 289 aa, Glycine max
  Coding DNA Sequence Number=SeqID_46825
  Homolog annotation: Hit_ID=Q1RSJ8; Match level="QueryCoverage=41%, HitCoverage=34%, E-value=9e-50, Identity=82%"; Hit description=Zinc finger, RING-type
MIPWGGLSCCLSAAALYLLGRSSGRDAEILKSVTRVNQLKELGLCLFRELKPLLSPHLGVGELLRHELGVEFGPNSNSKMVSESMLAVVIKPYQASHYRTIIKPHACWASPSQLLDIPLDCFQGPNVVGFWLESSMWLWFLIMLGIPYFSAQLLDAEILPLIVTISGRVSSETPINCEFSGLRGVIVEETAEQHFLKHNDAGSWIQDSALMLSMSKEVPWYLDDGTDRVHVVGARGAAGFALPVGSEAFEESGRSLVRGTLDYLQGLKVRVFASIQSFCSPLPAKIKEK

SEQ ID NO: 163604 - protein, 245 aa, Glycine max
  Coding DNA Sequence Number=SeqID_46826
  Homolog annotation: Hit_ID=O80339; Match level="QueryCoverage=41%, HitCoverage=50%, E-value=5e-22, Identity=54%"; Hit description =Ethylene-responsive transcription factor 3
  Subcellular localization annotation: CTP_CleavageSite=42; ConfidenceScore=5.47e-01
MVNNNNNNNNNKKKMMIIPRRGSSSSSSSSSSEAQRGGRQVVVVVVVGIGWWEDAVLAVVDDGGRRVAIAVAIVFVVVERDDRVNNHNKGLSARGGGGNPRPAEGLHGAAHAAARGPVHLDDGLELGGKPMGLVERNLRVVVRLCRAGEGGEIGFGLGPAEGSGSLVVGPRGILGGIEGPQPNALLLPRISNLRRESPPRPLPHATEPRRLLGLVRRGIHNGGSGGGGLGLGLGSHDAVSPCLLQ

SEQ ID NO: 163605 - protein, 90 aa, Glycine max
  Coding DNA Sequence Number=SeqID_46827
MSRICAELSFLLQKPNPIGGCGKKKLTGSAICTPNTDNEEAAIEMGNSAMTRLARGFQRCLSLLALLPGHVCIAMQRYAKSRGSERVTTA

SEQ ID NO: 163606 - protein, 389 aa, Glycine max
  Coding DNA Sequence Number=SeqID_46828
  Gene Ontology: Mol. function=zinc ion binding; Cellular component =cell outer membrane; Biological process=defense response
  Homolog annotation: Hit_ID=Q336R3; Match level="QueryCoverage=98%, HitCoverage=44%, E-value=1e-107, Identity=54%"; Hit description=Zinc finger, C3HC4 type family protein, expressed
  Pfam annotation: Domain name=zf-C3HC4; Domain location=337-375; Score= 34.0; E_value=5.4e-07; Accession=PF00097.15; Description=Zinc finger, C3HC4 type (RING finger)
MTSELKSLTNKCAEQVLEIKSLKTLTEKLQKENQELEFILDMHGQENYDKRHSEVRESERKAHSQAEMLKNALDEHSLELRVKAANEAEAACEQRLSAAEAEIEDLRSKLDASERKVFGDEEWGRDILELTEAVKVKDAEAEAYISEIETIGQAYEDMQTQNQNLLDQVIERDDYNIKLVSDSVKTKQAHNTLMSQKQALAKQLQQINTSIEHSKTRITHSEEQTKAILSDAIKCNQEEKHLAVTLEFAKWELGDTEKELKLLKSAVSSSEKEYDQIPKDTEAIQMELESERSLRKKLEEELGELNSKIDELTSETGETTIQKLEKEIRICKNMIKCTVCTDRPKEVVIVKCYHLFCNPCIQRNLELRHRKCPACGTAFGQSDVRFVKI

SEQ ID NO: 163607 - protein, 111 aa, Glycine max
  Coding DNA Sequence Number=SeqID_46829
LVTGLCQSYRVPVPPARSRHHDIGIVPARHPMDPEKSNRVLGFPTLITSLCQFYEVPVTPNKGETPQQPGEGRQRAISAPPPPLEFTSAHPQKVIRRPAQDVKEALLGGNL

SEQ ID NO: 163608 - protein, 224 aa, Glycine max
  Coding DNA Sequence Number=SeqID_46830
  Homolog annotation: Hit_ID=Q00M75; Match level="QueryCoverage=13%, HitCoverage=4%, E-value=1e-08, Identity=96%"; Hit description=PPR -repeat containing protein
GDELNWGRSKRFSVTVEGCYLGVGRTHFIIDTFERHRVVFTVGTSIASVATAWFGYSLRHLHDTKVDQRLQSIENAMKNNTNLQHSEIKDIVAEGCSIPACVATAGTSLIIGYALGWRGGIWYATKKFRKEQMKMLGQITPKRWQLLGKIKPRGLEFQFLRRKLTRSKVFDTATKTSETSIKDASTTHIAGKSDKASPGAAVKLCLGDLLVMGSNPETASLHMQ

SEQ ID NO: 163609 - protein, 235 aa, Glycine max
  Coding DNA Sequence Number=SeqID_46831
  Gene Ontology: Mol. function=carboxylic ester hydrolase activity; Cellular component=lysosome; Biological process=lipid metabolic process
  Homolog annotation: Hit_ID=Q6TGC0; Match level="QueryCoverage=77%, HitCoverage=46%, E-value=2e-48, Identity=52%"; Hit description =Triacylglycerol/steryl ester lipase-like protein
  Pfam annotation: Domain name=Abhydro_lipase; Domain location=36-99; Score=59.9; E_value=8.2e-15; Accession=PF04083.6; Description=ab -hydrolase associated lipase region
  Subcellular localization annotation: CTP_CleavageSite=43; ConfidenceScore=5.44e-01
MANTSVSTLLVILFWGLTLATGRKLSPLSTTTTLSSSPSDGICLSMVMPQGKTCEEHLVTTQDGYILNLARIRIRESRGPPVLLQHGLFMDGITWLLLPSNQSLAFLLVDNGFDVWVANTRGTKFSRQHTSLPSNSSDYWNWSWDELVAHDLPATFKYVHDLTGQKMHYVGHSQGTLIALAALSQDQLLNMLRSAALLSPIAYVGQLTSPLAKNAAENFIAEVDRIRSEPESILM

SEQ ID NO: 163610 - protein, 66 aa, Glycine max
  Coding DNA Sequence Number=SeqID_46832
MMVQELDTPGHGGPEVLQPVIPPLLGARRPEPSPESQDPTLNLEWAGQHYASTSPTEHSPSHVPSL

SEQ ID NO: 163611 - protein, 123 aa, Glycine max
  Coding DNA Sequence Number=SeqID_46833
  Gene Ontology: Mol. function=carboxylic ester hydrolase activity; Biological process=lipid metabolic process
  Homolog annotation: Hit_ID=Q1XBG1; Match level="QueryCoverage=70%, HitCoverage=21%, E-value=1e-25, Identity=56%"; Hit description=Lipase
EGTTSMFDYENRDENMKHYGQPTPPVYDMTRLPNDLPIFLSYGGADALSDVKDVQRLLEILKDHDADKLVVQYRNDYAHADYVMGENAHRDDDYSEGLILGNLKLLKEELAVYLDMPLEAIRD

SEQ ID NO: 163612 - protein, 358 aa, Glycine max
  Coding DNA Sequence Number=SeqID_46834
  Gene Ontology: Mol. function=tRNA isopentenyltransferase activity; Cellular component=intracellular; Biological process=tRNA processing
  Homolog annotation: Hit_ID=Q1W5W3; Match level="QueryCoverage=76%, HitCoverage=84%, E-value=1e-117, Identity=74%"; Hit description =Adenylate isopentenyltransferase
  Pfam annotation: Domain name=IPPT; Domain location=46-239; Score =14.2; E_value=7.7e-12; Accession=PF01715.8; Description=IPP transferase
GKKLIVRQIEKEKVVVVMGATGAGKSRLSIDLATCFPSEIINADKIQVFEGLDIVTNKISKEEQRGVPHHLLGTIKPNMDFSVNDFCDTSSEAIDSITRCQKLPIVVGGSNSYLEALMDDDDYKFRSRYDILCLWVDVEMSVLKSYVADRVDHMFYKGMVDELRPFYSPNGDYSRGVKRAIGVPEFHEYFGREEVADEETKQRLLEQAVKEIKLNTCKLAMKQLGKIRRLRNVKRWHIHRLDATPVFRMRGEEANDAWKRLVAKPSALIVARFLYNNNSKNNANVVSGSGLRVQPAASENESSSSSSNSKSSRSIITSATLRASIPTKVKRQDTNDGAQDLGNIDLVKLGQKDLPQSC

SEQ ID NO: 163613 - protein, 112 aa, Glycine max
  Coding DNA Sequence Number=SeqID_46835
MQTHPTKEIGINNGGTKGDPWSLVLGGASVPHYAQAEFGLSIIICNCLEVNGLATVPYQPMTRDHVPLESLGQNADVQSSLMSLQVGCTKEVVTCKNSNAQVTECEITVDEL

SEQ ID NO: 163614 - protein, 1446 aa, Glycine max
  Coding DNA Sequence Number=SeqID_46836
  Homolog annotation: Hit_ID=Q1S7H5; Match level="QueryCoverage=89%, HitCoverage=94%, E-value=0.0, Identity=63%"; Hit description=PWWP; Regulation of nuclear pre-mRNA protein
  Pfam annotation: Domain name=Extensin_2; Domain location=1103-1401; Score=-108.7; E_value=0.0044; Accession=PF04554.4; Description =Extensin-like region
MGMMMVAAVVVAMINNIGGNDNSCSNGGDGNNNIDNCSDGSVACNDNGSVAAMVISLVIVVAGVVAVVANGNDGDGCSHNNNYGSGGIKKLCKPFCNPADVEAFTEEKKQSILGKRHGKGAEFGRAVKEIIEVFEKLKKETQLDETGSGGDVANADVSNPVNSSAKYQTDAPELAHTLPMNSSNSIINKHEVVCVAEDDSAAVFKDESHNKEAMLGEPADKIAAVKSPKPVTYSSRKRSMGDLCLQGCVTDRHTSVRRSRNSSRAQNCVLPCNDNGKSAGNPSTTAAQSACTCRNRSVRKSSDLFGCDDFESSAFVLNGSMEDNSSEIITTDSDTFSLNEGSTMDSNFKLELSEAIDCPEIELNKGLDLEIKSVVNKKKRKPNRKRAANDASKPTSGPEEEIGVQNASQSSQNICGNSKERCFEQDGDEHLPLVKRARVRMGKSSVEGELHSTLQSQEKNCKEDTNSAPQMITSSNCENNSPADGDSSLLNGALDNVSPKISVPCSNTQICNAKKDQTFSSVDVEAALPPSKRLHRALEAMSANAAEEGQAHLEASSSIMTSSGMRCISNGKRCPSMAINNQEGNCLEPQKLDTCNIDSSHIKVYGFSISSNPMIFTENKSPIQVGKQMTKIQKHETGKDVLPGATDQVGGELSDHMVCQTAKADLKIQSNGQISSNLDSKFCDVGSIQDSPNPSLPANGEDNIRTVNNSNTASDGSEHNGISLDPVIGEKENDASLPHNIDVPQNEGAVCEDTECLKPAVVDIGTANDMHEIVNDAKCKGPEEDMNSVSTSDDHLGENGILDIRSSPSLTDGGDCVPQGSPPTTSICNVSTSDSSNILHNGSCSPDVHLHQKQTVSGPVDGSKDGDVATQQSRCMGKSTEAGRAALLYFEAMLGTLTRTKESIGRATRIAIDCAKFGIADKVMEILAHCLEMESSVHRRVDLFFLVDSIAQFSRGLKGDVCGVYSSAIQASLPRLLSAAAPPGNTAQENRRQCLKASGIYLRRSLRTERALDDPVREMEGMLVDEYGSNSTFQLPGFCMPRMLKDEDDGEGSDSDGGNFEAVTPEHTLEVYEMTSAIEKHRHILEDVDGELEMEDVAPSNAVEMNSICNVDTGNAKQCEKNLPLSFAPLHQDVRSSSPPPPSFLPPPPPPPRPPPPPPMSHHMPSTSDPYDTVVNSKGCTVSQTLKDNPLHSVAQPMAAPRHSQPISDAVHHLVPEYREMQMHMPESTCCFNSFPVPPPDNFRHTDGVTMHNKGYSIRPPQHVPSNQFSFVNGEQHVKHQREVPPPPPYSSSQHFVQNMERENFYNNHERLRPPPYVYEDRWNGPASYPGPRYQEKGVPPPYVCHPCESSRIPDHGWRFPPRSMNQRNSMPFRPPFEDAIPVANRVAINYWDAWGPSHKNVLAYGSGLLEFVGRVGVFNCDDSVENDEGGEFVLKVSSTELERNG

SEQ ID NO: 163615 - protein, 603 aa, Glycine max
  Coding DNA Sequence Number=SeqID_46837
  Homolog annotation: Hit_ID=Q1S7H9; Match level="QueryCoverage=55%, HitCoverage=98%, E-value=2e-56, Identity=39%"; Hit description=UBA -like
MGFNSVYRSLQEIFPQVDPRLLRAVAIEHPKDADLAAGIVIAEVIPFMSKKLPAAIPPQHNNYVASLNVEVESEEEGNRLRHRQLVDDVTVGPSSAPHSISVEVIKTADYSFVPDLNEALDKSTMSNDGTDKFLEMNDIKELDIYQNAEDNFSGETLNEIAQEMSNGFSQEDNENFERRFVDVDCENLISSGICQEMEPKHNNLSKEAASNNGDGNRIGNDSNEMGWLEVVSSLVDDYDATTSHRLEECETYLIELETSEAPKVCHVQGDALNYKDSLQSELVAGSSSTGDNTSDVEDDIGAKNAGSQYSHVCRIDLLEEIIDEAKTNKKMLFSSMESLINLMREVELQEKAAEQANMEAATGGSNILARIEEYKTMVVQANEANDMHSGEVYGEKAILTTELKELQSRLLGLSDERDRSLAILDEIRHILEVRLAAAEELRKAAEQLKLEKEESARKALVEQERLVEKVVHESQRLQQEAEENSKLQEFLIDRGRVVDMLQGEISVICQDIKLLKEKFDANLPLSKSFTSSQTSCKLASSGSSHKTLASDAGSEHSESSEIRKTSRTASIESLSSKSGHDEEEKSKADHNALLDDGWYILSD

SEQ ID NO: 163616 - protein, 176 aa, Glycine max
  Coding DNA Sequence Number=SeqID_46838
  Gene Ontology: Mol. function=transporter activity; Cellular component= integral to membrane; Biological process=transport
  Homolog annotation: Hit_ID=Q58J24; Match level="QueryCoverage=75%, HitCoverage=39%, E-value=2e-40, Identity=67%"; Hit description =Putative plastid glucose 6 phosphate/phosphate translocator
  Pfam annotation: Domain name=TPT; Domain location=91-176; Score= -24.3; E_value=0.015; Accession=PF03151.7; Description=Triose -phosphate Transporter family
  Subcellular localization annotation: CTP_CleavageSite=40; ConfidenceScore=5.11e-01
MKLTGHGLWRSTLSCKVKRWHRGSRLVAVAHAIRHVVATVSMSKGEPTFSVLVSRFLLGKAFPIPVYLSLLPIIGGGALAAVTKLNFNMIGFTGAMISNLEFVYCNIFSKKGMKGMSISGMNNYSCFSIMLLSILTTFAIVVEDPKVGSCSERLLPPPINVLGIAIAILGTFLYSQ

SEQ ID NO: 163617 - protein, 111 aa, Glycine max
  Coding DNA Sequence Number=SeqID_46839
MEKRLMIVLGIGRSGAWTRQACMWEILEKKEWSATSTMKAHLVDLTPSWGSKGGEMSPTKGGVVRLDGGQTTSIGKRTHPSELRDFDLHRVASPERVEHSLVAAGINLQVI

SEQ ID NO: 163618 - protein, 71 aa, Glycine max
  Coding DNA Sequence Number=SeqID_46840
MSMNYFITEQHLCLYVIYLAARITICMVTGDIRMVMAPSLTLERHKFMANLRKMFHEVVVVTSDGTNDGPT

SEQ ID NO: 163619 - protein, 154 aa, Glycine max
  Coding DNA Sequence Number=SeqID_46841
  Homolog annotation: Hit_ID=Q1SFD6; Match level="QueryCoverage=56%, HitCoverage=8%, E-value=1e-08, Identity=47%"; Hit description =Integrase, catalytic region
MEGFEVEVFTRRFAENFRIAAGYDIYQTRITLLEEEHEVKVALVEEIQEEKEVSYVHIVVSLTTLLMNATQSMAILLNTGFTSLKQYKALMALLQQQNITHNNLHVSQIGTTSNKGSTLSITCSVSKISQEEWILDSGATDHVTVFPHKVGNQL

SEQ ID NO: 163620 - protein, 123 aa, Glycine max
  Coding DNA Sequence Number=SeqID_46842
MVGYAPSSFADLVFAGKRIEAGLKRGKFDHPTLISEKAGMKRMRMREKTLAMTTIPTWPNFPPAQQCHHSANNSPSPYPPPSYPRRSSLNEPQNPPTTQPMLNTTFGMNQNTNQGRNFAAKSL

SEQ ID NO: 163621 - protein, 171 aa, Glycine max
  Coding DNA Sequence Number=SeqID_46843
MDVLMITKMITKDDDKGDDKKLKGQSKNEFKIFKIESRTLQDSRGKLISRIKNQDSRDQDFKNQDSRDQDSRIKRRLNQDKCEKEHDGSWVKKGTRHVGEEGRDGEDSSLLSKILDRFDGFQTIVGERFDNLELQVDMRFNEMESRITKVKEDVSYIRSSFDLPPPPPPSS

SEQ ID NO: 163622 - protein, 53 aa, Glycine max
  Coding DNA Sequence Number=SeqID_46844
MKTLKTTLDGKTDHAAPQWIEVKSQVQSGGYECDYYVIHWMWNIVIGGGGVKE

SEQ ID NO: 163623 - protein, 63 aa, Glycine max
  Coding DNA Sequence Number=SeqID_46845
MFKHIYTTVVDDASLWASGVQAWVMVPCMDSLSLNPYTMQRIDMLNVNITFKHWLRNPNERST

SEQ ID NO: 163624 - protein, 263 aa, Glycine max
  Coding DNA Sequence Number=SeqID_46846
  Gene Ontology: Mol. function=protein binding; Cellular component =integral to membrane; Biological process=protein amino acid phosphorylation
  Homolog annotation: Hit_ID=Q9ZTJ7; Match level="QueryCoverage=94%, HitCoverage=76%, E-value=7e-35, Identity=36%"; Hit description=Hcr2 -5B
  Pfam annotation: Domain name=LRR_1; Domain location=152-174; Score =0.5; E_value=2.3e+02; Accession=PF00560.23; Description=Leucine Rich Repeat
  Pfam annotation: Domain name=LRR_1; Domain location=176-198; Score =10.0; E_value=3.9; Accession=PF00560.23; Description=Leucine Rich Repeat
  Pfam annotation: Domain name=LRR_1; Domain location=200-222; Score =11.6; E_value=1.9; Accession=PF00560.23; Description=Leucine Rich Repeat
  Pfam annotation: Domain name=LRR_1; Domain location=224-247; Score =7.7; E_value=10; Accession=PF00560.23; Description=Leucine Rich Repeat
  Pfam annotation: Domain name=LRR_1; Domain location=27-49; Score =18.6; E_value=0.022; Accession=PF00560.23; Description=Leucine Rich Repeat
  Pfam annotation: Domain name=LRR_1; Domain location=51-73; Score =16.6; E_value=0.089; Accession=PF00560.23; Description=Leucine Rich Repeat
  Pfam annotation: Domain name=LRR_1; Domain location=75-97; Score =17.1; E_value=0.062; Accession=PF00560.23; Description=Leucine Rich Repeat
  Pfam annotation: Domain name=LRR_1; Domain location=99-121; Score =19.1; E_value=0.016; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=152-174::176-198::200- 222::224-247::27-49::51-73::75-97::99-121
MNHPCSTSHLCKLSIFPVLVIPLPLTSLVELDLSNNQLEGTIRTSLGNLTCLVELDLSANQLEGTIPTSLGNLTSLVKLQLSRNQLEGTIPTSLGNLTSLVRLDLSYNQLEGTIPTSLANLCNLMEIDFSYLKLNQQVNELLEILAPCISHGLTALAVQSSRLSGNLTDHIGAFKNIDTLLFSNNSIGGALPRSFGKLSSLTYLDLSINKFSGNPFESLRSLSKMSSLQIDGNNFQGVVKEDDLANLTSLMEFHASGNNFTLK

SEQ ID NO: 163625 - protein, 56 aa, Glycine max
  Coding DNA Sequence Number=SeqID_46847
MIQKLRKRGTLIKKSGETGIGEGKDQSFGKGGKRLLDFGSFEILGWHVNNPGFLFS

SEQ ID NO: 163626 - protein, 120 aa, Glycine max
  Coding DNA Sequence Number=SeqID_46848
MARPARDLNALSARCGAERNYEGPVDVFACDAKLVGGIHDVNKLSIPGIGGNFIGGVVPGNIGGGYIGVVPSYLVIGGVYLGGAIPGIGGSGFPNIGGGFQGQAFQNALGRCLRCCSIST

SEQ ID NO: 163627 - protein, 186 aa, Glycine max
  Coding DNA Sequence Number=SeqID_46849
  Gene Ontology: Mol. function=lipid binding
  Homolog annotation: Hit_ID=Q9LTR5; Match level="QueryCoverage=63%, HitCoverage=8%, E-value=3e-18, Identity=38%"; Hit description =Similarity to bactericidal permeability-increasing protein
MAFICERNLISAPAGKVVGMEVALTLGLENQEESLKLKLKDCGSNLWRFQNQKAGANIFAYMTIDVLEEDEVIPMACISLVIQGTGLVKIKGNNFVGSIRLNDFQMSSKWSNIGNLRMYLIQPVVWTLIETIFLPYANARLSRGLPLPIIHGFILQNAEIILSTSGLAVCSDVAFADSNKRFLQLN

SEQ ID NO: 163628 - protein, 137 aa, Glycine max
  Coding DNA Sequence Number=SeqID_46850
  Gene Ontology: Mol. function=lipid binding
MALFFVLFLLASSLTQGYAQFQLKNEAFISLLITQNGLDFMKELLVNKAISSLASLGLPNIEKTVKIPVVGSVYMVLSNISSYHIDVPSSHVKPGETGISIIASGVTCNLSINWYYSYSTWFVPVKTSDRDRAEVQA

SEQ ID NO: 163629 - protein, 174 aa, Glycine max
  Coding DNA Sequence Number=SeqID_46851
  Gene Ontology: Mol. function=acyltransferase activity; Cellular component=integral to membrane
  Homolog annotation: Hit_ID=Q2HTC9; Match level="QueryCoverage=86%, HitCoverage=28%, E-value=3e-52, Identity=66%"; Hit description =Chalcone and stilbene synthases, N-terminal
  Pfam annotation: Domain name=FAE1_CUT1_RppA; Domain location=15-174; Score=78.0; E_value=2.1e-21; Accession=PF08392.2; Description =FAE1Type III polyketide synthase-lik
MAVASTVLLSLGALYRWKRSPTVYLVDFACYKPKKEHKISMEGFLKMTKESEGFEEESLQFQRKISTRTGLGDKTYLPRGITSCPPKLCMNEVHLEENIVMFNALDALLAKTGIDPKDIDIPVVNCGLFNPTPSLSAMIVNHYRLRSNIKSYNTRSHTVSDDEHYFPQILDVQF

SEQ ID NO: 163630 - protein, 364 aa, Glycine max
  Coding DNA Sequence Number=SeqID_46852
  Homolog annotation: Hit_ID=Q1SJ82; Match level="QueryCoverage=23%, HitCoverage=21%, E-value=1e-14, Identity=46%"; Hit description =Probable Ta11-like non-LTR retroelement protein [imported] -Arabidopsis thaliana
MGLPPERLLIQGIPKETSRTPSLGLLIVEHFVFSCGLQIFNTTVRQSNVKCWLRIHGPPQEYWRDNILFAIARGVGVPLALDVATTNRDYGHFARVLVEVDLTLPLREHSLDKCRHKHGVILIQPRVSNKEAPLSSCDESLHPESPSGDELVMDSINEAVQVQQDLHVLAKTWGDMAQEDSCFTPYQSHSTQNLTGKRARRFSLCGISKPKVGAVSHSLGISPLIKQHLSLQLTTACLYGYPPPQMPPPTPPKPGLLKPPPKPGLLKPPPKPGLLKPPPPKPGKPPPPKPGKPPPPKPGKPPPPPKPGKPPPPKPGKPPPPKPGKPPPPPKPGKPPPPPKPGKLPTPKPGKPPPKPGEPPPKPP

SEQ ID NO: 163631 - protein, 74 aa, Glycine max
  Coding DNA Sequence Number=SeqID_46853
  Gene Ontology: Mol. function=oxidoreductase activity; Cellular component=mitochondrial respiratory chain; Biological process =respiratory gaseous exchange
  Homolog annotation: Hit_ID=O03376; Match level="QueryCoverage=83%, HitCoverage=19%, E-value=1e-28, Identity=96%"; Hit description =Alternative oxidase 3, mitochondrial precursor
MTEIIVISCDEHPWDSYHSDVSIDVTKHHTPKSLTDKVAFRAVKFLRVLSDMYFKERYGCHAMMLETIAAVLGM

SEQ ID NO: 163632 - protein, 223 aa, Glycine max
  Coding DNA Sequence Number=SeqID_46854
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q6ZDR8; Match level="QueryCoverage=45%, HitCoverage=8%, E-value=1e-21, Identity=54%"; Hit description =Putative potential copper-transporting ATPase
  Pfam annotation: Domain name=HMA; Domain location=134-222; Score =23.2; E_value=0.0009; Accession=PF00403.16; Description=Heavy-metal -associated domain
  Subcellular localization annotation: CTP_CleavageSite=80; ConfidenceScore=5.30e-01
MDSAFSITTKAHVALFRVLHRHFHGAPKRVLLRCNLKRLIASYSSSNCCRIPCSFASAPSPSSLGSFRGLLPRTPPCSPRCISFASPAGGGNGGAGTGDGGGGGGSGGESGDVNLKLVGDASQELSALSPDVIILDVSGMVCGGCAATVKRILESQTINIKVEESCLGFKAMPQVSSASVNLTTETAIVWPVSEAKNAPNWQKQLGEALAEHLTSCGYNSSLR

SEQ ID NO: 163633 - protein, 66 aa, Glycine max
  Coding DNA Sequence Number=SeqID_46855
MVPSPLALPRRSCHVKRDAQVAAAAWPSAYVERDAQARTTALADQEQLLQQEQGGSGSANGVGVLG

SEQ ID NO: 163634 - protein, 53 aa, Glycine max
  Coding DNA Sequence Number=SeqID_46856
MQSKLKDLELEANALIFVGGKVSVDILPLMKLLSFAVGVLPDHVPKLLALLSP

SEQ ID NO: 163635 - protein, 95 aa, Glycine max
  Coding DNA Sequence Number=SeqID_46857
  Gene Ontology: Mol. function=iron-sulfur cluster binding; Cellular component=membrane; Biological process=nodulation
  Homolog annotation: Hit_ID=P23233; Match level="QueryCoverage=96%, HitCoverage=89%, E-value=4e-38, Identity=79%"; Hit description =Nodulin 16 precursor
  Pfam annotation: Domain name=GRP; Domain location=1-74; Score=-9.0; E_ value=0.00058; Accession=PF07172.2; Description=Glycine rich protein family
MGSKMAIVIVALFAVLLFISQEVACRDFKEELGEVVKETNEESDARLAGSGGGDLDYCPGYDTIRKWIGRCRCGCCQWTTEPEVCIDCCTVMHHN

SEQ ID NO: 163636 - protein, 332 aa, Glycine max
  Coding DNA Sequence Number=SeqID_46858
  Gene Ontology: Mol. function=oxidoreductase activity; Cellular component=mitochondrial respiratory chain; Biological process =respiratory gaseous exchange
  Homolog annotation: Hit_ID=Q41266; Match level="QueryCoverage=99%, HitCoverage=100%, E-value=1e-154, Identity=81%"; Hit description =Alternative oxidase 2, mitochondrial precursor
  Pfam annotation: Domain name=AOX; Domain location=39-330; Score =640.9; E_value=1e-189; Accession=PF01786.8; Description=Alternative oxidase
MKLIALSSTVRRALLNGRNQNCNRLGSAAETRLLCAGGANGGFFYWKRTMASPAEAKFPEKEKAEAEKSVVESSYWGISRPKVSREDGTEWPWNCFMVRILFLIRNQALGDLSSNVSIDLTKHHVPKNFLDKVAYRTVKLLRIPTDLFFKRRYGCRAMMLETVAAVPGMVGGMLLHLRSLRKFQPSGGWIKALLEEAENERMHLMTMVELVKPKWYERLLVLAVQGVFFNAFFVLYILSPKVAHRIVGYLEEEAIHSYTEYLKDLESGAIENVPAPAIAIDYWRLPKDAKLKDVVTVIRADEAHHRDVNHFASDIHFQGKELRDAPAPVGYH

SEQ ID NO: 163637 - protein, 136 aa, Glycine max
  Coding DNA Sequence Number=SeqID_46859
  Homolog annotation: Hit_ID=O22490; Match level="QueryCoverage=27%, HitCoverage=35%, E-value=8e-11, Identity=78%"; Hit description =Cytochrome C
MASFDETPPRNSKNGEKIFKTKCAQCHTIDKGADNKQGIYRHSSPSVQELLCIDVEGNIMLVEEKKIGKKNEISLSRKLKLANCLMAQILLHGTLHATVYEVDKLKIGGGNFLTKFIDNLAMVSALPLLLPSPNRE

SEQ ID NO: 163638 - protein, 156 aa, Glycine max
  Coding DNA Sequence Number=SeqID_46860
MWGWIPQTTPQKETCLNALGDGGVFVLLVVAVIAAILLLLQHHQHKIKAVKLSGLTIIPSYPSRDWGLGFLPNETHDATSEREMMHFDGALHQGKANLLTEGGGGSSRDRACCVEAQGFKRFLLAAWKLKGSRDFCWLRVDTYIGLLNSTEITTGV

SEQ ID NO: 163639 - protein, 121 aa, Glycine max
  Coding DNA Sequence Number=SeqID_46861
  Gene Ontology: Cellular component=membrane; Biological process =nodulation
  Homolog annotation: Hit_ID=P23233; Match level="QueryCoverage=93%, HitCoverage=88%, E-value=3e-22, Identity=54%"; Hit description =Nodulin 16 precursor
  Pfam annotation: Domain name=GRP; Domain location=1-63; Score=-10.1; E_value=0.00076; Accession=PF07172.2; Description=Glycine rich protein family
MGSKMAIVIVALFAVLLFISPEVACRDFKEELGEVVKETNEESDARLAGSGGGDLDLSHVGGGDKLELDDKIICPPISSLEVYDFPPKKEFGNCRCGCCLRIPELGGCKYCCPEVRRQRAP

SEQ ID NO: 163640 - protein, 281 aa, Glycine max
  Coding DNA Sequence Number=SeqID_46862
  Gene Ontology: Mol. function=hydrolase activity, acting on acid anhydrides, catalyzing transmembrane movement of substances; Cellular component=integral to membrane; Biological process=metal ion transport
  Homolog annotation: Hit_ID=Q6ZDR8; Match level="QueryCoverage=94%, HitCoverage=27%, E-value=1e-105, Identity=71%"; Hit description =Putative potential copper-transporting ATPase
  Pfam annotation: Domain name=E1-E2_ATPase; Domain location=115-281; Score=124.6; E_value=2.9e-34; Accession=PF00122.10; Description=E1 -E2 ATPase
MEERHRQLRESGRELAVSWALCAVCLVGHFSHFFAAKAPWIHVFHSIGFHLSLSLFTLLGPGRQLILDGLKSLLKRTPNMNTLVGLGALSSFTVSSFAALLPRLGWKAFFEEPIMLIAFVLLGRNLEQRAKIKATSDMTGLLSLLPPKARLLLNNRETEVGSVVEVPSDSLSVGDQIIVLPGDRIPADGIVRSGRSTVDESSFTGEPLPVTKVAGSEVAAGSINLNGTLTMEVQRPGGETAMANIVRLVEEAQSREAPVQRLADKVTFLGGSKHPIPPVKE

SEQ ID NO: 163641 - protein, 247 aa, Glycine max
  Coding DNA Sequence Number=SeqID_46863
  Gene Ontology: Mol. function=DNA binding; Cellular component=nucleus; Biological process=regulation of transcription
  Homolog annotation: Hit_ID=Q0PJF7; Match level="QueryCoverage=72%, HitCoverage=100%, E-value=4e-69, Identity=75%"; Hit description=MYB transcription factor MYB166
  Pfam annotation: Domain name=Myb_DNA-binding; Domain location=61-106; Score=49.5; E_value=1.1e-11; Accession=PF00249.21; Description=Myb -like DNA-binding domain
  Pfam annotation: Domain name=Myb_DNA-binding; Domain location=9-55; Score=52.8; E_value=1.1e-12; Accession=PF00249.21; Description=Myb -like DNA-binding domain
  Pfam module annotation: Pfam domain module=Myb_DNA-binding::Myb_DNA -binding; Domain location=61-106::9-55
MTGGHDRVKGSWSPQEDATLLKLVNEHGARNWSVISAGISGRSGKSCRLRWCNQLSPEVQHRPFTPAEDKMIIKAHAIHGNKWATISRLLPGRTDNAIKNHWNSTLRRRRAVESSSSSSASPPAKRHSSLFDTLHPFKKQCIEKENEEERVLSPVTTSLSLFPPGEKSEEEEEEEEQEEEEKEKEELFQVNVNVNQKVTDQNYFMQMMQRMIAEEVRNYMETLRNCQRNNGLSLEPGLDLLPPTLPK

SEQ ID NO: 163642 - protein, 110 aa, Glycine max
  Coding DNA Sequence Number=SeqID_46864
MTSKIQILSILGMLAMFFLISTEVLATGLHGVGVGGGLPGVGVSAGLPGVGTGLHGVGGAGLSGAGGVGLSADAGLSRAGDAGLSGAGGGRRGRAGSPSYHASSPSGGVK

SEQ ID NO: 163643 - protein, 88 aa, Glycine max
  Coding DNA Sequence Number=SeqID_46865
MGPGGGSYGGGIPGMGLPGGGYSGGPKGGGYGGGIPIMGLPDGDGPGGGYGGGPGNGFPGGDYGGGPGGGYDGGPGGSLPGGGYRGGP

SEQ ID NO: 163644 - protein, 345 aa, Glycine max
  Coding DNA Sequence Number=SeqID_46866
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q6ZDR8; Match level="QueryCoverage=88%, HitCoverage=31%, E-value=1e-82, Identity=55%"; Hit description =Putative potential copper-transporting ATPase
  Pfam annotation: Domain name=Hydrolase; Domain location=72-317; Score= 109.3; E_value=1.1e-29; Accession=PF00702.16; Description=haloacid dehalogenase-like hydrolase
MHASLVSLSLANNLYVLQQCKMFTIITMFLVVACPCALGLATPTAVLVGTSLGAKRGLLLRGGNILEKFAMVNTIVFDKTGTLTVGRPVVTNIVIPTCIKNAISRLAVKSQTEENALSDVEVLRLAAAVESNSVHPVGQAIVNAAQAANCHDAKVKDGTFLEEPGSGAVATIDNKKVSVGTLEWITRHGVINSIHQEVEKSNNQSFVYVGVDDTLAGLIYFEDEIREDARDVVDRLSKQNIGVYMLSGDKRNAAEHVASLVGIPKEKVLSQVKPDEKKKFINELQKDKNIVAMVGDGINDAAALASSHVGIALGGGVGAASEVSSIVLMRNQLSQYSSVNHKIYG

SEQ ID NO: 163645 - protein, 325 aa, Glycine max
  Coding DNA Sequence Number=SeqID_46867
  Homolog annotation: Hit_ID=O82021; Match level="QueryCoverage=30%, HitCoverage=35%, E-value=6e-51, Identity=98%"; Hit description =Putative arginine/serine-rich splicing factor
  Pfam annotation: Domain name=RRM_1; Domain location=18-89; Score =92.7; E_value=1.1e-24; Accession=PF00076.12; Description=RNA recognition motif. (a.k.a. RRM, R
MSHFGRSGPPDISDTYSLLVLNITFRTTADDLFPLFDKYGKVVDIFIPKDRRTGESRGFAFVRYKYADEAQKAVERLDGRMVDGREITVQFAKYGPNAERISSVVVWGENGMPGEGRYYYMLVTKEGLLKHPQDQGDQGAVAQGKGIVMITETEIIGEEVAAEVMIGMNVTGIVGETKIIVAEVGAVVPVLITRVVVEDAMMMSVIVEAGADQLIGIHSLLASSFNCESPPPQRSTSPQRSTSPRKSPRGESPANRSREERSPTPRSVSPRGRPDASRSPSPRNSNGDLTVAALYAGIGLAMVSAVDTDDGCLAVLLVSVDSKAT

SEQ ID NO: 163646 - protein, 109 aa, Glycine max
  Coding DNA Sequence Number=SeqID_46868
LVPVELLEIERQLDARLRVFYHPEQLDNGVTPGWYICLKDFNALPKKDLVIVTCDLFYACCLTTLKPPSMDTRIHNGFCNNVRASRHRWVIFHIYQASSHICFKHISFD

SEQ ID NO: 163647 - protein, 58 aa, Glycine max
  Coding DNA Sequence Number=SeqID_46869
MQSKFQSQMQSQGLTLPPKSEVGPSITHVSTNESCVDPSGNDPDTADSEKCGLELWNQ

SEQ ID NO: 163648 - protein, 92 aa, Glycine max
  Coding DNA Sequence Number=SeqID_46870
  Subcellular localization annotation: CTP_CleavageSite=87; ConfidenceScore=5.17e-01
MVKKPTHLGELITSALSFSSPGRAATTPNDPLPINRHPRGVLRGSKAFSSNKRWWRIPDIFIFGRRSFGFSLALPSKGRLQQMATPLGMLES

SEQ ID NO: 163649 - protein, 52 aa, Glycine max
  Coding DNA Sequence Number=SeqID_46871
MAQDECVGWGTYYGAFEEEDEDKYISTIFTGETGQYYKDSGIQVLVSTRTVF

SEQ ID NO: 163650 - protein, 169 aa, Glycine max
  Coding DNA Sequence Number=SeqID_46872
MKDNMAPVAATSEEVHQEGVRWLIDDNSEVDPNKDMHDVSSQGSYYSLATMIEYKQFLVGESLPLYHGKIDKPKQPSPREKMSGVATNVYSRKMLEKPKRGLQILKRRVRELFTHGEGISTPHACHKGQQPLIEWHNMTSRLFIFPFYIFLLFGVDKGVALAPTYPQVR

SEQ ID NO: 163651 - protein, 70 aa, Glycine max
  Coding DNA Sequence Number=SeqID_46873
MASNRKSSSWARGGGEGSRKREATLRAAVKVKVPASSVAMVGGGKRDVWTYFRIKLIPKCFTDQLDPEAA

SEQ ID NO: 163652 - protein, 324 aa, Glycine max
  Coding DNA Sequence Number=SeqID_46874
  Gene Ontology: Mol. function=transcription factor activity; Cellular component=nucleus; Biological process=regulation of transcription, DNA-dependent
  Homolog annotation: Hit_ID=Q1SEM6; Match level="QueryCoverage=50%, HitCoverage=45%, E-value=1e-34, Identity=52%"; Hit description =Pathogenesis-related transcriptional factor and ERF
  Pfam annotation: Domain name=AP2; Domain location=60-124; Score =109.3; E_value=1.1e-29; Accession=PF00847.10; Description=AP2 domain
  Subcellular localization annotation: CTP_CleavageSite=75; ConfidenceScore=5.59e-01
MASLLPQPQETKPTATTATETTPSETSITASANKSSSSNNNNSSSNSRKCKGKGGPDNNKFRYRGVRQRSWGKWVAEIREPRKRTRKWLGTFATAEDAARAYDRAAIILYGSRAQLNLQPSGSSSQSSSSRSSSSSTQTLRPLLPRPSGFTFNFPFNSAPATTVPYPYNNSHNYTYTPPVLYPIDNSKNHNINTVQVHHPHHYRCPEEVVQVPHSESDLGGLGGNNNIVVDGSIRSTSYQRHGFLDNINNNNNHVHVQVQHGVFSNQQQQHQNSVVEGVNSSVVGSVSSSMDASSVDPDLALVGTMGLGSSSPFWSMANEDDYT

SEQ ID NO: 163653 - protein, 59 aa, Glycine max
  Coding DNA Sequence Number=SeqID_46875
MTMVVMSCGGGIKGKVQWWWNGGGDSDDSDSVVVRLHQQDVMTVVALNGGDNDGSDDIS

SEQ ID NO: 163654 - protein, 361 aa, Glycine max
  Coding DNA Sequence Number=SeqID_46876
MDSFTPFSPRGEACLPVRKPPFMHKERKGELGPTLSKQRGSICQLNLILAIRQLCYPTRGAPLEEELAPVISRGFSETNVETLRKVRKEWEVVQKKDKELRGSNNRPIGGYREWLKAHVQGLEMLPSLRTAKREGIEALEEDEEVQALRTELEQAQTIKERFKSAALKIRKENAELRDTNIATTKALERETKRARREEHGRNKFRGALWGSNSELKLRREERDRSRVDSLILKDELKVCSRSKRNLSQQLCETETNMLAIVSKYQEELNLATAHEHKVADEYSRVYAEKESRGRVIDSLHQEATMWMDRFVLTLNGSQELPRLLAKAKAMADTYSTPEEIHGLLGYCQHMIDLMAHIIRNR

SEQ ID NO: 163655 - protein, 197 aa, Glycine max
  Coding DNA Sequence Number=SeqID_46877
  Gene Ontology: Mol. function=pepsin A activity; Cellular component =endoplasmic reticulum; Biological process=proteolysis
  Homolog annotation: Hit_ID=Q8H9F4; Match level="QueryCoverage=97%, HitCoverage=39%, E-value=3e-38, Identity=46%"; Hit description=41 kD chloroplast nucleoid DNA binding protein
YMETFSYCIPSVDDVGYITFGYDPDTDFDKRIKYTPLVIPQGGLNHYGLSITGIAIDGDILPGLNFSQINHAGFIIDSGTVFTRLPPTIYATLRSVFQQRLSNYPTAPSHNVFDTCYDLTGYHYPIPEMSFVFPGVTVDLHPPGVLYEFDDKQSCLAFIPNKDDSQITIFGNVQQKTLEIVYDNPGNRIGFRSDGCS

SEQ ID NO: 163656 - protein, 304 aa, Glycine max
  Coding DNA Sequence Number=SeqID_46878
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=32%, E-value=1e-159, Identity=84%"; Hit description=DNA -directed RNA polymerase beta chain
  Pfam annotation: Domain name=RNA_pol_Rpb2_6; Domain location=1-213; Score=146.8; E_value=5.7e-41; Accession=PF00562.18; Description=RNA polymerase Rpb2, domain 6
  Pfam annotation: Domain name=RNA_pol_Rpb2_7; Domain location=215-292; Score=144.1; E_value=3.6e-40; Accession=PF04560.10; Description=RNA polymerase Rpb2, domain 7
  Pfam module annotation: Pfam domain module=RNA_pol_Rpb2_6::RNA_pol _Rpb2_7; Domain location=1-213::215-292
MELVILGSWVETGDILVGKLTPQMAKESSYSPEDRLLRAILGIQKREIKVGDKVAGRHGNKGIVSKILSRQDMPYLQDGRPVDMVFNPLGVPSRMNVGQIFECSLGLAGGMLERHYRITPFDERYEQEASRKLVFSELYEASKQTSNPWIFEPEYPGKSKIFDGRTGNSFKQPAIMGKPYILKLIHQVDDKIHGRSSGHYALVTQQPLRGRAKQGGQRVGEMEVWALEGFGVAHILQEMLTYKSDHIKTRQEVLGTTIIGGTIPKPTDAPESFRLLVRELRSLAMELNHFLVSEKNFRIHRKEA

SEQ ID NO: 163657 - protein, 415 aa, Glycine max
  Coding DNA Sequence Number=SeqID_46879
  Gene Ontology: Mol. function=ubiquitin-protein ligase activity; Cellular component=ubiquitin ligase complex; Biological process =protein ubiquitination
  Homolog annotation: Hit_ID=Q1SEL7; Match level="QueryCoverage=99%, HitCoverage=57%, E-value=1e-172, Identity=74%"; Hit description=Zinc finger, RING-type; U box
  Pfam annotation: Domain name=U-box; Domain location=281-355; Score =91.4; E_value=2.7e-24; Accession=PF04564.6; Description=U-box domain
MNNVLSAMMVSPGLLPSGTLLDSLIHVCNEVGSMEKFPLVHTRNVSTMIRRIKLLSSLFEEIQETDTPLPPSSILCLTELFSVIRRVKVLIQDCKDGSSLWSLIQLEFISNQFYVLVKEMGRALDILSLSLLNVTSDIKEQVELLHKQAKRAELLIDPRELHRREQLIQVMANNSLQNKKKKGLVDFGKVEEILSSIGLRTPSDYEEEISKLEAEAQNQAGTGGLIVVSNINNLISLMCYSKSMIFKEGESDTKEDCKPLSSFLYNKVYDSSSSSQSMTPNVPDEFRCPISLDLMRDPVIVSSGHSYDRISIAQWINSGHHTCPKSGQRLIHTALIPNYALKSLVQQWCHDNNVPVDEPTTEGNKNSSKKLKEDAVDHISANKAAADAVKMTAEFLVGKLATGSADIQRQAAYEL

SEQ ID NO: 163658 - protein, 425 aa, Glycine max
  Coding DNA Sequence Number=SeqID_46880
  Gene Ontology: Mol. function=pepsin A activity; Cellular component =cellulose and pectin-containing cell wall; Biological process =proteolysis
  Homolog annotation: Hit_ID=Q9LEW3; Match level="QueryCoverage=93%, HitCoverage=90%, E-value=5e-65, Identity=36%"; Hit description =Nucleoid DNA-binding protein cnd41-like protein
  Pfam annotation: Domain name=Asp; Domain location=112-422; Score= -158.9; E_value=0.00032; Accession=PF00026.14; Description=Eukaryotic aspartyl protease
  Subcellular localization annotation: CTP_CleavageSite=25; ConfidenceScore=5.09e-01
MATSLTFTCITVFFSFFLSFNNYVKGDLIPPSTCNRTSIKGLNRKISLELVHMDGPCSHLKRNNVVNDNDFLRDHERVKYIQSRIFKNNNLTELDSSVSIPTIPGLPLSTLNYIIVIRLGTPENSYQMVQFAQIRHVKALMNTRQGLKCSKDIRLCHYSIRYGDGSYSTGFFGKDRLALYSNISPNSGITDDFYFGCGIINKGLFHRTAGVFGLGRGELSFVSQTSSQYMETFSYCIPNIDKVGYITFGPDPDADHDERIEYTPLVIPQGGLSHYGLNITGIAIDGDILMGLDFNEIDHGGFIIDSGCIVTRLPPTIYAKLRSVYQQRMSNYPSAPTYTPFDTCYDLSGFHYPIPEMSFVFPGVTVDLPRAGTFYQLNPKQYCLAFIPNKDDSQISIFGNIQQKTLEIVHDNLGNKIGFRPNGCG

SEQ ID NO: 163659 - protein, 81 aa, Glycine max
  Coding DNA Sequence Number=SeqID_46881
MVYQRSKCHPQISRRSDLEIGDVGIKDNDVTWWRGPDLTVKRSDLEKDDVDVDDNKRTRESKSNFSIKSVGNKAFMFRKSV

SEQ ID NO: 163660 - protein, 107 aa, Glycine max
  Coding DNA Sequence Number=SeqID_46882
MIESFQQQQQISVLELYVEKDVAGGSIFHAANSVTSCGCNVSHHESELPRNISNLHDDEDDDDDDYLASNSYVEESFNEDDSDDGISDTDDEVTDIVEPVSIVHPTK

SEQ ID NO: 163661 - protein, 300 aa, Glycine max
  Coding DNA Sequence Number=SeqID_46883
  Homolog annotation: Hit_ID=Q941V7; Match level="QueryCoverage=40%, HitCoverage=48%, E-value=3e-30, Identity=52%"; Hit description =Glutaredoxin-like
MAASPTTPDNIISKEPPTKIIVCCQYIHDSNMLSGVAREHEEACRATNQAVGIARRTASKSVFLCEDFVASVALIAHYESEASARIAGVVLVGAREAFDEPVELAALVELADVVSSANVDATDEYARQGEVAAAAEDGVELVAEAVVDGDVALVDGDAEAAQDGSDGAAVTTTPWSRPGGSAAGTVAREAPQARSTAVEIRTRRKRDGDLGAAGSDSGLSWKRLWISLKEEQEKLKERVRECDGDDDGEGEGGGVLRNPLGELSHGGHMRSGKRKRVLRVVKSGEGDGHAKKTKRRGWGL

SEQ ID NO: 163662 - protein, 645 aa, Glycine max
  Coding DNA Sequence Number=SeqID_46884
  Gene Ontology: Mol. function=protein-tyrosine kinase activity; Cellular component=integral to membrane; Biological process=protein amino acid phosphorylation
  Homolog annotation: Hit_ID=Q84U00; Match level="QueryCoverage=49%, HitCoverage=99%, E-value=1e-123, Identity=65%"; Hit description=Ser -thr protein kinase
  Pfam annotation: Domain name=LRRNT_2; Domain location=35-78; Score =56.9; E_value=6.6e-14; Accession=PF08263.3; Description=Leucine rich repeat N-terminal domain
  Pfam annotation: Domain name=LRR_1; Domain location=106-128; Score =13.4; E_value=0.81; Accession=PF00560.23; Description=Leucine Rich Repeat
  Pfam annotation: Domain name=LRR_1; Domain location=130-149; Score =12.7; E_value=1.2; Accession=PF00560.23; Description=Leucine Rich Repeat
  Pfam annotation: Domain name=LRR_1; Domain location=154-176; Score =3.0; E_value=78; Accession=PF00560.23; Description=Leucine Rich Repeat
  Pfam annotation: Domain name=Pkinase; Domain location=357-614; Score=- 6.7; E_value=3.7e-08; Accession=PF00069.15; Description=Protein kinase domain
  Pfam annotation: Domain name=Pkinase_Tyr; Domain location=358-614; Score=-27.8; E_value=9.2e-11; Accession=PF07714.7; Description =Protein tyrosine kinase
  Pfam module annotation: Pfam domain module=LRRNT_2::LRR_1::LRR_1::LRR_ 1::Pkinase::Pkinase_Tyr; Domain location=35-78::106-128::130-149::154- 176::357-614::358-614
MAKNRKLTRFKDLSIAFRFVAVFFLLQKLGLCCSLNEEGNALLKLRQRIVSDPFGALSNWIDDEVSVDPCNWFGVECSDGRVVVALNLKDLCLGGTLGPELVKLVNIKSIILRNNSFSGIIPEGFVELEELEVLDLGYNYFSGHLPADLRSDISLAILLLDNNDFLVGFSPEINELRMLSECQVDENKLTNAAKMPACTKRVTTWNIDQGKSTRGLLQQKAKPRTNQGHFYRVADPPVKSSPPPPSASPSASAKPPGPKLAPHRKNGSDSPPPHSTPGSGTLSKTESNSPKVHTFPILPGVIGGAVFLIFSSIGIYLCKTKVANVRPWATGLSGQLQKAFVTGAQKLRRSDLEAACEDFSNVIGTSPIGTLYKGTLSSGVEIAVAFVPVTSSRNWSKTLEAQFRSKIDTLSKVNHKNFVNLIGYCEEEDPFTRVLVFEYAPNGTLFEHLHIKEAEHLDWGTRLRVATGMAYCLQHMHQLDPPMTLIKLNSSAVYLTNDYAAKLSDLSFSNDITSAEARAIDMPIATPESNVYSFGVLLFEMVTGRLPYSVEHRDSLENWASHYLEGDQPLIEMVDPILVSYQEDQLEQVAALITSCVHPDPQQRPTMKDVSERLREITKITPESAVPKLSPLWWAELEIASAEAR

SEQ ID NO: 163663 - protein, 589 aa, Glycine max
  Coding DNA Sequence Number=SeqID_46885
  Gene Ontology: Mol. function=molecular_function; Cellular component =outer membrane; Biological process=biological_process
  Homolog annotation: Hit_ID=Q9FFG3; Match level="QueryCoverage=86%, HitCoverage=86%, E-value=1e-147, Identity=51%"; Hit description =Arabidopsis thaliana genomic DNA, chromosome 5, P1 clone:MOP10
  Pfam annotation: Domain name=Bac_surface_Ag; Domain location=243-589; Score=53.0; E_value=9.7e-13; Accession=PF01103.13; Description =Surface antigen
  Pfam annotation: Domain name=Surf_Ag_VNR; Domain location=79-157; Score=14.6; E_value=0.049; Accession=PF07244.5; Description=Surface antigen variable number repea
  Pfam module annotation: Pfam domain module=Bac_surface_Ag::Surf_Ag _VNR; Domain location=243-589::79-157
MSNTEEEEEATPSNPNNHSQHSTNNDVEPRDDEDIEEDDDDVVQEPNRGIPQSAASKLREQRFKVESLSRRLSSELVPIRVHDVVINGNTKTKDWVIEAELKDIENATSMQELMQASQIAVARLQGLEIFDSCKVRLEAGPRELPNTANVIVDVVETDNKVSGEFGVYTKPSFHPGVLPLELEFHLGKLDNPLMQTFIIRITEVKLQFLLENTNSTYGTISKFCPKILHTSSWTAEGALKYKNLLGYGDLWDASLAYGANQATEVSVGVYAPRVKGFLTPIVTRISMLSQDWQESSSYKERLLGASLGLISTKHHDLAYTLGWRTLTDPSQMSSRSIRRQLGHGLVSSLKYTFKIDRRNSPIRPTKGYAFLSTTHVGGLTPDPRSLRFLRQEFDVRFAVPFGFYNTALNLGISAGAVFPWGHGFRTKSSPLPERFYLGGDFSPVCTLGGPTTLWGFKTRGLGPTEPRRQNRDGSNDDNVDSSGWDFVGGDLAVTAFADLSFDLPIRWLREHGIHGHVFAGSGNAAKLTQNEYKHFSPRKFLESFRMSVGCGVVIPTRLFRLEGNYFYILRKDEHDRGKTGFRFSFSAPS

SEQ ID NO: 163664 - protein, 359 aa, Glycine max
  Coding DNA Sequence Number=SeqID_46886
  Gene Ontology: Mol. function=hydrolase activity, acting on ester bonds; Cellular component=cellulose and pectin-containing cell wall; Biological process=lipid metabolic process
  Homolog annotation: Hit_ID=Q1SEL6; Match level="QueryCoverage=95%, HitCoverage=94%, E-value=1e-126, Identity=65%"; Hit description =Lipolytic enzyme, G-D-S-L
  Pfam annotation: Domain name=Lipase_GDSL; Domain location=30-349; Score=183.4; E_value=5.6e-52; Accession=PF00657.12; Description=GDSL- like LipaseAcylhydrolase
  Subcellular localization annotation: CTP_CleavageSite=15; ConfidenceScore=5.08e-01
MASLITSSFSILLLLCMLKSTTASSNFSAIFAFGDSTVDPGNNNHLFTLFRGDHFPYGRDFPTHLATGRFSNGKIATDYLAQFLGLKDLLPAYFDPLVTVSDMVTGVSFASGGSGLDPNTVALARVLDLSSQLASFEQALQRITRVVGNQKANDILENALFVISIGTNDMLYNAYLMPATSRMIRYGSISGYQDYLLQNLNDFVQTLYGAGARRILVAGLPPIGCLPVQVTLSSIKDLHWLQRVCDAQQNMDSQAYNNKLQSHIHLLQSTLNDAKIAYFDIYTPILDMVQNPTKYGFAQTLQGCCGTGLLEMGPVCNALDLTCPDPSKYLFWDAVHLTEAGNYVLAENGQQNVIPYLSN

SEQ ID NO: 163665 - protein, 45 aa, Glycine max
  Coding DNA Sequence Number=SeqID_46887
MDAPNSVITSLGHKDELGRITWNNGWLLFRILKRRKKTTSSYGPF

SEQ ID NO: 163666 - protein, 667 aa, Glycine max
  Coding DNA Sequence Number=SeqID_46888
  Gene Ontology: Cellular component=nuclear chromosome; Biological process=chromosome organization and biogenesis (sensu Eukaryota)
  Homolog annotation: Hit_ID=Q9S7T7; Match level="QueryCoverage=99%, HitCoverage=95%, E-value=2e-91, Identity=35%"; Hit description =Sister chromatid cohesion 1 protein 1
  Pfam annotation: Domain name=Rad21_Rec8; Domain location=613-667; Score=73.0; E_value=9.8e-19; Accession=PF04824.7; Description =Conserved region of Rad21  Rec8 like protein
  Pfam annotation: Domain name=Rad21_Rec8_N; Domain location=1-80; Score=62.8; E_value=1.1e-15; Accession=PF04825.4; Description=N terminus of Rad21  Rec8 like protein
  Pfam module annotation: Pfam domain module=Rad21_Rec8::Rad21_Rec8_N; Domain location=613-667::1-80
MAATMHAKINRRKLDKLNIINICEEILNPSIPMALRLSGILMGGVVIVYERKVKLLYDDVTRFLVQSSTLTFPANSVSFSLHFSAFVSYGYKVEINEAWKVKAAPDPTLLPKSKSKAKKEAVTLPGTGETNVADIEQSLQFSNTGTTNGFQHNAYFTMRLDSVDEPFISNGAREDQDQSELLHQVDAENITLFERFETFQANADPYNHLLFERFERFDIEGDEETQVNVTSADQIPTTLVPSPPHQDEPTRAYANTGVLMEETTVPSRPNSFMTQPRYGLTTPSNLVPHHNLEAWKVVCPDTFQDHHPGHPDIQQPSEGMIPRQEPKRRGPNKRKRGQPSTIEMDYEQTIIPAHIYQHWLQNASDIVSRRGRKKKLTDVMSSTKIANLMKLPPVVLIGDLFTAENDNIYYPKAIMDLWIKSIQPPHDSPSAHHPPEPSFSSPPGVQNEDFMQFPSEDFDSRPDYQAPPMEKAREHILLDELTTSLLRGHEATPHISSGKAGDSVHSFPRPTSENGPASHSDFDSGRTVNRFKNKRYSSSANSSGGLEPLGGLEPLAEDVNFKLARLYEDGPTPDQELFVETGPTQTQANINHPSDKITDSIQAQMKAHFDTPGAPPVESLHNLAAGMTRTSAAQLFYQICVLASRDALKVDQKVPYGEIVFSRGLKM

SEQ ID NO: 163667 - protein, 136 aa, Glycine max
  Coding DNA Sequence Number=SeqID_46889
  Gene Ontology: Mol. function=ubiquitin-protein ligase activity; Cellular component=ubiquitin ligase complex; Biological process =protein ubiquitination
  Homolog annotation: Hit_ID=Q1SEL7; Match level="QueryCoverage=92%, HitCoverage=17%, E-value=3e-51, Identity=81%"; Hit description=Zinc finger, RING-type; U box
  Pfam annotation: Domain name=Arm; Domain location=1-41; Score=22.2; E_ value=0.0018; Accession=PF00514.13; Description=Armadillobeta-catenin- like repeat
  Pfam annotation: Domain name=Arm; Domain location=42-83; Score=6.4; E_ value=1.9; Accession=PF00514.13; Description=Armadillobeta-catenin -like repeat
  Pfam module annotation: Pfam domain module=Arm::Arm; Domain location =1-41::42-83
YNPNKVSVVKAEAVPVLVELLMDDKAGITDDALAVLALLLGCSEGLEEIRNSRALVPLLIDLLRFGSVKGKENSITLLLGLCKQEGEVVARRLLANPRSIPSLQSLAADGSLRARRKADAVLRFLNRCCSQPHHCV

SEQ ID NO: 163668 - protein, 177 aa, Glycine max
  Coding DNA Sequence Number=SeqID_46890
MGAKYLEAVKQRLHAIKQWFPDEIRTLQGTTQTLTHDIDMWQLTSEVNGQRPNWASRTNFVAVTPLDYAQGWPWTGLLTTKDVWEIEHLEMHKEAKGGSGTDQNNDTLVFLFFTATHFVALVRSLAFVVMFLSIMRKLGLAFASLFLSLPNRPLDCYCNLPYVLKLLDFPKSYCKLH

SEQ ID NO: 163669 - protein, 153 aa, Glycine max
  Coding DNA Sequence Number=SeqID_46891
MSISLTRLAWSMWGGRGKEKKPVSSKASALNSKQSSEWGLAKETKMGPPHRKVGRNKEERRVDREYDDDVVLVPCDNDCNCDCCLSGSESDDSDWSIGWLEPLASDFRSNGDDGFAVLVPCYKPSCCKVVEEASNKALLGVIKNLSNEFSSEM

SEQ ID NO: 163670 - protein, 595 aa, Glycine max
  Coding DNA Sequence Number=SeqID_46892
  Gene Ontology: Mol. function=zinc ion binding; Cellular component =cellulose and pectin-containing cell wall; Biological process =metabolic process
  Homolog annotation: Hit_ID=Q9SIZ3; Match level="QueryCoverage=93%, HitCoverage=93%, E-value=0.0, Identity=66%"; Hit description =Expressed protein
  Pfam annotation: Domain name=DUF248; Domain location=93-587; Score =1031.9; E_value=0; Accession=PF03141.7; Description=Putative methyltransferase
  Pfam annotation: Domain name=Methyltransf_11; Domain location=212 -307; Score=28.2; E_value=2.9e-05; Accession=PF08241.2; Description =Methyltransferase domain
  Pfam annotation: Domain name=Methyltransf_11; Domain location=459 -554; Score=2.5; E_value=0.031; Accession=PF08241.2; Description =Methyltransferase domain
  Pfam annotation: Domain name=Methyltransf_12; Domain location=212 -305; Score=7.7; E_value=0.085; Accession=PF08242.2; Description =Methyltransferase domain
  Pfam module annotation: Pfam domain module=DUF248::Methyltransf _11::Methyltransf_11::Methyltransf_12; Domain location=93-587::212 -307::459-554::212-305
MAILAEDFFKERKYPFIVTLLILLICVTLFLFSFNHTTSNTVAFYSVIQEKPPLNPSQASADYTANPKVQELPPNVTNVRFDWKLCKEPQNVDFIPCLDNFKAIKALKSRRHMEHRERHCPETRLHCLLSLPKGYKVPVPWPKSRDKIWYDNVPYSKLVEYKKDQHWVVKSGKYLVFPGGGTQFKDGVDHYIKFIEKTLPAIKWGKHTRVILDVGCGVASFGGYLLDKNVITMSFAPKDEHEAQIQFALERGIPATLSVIGTQKLTFPDNGFDLIHCARCRVHWDADGGKPLYELNRILRPGGFFAWSATPVYRDDERDQKVWNAMVDITKAMCWKVVAKGHDSSGIGLVIYQKPTSSSCYEKREENNPPLCENKDGKNISWYARLDSCLTPLPVDGKGNLQSWPKPWPQRLTSKPPSLPTDSDAKDKFFKDSKRWSELVSDVYMNGLSIKWSSVRNVMDMNAGYAGFAAALIDLPVWVMNVVPIDVPDTLSIIMDRGLIGMYHDWCESFNTYPRTYDLLHASFLFKYLEQRCDIVDVAVEIDRILRPNGYLVVQDSVEILNKLNPILRSLNWSVTLHQNQFLVGRKGFWRPTSS

SEQ ID NO: 163671 - protein, 131 aa, Glycine max
  Coding DNA Sequence Number=SeqID_46893
  Gene Ontology: Mol. function=transposase activity; Cellular component= membrane; Biological process=transposition, DNA-mediated
  Subcellular localization annotation: CTP_CleavageSite=21; ConfidenceScore=5.12e-01
MENLAQVAGLNAMSVTNTVITAAHNARAHRRNCERMAAQVRMIWNLLEALKSTEVARLPATKEPLDGLEEALQEALDLVESCKDRSYLYMLAMGWSVVNQFRHVQAQIDRYLGLVPLISVVHDFRMQVRDK

SEQ ID NO: 163672 - protein, 64 aa, Glycine max
  Coding DNA Sequence Number=SeqID_46894
  Gene Ontology: Mol. function=transporter activity; Cellular component= integral to membrane; Biological process=transport
  Homolog annotation: Hit_ID=Q39LX0; Match level="QueryCoverage=100%, HitCoverage=13%, E-value=1e-17, Identity=71%"; Hit description=Major facilitator superfamily (MFS_1) transporter
  Subcellular localization annotation: CTP_CleavageSite=17; ConfidenceScore=5.02e-01
MSTLPLENTLPASQPVRSVSDVARLINTRSSKNNYARMIVFLALGGVFLDAYDLTTLSYGIDDV

SEQ ID NO: 163673 - protein, 237 aa, Glycine max
  Coding DNA Sequence Number=SeqID_46895
  Gene Ontology: Mol. function=receptor activity; Cellular component =integral to membrane; Biological process=amino acid transport
  Homolog annotation: Hit_ID=Q1TUN1; Match level="QueryCoverage=97%, HitCoverage=44%, E-value=1e-53, Identity=46%"; Hit description=NLPA lipoprotein
  Pfam annotation: Domain name=Lipoprotein_9; Domain location=2-230; Score=79.9; E_value=8e-21; Accession=PF03180.4; Description=NLPA lipoprotein
MTGEQKLIDYVGEHIAPDYGLKLEAVGVQDPVQADRAVAEGQYAATVYQHQWWLKQVVDANGFQLTSSLPLFQWAFGIYSDRYHSVADLPQGATIVVPDDGANQGQALWLLARQGLITLDPTVEPRTAKLKNIVGNPHGFVFKELDLLTMPRALNSVDAAIGYVSQFDAGKVPRDKGILFPPAPRTFASQLVIGTPYLEQENIVKLRQAFADPRVQQWLKTTDDPLVKGVLVPVSAE

SEQ ID NO: 163674 - protein, 193 aa, Glycine max
  Coding DNA Sequence Number=SeqID_46896
  Gene Ontology: Mol. function=RNA-directed DNA polymerase activity; Biological process=RNA-dependent DNA replication
  Pfam annotation: Domain name=zf-CCHC; Domain location=86-103; Score =6.0; E_value=0.1; Accession=PF00098.13; Description=Zinc knuckle
SHERRPLDFSHNLPLGFATIVVGQNIGNFLGEFLDYDDKHNSISWMSFMKIRVLLDITKPLECTKKIRKEGGDEKIINFKYERLSLFCYLCGFLGHTEDFCSKLFKVQVDDGQRSWDTPPSSMAAGSRYLREEGQSSYVAQQDLGVANSMPFNSNLKPANNEALIAAEKKHNELLIAALKSPNILLPQPSIAH

SEQ ID NO: 163675 - protein, 248 aa, Glycine max
  Coding DNA Sequence Number=SeqID_46897
  Gene Ontology: Mol. function=chitin binding; Cellular component =extracellular region; Biological process=chitin metabolic process
  Homolog annotation: Hit_ID=UPI000044A8F0; Match level="QueryCoverage =76%, HitCoverage=99%, E-value=9e-29, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
HVLAFRGLHVLAFRGLHVLAIRGLHVPTFKGLHVLTIRGLHVLTFRGLHDLTFRGLHAFTFRGLHVLTIRGLHALTFRGLHVLATRGLHVLAFRGLRVLTFRGLHALAFRGLHALTFRALHVLTFRGLHVLVIRGLHVLTFRGLHAITFRGLHIFTFRGLHVLAFRGLHTLSFSGLHALAFRGLDALVFKGGRAHKTPSGPREVQQGPGVSSSGYGPLDHARKTPSGPGEVQQGLGVSSCDYGPLSVL

SEQ ID NO: 163676 - protein, 144 aa, Glycine max
  Coding DNA Sequence Number=SeqID_46898
MVPLSVNLEKLSANPCGNVQLSEPCLTKPPMASRKHKTIGSRPTTQYDTRRFHSLDSWNRYTDNVLGRNIFPERKVELYHTEQDDFKIELERHNFHKHLTNLVDGSIDLALGPSPKQARVKGHLVKIDADSLNTFLETPVVLLE

SEQ ID NO: 163677 - protein, 136 aa, Glycine max
  Coding DNA Sequence Number=SeqID_46899
MTKPRLQCTSCSSSLLLGLFSPNRPVAAQEFYALAVCRSCHKCVIKVRTDLAHIARCRNLPFSGRATRGLTGASSKEGKRAESPPAFIRGKRRKNRKKALSTTLSGKGSGVVFTHGEGCFLCSYVFLNCDKEIRPT

SEQ ID NO: 163678 - protein, 401 aa, Glycine max
  Coding DNA Sequence Number=SeqID_46900
  Gene Ontology: Mol. function=RNA-directed DNA polymerase activity; Biological process=RNA-dependent DNA replication
  Homolog annotation: Hit_ID=Q8H6Q8; Match level="QueryCoverage=99%, HitCoverage=50%, E-value=7e-42, Identity=35%"; Hit description=CTV.20
MAIPFKTKDVNEEVTSKDIKSLMEQANYTNKYLQALGETIKTKVVPKQKSIEEASPSIPIEKPLFKPFKVSEKAKRKIRELRKTKSLIEGVGDNHSELLNKIGSLLKVIPDTPQASENTSKMVTRSTSKLINVINEDSDQNSDYTTEIGSVSEKNINSINSKHWKTPSKLYYQRPTAPDLLLEERDAQTEYNIMNTLQHMTMVAMTYQTSHECSEETIIDILVAGFSGQLKGWWDNYLTNEEKSKIYSAVKTDLNGKVITNDDDKEIPDAVNTLIFTIAQHFIGDPSLWKDRSAELLSNLKCRTLAYFRWYRDTFLTRVYTREDSQQPFWKEKFLAGLPRSLGDKVRDKIRSQSANGDIPYESLSYGQLISYVQKVVLKICQDDKIQRQLAKEKAQTKKDL

SEQ ID NO: 163679 - protein, 149 aa, Glycine max
  Coding DNA Sequence Number=SeqID_46901
  Pfam annotation: Domain name=zf-CCHC; Domain location=129-146; Score =9.2; E_value=0.031; Accession=PF00098.13; Description=Zinc knuckle
MPHIVVITLARRKKENTKIVTIMKKDIGHILDLTPIGKKKKESLKRLTLTSHTPIGKKKKESLKRLTLRVEQQLKRKSTSKSYGSHSYPKKDQGQGILGVTPSKPKDDKGKTIEKQPLKASMKEKGSSMKWFNCLGRGHITSQCPTIKP

SEQ ID NO: 163680 - protein, 180 aa, Glycine max
  Coding DNA Sequence Number=SeqID_46902
  Homolog annotation: Hit_ID=Q4UV59; Match level="QueryCoverage=26%, HitCoverage=16%, E-value=2e-08, Identity=65%"; Hit description=CDP -diacylglycerol-glycerol-3-phosphate 3- phosphatidyltransferase
HNIIMNLRCRCPERPTQLQGWRLTSDCTPVSPDGKGIENEKGAEAPFRLPAESRGFNRLMFGAGNEARTRDLNLGKVALYQLSYSRMGLHVWRRGALFSGAAGLSACKPFLIANRFRDCPINLVIDQKARILHDFFRSCLPSLISGACFIACLPGPADRFKCFKLYAAGVESAAKLNQVI

SEQ ID NO: 163681 - protein, 381 aa, Glycine max
  Coding DNA Sequence Number=SeqID_46903
  Gene Ontology: Mol. function=UDP-N-acetylmuramate dehydrogenase activity; Cellular component=cytoplasm; Biological process =peptidoglycan biosynthetic process
  Homolog annotation: Hit_ID=Q7WGH4; Match level="QueryCoverage=90%, HitCoverage=98%, E-value=1e-117, Identity=64%"; Hit description=UDP -N-acetylenolpyruvoylglucosamine reductase
ASTTACTTCRRCWDYEPGRHHEKKDPRGSFFICVPAASHDHGFGFQRHAIAIHDRVLDRTRQRHDVGRRGAAAIHQHQRLPIMHAGGAQLASFPAALIDQPARGKLETPVRLRIGNQPWETLEQRITLRGRDDGILEKAAGIARNGGIRQLGAPDLADRIEDGARGRFPRDQARMALQVGICQHRTPRPRQAQAHRHDDPAAGRLMLEHAVAIGEAAVGGGHLHVAARAHIPGRQTVEAVGQLDAIGTDVLHRRRAHGARDQGQVFQTVPALPDALGDEAMPGFTAGGLHQPGIGLRPQQAHTAQRHPRHQAGHGLGQHQIAAAAQHQQRGMARGQLGQGRQLRDIIQRHAGLGHGHQAEGIEPGKILRRSGQHGRRSGGI

SEQ ID NO: 163682 - protein, 433 aa, Glycine max
  Coding DNA Sequence Number=SeqID_46904
  Gene Ontology: Mol. function=transferase activity; Cellular component= mitochondrial inner membrane; Biological process=metabolic process
  Homolog annotation: Hit_ID=Q7WGH8; Match level="QueryCoverage=61%, HitCoverage=96%, E-value=1e-131, Identity=80%"; Hit description =Probable inorganic polyphosphate/ATP-NAD kinase (EC 2.7.1.23) (Poly(P)/ATP NAD kinase)
  Pfam annotation: Domain name=GntR; Domain location=309-370; Score =7.1; E_value=0.012; Accession=PF00392.11; Description=Bacterial regulatory proteins, gntR f
  Pfam annotation: Domain name=HTH_11; Domain location=316-377; Score =10.8; E_value=0.0059; Accession=PF08279.2; Description=HTH domain
  Pfam annotation: Domain name=HTH_5; Domain location=310-362; Score =13.5; E_value=0.016; Accession=PF01022.11; Description=Bacterial regulatory protein, arsR family
  Pfam annotation: Domain name=HTH_DeoR; Domain location=318-373; Score= -0.5; E_value=0.069; Accession=PF08220.3; Description=DeoR-like helix- turn-helix domain
  Pfam module annotation: Pfam domain module=GntR::HTH_11::HTH_5::HTH _DeoR; Domain location=309-370::316-377::310-362::318-373
VPVQLAAQGGKEAVAFRMHEADGVGRALHHDAVAGLQVGPGLHVEMHAGPDFDAAHGGERHVQHAAVGNDDGTVGQGLRRHRHQHHGVHAGVQDRAVGRQRIGGRAGGRGDDQAVGALRVHEGAVEFDAHLDHAAAPGAVQHHVVQGRGRVHLLVAAPRAAFEQHALFDLEVALQHARQRAVRVLHGNVGDETQVAVVDADHRHAVGREVARGAQHRAVAAHDHRQRRILADLFVSGDRVFREAGVAGRAGVLVSADQRDGRKVHGGEANQKNEIGPESGLLADYMGPHIGLRDKNRLNWKRFPKIPAMDDRARALLKALIERYIADGQPVGSRTLSKVFDLSPATIRNVMADLEELGLIHSPHTSAGRIPTPRGYRMFVDSLLAVQSYQLEPHNMGDMLAAAEPTRAVNAAAALLSNLTQFAGVVLTPKRAQ

SEQ ID NO: 163683 - protein, 119 aa, Glycine max
  Coding DNA Sequence Number=SeqID_46905
  Homolog annotation: Hit_ID=Q8W239; Match level="QueryCoverage=40%, HitCoverage=18%, E-value=6e-13, Identity=70%"; Hit description=GT-2 factor
MELIGDTTTVMETSSGEAVAAHDGGEVIMMDANSGEEENNNKGEEGEEEEEGDNKINSNNNSLCGGNRWPRQETLALLKIRSDMDAVFRDSSLKGPLWEEVASFSSSFVYAAFLFSLSC

SEQ ID NO: 163684 - protein, 456 aa, Glycine max
  Coding DNA Sequence Number=SeqID_46906
  Gene Ontology: Mol. function=DNA binding; Cellular component=nucleus; Biological process=porphyrin biosynthetic process
  Homolog annotation: Hit_ID=Q8W240; Match level="QueryCoverage=62%, HitCoverage=76%, E-value=2e-41, Identity=64%"; Hit description=GT-2 factor
KLSELGYHRSAKKCKEKFENVYKYHKRTKESRSGKHEGKTYKFFDQLQALENQFTVSYSPKPQPTLATTTNIITLPPPTRPSDTTAISYVTTTVPSTNPTIISPSPQPPTHATTTTTITSPTVATNPKNPPQSNNNSNIPNYSLLNMNNLFSTTSTSSSTASDEDLEEKYRKKRKWKDYFRRLTRQVLAKQEEMQKRFLEAIDNREREQVAQQEAWRIQEMARINREHELLVQERSTAAAKNAAVIAFLQQLSGQHQNSTTTKAGANFLQQPLPQQVQPPPQQAPQPLMMSNNNNIEIQKMNNGHSVVAAATPTTVVAATAIATTAVTTTPSSLSSLSSSRWPKTEVHALIRLRTSLEAKYQENGPKAPFWEDISAGMLRLGYNRSAKRCKEKWENINKYFKKVKESNKQRREDSKTCPYFHELEALYKEKSKTTQNPFGASFHNMKPHEMMEPLM

SEQ ID NO: 163685 - protein, 111 aa, Glycine max
  Coding DNA Sequence Number=SeqID_46907
MPNVPLGNDMMKVGVKEVRDVDAHVPVPTEEDKQRPEGPTKPADRPKPDDDPICQRTLMIPQLFLKLMSWDATVFRVYNDNVPLYIKHEDLGEIAHDGQHLNIVVIQLWII

SEQ ID NO: 163686 - protein, 136 aa, Glycine max
  Coding DNA Sequence Number=SeqID_46908
MKTGPVQIDRSSNIEVSQPTLLRVSEARLTGASSKEENARSRHQRLFVENVGKTEGNRSKRIFQVRELYLRLRKVDKSGALAPTYPPSKRKSDLRSSFLRVNQAILFTWKVIILRRWTLKMIHLLVIFVDELDFAS

SEQ ID NO: 163687 - protein, 440 aa, Glycine max
  Coding DNA Sequence Number=SeqID_46909
MNKNYKLSEYTFRLSTAVNKLTMHLTKVKEQIANVRDYITIRNIFDRPKDIVDLLKALIYPQQKGAENPKIFEGTNLVTKGIEVFRQKHVLLFISGLDSIEDEISLLNSIYERLQEDPREAKGFKKEDFKILWIPIVVKWSQSSREQFKALKSGTKFYAVEYFFELPGLKIIKDTERLNYEIQPIAPLFSSKGTLLNGNALEVIFEWGIEAFPFRKIDGDELTQKWKWLWDLILKATPGLQVKENRYIFIYGGANNTWVQNFTQELSKIKMNQSIQRADIIIENYQLGKGKGELNNSVPSFWIGVERKKQNKKHQEAVDCEIQKIVKCLFCLKRDPQGWAILSKGHNIKHLCHGQAVYQTVAEFQNWKEKVFEREGFDIAFKEYYDAKEKEISDTQPCEDYTSASSVIATIACPNPTCGRVMEVSSVNYKCCHRDDALNC

SEQ ID NO: 163688 - protein, 689 aa, Glycine max
  Coding DNA Sequence Number=SeqID_46910
MGSNTIYFTTRQGLLCSQHKPHKIPVIMAWVLSNTATSATTPEHKDQLPNPFELQDSQIRHKVYLTHVNDDKEFDRDILFTLVSNTVNSTSAQLSAATTSVTSLKPDFPTLKRLSCQMITTRGTPECAHQTALRILQQLSGFSWDAKALIAVAGFSLEYGEFWRLDRVQAADQFGNSLKQLNQVQISRRVPADMIDLVTVLGEVLSYINLWAKWSAMDYDTEAVHSLQAAMQEIPLVVYWTIASTVASIGNLVGISEHKLSAYKERLEFIFKKLQFHLENCRVEIGRIQDYHIRFNIRYPKIKDVVELLDILIIPGSDNGTSIPKIFEGGVLIKNGIEVFKQKYVMLFFSSLDSIGDEILLLNSINNGLQENPGEEIKGFKKGDFKILWIPIVDDWKSKREQFTNLKEKIKFYLVEYFEELPGYDIIMDKFKYEGLPIVSVVNPQGQIMNENALQIIFEWGIDAFPFRRSDVYDLNKKWKWFWNLLEQTDDNAKRLGKDNTSYAFIYGGNDSSWVQNFKIAIGKIEKHVINNVDINIEPYQLGESNPDNVPSFWIGLDGKKKNKGCKDKVDCEIQEVVRTLLCLKQDPSGWVVLSRGRNLKILGHAEPMYQTVLDFEKWKNKVLEKETFDVAFKEYYDVVKEKYASLPYDHTSSVLATITCPNPLCGRVMEVTSINYRCCHGSANSCNL

SEQ ID NO: 163689 - protein, 588 aa, Glycine max
  Coding DNA Sequence Number=SeqID_46911
  Gene Ontology: Mol. function=RNA binding; Cellular component =ribonucleoprotein complex; Biological process=regulation of translation
  Homolog annotation: Hit_ID=Q2R1U8; Match level="QueryCoverage=99%, HitCoverage=60%, E-value=1e-115, Identity=44%"; Hit description =CRS1/YhbY domain containing protein, expressed
  Pfam annotation: Domain name=CRS1_YhbY; Domain location=205-288; Score=94.5; E_value=3.2e-25; Accession=PF01985.11; Description=CRS1 YhbY domain
  Subcellular localization annotation: CTP_CleavageSite=94; ConfidenceScore=5.61e-01
MALVPTCHLHPFFDSFHASPSFHSLLFRHSPNSTFLRPKPPFIFRCNPAKSFSTDKHWLKRWNDPTNNHARPKPPRAVLGYSENGDASKSGLASSDEEGGDGNTGGITLDRIVEKLKKFGYVEDGIQNKERVIEKGSVEDIFYVEEGMLPNSRGGFSSESPLGFGSFGSDDGEVRFPWEKPVVEELEERKSMRSRSKTSLAELTLPESELRRLLKLTFEKKHKTRIGRSGVTQAAVDKIYERWKTSEIVRLKFEGEAALNMKRMHEILERKTGGLVIWRSGNSVSLYRGVSYEAPSVQQNKKIYRKSKNSSKLLPTPSYSVGNSPNAASTSGTSAPLANLESTNDNKEKDYLPKVNYEHEVDKLLDGLGPRYTDWPGCNPLPVDADMLPATVPGYQPPFRVLPFGVRATLGLREATSLRRMQGPSSTFCIRNRQVQGLAVAMTKLWEISSIAKVALKRGVQLTTSERMAEEIKLCFLEHLFIISESKLTGAILLSRNKDFLVFFRGKNFLSADVTQALLERERMAKVMQDEEEQARLRASSLLIQTNNTSDLSAEAGTLGETLEADAKWGETLDERHKQKIMREVEQL

SEQ ID NO: 163690 - protein, 144 aa, Glycine max
  Coding DNA Sequence Number=SeqID_46912
  Gene Ontology: Mol. function=GTP binding; Cellular component=signal recognition particle, endoplasmic reticulum targeting; Biological process=SRP-dependent cotranslational protein targeting to membrane
  Homolog annotation: Hit_ID=Q2R1U8; Match level="QueryCoverage=87%, HitCoverage=16%, E-value=5e-42, Identity=60%"; Hit description =CRS1/YhbY domain containing protein, expressed
  Pfam annotation: Domain name=CRS1_YhbY; Domain location=12-109; Score= 48.0; E_value=3.1e-11; Accession=PF01985.11; Description=CRS1  YhbY domain
MAVEMGTILVEVAEAERKLRRAEKALMKLESFLKPSEYKTDPESRCGVFDGTIENMHLHWKYWELVKKIVKAKTFERVKKIALALEAESGGVLVSVDKVSKGYSVIVYRGKDYQRPSTLRPKNLLTKRKALARSIELQRHEKPM

SEQ ID NO: 163691 - protein, 656 aa, Glycine max
  Coding DNA Sequence Number=SeqID_46913
MSLSNGADSTATSKQQKPQLPNPFDLTDSEILEKVYLTHLHDEDKCDVEVLLDIVSSIVLKTRLAEGKASQTIFQPEFRTMKLISCQMITTPHGERYVHQTTMCILQHLRSYSWEAKALVTLAAFALEYGNLLHLSDVETPENQLTNSLKQLNQVQARKNPGTTLVELVMEVLHGIQEWSRLSGLDYDIVEVPSLTDAQQEVPVVVYWMIASLVAATANLVALSEYKLADFLDRLSSAADKFKEHLKSSVVQKGYADENYKRRKAFSNPKDIVEFLKLLIQHNGSKVQIYDGSIKTKTDIEVFNQKYVLLFISSLDKIEDEISLLNTIHDRLQENPNEVVKNYKKGDFKILWIPIVDTWDDKQKHKFNILKNTIKWYAVEFFTELPGTDLIKEKFNYLGKPIAPVLTPLGDRMNEDAMDLIFQWGIDAFPFRKIDGIDLTLKWKWFWDATKKANLGIQQVTGDRYIFISGGADKKWIQDFAVAVEKTRGHAIILNTDTIIDHYQLGKDDPTDVRRFWIEIERKRLKKHKDAVDCEIQKVVKTLLCLKQDQQGWAILTKGSNVRILGHGEPMRQTLAEFDTWKDKVFQKEGFDVAFDEYYKTKLDELYARQQCAFVKNNADVLVTITCPNPTCGRVMEVTSVNYKCCHRDASNNGNI

SEQ ID NO: 163692 - protein, 46 aa, Glycine max
  Coding DNA Sequence Number=SeqID_46914
MNARRREYMLGVLPKRRILMRHVKSQGKSGYGGVYHHTRPQHSVNG

SEQ ID NO: 163693 - protein, 69 aa, Glycine max
  Coding DNA Sequence Number=SeqID_46915
MVVPGDNGEKEEEEGGGMWVTQMRSRTSLGCDVMIILLMRNNFIGKVIKFTHVPMAGGRWYENRSLSID

SEQ ID NO: 163694 - protein, 84 aa, Glycine max
  Coding DNA Sequence Number=SeqID_46916
MENVKDKGDEALYDKLDSAYPSDDENYEVEDGEDGEEGDEAYLETHNSENDSEIESEVESDNMYPPIFLPHQVEGQGSFDFGDT

SEQ ID NO: 163695 - protein, 450 aa, Glycine max
  Coding DNA Sequence Number=SeqID_46917
  Homolog annotation: Hit_ID=Q10GG7; Match level="QueryCoverage=96%, HitCoverage=80%, E-value=1e-125, Identity=54%"; Hit description =H1flk, putative, expressed
  Pfam annotation: Domain name=Zeta_toxin; Domain location=111-329; Score=-76.2; E_value=0.064; Accession=PF06414.2; Description=Zeta toxin
MESEVPAELCRLADEYLIKPKECLESILEYLADQKDPTTLCQKFINEFDRCILSYFAFNWNQASYIISQVLSVESPPKIRLKKILLEATREQRFERVTKNLKVARVFSTLVEEMKAIKLDSQRTNDMVHNVHSERSPVLLLMGGGMGAGKSTVLKDILKESFWSGAASNAVVVEPDAFKENDVIYRALSSRGHHDDMLQTAELVHQSSTDAASSLLVTALNEGRDVIMDGTLSWEPFVEQTITMARNVHKHRYRMGVGYKVSEDGTIITEDYWEQVDDAEEHLQSEENCNGESRTRKPYRIELVGVVCDGYLAVVRGIRRAIMTGRAVRVNSQLKSHKRFANAFPRFCKLVDDARLYCTNDVGGPPQLKWRKDGDQNQNLPDPKDIKCLERIGSVNVEADSIYELYKDPSPIMEPGSVWKDIVLSPSRYNNDQKELKEFIQKIETSIRKR

SEQ ID NO: 163696 - protein, 126 aa, Glycine max
  Coding DNA Sequence Number=SeqID_46918
MIREAEHSPTNQGKNKLALRKCRAELITSLQLLGDYESLLTPPQLVLVEANQAAAKAIMFLSGNPVGSGCFKYMSTNDMPMKCWEERGNGQGGSGANGTITGKACPKGLYGTLSDPTTQLEQDCIH

SEQ ID NO: 163697 - protein, 102 aa, Glycine max
  Coding DNA Sequence Number=SeqID_46919
  Gene Ontology: Mol. function=hydrolase activity, acting on glycosyl bonds; Biological process=carbohydrate metabolic process
  Homolog annotation: Hit_ID=Q84K13; Match level="QueryCoverage=66%, HitCoverage=32%, E-value=3e-09, Identity=68%"; Hit description =Putative polygalacturonase
  Subcellular localization annotation: CTP_CleavageSite=69; ConfidenceScore=5.04e-01
MLPRGLNLHRDLGSLVAASASGFQLPPLPTTTPTCAGFFRDVPPRKVVLSIEDFGGGGDGKTSNTKSFRRAIRTKWDSEWSRKDVVGTLVEQNIGAHERAPP

SEQ ID NO: 163698 - protein, 354 aa, Glycine max
  Coding DNA Sequence Number=SeqID_46920
  Homolog annotation: Hit_ID=Q5DMX0; Match level="QueryCoverage=48%, HitCoverage=32%, E-value=1e-07, Identity=26%"; Hit description =Protein disulfide isomerase (PDI)-like protein 2
MADFVVGVMVSLVDITVLKRKHVYLLISSLDITEEEISVFQTVYDSIKTSDQYEIVWIPIVEEWTVEYDNKFEDFKCKMPWYAVQHSGPIAGYQYIKEEWHYKSKPMVVVLSPQGKVQHSNAFHLIQAHGTRAFPFTTVKQEQINNETDWVGSVIGNIYPIINTWIKEKKYIFLYGGKDKEWIQQFTKNVSALASDAAITEANISIEWLCVEKEDRSVMRRFWGGIESLFVTKVHKAVDAVTLEVQKMLSYKNEAGWSLLISEGSSVVVCGHGKTITDTVEGFQNWKGSLTKKGFGLSFQGYHQKIVDITHRCSYLEISNVSGRLPETIKCPDCPRIMEIFVSYKCCHNNTIHY

SEQ ID NO: 163699 - protein, 56 aa, Glycine max
  Coding DNA Sequence Number=SeqID_46921
MAMEKRKHLGFPLVTKSFKLIHNIPMPIRKHFVHKVLGPQIQTSKQLGGTVQKQNS

SEQ ID NO: 163700 - protein, 61 aa, Glycine max
  Coding DNA Sequence Number=SeqID_46922
MSVKNLIGRLRVHDKTNHTLVSQVTLTRLKGAFKPGVFTLKAYTSKSPSGPLLLDKWPHIS

SEQ ID NO: 163701 - protein, 57 aa, Glycine max
  Coding DNA Sequence Number=SeqID_46923
  Gene Ontology: Mol. function=fumarate hydratase activity; Cellular component=tricarboxylic acid cycle enzyme complex; Biological process=fumarate metabolic process
  Homolog annotation: Hit_ID=Q10LR5; Match level="QueryCoverage=83%, HitCoverage=15%, E-value=2e-09, Identity=74%"; Hit description =Fumarate hydratase 1, mitochondrial, putative, expressed
MFTTQVKYGIDRVIDTFPRMYQLAQGGTAVGTRLNTKKGLPMMLLLKLVEYILIREN

SEQ ID NO: 163702 - protein, 315 aa, Glycine max
  Coding DNA Sequence Number=SeqID_46924
MSSTKCLLQDAENEQNPLTMTDDQILEEIYSNHVGSDTKFDVDSLFTLVENTLRRSTHIVDNFVQGSHASLEHTDDKIPQFDSPLCTLKQISFEMSCKPPSDVIAHKTTLAILNNLKNYEWNAKAVLTLAAFALEYSEFWLLAQYQQSDPLAKSVAILKRVPVLTRQAALQKYRQAIVELEKLTNDLGVAIEQISVDVYWAIITIVSLTTRIDCLTTESEQKQELSHYGQKINIILSKLKKQITLCRQQIDAAEYYRKLRKLFQTPTEIMEVFKILIFNKDVPQPLYCGATKTMVCDSLLKSYFHVRNLFSSERK

SEQ ID NO: 163703 - protein, 568 aa, Glycine max
  Coding DNA Sequence Number=SeqID_46925
MSCKPQGEEIAHITTMAILVKLSNYEWDAKAVLTLAAFAMEYGEFWLLAQNQPTDPIAKSVAALKGVPVLTRPAALQKHRQAITELNNLVKTTLLVIELIFELEKLTTFDTKDVPALLPAIEQIPVDVYWAIITIAAIVTQTDYLTTELGNKQDLSHYGQKMNIILSKLRKQIMLCRQQIEEAEYHQRLRKFFQTPTEIMEVFKFLVYSKDAPQLLFHGATKTTVEITELKKKHVYLLISTLDITEEEISVLQPVYDSIKTGDQYKIVWIPIVEEWNEMLHKRFEFLKSKMPWYVVQHFGAIAGYKYIKEEWHFKKMPMVVVLNPQGKVQHANAFHLIHVYGMKAFPFTIADQERIDREIHWIGSVVGDNHPHISTWIREQKYILIYGGSDKEWIHQFTKYATAFANDAALKDAKIHIELFCVEKEDKSFLRRFWSGIESLFVTKAHNTVDAVTQEVQKMLSYKNETGWAVLCKGSSVVMSGHGTTILKTLAEFEKWKEDVVKKGFEPSFKEHHERIRRTHHRCIHLEIPNAAGKLPETIRCPECGRIMEIFISYKCNHRDNTSIAIN

SEQ ID NO: 163704 - protein, 66 aa, Glycine max
  Coding DNA Sequence Number=SeqID_46926
MNSWGSRLDGGGWMNEKLFMGLGIRFEGCMNDKHFMGLRIRFEGGGYTNSARQSTPGAQDSMAEDA

SEQ ID NO: 163705 - protein, 92 aa, Glycine max
  Coding DNA Sequence Number=SeqID_46927
MAQLSNGTSSTTLISKSGTTSIPHRASLPNPFDLTDDQILDIVYLAHLNDDETCDTDKLYNLVSNIVLRSQSPISAASFKPDFLTLKLISCQ

SEQ ID NO: 163706 - protein, 789 aa, Glycine max
  Coding DNA Sequence Number=SeqID_46928
  Homolog annotation: Hit_ID=Q8ZLX6; Match level="QueryCoverage=49%, HitCoverage=59%, E-value=1e-131, Identity=62%"; Hit description=2,4 -dieonyl-coa reductase
  Pfam annotation: Domain name=3HCDH_N; Domain location=100-225; Score=- 103.4; E_value=0.011; Accession=PF02737.8; Description=3-hydroxyacyl -CoA dehydrogenase, NAD binding domain
  Pfam annotation: Domain name=DAO; Domain location=102-495; Score= -44.3; E_value=0.0049; Accession=PF01266.14; Description=FAD dependent oxidoreductase
  Pfam annotation: Domain name=NAD_Gly3P_dh_N; Domain location=101-241; Score=-60.3; E_value=0.1; Accession=PF01210.13; Description=NAD -dependent glycerol-3-phosphate deh
  Pfam annotation: Domain name=Pyr_redox; Domain location=102-191; Score=11.5; E_value=0.0017; Accession=PF00070.17; Description =Pyridine nucleotide-disulphide oxidor
  Pfam annotation: Domain name=Pyr_redox_2; Domain location=102-271; Score=11.6; E_value=5e-05; Accession=PF07992.4; Description=Pyridine nucleotide-disulphide oxidor
  Pfam module annotation: Pfam domain module=3HCDH_N::DAO::NAD_Gly3P_dh_ N::Pyr_redox::Pyr_redox_2; Domain location=100-225::102-495::101 -241::102-191::102-271
HLRQHVSVPVIATNRINHPQVAEEIVRDGIADMVSMARPFLADAAFVSKAQAGQPDAINTCIACNQACLDQIFAGKVTSCLVNPRACHETLMPVIAAAQPKRLAVVGAGPAGMAFALQAAQRGHHVTLYEADAQIGGQFNIARQIPGKAEFSETLRYFRHQLVAAGVELCLNHRVSADELEQADEVIIATGITPRQLAIPGIDHPSVVSYLEVIRDKKPVGRRVAIIGAGGIGFDTAEFLLQHADREEDFYQSWGIDRSLQARGGLVRPQPAPADRQIWLLQRKSGKPGAGLAKTTGWIHRASLQAHGVQMWGDVEYLKIDDDGLHLRHQGEALTLAVDNIVICAGQEPLRTLAQALAARGKAVRLIGGADVAQELDARRAIAQATELALSLGHQFAVAKQLLHFLMIAKVAVADDAQLAAILQAAFGVTQHLPRQVVGDRVLLMERRIAQHRMQSVRRKTAQHVVNPKLAARQILRSVELNVELAGGHRHVRFIDEQHLGLRILFQRLQANHAVTAAEIDDFALNIVRQVLQKEARANIQRRAGEHIGVIVDMIRRLVERPHGGRRHVRQRRRAEMARGIMDVFGFTGRQNQGIRRDDRPQRAQLVLKQRQRFGQLNQYRRRGSRQRRQAIKKVYRRFIQTVETQILPGRLLAEPRVADVPDFPIVQPAGQRAKARALFAHRREALKRQRAIGQFKLAHGISGVGYPENILEQVQVLIDNQRLAAFLQQRYPDTHDVVSDRALYDYTQALKNRYMRSAPPGGNLKAKAEIRISTFFRLAPEPFLRMIV

SEQ ID NO: 163707 - protein, 165 aa, Glycine max
  Coding DNA Sequence Number=SeqID_46929
MIMRGQDIYSSQDEATTSPSSSESEEAKEEKSSEEIYPQEEGQPLVVKEKCKEVSVSSKSLAKKETHFTIKTNIKETFPLRQPPHFLFCKKTLASIATPLGLEFIPQVKKFLDEDLVCKSLNPCALLGPKIGIIRHQVPKIGGMMNVLNGATLFCKITRAPNIFM

SEQ ID NO: 163708 - protein, 197 aa, Glycine max
  Coding DNA Sequence Number=SeqID_46930
  Homolog annotation: Hit_ID=Q47522; Match level="QueryCoverage=25%, HitCoverage=62%, E-value=7e-22, Identity=94%"; Hit description=LacZ protein
YDGVLEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIHRIAYGSVTEAPRLGFSSQKQFFSPKQLKCTTKGVRDPLEQPPLAYLSEKGEEVAAQLAQASWVASSISNPASKMFWKAQI

SEQ ID NO: 163709 - protein, 269 aa, Glycine max
  Coding DNA Sequence Number=SeqID_46931
  Gene Ontology: Mol. function=protein serine/threonine kinase activity; Cellular component=integral to membrane; Biological process=protein amino acid phosphorylation
  Homolog annotation: Hit_ID=Q9LY50; Match level="QueryCoverage=65%, HitCoverage=23%, E-value=9e-41, Identity=51%"; Hit description =Receptor kinase-like protein
  Pfam annotation: Domain name=Pkinase_Tyr; Domain location=1-171; Score=-171.6; E_value=0.061; Accession=PF07714.7; Description =Protein tyrosine kinase
MRIRIALDASRGIEYLHNYADSFIIHGDIKSSNILLDASWTARVSDFGWKFMRNRQRIIENTDPKYVIRGALSAESDVHGLGVVLFELLTGKRPTFVYGEDGGTLLSRKHLVDFAVTAISNGFLEKFLDQRAGQPDVNEAEAVKLVADTAIRCVNLKLKDRPTMADIVVRLERALAICDYDSIFRALESMRWKRVVGPLAASPASHFIHFCEGFGAGRNEIRWPRWWIALTSSIWKHRNLFIFQGNRFEPPKVMEDALVIYHFFSSKTC

SEQ ID NO: 163710 - protein, 86 aa, Glycine max; identical to SEQ ID NO: 149010
  Coding DNA Sequence Number=SeqID_46932

SEQ ID NO: 163711 - protein, 147 aa, Glycine max
  Coding DNA Sequence Number=SeqID_46933
MSNDRFSCVGPIELLCTVGRTPDEILNLLERSMTPTHDAVLYYNGRWNMPRQNNFVGYAFTGKNPQKFDISKGCTIDELKDLIKQLAPKGNPPHGIHESQLLKTDDDVLKVMVESNYWKQFVPIEILAFFSKPIMENEDEVVTSLQD

SEQ ID NO: 163712 - protein, 135 aa, Glycine max
  Coding DNA Sequence Number=SeqID_46934
NHTYKDTQWTRRSPIGPWGFQLWLRASVVLQGARSPQQGHVIIGSRLQDTQWTRRSPTGSWSCQALITGLCQFYGVPVTSSKGIRPPTNRAFIKKYCVSRQAQGETPQQPRDGQQRATDAPPSPLEFTSAHPQKG

SEQ ID NO: 163713 - protein, 133 aa, Glycine max
  Coding DNA Sequence Number=SeqID_46935
MSRGSGDLGDVKWGAIAQNQAWLIPTQPGHSQSVRTCDVPKQNKVHEARRLVWRLASYVSWVVSENYSLVIDYHSWCCNVPSCERVRARLTGVFSKGGKMRGVATNVYLWKTSEKPKETGQNENSKFGSCIYA

SEQ ID NO: 163714 - protein, 96 aa, Glycine max
  Coding DNA Sequence Number=SeqID_46936
MTKRARREEHGRNKFRGALWGSNRDQSGVDSLILKDELNVCSRSKRNLSQRLCETETNMLAIISKYQEELNLATAHEHRVADEMPKCTRRRRLEEG

SEQ ID NO: 163715 - protein, 122 aa, Glycine max
  Coding DNA Sequence Number=SeqID_46937
  Homolog annotation: Hit_ID=Q5CD50; Match level="QueryCoverage=46%, HitCoverage=27%, E-value=7e-12, Identity=59%"; Hit description=MAD2
MFALPLTRRKREPQRPLTLSLFPFQIPFSLVVVFGAAQPKPDLQIPLSLSDLNAYCPSHGVKVHPQGAQGLVERPTNFLQSCILYNHGVYPEESFVKVKKYGLPMLLTEDEGVKSFLADLTS

SEQ ID NO: 163716 - protein, 164 aa, Glycine max
  Coding DNA Sequence Number=SeqID_46938
  Gene Ontology: Mol. function=cysteine-type endopeptidase activity; Biological process=proteolysis
  Homolog annotation: Hit_ID=P49045; Match level="QueryCoverage=63%, HitCoverage=22%, E-value=5e-44, Identity=79%"; Hit description =Vacuolar-processing enzyme precursor
  Pfam annotation: Domain name=Peptidase_C13; Domain location=35-164; Score=-239.3; E_value=0.0003; Accession=PF01650.8; Description =Peptidase C13 family
MVVPIRVHGAAARSNRKEWDLVIKLLTELMDADSDEVGTRWAILMVGSNGYGNYRHQLLIKGGLKEENIVVFMYNDIASNQSNPRHGVIINHPEGEYLYAGVPKGDQSGSRCFARMLQPYGINIDLKEHSNPMTPKAYTPKSPLGPLPPDSGPTPKIILAHRRC

SEQ ID NO: 163717 - protein, 417 aa, Glycine max
  Coding DNA Sequence Number=SeqID_46939
  Gene Ontology: Mol. function=RNA-directed DNA polymerase activity; Cellular component=chromatin; Biological process=chromatin assembly or disassembly
  Pfam annotation: Domain name=RVP_2; Domain location=2-111; Score= -64.4; E_value=0.1; Accession=PF08284.2; Description=Retroviral aspartyl protease
  Pfam module annotation: Pfam domain module=RVP_2::RVT_1; Domain location=2-111::209-390
MGLIGDRQIVLLVDGGSTHNFIQLQLVSQLGLPTRTTNPLQVMVDNGKQLECNCLFEAVTMVIQATPFTVDLHVLPIACANVVLGVQWMKSLSLVLTDYNTLCMKFFHEGSFVEHKGDTESTWNSLSSSKFHHLCRKHPNSLYLHVIVLYEASFTKASSSSDTSPLVQALLDKFQSLFQPPHALPPPRDTDHRIHLLPQATSVNVHPYRYPHYQKQEIENQDGSWRFCMDYQALNALTIKDRFPIPTVDELLDELGGACCFSKLDLLQGYHQIRMYSSDISKTAFRTHHGYYKFHVEYLRHVVSYEGVQPVASKLEAILHWLISQSTKPVRSFLGLVGFYRCFIKGYATIAASLVKLTMLDRFQWTDQAQVAFEHLKHALSSAPVLALPDFELSFSVEIYASGTWVWESFFHSKAIP

SEQ ID NO: 163718 - protein, 621 aa, Glycine max
  Coding DNA Sequence Number=SeqID_46940
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=85%, HitCoverage=70%, E-value=2e-55, Identity=45%"; Hit description=Chromo
MTLTCIKSEEVLAQNSVEKDGHVSDDPHHMGVRKSTQLRRENILLKDFTHFRTLGLEEEDVEDSSSLIAPSDVQEVETIEPDDHHLSLNALKGGVGVSTIRLMAYIDKLPVTVLIDGGSSDNFLQPRVAKFLKLLVEPTTQFRVMVGNGNYMTAEGLVKQLKKTIGPHIADYDALQLKFLMNGKFTILQGGHNLMPEQAQLHHIRRMITTNSIVAVYSMQLLEENVSPKSFLDLPTSMKLEALNAITIKDSFPIPMVEELVDELFGATFFSKLDLRKFVVVFFDDILVYSANWKDHLYHLEVVLNILRKHKLFARFSKCCFGVQQIDYLGHTSSGSSIAMDANKLKAVQNWLKPMNLKQLRGFLGLTGYYRRFVKSYATIVAPLDLLKKDSFKWFQATAQAFQQLKIAMTFAPVLAIPNFNELFVLETDASRRGSRYDFTIQYKPGKENMLVDALARSFMMAISSPIHSWINQPLPIPQQIWVDIAMNFIVQLPTSQGFSTILVVMDRLSKFGYFIPLKANYNAKVVAEKIQNVAYKLKLPESAIIHPIFHVALLKPFHGMVSQPYVPLPLNSSDMGPVLNPLKLLDVCVVRRLEKEISQVLIQWEATKLKMLLGKICKTT

SEQ ID NO: 163719 - protein, 166 aa, Glycine max
  Coding DNA Sequence Number=SeqID_46941
  Gene Ontology: Mol. function=kinase activity; Cellular component =integral to membrane
  Homolog annotation: Hit_ID=Q10JV0; Match level="QueryCoverage=97%, HitCoverage=30%, E-value=3e-42, Identity=55%"; Hit description=MAP kinase-activating protein C22orf5, putative, expressed
  Pfam annotation: Domain name=DUF300; Domain location=1-152; Score =66.7; E_value=3.6e-17; Accession=PF03619.7; Description=Domain of unknown function
MILKTVYALLAFILELAGVYGDGEFKWYYGYPYIAVVLNFSQMWALYYLVQFYNVTHERLQPIKPLAKFISFKAIVFATWWQGVGIAVLCTFGVLPNEGKFQTGLQDFLISIETTFMSMAMQMAIAAVAHVFVFSAKPYHFLPPAAYGKITKETIGAALEIDEGSK

SEQ ID NO: 163720 - protein, 332 aa, Glycine max
  Coding DNA Sequence Number=SeqID_46942
  Gene Ontology: Mol. function=RNA-directed DNA polymerase activity; Cellular component=chromatin; Biological process=chromatin assembly or disassembly
  Pfam annotation: Domain name=rve; Domain location=141-278; Score =46.5; E_value=9e-11; Accession=PF00665.16; Description=Integrase core domain
  Pfam annotation: Domain name=zf-H2C2; Domain location=82-123; Score =24.5; E_value=0.0002; Accession=PF09337.1; Description=His(2)-Cys(2) zinc finger
  Pfam module annotation: Pfam domain module=rve::zf-H2C2; Domain location=141-278::82-123
MGDQVISIFCQLQYFKGYLDILASEGLLSETSSLSKKHCNAILQSPAAHPEFIIVNNLILHQKRIWLPRDFQMIPTLLTEFHLTPTGGHMGIAKTLAQISENFSWPGLHNDVRKFIAQCVDCQHTKYKTKKSVGLLCPLPVPHRPWEELSLDFIMGLPLYHGNSVILVVVDRFSKGIPLGMLPADHTAHTIASLFMEIVGNFWRELFQFSGTQLRVSSAYHPQSDGQTEVMNRIIEQYLRAFVHRKPQTWGKLLLWVEWSHNTSWNVATGTTPYDITFELKPFNFLDYITRSSKLDAVEEMLKDRDETFQIIQKKLLKAQTTMKHFADAKRK

SEQ ID NO: 163721 - protein, 133 aa, Glycine max
  Coding DNA Sequence Number=SeqID_46943
MSAKASSEVQGLAHYLSLGYPGLSQEDYHLEDKVILQGPPDDSIAVTKVQLAESGAKQAEMRATRRPAAADAVESPRTRDVDERGGINVTMRLKYMRLVSRSPSSTGLENSSAIVAKRDEEGGGWDWRRETWK

SEQ ID NO: 163722 - protein, 179 aa, Glycine max
  Coding DNA Sequence Number=SeqID_46944
MEAEVATDVVTRMATSEEGTSHENPTDLTILTRFHPIKEQRLIDLRLAFASGEINPLTGKTMINNNLVEVVVVASSSCLKRSKTSTPSSGLDGATLTPSPTVLPARTFALTETSRPIIKAWKTSLLERGKEIVKSEKDSDFSLTLDTSFTSIDLQRTSGESSHQNQNKKYKNGEDRNSN

SEQ ID NO: 163723 - protein, 92 aa, Glycine max
  Coding DNA Sequence Number=SeqID_46945
MATELQRKQDKLNRQLMEMQKELFNNLHAHLEPQVNAIEPPLIEVTSQPPQIVENALATIITFTTPHEITLLTTFALTGVSEESIQDLLCLQ

SEQ ID NO: 163724 - protein, 69 aa, Glycine max
  Coding DNA Sequence Number=SeqID_46946
MSQNFTYCATKGAKYLKAVKQRLHAIKQWSPDEIRACYCAERESVGITNIFCSKSLEKYNLPVSLCAQN

SEQ ID NO: 163725 - protein, 198 aa, Glycine max
  Coding DNA Sequence Number=SeqID_46947
  Subcellular localization annotation: CTP_CleavageSite=48; ConfidenceScore=5.09e-01
MPNINQAFRPSTETPLVQRPSSKGHPLNHKGPPLKLSSYTTSPRWQLQSEHKRQSRKEFPGWLIFQEDSPNVKTNPFASYGGPAVNAVEECGPQRPKQMKDVVTFRRFILKVLCEAGIIFFDGGEGDTCLVHPGAAPDVEVCPVAEDLLQGIMDQGWFEVGGGSKGEQHLCMQLADKSPSKPKPLVIHFTRDAATQKP

SEQ ID NO: 163726 - protein, 49 aa, Glycine max
  Coding DNA Sequence Number=SeqID_46948
MNLGIPRSCGSACPRTLGSRISFLNDHLEETLGPTKIGENHSKCIILTQ

SEQ ID NO: 163727 - protein, 79 aa, Glycine max
  Coding DNA Sequence Number=SeqID_46949
MVREFFTQREGKGYLVQGKLTQASQLIGLEGISSLRRMACLGLKKFHDSGEPDASLELTNNHQNPVRPLGLHCNRCQTP

SEQ ID NO: 163728 - protein, 192 aa, Glycine max
  Coding DNA Sequence Number=SeqID_46950
MMEAMMNMRKMMEAMTTATVVATNIATEMDPIHPAGSIKGEGPSTVLEKERIEHMEERLHAIEGGGTYVLANMTELCFVPEVVIPPKFKSLSDLRSLRFLFNLVKSFTSKDPQGMYPPLFSLNNLVDVPSTRTDPQEMYPLLFSVTTTQVDVPSTCTTKDVPSNVLRQSSQAVSPSKLCARGNKRILRRLVL

SEQ ID NO: 163729 - protein, 54 aa, Glycine max
  Coding DNA Sequence Number=SeqID_46951
MLSPMNHKDEDFESYANIKTKEIKASTLSPMKDKGKNIESYGNIKVGILSPMKA

SEQ ID NO: 163730 - protein, 96 aa, Glycine max
  Coding DNA Sequence Number=SeqID_46952
MCMDSSSYSPYKNLGNHNLNQKVILRTGCRIQGGMCTIGAYLNGLDNYLKGIINSALKGLDNTPQSKSKAATRWIVVKYFNDARPLEPERLKALRI

SEQ ID NO: 163731 - protein, 88 aa, Glycine max
  Coding DNA Sequence Number=SeqID_46953
  Gene Ontology: Mol. function=nucleic acid binding; Biological process= DNA integration
MLNQSLSPIIRAPTKIGNCVPYNLQVVNSHIHKHRLLSLLQVPHHLLSNYPSIIPRVQMVSTKNANYESNIDSSAYLSIYEAAQSTSK

SEQ ID NO: 163732 - protein, 181 aa, Glycine max
  Coding DNA Sequence Number=SeqID_46954
  Gene Ontology: Mol. function=protein binding; Cellular component =endoplasmic reticulum; Biological process=ER to Golgi vesicle -mediated transport
  Homolog annotation: Hit_ID=Q10M68; Match level="QueryCoverage=96%, HitCoverage=38%, E-value=3e-58, Identity=61%"; Hit description =Serologically defined breast cancer antigen NY-BR-84, putative, expressed
MESIISKLRNLDAYPKINEDFYSRTLSGGVITLASSILMLLLFYSELRTTPFSRRFHSFKTSNRNSLSFLPLPPGLYLHAVTETKLVVDTSRAETLRINFDVTFPALPCSILSLDAMDISGEQRLDVKHDIIKKRLDSRGNVIETRQEGIGAPKIEKPLQRHGGRLEHNETYCGSCYGSEV

SEQ ID NO: 163733 - protein, 138 aa, Glycine max
  Coding DNA Sequence Number=SeqID_46955
MVVHYFQYSVKCSKSDGQVTRHKIKNCQKREDNDGLFTSVGDGSVHLVGTGFTKSAYWLHCRLVTMTSLEQSSPLCCSWVESLQACIFICHIHCKWVQSMMLDAALELSLCHYEVEAIHSNFMMLLFGGSKSSKTVLF

SEQ ID NO: 163734 - protein, 116 aa, Glycine max
  Coding DNA Sequence Number=SeqID_46956
  Homolog annotation: Hit_ID=Q10M68; Match level="QueryCoverage=49%, HitCoverage=22%, E-value=4e-11, Identity=67%"; Hit description =Serologically defined breast cancer antigen NY-BR-84, putative, expressed
  Pfam annotation: Domain name=DUF1692; Domain location=4-92; Score= -86.2; E_value=0.011; Accession=PF07970.2; Description=Protein of unknown function (DUF1692)
MLHQKFYLKTYQILPLVFVVFQVVPTVYTDVSGHTIQSNQFSVTEHFRTGDMGRLQSLPGVFFFYDLSPIKIHSSITVKGLSRRRWNLVNLTDGCYLSNFERMALQRQSIQEKVDY

SEQ ID NO: 163735 - protein, 53 aa, Glycine max
  Coding DNA Sequence Number=SeqID_46957
MDLGPEVEMVKIRPNEVALHHKESTKLETLELKKTHHNEMSKVQRQEDQVQSP

SEQ ID NO: 163736 - protein, 63 aa, Glycine max
  Coding DNA Sequence Number=SeqID_46958
MHGPIVTGNRQNIAMNHEKHCIQHTGCKHETDICELPVDAGPRVSNHIKQEAATSGPFVGDDG

SEQ ID NO: 163737 - protein, 48 aa, Glycine max
  Coding DNA Sequence Number=SeqID_46959
MTQDSFGLIKVKANERRTRAAALVAEDTCPLPSVFLTLLRSLFDHVSG

SEQ ID NO: 163738 - protein, 172 aa, Glycine max
  Coding DNA Sequence Number=SeqID_46960
  Gene Ontology: Mol. function=protein dimerization activity
  Pfam annotation: Domain name=zf-C2HC_plant; Domain location=58-112; Score=37.6; E_value=4.3e-08; Accession=PF07567.3; Description =Protein of unknown function, DUF1544
MFHLLLLATCCCYLLLILFHFSISGIESGNGLDSSNSNIGTSTGAASRSKNAPGNRTNIGWKHETDVLGNGKKVKYNYCSKINNGGIFIFKHHLAGTRWDSEPCASVLEEVKMLMMNVVAEVANASEKRKKLNSIHEEGTEGVEVESNSSQSGIQRKWMLGFKGRGKQICLG

SEQ ID NO: 163739 - protein, 74 aa, Glycine max
  Coding DNA Sequence Number=SeqID_46961
GFASSLLVHFFFLPQSLTLSHNHPIGELEELFRASEDDLILRWSTTVADNHVHLEAASPNSHEVHDEHNPCKNF

SEQ ID NO: 163740 - protein, 107 aa, Glycine max
  Coding DNA Sequence Number=SeqID_46962
MIDTKARYYASLKKEVYVERKRDLKDNEFTLTQETFEDKGWNKLIEQVVYSEPFVREFYANTIIQDGHKEMKSRVRGIVVKYDSMAINNLLGSTLKLRKGQQSGYEE

SEQ ID NO: 163741 - protein, 291 aa, Glycine max
  Coding DNA Sequence Number=SeqID_46963
  Gene Ontology: Mol. function=DNA binding; Cellular component=oxygen evolving complex; Biological process=DNA integration
  Homolog annotation: Hit_ID=Q1SS72; Match level="QueryCoverage=89%, HitCoverage=18%, E-value=3e-77, Identity=55%"; Hit description =Integrase, catalytic region
MNTEIQALEVNNTWILTDLPQHKTAIGYVNNAFLHGDLNKEVYMVLPPGMQLDKSGKANRQWYAKLSSFLISHGYTQCVSNCSMFIKHGPQSITALLVYVDDIVLSGNDLIEIQNITKLLDYAFKVKDLGDLKFFLGFEIAKTPAGINLCQRKYALDILNDTGVLGSKPVSTPFDYTTRIHQHSSSPLSTEGASSYRKLIGRLIYLANTRAYITYVVQHLSQYVAEPTSAHQQATFRILKYIKGSPSAKIFLSVDSQIHLKGFSDSDWVDCIDTRRSITGYAIHLGNSLIL

SEQ ID NO: 163742 - protein, 703 aa, Glycine max
  Coding DNA Sequence Number=SeqID_46964
  Gene Ontology: Mol. function=binding; Cellular component=thylakoid; Biological process=photosynthesis
  Homolog annotation: Hit_ID=Q1T1X0; Match level="QueryCoverage=81%, HitCoverage=98%, E-value=1e-112, Identity=42%"; Hit description=IMP dehydrogenase/GMP reductase
  Pfam annotation: Domain name=TPR_1; Domain location=238-271; Score =33.0; E_value=1.1e-06; Accession=PF00515.18; Description =Tetratricopeptide repeat
  Pfam annotation: Domain name=TPR_1; Domain location=272-305; Score =23.2; E_value=0.00092; Accession=PF00515.18; Description =Tetratricopeptide repeat
  Pfam annotation: Domain name=TPR_1; Domain location=306-339; Score =8.9; E_value=0.47; Accession=PF00515.18; Description=Tetratricopeptid e repeat
  Pfam annotation: Domain name=TPR_1; Domain location=424-458; Score =8.2; E_value=0.57; Accession=PF00515.18; Description=Tetratricopeptid e repeat
  Pfam annotation: Domain name=TPR_1; Domain location=471-504; Score =15.2; E_value=0.082; Accession=PF00515.18; Description =Tetratricopeptide repeat
  Pfam annotation: Domain name=TPR_1; Domain location=505-538; Score =32.2; E_value=1.8e-06; Accession=PF00515.18; Description =Tetratricopeptide repeat
  Pfam annotation: Domain name=TPR_1; Domain location=539-572; Score =21.3; E_value=0.0035; Accession=PF00515.18; Description =Tetratricopeptide repeat
  Pfam annotation: Domain name=TPR_2; Domain location=238-271; Score =32.1; E_value=1.9e-06; Accession=PF07719.7; Description =Tetratricopeptide repeat
  Pfam annotation: Domain name=TPR_2; Domain location=272-305; Score =25.5; E_value=0.00019; Accession=PF07719.7; Description =Tetratricopeptide repeat
  Pfam annotation: Domain name=TPR_2; Domain location=425-458; Score =18.3; E_value=0.027; Accession=PF07719.7; Description=Tetratricopepti de repeat
  Pfam annotation: Domain name=TPR_2; Domain location=471-504; Score =17.4; E_value=0.053; Accession=PF07719.7; Description=Tetratricopepti de repeat
  Pfam annotation: Domain name=TPR_2; Domain location=505-538; Score =20.9; E_value=0.0046; Accession=PF07719.7; Description =Tetratricopeptide repeat
  Pfam annotation: Domain name=TPR_2; Domain location=539-572; Score =20.0; E_value=0.0084; Accession=PF07719.7; Description =Tetratricopeptide repeat
  Pfam annotation: Domain name=TPR_4; Domain location=238-263; Score =10.2; E_value=2.3; Accession=PF07721.5; Description=Tetratricopeptide repeat
  Pfam annotation: Domain name=TPR_4; Domain location=272-297; Score =7.6; E_value=4.7; Accession=PF07721.5; Description=Tetratricopeptide repeat
  Pfam annotation: Domain name=TPR_4; Domain location=306-331; Score =3.8; E_value=13; Accession=PF07721.5; Description=Tetratricopeptide repeat
  Pfam annotation: Domain name=TPR_4; Domain location=425-450; Score =5.8; E_value=7.6; Accession=PF07721.5; Description=Tetratricopeptide repeat
  Pfam annotation: Domain name=Thioredoxin; Domain location=623-701; Score=10.7; E_value=2.2e-05; Accession=PF00085.10; Description =Thioredoxin
  Pfam module annotation: Pfam domain module=TPR_1::TPR_1::TPR_1::TPR _1::TPR_1::TPR_1::TPR_1::TPR_2::TPR_2::TPR_2::TPR_2::TPR_2::TPR _2::TPR_4::TPR_4::TPR_4::TPR_4::Thioredoxin; Domain location=238 -271::272-305::306-339::...
  Pfam module annotation: Domain location=424-458::471-504::505 -538::539-572::238-271::272-305::425-458::471-504::505-538::539 -572::238-263::272-297::306-331::425-450::623-701
MEMKAKNNNNKNKVGSELGCGLMGRILHLKSHKMRKASVHSLPLKNAHSDDDDVKTEESKVARKSFTHTEPPHKLSGAEQKPARMSVSIIHHQQQQPCTNRNNQHLRHSDVAARSSTSSFTSTSISSHTKFQQNQDKDHERKPRGDPTGNSLALARISTSKENNENKKSQLKLTGNLLVNNTPRRKSVEYMPKSAELNSVRSSYTNASKVLMGNIMRRNSNSNEVAQFLSPRLKKMDPEVLKSMGNEAYKQGRFEEALALYDQAIALDLNKAVYHCNKSAALIGLGRLQEAIVECEESIKLDPSYVRAYNRLATIYVRLGEAEKALDCNQSIPYVDSILAFQAQALQNHLNKCIEARKVNAWSDILKETQFAISLGADSAPQVYALQTEALLKLLRYQEAYVIYDKMPKFSIDWCTKMFGPARSAYLLVIGSMVYLASGRFEEAVASTQQAAKVDPGNREVNAMVRKARAATSARMSGNLLFKASKFTEASGAYNEGLEHDPHNSVLLCNRAACRSKLGQNEKAIEDCNAALMVQPGYSKARLRRADCNAKLERWEAAIQDYEMLLRERPGDEEVARALFEAQLQLKVLHGEDIKDLKFGSNLVSISSNDRFRHYVTSPGMAVVLFSNKTTHKKVLLVLEQISKRFPSVNFLKVEIEDHPYLAKSEGVSSIPAFKIYKNGSRVKEISGNNHELLERSVKLYSS

SEQ ID NO: 163743 - protein, 195 aa, Glycine max
  Coding DNA Sequence Number=SeqID_46965
MDPEDEKRINRTTSFGKFCKRRERGLKPSHHHRSVPATRPLSSPWQPRTARPCTSGGGGKAPPYLMVYPLVALFFVRGNKELCLVLDVVIPPKFKVPDFDKYKGTTCPKNHLKMYGRKMEAYAKDEKLLMHFFPRKPNLVFASERTEAGPRKGKFNYVASANLGSGGPKRKKVGKPYVVAALPAWPNFPLAAYNP

SEQ ID NO: 163744 - protein, 146 aa, Glycine max
  Coding DNA Sequence Number=SeqID_46966
MSQHSIHPNSKVVVTYRQFECKNWKSGTLESREVKHDVPCFQFCSDFNGLKSASVGPNGPDSCTDISHGRGGITCEGGAGFLWDAGSKALGAGSKGLTSSRINFVTIYDLNKLQSPKSQHTLIGCNTNHFTCATEVNSLPKQTIHV

SEQ ID NO: 163745 - protein, 165 aa, Glycine max
  Coding DNA Sequence Number=SeqID_46967
RQEANKESENEVLRPPQIYINIAFAEAIVQMPKYAKYLQENFPNKGKLADFATTDLYKECTPIFLRKLSPKLIDPRSFLVPYTIGHLQIDRALCDSATNKMKTIVAKSHPSVGKEDPPRNRAISTDFGWSKKKGDSITIQALSYIVNDCTGGSMQKGKITLFKGG

SEQ ID NO: 163746 - protein, 227 aa, Glycine max
  Coding DNA Sequence Number=SeqID_46968
MDILNTALGRPEHPGRVRVTGTCVTISQYFGQASRASNTSSPSINQQQLVDIIGGIKDDIRKQLQDEIRKEVQDEIRKEVQQEHKQQQEAWMRAVEEKQWQNLEMMKQELKKSLKVELSHIASHQSAPIEAPEIQALLMRVSTKGSCAGPEGSRLLKELLNGDDDLMGLFVVVGQNIVLAGLGKVFENSFTIRNIRYENDVVKVQVVRTYMPHAEVPIPTSEVHYLE

SEQ ID NO: 163747 - protein, 249 aa, Glycine max
  Coding DNA Sequence Number=SeqID_46969
  Homolog annotation: Hit_ID=O80513; Match level="QueryCoverage=40%, HitCoverage=51%, E-value=3e-40, Identity=79%"; Hit description =Putative PREG1-like negative regulator
  Pfam annotation: Domain name=Cyclin; Domain location=147-249; Score =20.2; E_value=3.7e-07; Accession=PF08613.1; Description=Cyclin
  Pfam annotation: Domain name=Cyclin_N; Domain location=151-248; Score= -27.3; E_value=0.037; Accession=PF00134.13; Description=Cyclin, N -terminal domain
  Pfam annotation: Domain name=Vps4_C; Domain location=57-97; Score =16.0; E_value=1.8e-05; Accession=PF09336.1; Description=Vps4 C terminal oligomerisation domain
  Pfam module annotation: Pfam domain module=Cyclin::Cyclin_N::Vps4_C; Domain location=147-249::151-248::57-97
MGVGHNDQKVLVLAATNTPYALDQVHLGDTPHNLAESDFEHLARKTEGFSGSDISVCSAVQTTIQDLAAKGLASKILPPPISRTDFDKVLARQRPTLLMLVGFLNVDVTNFMIVIGLSFFRFQVGVRVDNFSCYASPSRKRQTNFITKLCQMIAFLSSLLERVAESNDHNQQHQKISVFHGLTRPNISIQSYLERIFKYANCNPSCFVVAYVYLDRFTQRQPSLPINTFNVHRLLITSVMVAAKFMDDM

SEQ ID NO: 163748 - protein, 50 aa, Glycine max
  Coding DNA Sequence Number=SeqID_46970
MALLETGSKNGNSKQTYLELIQQKVSVPLPTDNCVQVSILWPKTGSSHNN

SEQ ID NO: 163749 - protein, 251 aa, Glycine max
  Coding DNA Sequence Number=SeqID_46971
  Gene Ontology: Mol. function=RNA-directed DNA polymerase activity; Biological process=RNA-dependent DNA replication
MQIGGCHICDGAHEPGQCIAQEDSSREVNYMGAQNRHGFQGYNQVRPPGFNQGRNFTQGSSWRNHSGNQFNKEQRSQPVQNFNQKVDLYRKTSKLEETLNQFMQMSMSNYRSTESSIKNLEIQMGQLAKQVAERPTSSFGANTETNLKEECRAVLTRSQRRAQLAREARKEEPPTPLKEPSYPLVLSKKNKERYFKRYMEIFKGLEITMPFGEALQQMPLYTKFMKDILTKKGKYIDNESIVVGGNYSAVI

SEQ ID NO: 163750 - protein, 67 aa, Glycine max
  Coding DNA Sequence Number=SeqID_46972
MPQPHGINMGLKEHSNRVPLPPRPRLRRIRLDLTFLIQPVQLSNNPYTYEFHDNPYTYEFHDEKSPT

SEQ ID NO: 163751 - protein, 49 aa, Glycine max
  Coding DNA Sequence Number=SeqID_46973
  Homolog annotation: Hit_ID=Q1SPY9; Match level="QueryCoverage=78%, HitCoverage=5%, E-value=3e-11, Identity=79%"; Hit description=Ankyrin
MAMVLFDFGAESGDWLKDTSESCSVVAALVAGVSFATASSIPGGTNDEG

SEQ ID NO: 163752 - protein, 54 aa, Glycine max
  Coding DNA Sequence Number=SeqID_46974
MNPGIAIWTKKVYMVQELVKAIITRKQQSVKNNESKKTNMGRRLSLIEGEERRQ

SEQ ID NO: 163753 - protein, 121 aa, Glycine max
  Coding DNA Sequence Number=SeqID_46975
  Homolog annotation: Hit_ID=Q32W70; Match level="QueryCoverage=35%, HitCoverage=20%, E-value=2e-12, Identity=77%"; Hit description =Tyrosine specific protein phosphatase family protein
MKAEGLEEGEVGGFGEAGAENAIINHGEVEGRNEEILAVVVSGGGVIGDSELDLAAHGSVLFVPLVVVMGALEFCRHLHICLFVCFKREREGGVREVFRGGALKLERLLRENGWMALKGLK

SEQ ID NO: 163754 - protein, 290 aa, Glycine max
  Coding DNA Sequence Number=SeqID_46976
  Gene Ontology: Mol. function=DNA binding
  Homolog annotation: Hit_ID=Q1S0F5; Match level="QueryCoverage=52%, HitCoverage=28%, E-value=6e-20, Identity=38%"; Hit description=IMP dehydrogenase/GMP reductase
MGSSQTPSLKKRFYQVNVKSLGITSLKELGKLMGQLQRQAFRKAYGKIWDLAMVLHFLGLPAITHGGRIQRDPRMSSRGKETIPLLKANGPIHKHSCTVDLRRSPFPNVDGLVNLAAIDAFLAYHDHKESPVVAMLAGLYDTFDQRYEKSSTRIVCCTPALYVCLVSHLFRQELRHACPLESHRSCTEKGRANWDQLLANKEGASVNWFIRWKEGRTGVLISCGGFPKVPLIGTRGCISYNPVLAIRQLGYPMRGAPLEEELTPVRKAWEIVQKKDKELRGSNNGPIGGY

SEQ ID NO: 163755 - protein, 212 aa, Glycine max
  Coding DNA Sequence Number=SeqID_46977
MVVQQHHHHIRQHHLGDDVQGCFLGKVSGEVDFREELQHHQMTSSCHLRRNAKVVDGVLVGIFLTLLTSDHEVLHRFVTVECKSMAWSADLSRSSADLRSGVLICHCVAILKSIERLEGEKVKREEEEGEDREIRGRKSKERRRGGRRISPYKKEHHVSARRFDALNDRASSDDVTSMEVVQDSQEPIKLTWASGNQFGSLGDNENPNMFKI

SEQ ID NO: 163756 - protein, 102 aa, Glycine max
  Coding DNA Sequence Number=SeqID_46978
MANVRTVESMTPLDILELTLGQSYSHRTLGHIEKKKKGKDRKRNYIKSSWLSSFQQRRFSLSSSWKFYNCKREIFSKGGKDKKGNGRKELLMLASPSSFCLL

SEQ ID NO: 163757 - protein, 351 aa, Glycine max
  Coding DNA Sequence Number=SeqID_46979
  Gene Ontology: Mol. function=protein kinase activity; Cellular component=cytoplasm; Biological process=protein amino acid phosphorylation
  Homolog annotation: Hit_ID=Q67WD3; Match level="QueryCoverage=86%, HitCoverage=48%, E-value=1e-104, Identity=59%"; Hit description =Protein kinase-like
  Pfam annotation: Domain name=Pkinase; Domain location=45-309; Score =55.8; E_value=1.5e-13; Accession=PF00069.15; Description=Protein kinase domain
  Pfam annotation: Domain name=Pkinase_Tyr; Domain location=45-309; Score=14.9; E_value=2.2e-13; Accession=PF07714.7; Description =Protein tyrosine kinase
  Pfam module annotation: Pfam domain module=Pkinase::Pkinase_Tyr; Domain location=45-309::45-309
MSKEVIATQSPTPFEYEILDSDAEVLRTVRASSNCANPWIEPERLKLRHRIGRGPFGDVWLATHHQSTEDFDEYHEVAAKMLHPIREDHVKIVLEKFNELYFKCQGVASVSWLHGISVLNGRICIIMNLCEGSIGDKMAGLKEGRISLNDVLRYGINLAQGVQELHSKGSFILNLKPFNVLLNDNDQAILGDVGIPSLLLGSSFLSSDMAKRLGTPNYMAPEQWEPEVRGPISFETDSWGFGCTIVEMLTGNQPWYGCPVRRIYQSVVEKHEKPNIPSGLPSSVENILSGCFEYDLRNRPLMVDILSVFQRYGVANILPFAGECVSKLQLGFIKYLQRCSLIMYPISSWPR

SEQ ID NO: 163758 - protein, 44 aa, Glycine max
  Coding DNA Sequence Number=SeqID_46980
MTSCVMNNSDADPPGGSSGNYIVIDNSLQQTRQVLFPSSNQEMR

SEQ ID NO: 163759 - protein, 609 aa, Glycine max
  Coding DNA Sequence Number=SeqID_46981
  Homolog annotation: Hit_ID=Q2QM21; Match level="QueryCoverage=44%, HitCoverage=40%, E-value=5e-78, Identity=50%"; Hit description =Expressed protein
MEYWRPWFWGHADKYYVVKLSQLRLKFGPTLDAANDKIIAIQIKGTATKKGKVSSSSSTSKSFLIPFHRTQKLGSTHTTTFPHRFTNSKAPTIVWDARDLCDFHLVLKHGTCYMTLHVLHAEGDIGEYKSEMVVVGEVSMSVTMAEFMEGEEMKNESNSCQVQRTLPIQLKVHGLFMEEATLSVSLSLLKLRNFHDDLPRAFVNKVTSLEDKNNGKVVDQVEEPSPYEWDELSVYDSDDSSDKSTTTTTSSSSSSSTSTAIHCEGSSVTNGSERFVASDSETLLDTMQRSWSMLPWNRSFKGWSFKRTSSRKQEPLTSHSSHSMGPYFDHNKCSASGWETRELRSRDAQAMLKTNVFFASFDQRSKQACGESACTALAVCIAHWLHSNHNMPTRSQFDSLIKRGSSEWRRLSHSDHYLKLFPDKHFDLETVLEANIRPLVVTPQNSYTGFFSPEKFQCLEGAMSFDDIWDEITRNDDVVDHEPRIYIVSWNDHFFVLKVEVDACYVIDTLGERLFEGCRKAFILKFDGSSLMHAKGSKKERGEIVCKGKECCKEFIKRFLAAIPLRQLEEEERNKGTVYNPYFHRKLQIDLHYSLLSSLSSASSIGEPL

SEQ ID NO: 163760 - protein, 198 aa, Glycine max
  Coding DNA Sequence Number=SeqID_46982
  Gene Ontology: Mol. function=glutamyl-tRNA reductase activity; Biological process=tetrapyrrole biosynthetic process
  Homolog annotation: Hit_ID=Q2QM36; Match level="QueryCoverage=98%, HitCoverage=55%, E-value=5e-54, Identity=54%"; Hit description =Expressed protein
  Pfam annotation: Domain name=DUF266; Domain location=1-71; Score =37.7; E_value=9e-10; Accession=PF03267.4; Description=Arabidopsis protein of unknown function, DUF266
MSNSVFVLISPSCIPLHSLKFTYHVLLRQGKSFVEILANEETAYDRWAARGPHAMLPEVRLEEFRVGSQFWALTRRHARLVVSDRVLWSKFDAPCVRFDSCYPEENYFPTLLSMWDPQGCVPATLTHVNWTGRVDGHPRTYEAWEVGPELIRRMREDRPRYGDGNSDGRSDPFLFARKFAPDALQPLMRIANGVIFRD

SEQ ID NO: 163761 - protein, 57 aa, Glycine max
  Coding DNA Sequence Number=SeqID_46983
MATKEAFVSSLKVALKSRRARTSVNVMEDKWCGGLWIEVFGGKCVVDEEREDFTLRE

SEQ ID NO: 163762 - protein, 98 aa, Glycine max
  Coding DNA Sequence Number=SeqID_46984
MAEPLKSLLSASWVLGGSDTGSIRFSDEFDSLRDMEKAKFKRGKGFGEFEEVKTKEGERERLESIRHRRDAATCESELLNLTTRQLRCLKLAPPIYII

SEQ ID NO: 163763 - protein, 65 aa, Glycine max
  Coding DNA Sequence Number=SeqID_46985
  Homolog annotation: Hit_ID=Q6K5Y4; Match level="QueryCoverage=60%, HitCoverage=11%, E-value=8e-10, Identity=75%"; Hit description =Putative UDP-N-acetylglucosamine transporter
MESVRGVNVPMYTTLRRTTVVFTMLVEFVLVGQRYTPSVIFRLIGTCCALHLDLVYAICIWYIGN

SEQ ID NO: 163764 - protein, 61 aa, Glycine max
  Coding DNA Sequence Number=SeqID_46986
MAWPRDQPSSRGVNPFLWKLWLKHQNAREKGVEGGNDAGTKKEGSGCTNAFWDHLTVECGE

SEQ ID NO: 163765 - protein, 124 aa, Glycine max
  Coding DNA Sequence Number=SeqID_46987
MGNPKGLSIESSSPEFLDEASRGAWKRVSRDGVARVEEEEGGWFVHGQGGGLEVTHGGGRVPEWRAWMRRLRREEECWVRSQRREGEGRSCTQRRRKGLWVTVKKGKRRRRYGVWLRREKKECT

SEQ ID NO: 163766 - protein, 863 aa, Glycine max
  Coding DNA Sequence Number=SeqID_46988
  Gene Ontology: Mol. function=RNA-directed DNA polymerase activity; Biological process=RNA-dependent DNA replication
MVGSKKSIPPIDRHLMVIKLNKNMDASIKKTLRCKWDKFPRKWRSSKSGSFFTNTQPNPKEQCKAITTRRGALVGDLTREKSEQEGVVEEIIEDDESKFDEESEKKNKDSKNNKMNPPSKDLPYPHAPTKEDKEKKYARFLEIFKQLEVNVPFLEAIEQMPTYAKFMKEIFTKKRFIEQDTIQLSAWYPTVGKTLLDLGVSINLMPLSLLAKIGHLDLKPTRITLQLAYCSIKRPHGVLEDVLVKVDKFIFPADFVVMDIEEDFELPLILGRTFMNMAKILVNVHDGQIKLQDVIDEVVIHSKEKLSNASPLEKTIIDVFETLDEEEEKEIGECLKQLDTLKEIPSEEEIIEELKKDEKAEEAKLELKILTLHLNYEFLELNGRKFVIINSSLSTLEEEKLIEILKDHKGAIGWLNHVMKEEGGMTIIRNEKNELIPTRTVVRWRMCIDYRKLYKVIRKNHFPLPFIDQMLERLADQAFYCFLNGYSGYNEIVVDPKTKRKLLSHASLKCIEVFMDDFSIFDSSFDLCLSNLEIVLKRCVKTNLILNWEKCHFMVTEGIFLGHKISSKGIEVDKAKVDVIERLHLPTNASLVSAPILIAPNWKKYFEFVCDASDYVVRVVLGQRKDKIFHPMHYASKEFDLEIQDKKGSENQVANHLSRLVNEEVATLEIEILEEFSDEKLLLVYERPWFADLANFKDAHEHVKSCDKCQRMGGISRRNEMPLQNILVVEVSNREIKKILEKTVASSRKDWAMKLDDALWAYRTAFKTLIVLSPFQMVYKKSCHLPVELEHKAYWALKLKLFHGKLKSKWSSPFVIKEVRLYATTELEDPSSKRNWVVNGQRLKPYLGGEVERLTTILHLNDP

SEQ ID NO: 163767 - protein, 108 aa, Glycine max
  Coding DNA Sequence Number=SeqID_46989
  Gene Ontology: Biological process=protein modification process
  Homolog annotation: Hit_ID=Q1S2J8; Match level="QueryCoverage=65%, HitCoverage=22%, E-value=8e-24, Identity=76%"; Hit description =Ubiquitin
MATVAELKDAVEAVFSHVPHKGPAKISWAHVWGQFCLCYDGQKLVTEKDYLRNYGIKDGDQLRFIRHVTNNCCVQRKRLKKRVVYLKQHRRNQHAICQATLDDSWPVP

SEQ ID NO: 163768 - protein, 248 aa, Glycine max
  Coding DNA Sequence Number=SeqID_46990
  Gene Ontology: Mol. function=RNA-directed DNA polymerase activity; Biological process=RNA-dependent DNA replication
MALMILFPQALVEVLYQHNSDHNPLLLSCSKLVVDAWLSRPEYPNLVVDAWQGRTLQVMSFISLRKVKEETTIFNSQVFGNIFKRKRQLQAWIQGVHRVLDVRVYASLVSLEKELEKLYNDVLYQKEVLWYQKSRERWVKLGNKNTKFFHTQITIKRRRNRIYGLMINGNWRTEKENCQPSGLSMQNILVLSQQAMETLLATVSMKEEKVSNNEWHPVKITRQCLSISHLFFADDCLLSRKRVMTSQP

SEQ ID NO: 163769 - protein, 115 aa, Glycine max
  Coding DNA Sequence Number=SeqID_46991
MVSNPSRAQKKEKTSKRKQGECSQAALNRLDTWFTDESKKNDYKMIYKKGTFYPELVKVFYICARVYLEGVCKFDEMPDGYSKMQTYRGILFDPARNLRNHLGVGGLFFKRRMKT

SEQ ID NO: 163770 - protein, 222 aa, Glycine max
  Coding DNA Sequence Number=SeqID_46992
  Gene Ontology: Mol. function=protein binding; Cellular component =integral to membrane; Biological process=defense response to fungus
  Homolog annotation: Hit_ID=Q1SWI6; Match level="QueryCoverage=90%, HitCoverage=96%, E-value=5e-40, Identity=45%"; Hit description =Leucine-rich repeat, plant specific
  Pfam annotation: Domain name=LRRNT_2; Domain location=14-54; Score =50.8; E_value=4.5e-12; Accession=PF08263.3; Description=Leucine rich repeat N-terminal domain
  Pfam annotation: Domain name=LRR_1; Domain location=123-145; Score =13.7; E_value=0.67; Accession=PF00560.23; Description=Leucine Rich Repeat
  Pfam annotation: Domain name=LRR_1; Domain location=147-170; Score =14.2; E_value=0.48; Accession=PF00560.23; Description=Leucine Rich Repeat
  Pfam annotation: Domain name=LRR_1; Domain location=172-194; Score =14.0; E_value=0.55; Accession=PF00560.23; Description=Leucine Rich Repeat
  Pfam annotation: Domain name=LRR_1; Domain location=196-217; Score =12.0; E_value=1.6; Accession=PF00560.23; Description=Leucine Rich Repeat
  Pfam annotation: Domain name=LRR_1; Domain location=96-121; Score =10.5; E_value=3.1; Accession=PF00560.23; Description=Leucine Rich Repeat
  Pfam module annotation: Pfam domain module=LRRNT_2::LRR_1::LRR_1::LRR_ 1::LRR_1::LRR_1; Domain location=14-54::123-145::147-170::172 -194::196-217::96-121
LWLLSLPCRESVCIPSERETLLKFKNNLNDPSNRLWSWNHNNSNCCHWYGVLCHNLTSHLLQLHLNTSDSDYANWEAYRRWSFGGEISPCLADLKHLNYLDLSGNYLLGEGMSIPSFLGTMTSLTHLNLSYTGFYGKIPPQIGNLSKLRYLDLSDNDFEGMAIPSFLGTMTSLTHLDLSYTGFMGKIPSQIGNLSNLVYLYLSYTNLSKAFHWLHTLNLFLL

SEQ ID NO: 163771 - protein, 259 aa, Glycine max
  Coding DNA Sequence Number=SeqID_46993
ERKVELYHTELDDFKAELERHNFHKHLTNLADGSIDLALVKEFYANLYSFEDHPPKQSRVRDHLVKIDADSLNTFLETPVITESHPGKILRKDLTTLAQVWSVLSYSNLAPISHTSNLKVDGARLIFGLVSHLDMNIGALISDQMTSIAQSNTSRLGFPALITALCRAREVVSDSLTFERLSPVINLAYIRKNCWNPEDLTVSIRGARRARERQAELPSTSAAPTLASTSAAPSVPAQTNYQRFEAMLQSIHQGQIILL

SEQ ID NO: 163772 - protein, 116 aa, Glycine max
  Coding DNA Sequence Number=SeqID_46994
  Subcellular localization annotation: CTP_CleavageSite=59; ConfidenceScore=5.25e-01
MCAAPFEFGAMFHDCLSADPQGNLPFSPLFRSPMNVIALALFMCPPPSSMELCFMIALSADPQGNPALSHFFGAPCLLLPSAVHVCSTFEFGAMLHDCLSADPQGNPPFSPFFGAP

SEQ ID NO: 163773 - protein, 141 aa, Glycine max
  Coding DNA Sequence Number=SeqID_46995
MTIQNMQFQQETRASIQSLTNQMGQIATHLNQAQSPNYDKLPSQTVPPPVAASALEPVKLHATPENEDEIVAQKRKFTHQGANKNFHAGGPSSSYSFGKGDLGDLQESRGEHTSAGCHQADSKICQVSKGSMHPQKEAQRQ

SEQ ID NO: 163774 - protein, 462 aa, Glycine max
  Coding DNA Sequence Number=SeqID_46996
  Gene Ontology: Mol. function=hydrolase activity, acting on acid anhydrides, catalyzing transmembrane movement of substances; Cellular component=integral to membrane; Biological process =potassium ion transport
  Homolog annotation: Hit_ID=Q1DGG2; Match level="QueryCoverage=65%, HitCoverage=51%, E-value=1e-154, Identity=92%"; Hit description =Potassium-transporting atpase b chain
  Pfam annotation: Domain name=Hydrolase; Domain location=11-184; Score= 69.6; E_value=1e-17; Accession=PF00702.16; Description=haloacid dehalogenase-like hydrolase
  Pfam annotation: Domain name=KdpC; Domain location=296-461; Score =137.7; E_value=3.2e-38; Accession=PF02669.6; Description=K+ -transporting ATPase, c chain
  Pfam module annotation: Pfam domain module=Hydrolase::KdpC; Domain location=11-184::296-461
IIELSELQPQDLIVSSPTYIDFTAETRTSGIDFEDTRIRKGAYDTIKKLTEKAGNIFPQETQDATTKISENGGTPLVVSVNEKVWGVIELQDIIKTGIQERFQRLRKMGVKTVMVTGDNPLTAKFIAEKAGVDDFIAEAKPEDKMNYIKKEQQSGKLVAMMGDGTNDAPALAQADVGVAMNSGTQAAKEAGNMVDLDNDPTKLIEIVEIGKQLLMTRGTLTTFSIANDVAKYFAIIPALFITFIPALQKLNIMNLHSPESAILSAIIFNAVIIPALIPLALKGVAYKPIGASALLRRNLLIYGLGGSKLLPTQGNAETITYRDQKFYANIGQEFKSPKYFHSRPSAANYNAAGSAGSNKGPSNKEYLETVQKRIDTLKMQNPEMKDTEVPVELVTASGSGLDPDISEAGALYQIKRVAKERNLSEDRIESLVKTNTEKPLLGLFGPSKVNVLKLNIALDKLQ

SEQ ID NO: 163775 - protein, 203 aa, Glycine max
  Coding DNA Sequence Number=SeqID_46997
  Gene Ontology: Mol. function=transferase activity, transferring phosphorus-containing groups; Cellular component=membrane; Biological process=regulation of transcription, DNA-dependent
  Homolog annotation: Hit_ID=Q1XPD7; Match level="QueryCoverage=99%, HitCoverage=36%, E-value=3e-51, Identity=51%"; Hit description =PAS:ATP-binding region, ATPase-like:Histidine kinase, HAMP region:Histidine kinase A-like
  Pfam annotation: Domain name=HATPase_c; Domain location=95-203; Score= 103.8; E_value=5.2e-28; Accession=PF02518.16; Description=Histidine kinase-, DNA gyrase B-, and HSP90-like ATPase
MGVQLLGNQKFGELNDQQQELLKSINDDGQRLLDITGELLNLSQVETGNIRLNIKSCSPKEIVATAIKNVEKLAEQKNISISTDFLTSEEDLVSADFDKTVWVMNNFLSNAIKHSFQDENIRILVEKSEAMILFSITDTGSGIDEKYHRQIFDRYFQVPGEHQNGTGLGLAISKNFIEKQHGEIGVKSAPNQGSTFYFGLPVA

SEQ ID NO: 163776 - protein, 69 aa, Glycine max
  Coding DNA Sequence Number=SeqID_46998
MFCNLPLDGRARQDGNVRLPKRRTRGSRHQRLFEENVRKTKKKQKRALDRLAARPGELMLHSEVNGSPR

SEQ ID NO: 163777 - protein, 104 aa, Glycine max
  Coding DNA Sequence Number=SeqID_46999
MVAIHVKASRVGIKAQPLQWLSSKKSKGKLILRKMESIGQTMNRSTLFNENGNYIPDDDNLKELPRKRWTDEQIEILTEVKSKECHHQCTIKKGVCKGALYQKC

SEQ ID NO: 163778 - protein, 208 aa, Glycine max
  Coding DNA Sequence Number=SeqID_47000
  Gene Ontology: Mol. function=oxidoreductase activity; Biological process=metabolic process
  Homolog annotation: Hit_ID=Q6ZG50; Match level="QueryCoverage=91%, HitCoverage=92%, E-value=6e-35, Identity=62%"; Hit description=Short- chain dehydrogenase/reductase family protein-like
  Pfam annotation: Domain name=adh_short; Domain location=9-161; Score=- 37.7; E_value=0.0017; Accession=PF00106.15; Description=short chain dehydrogenase
MASSASSRGIAAIVGVGPNLGLSIARKFAHEGYTVAILARDLGRLSRFADEIAREEKAQVFAIRIDCSDSRSVREAFEGVLSLGFVEILVYNAYQPLPWYPTSFQDLRVDSFEKSLAISSVGAFHCAQQALTDMNLHAVGHRGPMLTTTSSSSQRRNSLGEQSSGVVGGGEGTMDPDSLAQTFWHLHVQDRNAWTQEMDLRSPSARFF

SEQ ID NO: 163779 - protein, 122 aa, Glycine max
  Coding DNA Sequence Number=SeqID_47001
MRHPLENKPWNEKLYHQESALDMKLREEASMEEKNERKREGGVEIEGKEGEKLNFEVCLTTHGPKIYPKTHENPKAFSYTSGLIFLEFSIQCPWGVGLHHPLPLEKHLTSNPEVLETLDFFP

SEQ ID NO: 163780 - protein, 293 aa, Glycine max
  Coding DNA Sequence Number=SeqID_47002
  Subcellular localization annotation: CTP_CleavageSite=51; ConfidenceScore=5.06e-01
MVLSKKATDKGNVIAKAIEVTSSSFSKKTILRTPPHANGVMIGSPKKKVISQKEKQGQKRRRLEMIKNVVRIFSALLRSKKSTSFIDVEEPIYLRWVKAFYAIVVVDQSNFTIKATLKGIDILILEHILEIILKIPSLRRDKVIKKLKELKDNELKSKALNSFGRLVYWICMHYVLPKVGTFQEMLSKNTCFLKRKKFLETFLEKVRKMFLKVFKIKKRRKNPLRVRKMRMFTIRSLYLRLFRVMKAINMLKVKIVAAEEPGKVSIEKENTGEKIHVGSVKDSLFNIENMQRY

SEQ ID NO: 163781 - protein, 63 aa, Glycine max
  Coding DNA Sequence Number=SeqID_47003
MDVSWTGSIEVVTWEVLLMLSVNDERSRGQGLKLIFCFPTTTKYMSLKNPKKMNKDNPSEESC

SEQ ID NO: 163782 - protein, 513 aa, Glycine max
  Coding DNA Sequence Number=SeqID_47004
  Gene Ontology: Mol. function=DNA binding; Cellular component =chromatin; Biological process=DNA integration
  Homolog annotation: Hit_ID=Q1S1B7; Match level="QueryCoverage=57%, HitCoverage=47%, E-value=6e-59, Identity=41%"; Hit description =Integrase, catalytic region
  Pfam annotation: Domain name=zf-CCHC; Domain location=95-112; Score =7.5; E_value=0.058; Accession=PF00098.13; Description=Zinc knuckle
  Pfam module annotation: Pfam domain module=RVT_2::zf-CCHC; Domain location=217-420::95-112
MEGFEVEVFTRGFAGNFRIVAGHGIYQTSVCVYDALTSVMERKKQDQAMQFLRERQLASNDIMGNTSLINAVNTNSSNLGNSSTYYGNSRGRRSKLCTYCGFTDHTVDECYKKHGYPLAENFYKSQGSNINNISAEKEEGDSLAQERKQETQNDNVKLTFQQYKALMALLQQQNTVHNNSHVNQIGTISNKGSVLFITCSISKTSQDERSLDSSATAMNAEIKALELNDVRVLTNLPQHKTTIGCKWAYKIKNKFHGSIERYKARLVAKWYTQVEGQDYPDTFSPIAKLTIVRLLPTLDAINQWHLQQLDVNNVFLHGDLNGEVYMVIPHGMQVARPGQHGSNIIVVLLVYVDDIIQRITNLLDSAFKIKDLGDLRYFLGFEVARSSIGINLYKRKYALDILNDAGMLGSKSISTPCDYTTKLHQHSGSPLSIKDASSHRRLIRRLIYLTNSSNIHLKGFSDSDWAGYLDTRRFITGYVVYLGDSLISWKSKKHAIMSKSSSEAEYRALASAI

SEQ ID NO: 163783 - protein, 366 aa, Glycine max
  Coding DNA Sequence Number=SeqID_47005
  Gene Ontology: Mol. function=protein serine/threonine kinase activity; Cellular component=flagellin-based flagellum; Biological process=protein amino acid phosphorylation
  Homolog annotation: Hit_ID=Q2QDF4; Match level="QueryCoverage=99%, HitCoverage=61%, E-value=1e-123, Identity=62%"; Hit description=CDPK- related protein kinase
  Pfam annotation: Domain name=Pkinase; Domain location=125-364; Score =123.0; E_value=8.3e-34; Accession=PF00069.15; Description=Protein kinase domain
  Pfam annotation: Domain name=Pkinase_Tyr; Domain location=125-365; Score=-63.9; E_value=1.5e-08; Accession=PF07714.7; Description =Protein tyrosine kinase
  Pfam module annotation: Pfam domain module=Pkinase::Pkinase_Tyr; Domain location=125-364::125-365
  Subcellular localization annotation: CTP_CleavageSite=17; ConfidenceScore=5.18e-01
MGLCTSKPRAKNANPTNSSSLNSHTHFTDPNADENLRKNHTPTPKKSPLFPFYTPSPAHHLFSGKSPAPANPRRFFRPPSPAKHIRAVLARRHGSVKPNEATIPEDEVVTLDKNFGFSKQFEHKFEVGDEVGRGHFGYTCAAKLLKGNLKGQHVAVKVIPKAKLITRLGKSPILVDSPFLTCICGGRCWEVPHCRPQEMTTAIAIEDVRREVKILRALTGHKNLIQFHDAYEDSDNVYIVMELCEGGELLDRILSRSGKYTEEDAKAVMIQILNVVAFCHLQGVVHRDLKPENFLFTSKDENSLLKAIDFGLSDFVKPDERLNDIVGSAYYVAPEVLHRAYSTEADVWSVAVHFGRGLNPGSFVLC

SEQ ID NO: 163784 - protein, 251 aa, Glycine max
  Coding DNA Sequence Number=SeqID_47006
  Homolog annotation: Hit_ID=Q9AVH2; Match level="QueryCoverage=18%, HitCoverage=16%, E-value=1e-19, Identity=97%"; Hit description =Putative senescence-associated protein
MTEGCGEGFCLANLPGDAFSLWGNFFEAKKQMMADAKVGGAGLWPRAKFRIGWPPPPPKKTVLLPGFCQLWLPPRWLSLCLGGGSSCHNMARHKAQGGGGAWSSVRPGTHLVSTRQAKRERADERGRDESKRQGLKSQWIVAARPLCHLQIPRRVFKSSAKGFYPPLDGNCASRRLVGLNPPHEGHQRHVPLGGRGPLLLVGKRTAGARVASSPDSDLEAFSHNPTHGSFAPLAFQPSAMTNCANQRFLSY

SEQ ID NO: 163785 - protein, 50 aa, Glycine max
  Coding DNA Sequence Number=SeqID_47007
MGHGEGDEPLDVGDLYVDVIPRVIQRDGRSTLSNDEFILSPTKGKNEAHR

SEQ ID NO: 163786 - protein, 133 aa, Glycine max
  Coding DNA Sequence Number=SeqID_47008
  Gene Ontology: Mol. function=ATP-dependent helicase activity
  Homolog annotation: Hit_ID=Q676Y4; Match level="QueryCoverage=84%, HitCoverage=39%, E-value=2e-32, Identity=62%"; Hit description =Protein tyrosine phosphatase
MAGFFSLLRRLYLSLYNWTVLFGWCQVLYFVLKTLNESGHQYVYNAAEKPLLYAQTAAVLEVSNPLLNMSCLMKMKIDVGVGLVRSPVTATLPQISSRLFLVWGILWSFPETRSHVLVTSLLISWSITEASLS

SEQ ID NO: 163787 - protein, 1030 aa, Glycine max
  Coding DNA Sequence Number=SeqID_47009
  Gene Ontology: Mol. function=structural constituent of ribosome; Cellular component=intracellular; Biological process=translation
  Homolog annotation: Hit_ID=Q949K0; Match level="QueryCoverage=97%, HitCoverage=97%, E-value=1e-154, Identity=30%"; Hit description =Putative centromere protein
  Pfam annotation: Domain name=Pox_A_type_inc; Domain location=6-28; Score=22.5; E_value=0.0015; Accession=PF04508.3; Description=Viral A- type inclusion protein repeat
  Pfam annotation: Domain name=Pox_A_type_inc; Domain location=708-730; Score=8.0; E_value=5.5; Accession=PF04508.3; Description=Viral A-type inclusion protein repeat
  Pfam module annotation: Pfam domain module=Pox_A_type_inc::Pox_A_type_ inc; Domain location=6-28::708-730
MEKVYEELDEAKAEIEELKAQLRAKTDSLENLKKSHNAQVNQIQEARFKAENLNQKLLQQADEISEAKLVCEDLKGNLNKKESIIKHLSAANDRLLVDCDDKFKKWEDEKRGLVLALEEANEKTQNQEQQIHQYKQEIERMKGCLSVSEKKCLETKKNLKASKELRERDDMFQKLEEECMKVEDQLKWKKEQFKHLEEAHEKVQNQFKASKKEWEMEKSTLLDGISSLQNRLDSQIRISEDLQHQLHTCHQVLAHVESQKKRLEFEVSNLKVQLDNASNEYQDARLQLDCLNTHRDKDIADLRYLLKTKEAYHKESKYRMEKLEQENQELWMSLKELQEAQIQEAGTSYSQSKLRSKLRNLEQTHKECASTLKAKEAEWNFKLKQLTADLNRCRSDLEIKTESVEDLQMELESSQSLAIEMKLLNEEMSVMLIVLKQGISEAQLKLASHKDEMNLINKASEEKTFQLMWQLEMKDAALINAQKSINEEREIAARLMRQVESSVSNNELQHALQNELDRHKEMLEESTMSQLILKEKVWQMECNFKEQLEMKDAALTSAQKSIKEEREIAACLRRQVESYASNIELQHSLQNEVDDRQKEMLEESTTSQLILKEKVLQMECNFKEQLKEIHDALDSVIIELDETICERNEKEFELQIWKSIVERLKNDLEENHVLRRELETSLLAQVDFGESLKQEKVSLVYKLEEKERSLDYLQRHVELLERELRERGESEVSSESDNVRYLQIIAEKDKILEELQKEVVWLEQESFKKEFESAVIEKGTMERTFEHEKDYLIQIMKGKDRRMDELMQQVTSLEQQFTNSLTTFSSQLAEKQAEINLIRDASDKITASQILAALEIKEKKLMVVELEDDIHAIQQKLKLQEEKWSRSEQLALDTEVELAAKQVKAMELNDQMETTKLRKPDALLQKLQMENRNLLDSATRLSSERENLLASVQEFSDKICEFSTADTILMDKLRSMVQSFENGCPVMILKKDDGFLVKENMLVQSPTRIKKLEANSETRSPFKELNLLEE

SEQ ID NO: 163788 - protein, 298 aa, Glycine max
  Coding DNA Sequence Number=SeqID_47010
  Gene Ontology: Mol. function=structural constituent of ribosome; Cellular component=ribonucleoprotein complex; Biological process =translation
  Homolog annotation: Hit_ID=P49204; Match level="QueryCoverage=87%, HitCoverage=99%, E-value=1e-130, Identity=85%"; Hit description=40S ribosomal protein S4-2
  Pfam annotation: Domain name=KOW; Domain location=209-245; Score =40.5; E_value=5.6e-09; Accession=PF00467.19; Description=KOW motif
  Pfam annotation: Domain name=RS4NT; Domain location=37-74; Score =84.0; E_value=4.6e-22; Accession=PF08071.2; Description=RS4NT (NUC023) domain
  Pfam annotation: Domain name=Ribosomal_S4e; Domain location=128-204; Score=161.2; E_value=2.6e-45; Accession=PF00900.10; Description =Ribosomal family S4e
  Pfam annotation: Domain name=S4; Domain location=76-124; Score=26.9; E_value=7.4e-05; Accession=PF01479.15; Description=S4 domain
  Pfam module annotation: Pfam domain module=KOW::RS4NT::Ribosomal _S4e::S4; Domain location=209-245::37-74::128-204::76-124
  Subcellular localization annotation: CTP_CleavageSite=45; ConfidenceScore=5.12e-01
MWAFKAHDPALLQIRVLSSTSHLKCRSNSFCFFSLARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSVRDDEAKFKLCKVRSVQFGQKGIPYLNTYDGRTIRYPDPLIRANDTIKLDLEENKIVDFIKFDVGNVVMVTGGRNRGRVGVIKNREKHKGSFETIHVQDSTGHEFATRMGNVFTIGKGTKPWISLPKGKGIKLSIIEEARKRIAAQQATAA

SEQ ID NO: 163789 - protein, 46 aa, Glycine max
  Coding DNA Sequence Number=SeqID_47011
MTATDDGRRRTADKTRFDTNLKIEINTRYKRERRTTGSDNTLLPSE

SEQ ID NO: 163790 - protein, 325 aa, Glycine max
  Coding DNA Sequence Number=SeqID_47012
  Gene Ontology: Mol. function=protein binding; Cellular component =nucleus; Biological process=ubiquitin cycle
  Homolog annotation: Hit_ID=Q8LI88; Match level="QueryCoverage=84%, HitCoverage=66%, E-value=9e-68, Identity=48%"; Hit description =Putative zinc finger POZ domain protein
  Pfam annotation: Domain name=BTB; Domain location=74-167; Score=36.6; E_value=8.8e-08; Accession=PF00651.21; Description=BTBPOZ domain
MQFCWCFWCCSLIRIEASLWGYKRFFRRSLLETSEFLKNDCLKINCTVGVVVSAIDCPQLHSINIPESDIGSHFGALLDNMEGSDITFDVAGDKFPAHKLVLAARSPEFRSKFFNGLDEEKNEIIVTDLEPKVFKIFLLGFFFLIEKGSYRSSSLQEAMLHFIYKDTLTEEVDTVSSTTTSDFPVSEILTAKLLAAADKYDLANILTLADHCHATELKAVCLKFAAQNLAAVMRSDGFEHMKEKGPWLQSEILKTIAGCEGDGCSAVEKSQSVWGQLSDGGDMNGRRVIMPKNWGVKKKKAKKTKNPFLFCPTFPYSNGKFRKSG

SEQ ID NO: 163791 - protein, 397 aa, Glycine max
  Coding DNA Sequence Number=SeqID_47013
  Gene Ontology: Mol. function=RNA binding; Cellular component =ribonucleoprotein complex; Biological process=ribosome biogenesis and assembly
  Homolog annotation: Hit_ID=Q8LBT7; Match level="QueryCoverage=97%, HitCoverage=99%, E-value=1e-113, Identity=56%"; Hit description=Rev interacting protein mis3-like
  Pfam annotation: Domain name=KH_1; Domain location=157-209; Score =9.8; E_value=0.078; Accession=PF00013.19; Description=KH domain
MEIHSEEENGVANESQALEQKEKRKGKHDKPKPWDDDPNIDHWKIEKFDPSWNDGGMLEVSSFSTLFPQYREKYLQEAWPMVKSALKEFGVACELNLVEGSMTVSTTRKTRDPYIIIKARDLIKLLSRSLPAPQAIKILDDEMQCDIIKISGMVRNKERFVKRRQHLVGPNSSTLKALEILTGCYILVQGNTVAAMGSFKGLKQVRRIVEECMLNKMHPVYNIKILGVEISQFSFSHCQVLMMKKELEKDPALAQENWDRKNVKQKKVNTKQKKPYTPFPPPQQPSKIDIQLETGEYFLSNKRKSAKIWQEKQEKQAEKTAENKRKREEAFIPPKEPANLVDKSEDANSNVADMAMSLKKKTKKFGKRKSEENINAETYIIGSSEQASGKKSKKQRS

SEQ ID NO: 163792 - protein, 64 aa, Glycine max
  Coding DNA Sequence Number=SeqID_47014
MSFLMAVVLDAGKNFSKNTLLRSSQLEMDLGARGLHAGTNNIELLKMLMRIFTCKTMKLGQQMY

SEQ ID NO: 163793 - protein, 82 aa, Glycine max
  Coding DNA Sequence Number=SeqID_47015
QETVGLQVWGEVPHQAKVKRSPYMVARGPQVYPSNLPNNWYQSRWFKLVTSSNEYASTAGRSEKVEYHISEEKTHKPKPPEP

SEQ ID NO: 163794 - protein, 233 aa, Glycine max
  Coding DNA Sequence Number=SeqID_47016
  Gene Ontology: Mol. function=translation initiation factor activity; Cellular component=protein complex; Biological process=translation
  Homolog annotation: Hit_ID=Q6ZNE1; Match level="QueryCoverage=53%, HitCoverage=15%, E-value=3e-43, Identity=65%"; Hit description=CDNA FLJ16186 fis, clone BRTHA2007060, moderately similar to EUKARYOTIC TRANSLATION ...
  Homolog annotation: Hit description=INITIATION FACTOR 3 SUBUNIT 10
PEEKGKREVEEDDDDSSELHDLVAHLGEEGTRERSKVQTLVSLMRKRKTRRRKKVSVGTVVWWNRPARNDEVFLGVLSLFMGFPCSLFSEEWSHPVHWEFDQARTNPHVPRAQQVLKVGAQERRELVFVQVQLAQYVPALERLATMRLLQQVSNVYQSMKIETLSGMIPFFDFSQVEKSLESDGLRDHLANFAEELNKARQMIYPPDKRSSKLGALLPSLSEVVAKEHKRLLA

SEQ ID NO: 163795 - protein, 73 aa, Glycine max
  Coding DNA Sequence Number=SeqID_47017
MEKALTKKKRVRSKKMGAEPLSKNDVALAQTQAPFVLGLQPSALVEHVAHVDWSLLDQIPSEQGGSIPILASK

SEQ ID NO: 163796 - protein, 485 aa, Glycine max
  Coding DNA Sequence Number=SeqID_47018
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=3e-56, Identity=29%"; Hit description= UPI00006A17C9 related cluster
  Subcellular localization annotation: CTP_CleavageSite=69; ConfidenceScore=5.43e-01
MARACSPLKARTCNPLMARTCSPLKVSMCIPLMARTCSFLKLRTCSLLKARACSPLKARTCALLMAWVCSPMRARVCSPLKVRTCSSLKARMCSPVKARTCAPLMARACSPMKVSTSRPMKARPCSPLKARPCSPLKVRTCSPLKARTCKRTCSPLKATTCSTLKARTCSPLKARTCSPLKARACNPLKARTCSPQKVRTCSPLKARTCDGVLPSERRVRACRPLKARACIPLKARTFSPLKARSCYPLKARTCKRTCSPLKARVCSPPKARTCSPLKARACSPLKATTCTPQMTRVCSPLKLRACTPLKARACSPLKARTCKRTCSPLKATACSTLKARTCSPLKVRTSSPLKARAFSPLKARTSSPLMASRCKISCSPLKARACSPLNVRTCSPLKLRTCSPLKSSEGEGVLPSEGKVWACSPLKARACSALKVRMCSPLKARACSPVKARAYSPLKARAYCPQKASMSSPMKARESNPMKAR

SEQ ID NO: 163797 - protein, 74 aa, Glycine max
  Coding DNA Sequence Number=SeqID_47019
MNPAAEYVQRLKIERQAVETLYQAFSDNNPDLVDSVLAPSWEDIPLAPGQVAGPEGIKPIIRMLAQAFPDVQIV

SEQ ID NO: 163798 - protein, 304 aa, Glycine max
  Coding DNA Sequence Number=SeqID_47020
  Gene Ontology: Mol. function=transcription factor activity; Biological process=regulation of transcription, DNA-dependent
  Homolog annotation: Hit_ID=Q8UKC6; Match level="QueryCoverage=96%, HitCoverage=89%, E-value=1e-58, Identity=41%"; Hit description =Transcriptional regulator, LysR family
  Pfam annotation: Domain name=LysR_substrate; Domain location=93-302; Score=112.9; E_value=9.4e-31; Accession=PF03466.10; Description=LysR substrate binding domain
MDFHGIDLNLLVAFDALMNERNVTRAATQVGVSQPANECRFVAITHPVSVTRCSCAARRVLLPTARARDLSGPIAGALRQLEATLVAKPAFAAEKAQINFKLGVSEYPAFVLLPSLMQALQDVAPGVSLNVQAFTNRDHAVDLLDAGAIDVAIGVIPTHSDSRIISRPVLRDEFVTIVASNHPAARRGMDMESYLALPHILVSPEGELYGLVDQVLAQQGKKRRLGLTVQQMFTVPSIVAQTHMTATVMKRVALHAQASRQLVLFPPPLSLPEMVFNLIWHRRSDAHPAQQWFREFIEQQAARL

SEQ ID NO: 163799 - protein, 80 aa, Glycine max
  Coding DNA Sequence Number=SeqID_47021
MLTSSKRVQMTTLASACQSNLGSPNDEVRITERCLRMLPDSWVMIAKGGVVDKSETFAPTYPPFVMKNSDLRSSFFCETK

SEQ ID NO: 163800 - protein, 34 aa, Glycine max
  Coding DNA Sequence Number=SeqID_47022
VDFKIKTLKVGAKRLKLTIWDTGNIESKSCAFSS

SEQ ID NO: 163801 - protein, 112 aa, Glycine max
  Coding DNA Sequence Number=SeqID_47023
MSSSPLHNSKGQKKELFGRSAKVDVSLSELNALSECHPLSEASTRLGNRRNLEGNLSRRHALSTSSAHSASHLSPSRLNASLALSENSLTRAKHKNGAKRDVEVSEPFLSME

SEQ ID NO: 163802 - protein, 112 aa, Glycine max
  Coding DNA Sequence Number=SeqID_47024
MAGKESTLHLEVKCAWGMWIPNMVRGMDHFIGIRPRALSLTGVEARVEALPLVDFEEDPEIIKEDSKMEEDLKEDAKPMEESMVLPRDPTYGISLVATSDLYFVYLSHMVGR

SEQ ID NO: 163803 - protein, 231 aa, Glycine max
  Coding DNA Sequence Number=SeqID_47025
  Gene Ontology: Mol. function=transposase activity; Biological process= transposition, DNA-mediated
  Homolog annotation: Hit_ID=Q1T4P3; Match level="QueryCoverage=88%, HitCoverage=32%, E-value=3e-10, Identity=29%"; Hit description=IMP dehydrogenase/GMP reductase
MERVLADVLRDQRKLGNKGDEGWKRSALNVAAAVLSTSFNVNVTSDNVKNRIKLWISWYGIVSDILGQSGFDWDGTKHMITVENENAWNEYCTSHKSAKPFRYKVLQNWDDIVDLCAKDRATGHGAETAMDADEAMSRETNEVEFMGLGATAIDLEEPNSNTKGKRQGSTSSGTHPHKRKMGEKEGITTSLDKMANSFNRMVEKMDGKVDDEDIQEVLREAALIPDLNRQQ

SEQ ID NO: 163804 - protein, 106 aa, Glycine max
  Coding DNA Sequence Number=SeqID_47026
  Subcellular localization annotation: CTP_CleavageSite=89; ConfidenceScore=5.43e-01
MKDCKNTSGEDVSFTSRISQSLTNSSQVLRMASASNSHLCRSSHNKISQNSLELGPFSLYNFLNMQKLQARARLLCMQRLFQEKFQTPFANLISGLNRWPCSCSCA

SEQ ID NO: 163805 - protein, 126 aa, Glycine max
  Coding DNA Sequence Number=SeqID_47027
ALGFPALITGLNQSFGVPVTPSKVIRPPITRAFIEKYCTPRQAQGDAPQAANAPPPPHQVDPAGRPTTGGRCRYMSVSTSLASVSRDRVSLLLRALLQINLGLRSHGPRIGPRPRQRRCLQKLPAM

SEQ ID NO: 163806 - protein, 119 aa, Glycine max
  Coding DNA Sequence Number=SeqID_47028
MMKDAIHGHNFVAPGLYFLTPSLLCASSGFPTASILLEPSFAWLFIEKGKKVPDKLVQASCTHPHANILIPKITKIWHLSCMCPLMHMTRRLHMQCNNNTQENWIEIKEPLVLLPSMRR

SEQ ID NO: 163807 - protein, 65 aa, Glycine max
  Coding DNA Sequence Number=SeqID_47029
MEPLMEDIEARNVETKRADARRGDIKPSRLRGDIERGQRVFEVIGKGSESERSESRVRCSTSNAV

SEQ ID NO: 163808 - protein, 296 aa, Glycine max
  Coding DNA Sequence Number=SeqID_47030
  Homolog annotation: Hit_ID=Q1SSN0; Match level="QueryCoverage=64%, HitCoverage=53%, E-value=9e-64, Identity=65%"; Hit description =Survival protein SurE
  Pfam annotation: Domain name=SurE; Domain location=3-135; Score= -94.2; E_value=0.018; Accession=PF01975.8; Description=Survival protein SurE
MSIRFVLSNLIAKAVWTARSMSGANKKMIEALIARKKEEYLKEEFYSGVVAGAREALLCGVPALSISLNLKKDESQENDFKDDVSVCLPLINTAIRDVEKGTFPKSCLLNVEFPTSLLSNKGFKLTKQSMWRSTPNWLAVSTSRYPTGHFLANQGGLGLQFAQLGPDASAAKKNLEIIESMGAAGKSDPNKVNKYFKLEEEEVDEDLDYRALESGYVAVTPLSISPHIETVIQMTSKFESMNKLQNQLEKVESLTQDLEEGLEFLFRHLINTRGIVRSCGCPINSSADPVATTEGE

SEQ ID NO: 163809 - protein, 43 aa, Glycine max
  Coding DNA Sequence Number=SeqID_47031
  Gene Ontology: Mol. function=signal transducer activity
  Homolog annotation: Hit_ID=Q1T3X1; Match level="QueryCoverage=86%, HitCoverage=19%, E-value=8e-10, Identity=81%"; Hit description =Regulator of G protein signalling
MELNISHRSKQEILSTSSLTRPDLFHNALNEIIQRMKTYTRTL

SEQ ID NO: 163810 - protein, 141 aa, Glycine max
  Coding DNA Sequence Number=SeqID_47032
MAKRDRKTEREQHIHQLTTTLIYTIDQKTQAIDHRNKSSKVGSLTEVIAILAITSKHSNIAATPAINALQFTHYLAEECIGFSSSHSSKSSVGGSVGSSEGFPAVLKTMWDNVSVEGAVSGRFQAGGEREEQFQAGGEREE

SEQ ID NO: 163811 - protein, 315 aa, Glycine max
  Coding DNA Sequence Number=SeqID_47033
MTCRDKFMVIPHTFLPFRHSCVRWHAETNYGHSAPFCHPEAAGPMTCGDKLWSFRTPFFHSDKVVSDGTQRQIMVILRPFIIQRRRARLHAETNYGHSAHPFAIQTQLCPMARREKLWSFCTLLSSRGGGPDDVRRQIMVNPRTLFAFQTQLCPMARRDKLWSFCTLLSSRGGGPDDMRRQIMVIPRTLFVIQTKLCPMARRDKLWSFCTLLSSRGGGPDDVRRQIMVIPRTLFAIQTQLCLMARRDKLWSFCTLLSSRGGGPDDMRRQIMVIPRTLFAIQTQLCPMARRDKLWSFCTLLSSRGGGPDDVRRQIM

SEQ ID NO: 163812 - protein, 57 aa, Glycine max
  Coding DNA Sequence Number=SeqID_47034
MAEINQGKRMTGHDCPRIVCLLLAGFRPMVYSEAMGHATLPSFSCNLCLNMRPPSAR

SEQ ID NO: 163813 - protein, 447 aa, Glycine max
  Coding DNA Sequence Number=SeqID_47035
  Gene Ontology: Mol. function=transferase activity
  Homolog annotation: Hit_ID=Q1S9Q3; Match level="QueryCoverage=75%, HitCoverage=70%, E-value=1e-97, Identity=55%"; Hit description =Ankyrin
MPCAFPSGSGFGRLQQLLYDILRLERVELQNLCRITIHNCGKTIRIVPDVTDQVEGLHVAQEEGQQNNSFVGRFCDMALNFPPVKLLGRLLIFLYLLFQNYILLKFSSGISEIYEQKKTHRLVLEILNCLCQRISEYKESQLREASAYDAMLQAAKLGIIEFIDEMRKTTPDLLWAIDKNKRGIFAHAILNRRKDVFRLLNRVNGRKEIIRCSADVFGNTLLHLAGYLGPSSDLDRRSGAALQMQRELQWFKVVEKIVHPKCKEEKNSDGKKPRELFSESHLEMVKAGEKWAKDTAGSFTLVGTLITTIMFAAAFTVPGGNHQETGAPIFLHDHIFTLFIIADAISLFTSSTSVLIFIGILTSRYAEKDFLKTLPLKLLCGLVTLFLSVVAMMVAFCASLAMMLKGYQRLIIAAMSLASIPVIVLVPSQLRLFLEIFNSTMNATYIK

SEQ ID NO: 163814 - protein, 81 aa, Glycine max
  Coding DNA Sequence Number=SeqID_47036
  Homolog annotation: Hit_ID=Q47522; Match level="QueryCoverage=37%, HitCoverage=38%, E-value=6e-10, Identity=90%"; Hit description=LacZ protein
MRRYRARPIRHSGCASVGKGDRCGPVRYYASWLKGDVLHGRGKLATSELCYERIQGEITIYWDVGGCPVRCWHVGNGIDKL

SEQ ID NO: 163815 - protein, 101 aa, Glycine max
  Coding DNA Sequence Number=SeqID_47037
MSQPTLRRESDARLTGASSKEGKCAKSPPMVLNPSLQPPTPFYSQNRGGGCARLSQASYCFLQKVPDGPRWNDAILPPQGHWIEDSKKIGPKMQEKALGFS

SEQ ID NO: 163816 - protein, 80 aa, Glycine max
  Coding DNA Sequence Number=SeqID_47038
MKNKKVVVAGVSLSEACALGENHSLSETLSPLRELGESTKHLRAQRIISSLRESFVFSRAKCAQLAQQIFTNSCLVRKWC

SEQ ID NO: 163817 - protein, 232 aa, Glycine max
  Coding DNA Sequence Number=SeqID_47039
VVMKNKQKTRSLLPWSRREKTEALPSSKSDNLAEACGSSETSCGVVEEIKISDSTSDEYDESKSSSEESDNDDDIDEEEQIISAAQNVTTHTACDISENDLLNELKELELEAQDDNPKINAQEKEGAKTKDITEEEINDQVVDTKDKLDTHLYPPGRIMHIIPSPSSENNSNSSNHNSSEEKEVYLYETPRQLYGKLRLSRGMIIDHLTRNYLKVLQQLINQLEKEKSHYGG

SEQ ID NO: 163818 - protein, 1091 aa, Glycine max
  Coding DNA Sequence Number=SeqID_47040
  Gene Ontology: Mol. function=protein binding; Cellular component =membrane; Biological process=defense response
  Homolog annotation: Hit_ID=Q84XG0; Match level="QueryCoverage=94%, HitCoverage=91%, E-value=1e-119, Identity=31%"; Hit description=NBS -LRR resistance protein RGH1
  Pfam annotation: Domain name=LRR_1; Domain location=1015-1037; Score =10.6; E_value=3; Accession=PF00560.23; Description=Leucine Rich Repeat
  Pfam annotation: Domain name=LRR_1; Domain location=547-568; Score =4.4; E_value=43; Accession=PF00560.23; Description=Leucine Rich Repeat
  Pfam annotation: Domain name=LRR_1; Domain location=570-591; Score =20.2; E_value=0.0077; Accession=PF00560.23; Description=Leucine Rich Repeat
  Pfam annotation: Domain name=LRR_1; Domain location=593-615; Score =13.7; E_value=0.68; Accession=PF00560.23; Description=Leucine Rich Repeat
  Pfam annotation: Domain name=LRR_1; Domain location=617-639; Score =7.0; E_value=14; Accession=PF00560.23; Description=Leucine Rich Repeat
  Pfam annotation: Domain name=LRR_1; Domain location=759-780; Score =4.8; E_value=36; Accession=PF00560.23; Description=Leucine Rich Repeat
  Pfam annotation: Domain name=LRR_1; Domain location=782-804; Score =2.6; E_value=93; Accession=PF00560.23; Description=Leucine Rich Repeat
  Pfam annotation: Domain name=LRR_1; Domain location=812-842; Score =5.7; E_value=24; Accession=PF00560.23; Description=Leucine Rich Repeat
  Pfam annotation: Domain name=LRR_1; Domain location=917-939; Score =11.6; E_value=1.9; Accession=PF00560.23; Description=Leucine Rich Repeat
  Pfam annotation: Domain name=LRR_1; Domain location=941-965; Score =5.7; E_value=25; Accession=PF00560.23; Description=Leucine Rich Repeat
  Pfam annotation: Domain name=LRR_1; Domain location=991-1013; Score =11.9; E_value=1.7; Accession=PF00560.23; Description=Leucine Rich Repeat
  Pfam annotation: Domain name=NACHT; Domain location=188-320; Score= -33.4; E_value=0.023; Accession=PF05729.3; Description=NACHT domain
  Pfam annotation: Domain name=NB-ARC; Domain location=144-421; Score =41.1; E_value=6.6e-13; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::NACHT::NB-ARC; Domain location=1015-1037::547-568::570-591::593-615::617-639::759 -780::782-804::...
  Pfam module annotation: Domain location=812-842::917-939::941 -965::991-1013::188-320::144-421
MAQPERKSMDAAILVDSISDILKCSLAPPATRLSAKDLQQFQNHLEGIRDMVQKANNNINSQDSYVLAWLLEVKEVVNDLEDLIEVLRHKESATANATRSLIKASQNMAHRLKVTHHVKKASEELKRFLTEAQNLSFSKEARNIERKLLDTVAKFENTLVAVGRENVKKEIINQLKQFVNSGGDGVVPVVTIVGVPGIGKTKLARLVCEDEQVKAHFGEQIWVHGNRETLDVESIATPVAGTVKKGNRFLLVLDDLRDENVEECLHKLRKRLTEAVGAILITTRSNFVANYKIPGTVKLYALRGLNQEESWSLFQQIREQGSSNHINESVEREKVKEYCGGGVPMKIITIARLLNCSESPLSEAVLKEEFLQELKFTYYHQLPMHQKLCYVYCSLFPQDYVIDAEKLIHLWMAEGFLSRNLCSDPQEFGWACFNDFVPFVFEETGRDEFGVVKSYKMNRLMHELARIVAWDENIVVDSDGKRVHERVVRASFDFALDVQCGIPEALFEKAKKLRTILLLGKTNKSRLPHEVKMATSTCDKIFDTFKCFRVLDLHDLGIKMVPSSIGELKHLRYLDLSHNSIEKLPSSITKLVHLQTLKLSQCHVLKELPKDLEDLSCLMHLYLEGCLDLTHMPRGIGKLSSLQTLSLFVPSKNHHMGDLKDLNSLRGNLEILHLERLKLSASDEKDKYVRDKKHLNCLTLRWDHEEEEEEEEEKDKGNDVDHKDGKSLECLEPNPNLKVLCVLGYYGNMFSDWLSSMQCLVKFSLNDCPKCVFIPPLDHLPHLRVLELRRLDSLEFISADAKGSSSSTFFPSLKELTISDCPNLKSWWKTPKWEDDRPFFNCISKLHVQCCPNLHCMPLYPFLDEELVLVDSSVKSMRDTVHAKTSKDFLPLSKLKSMVIERITQSPPKSWLKNFISLENLLIRDCSELECLPEGFKSLSSLQRLTIEGCPKLDLDVSKTEWEGLKHLKCLTIREIPKLKSLPWGVEDVTSLEELELYECPALTFLPESMAKLTSLCKLVISECKNLGSLPKGLEMLKSLNTLTITDCPLLLPRCQPETGDDWPQIGHVRNILLKQNSQALRDLWSQGRTG

SEQ ID NO: 163819 - protein, 226 aa, Glycine max
  Coding DNA Sequence Number=SeqID_47041
  Gene Ontology: Mol. function=triacylglycerol lipase activity; Biological process=lipid metabolic process
  Homolog annotation: Hit_ID=Q6K832; Match level="QueryCoverage=93%, HitCoverage=31%, E-value=9e-38, Identity=42%"; Hit description =Lipase class 3 protein-like
MITSIVVRKAAGKLEKRPAEAPKTLMDTVLTLAEAIRFGYAETLGKWHLLDLPRAILYSVMDKGKKTVAVECAERSDCVQLKDPELLKELYELKKCLTQTMLFSKKRFRAFLFAAGFVKEDVLLRKRRARILKPAFTVILNKESKCLLVFIRGTRSIKDTLTDAIGAPVSFSHFICSDGELKKRDTVSGHGHRGMVAAARWIKKHCTTILLDALRQYPDFQIKVWS

SEQ ID NO: 163820 - protein, 621 aa, Glycine max
  Coding DNA Sequence Number=SeqID_47042
  Gene Ontology: Mol. function=DNA-directed DNA polymerase activity; Cellular component=cytoplasm; Biological process=response to DNA damage stimulus
  Homolog annotation: Hit_ID=Q3KBG7; Match level="QueryCoverage=99%, HitCoverage=59%, E-value=0.0, Identity=63%"; Hit description=DNA polymerase III, alpha subunit
  Pfam annotation: Domain name=DNA_pol3_alpha; Domain location=1-336; Score=282.6; E_value=7.6e-82; Accession=PF07733.3; Description =Bacterial DNA polymerase III alpha sub
PPDIDIDFEHERREEVLQYVFKRYGRERAALTAVAISYRGRSAIRDVARALGLPMDQVNELGAAMDHWGGHVPLPETLRERGFDPETPLMRRLLALTTELIDFPRHLSQHPGGFVISEHPLSTLVPVENAAMADRTVVQWDKDDLDATGLMKVDCLALGMLTAIRKCLAMLQQHGLHSGRMDAIPAKDTKTYDMICAADTIGVFQIESRAQMAMLPRLQPRCFYDLVIEVAIVRPGPIQGDMVHPYLERRRILREQGPEALNDPDNPLYPPQLERVFARTLGVPLFQEQVMQLAVEAAGYTPGQADALRRSMAAWKRRGGLEPHREKLLAGMLKNGFSRDYGEHLFEQIKGFGDYGFPESHAASFALLTYNSCWLKCHHPAAFTASLINSQPLGFYSPDQLLQDARRHGIGVLPVDVRHSDWDCTLDFSKGPAAIRLGLRLIDGCNEPVVQAIMRERAQRPFDDVGDLCQRTALDRRQQGLLADAGALRGLSGHRHRARWDISGVENRLPLFDQARATAEARVPLPLPSAWEDMQADYRSTGTTLGRHPISFLRAQLRSRGCLDAAQLAGHGHGRRVRIAGLVRMRQRPQTASGVTFLTLEDETGMVNAVVWRHLADRQHR

SEQ ID NO: 163821 - protein, 195 aa, Glycine max
  Coding DNA Sequence Number=SeqID_47043
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=2e-20, Identity=31%"; Hit description= UPI00006A17C9 related cluster
MLTFRGLHALTFIRLDVLAFRGLYALAFRGLHVLAFRGLHILAIRGLHALAFRGLHAFAFKGIHALSFRRLHVLAFRGLHTLSFRVLHALSFRGLNVLGFRGLHASPSEGCTPSPSEDYMSSPSEDYTSTPSKGYMLSPSHDYTSSLSDGYTPSPLEDYTSSPLKGCTPSPSEDYASSLSEGYMPSPLEDYTSSP

SEQ ID NO: 163822 - protein, 191 aa, Glycine max
  Coding DNA Sequence Number=SeqID_47044
  Gene Ontology: Mol. function=transcription factor activity; Biological process=regulation of transcription, DNA-dependent
  Homolog annotation: Hit_ID=Q5PH14; Match level="QueryCoverage=99%, HitCoverage=70%, E-value=2e-73, Identity=68%"; Hit description =Putative transcriptional regulator
  Pfam annotation: Domain name=LysR_substrate; Domain location=12-191; Score=7.5; E_value=0.00027; Accession=PF03466.10; Description=LysR substrate binding domain
MMATRRQCQQLANGWRGQLSIAVDCIVKPQRTRQLVKDFYRHFPDMELIISYEVFNGVWDALADGRVDVAIGATQAIPVGGRFAFQDMGALNWRCVVSPQHALAHSPQLDDETLRAWPSLVLEDTSRALPRRMTWTLDNQRRLVVPEWETGLDCLQAGVHFRTARVASAGLSSARHRRWRGYWNIWAMRRR

SEQ ID NO: 163823 - protein, 272 aa, Glycine max
  Coding DNA Sequence Number=SeqID_47045
MAKFDPEIVQEFYANAWPTEEGVRDMRSWERGQWIPFDADALSQFLGDPLVFEEGQQCEFSQRRNRVDGFDEEAIAQLLCTPGQDFARTAAGRRVQIMRTIMTTLTQTWMTLLLSNFLPSDHNFDLPLPKCQLVYAILTRMSAHVAQSYGVPVTPSKVIRPITRPFIEKYCTPRQAQGDAHQAADALPPPRQTDPAGSLGVEHYLQHLVHQQAANHRGQVQIHECLYRFSLSQQGQGSAFFACPTPEQFGAEVAWPGDWLDAQAGEEPAGSP

SEQ ID NO: 163824 - protein, 75 aa, Glycine max
  Coding DNA Sequence Number=SeqID_47046
  Homolog annotation: Hit_ID=Q15B61; Match level="QueryCoverage=36%, HitCoverage=12%, E-value=5e-08, Identity=85%"; Hit description =Pectin acetylesterase
MTKNMKACTQKLKHLQSLCGLILVVKDLVQIPTFSISVVCLDGTLPAYHLHRGYGSGANSWIVNLEVSHEYDLSN

SEQ ID NO: 163825 - protein, 114 aa, Glycine max
  Coding DNA Sequence Number=SeqID_47047
MINQGNESTKFLLWDRECSELIGQSADAVNKLKIEDDDVDLNASPQALDKLLGHELAFKINVQPKFRNSAVLKCSADSSLINVVMDMLADAETSSKMDIPISDSNHSVQHESEF

SEQ ID NO: 163826 - protein, 437 aa, Glycine max
  Coding DNA Sequence Number=SeqID_47048
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=8e-50, Identity=29%"; Hit description= UPI00006A17C9 related cluster
GLHILAFRGLHVLAIRGLYVFTFRGLHALGIRGLHVHALRGLHVLAIRGLHVLAFRGLDVITFRGLHAFSFIGLHILTFRGLHALTFRGLHVLTFRGLHVLAIRGLYVLTFRGLHALTFRGLHVLTFKGLNALSFKRLHIFSIRGLNVVTIIGLHVLTLRGLHALAIRGLHVLAFRGLHVLAFRGLHALAIRGQHVLTFRVLHVLAFRGRHVIAIRGLHTLTFRGLHVLAIRGLHVLAIRGLHALTFGGLHVLAIKGLQILTFRGLHALTFKGLHRTSHPRLHRTPHPHLQSTSLPHIQRTTHPRLQRAARLHALGIRGLHVHALRGLHVLAIRGLHVLAFRGLDVVTFRGLHAFSFIGLHILTFRGLHALTFRGLHVLTFRGLHVLTIRGLYVLAFRGLHALTFRGLHVLTFEGLHTLAFRGLHALAFRRLDALTY

SEQ ID NO: 163827 - protein, 63 aa, Glycine max
  Coding DNA Sequence Number=SeqID_47049
MGGYSADKDSVDDTVCEKYDISKEKWAPVLLDPQRPLLGGCAEKGTGHLEAKHRPPRVVSWGL

SEQ ID NO: 163828 - protein, 56 aa, Glycine max
  Coding DNA Sequence Number=SeqID_47050
  Gene Ontology: Mol. function=RNA binding; Cellular component =cytoplasm; Biological process=negative regulation of transcription from RNA polymerase II promoter
  Homolog annotation: Hit_ID=Q9LT41; Match level="QueryCoverage=88%, HitCoverage=16%, E-value=9e-12, Identity=72%"; Hit description=RCD1
HIPLYLYPFLNTTSKSRLFEYLRLTTLGVIGALVKVQPPCTNKFTSSSQEIVDAYG

SEQ ID NO: 163829 - protein, 80 aa, Glycine max
  Coding DNA Sequence Number=SeqID_47051
  Homolog annotation: Hit_ID=Q9M112; Match level="QueryCoverage=39%, HitCoverage=3%, E-value=4e-09, Identity=90%"; Hit description =Putative GTP pyrophosphokinase
MKKRTKMLGNNTTKKMLMQVLLVLKSKVKDYIATPKPNGYQSLLTTVIPFLYERIFRLEVQFLMPALCKFEVEPVLFLGM

SEQ ID NO: 163830 - protein, 107 aa, Glycine max
  Coding DNA Sequence Number=SeqID_47052
MVVIVPKEHLVVWFCSLHNRPYNYLKGIINSALKGLDDAPQPKSKAPTRWIVVKCNRQKGTSYYVMHWMTTIILGSFRNNWEAYFNDPRPLEPERLKVLRIQWAQYL

SEQ ID NO: 163831 - protein, 66 aa, Glycine max
  Coding DNA Sequence Number=SeqID_47053
MVRTKKTWQMTSEKIDSLEEQASQGSLIPHGRQDVLTTAIGRPDHPGRVHAPGAGVTIKQYFGSAP

SEQ ID NO: 163832 - protein, 291 aa, Glycine max
  Coding DNA Sequence Number=SeqID_47054
  Gene Ontology: Mol. function=L-lactate dehydrogenase activity; Cellular component=glyoxysome; Biological process=tricarboxylic acid cycle intermediate metabolic process
  Homolog annotation: Hit_ID=P37228; Match level="QueryCoverage=93%, HitCoverage=74%, E-value=1e-120, Identity=85%"; Hit description =Malate dehydrogenase, glyoxysomal precursor
  Pfam annotation: Domain name=Ldh_1_C; Domain location=106-279; Score =237.6; E_value=2.7e-68; Accession=PF02866.8; Description =lactatemalate dehydrogenase, alphabe
  Pfam annotation: Domain name=Ldh_1_N; Domain location=1-104; Score =87.5; E_value=4.1e-23; Accession=PF00056.13; Description =lactatemalate dehydrogenase, NAD bind
  Pfam module annotation: Pfam domain module=Ldh_1_C::Ldh_1_N; Domain location=106-279::1-104
MKVSQDTGKKCKVRGFLGQQQLEDALIGMDLVIIPAGVPRKPGMTRDDLFNINAGIVKTLCEAIAKCCPKAIVNFISNPVNSTVPIEAEVFKSAGTYDPKRLLGVTMLSVVRANTFVAEVLGVDPRDVDVPVVGGHAGITILPLLSQIKPPCSFTPKEIEYLTDRIQNGGTEVVEAKAGAGSATLSMAYAAVKFADACLHALRGDAGIIECAYVASQVAELPFFASKVRLGRGGVEEILPLGPLNDCERVYLVLLFQQGEFGKAKKELAASIEKGISFIRKSVVDDSSSRK

SEQ ID NO: 163833 - protein, 50 aa, Glycine max
  Coding DNA Sequence Number=SeqID_47055
MSEVVLRQCVGCRPLDGDRGAVIHKGKLPGCIPNGGCCCAPVCSFLVLPR

SEQ ID NO: 163834 - protein, 131 aa, Glycine max
  Coding DNA Sequence Number=SeqID_47056
MGLKSEINQGKTVVRPQFVARCRFLLSVNIGCQIYPKGVRVSERRPVGSRTYFFPKKMQVSSPGRAELAGVSNPCTRVVKKGEGEVFCTQKLSPPPLIQKTKATGFTSFAALSHHFCVFASIFALLLTLYK

SEQ ID NO: 163835 - protein, 305 aa, Glycine max
  Coding DNA Sequence Number=SeqID_47057
  Gene Ontology: Mol. function=chromatin binding; Cellular component =chromatin; Biological process=chromatin assembly or disassembly
  Homolog annotation: Hit_ID=Q1SAV4; Match level="QueryCoverage=98%, HitCoverage=76%, E-value=1e-103, Identity=56%"; Hit description =Integrase, catalytic region
  Pfam annotation: Domain name=Chromo; Domain location=249-297; Score =14.5; E_value=0.019; Accession=PF00385.14; Description='chromo' (CHRromatin Organisation MOdifier
  Pfam annotation: Domain name=rve; Domain location=1-102; Score=-2.6; E_value=0.0099; Accession=PF00665.16; Description=Integrase core domain
  Pfam module annotation: Pfam domain module=Chromo::rve; Domain location=249-297::1-102
MDIMCKHHGFPKSIVSDRDPLFLSSFWRDLFRLSGTRLRMSTAYHPQTDGQTEVMNRVLEQYLRAFIHNQPADWYRYLALVEWSYNTSLHSSSGLTPFEIVYGKPPPSLIHYLQGSSPNEAVDSLLTNRQEIHHKLQSRLTKAQANMKKLADTKRRDLEFAIGQWVYIKLRPFRQRSITGVLHPKLSKRYFGPFQIEERIGKVSYRLRLPDEARIHPVFHVSLLREHHGPPPPPTDVSPLTFISQKPVPRPLCVLSSKWDHSTSPPTRLVLIQWEGQPPEDTTWEEWPQVCDLYHLEDKVVFGGG

SEQ ID NO: 163836 - protein, 116 aa, Glycine max
  Coding DNA Sequence Number=SeqID_47058
  Homolog annotation: Hit_ID=Q1SYF1; Match level="QueryCoverage=47%, HitCoverage=16%, E-value=5e-07, Identity=50%"; Hit description=Basic helix-loop-helix dimerisation region bHLH
MLAMILSELEKLYFIVQSSSFLPFGNSKTDVTIIAQMNKENCMTAKDLLGRLRQALDVDIYEALKLHSLAGHIVMMLGSCASNVWVHRVDSDIGWMIAIEVTAVVIKRTQAPDPNA

SEQ ID NO: 163837 - protein, 344 aa, Glycine max
  Coding DNA Sequence Number=SeqID_47059
  Gene Ontology: Mol. function=RNA-directed DNA polymerase activity; Cellular component=chromatin; Biological process=chromatin assembly or disassembly
  Pfam annotation: Domain name=RVP; Domain location=73-177; Score=-3.8; E_value=0.0091; Accession=PF00077.10; Description=Retroviral aspartyl protease
  Pfam annotation: Domain name=RVP_2; Domain location=58-185; Score= -49.9; E_value=0.0077; Accession=PF08284.2; Description=Retroviral aspartyl protease
  Pfam module annotation: Pfam domain module=RVP::RVP_2; Domain location=73-177::58-185
MALRREKGLCYNCDEKWSSSHRCKGRVLLFIADESDELTPEPSPLDMESPTSLTIDPDTNQPHISLHALSGLPSSETFRLTGTINHSNLTILIDSGSTHNFLQPRIAQFLRLHPQSTSPLHVLVGNGSVLDCNQMCPDTPLTLQDHQFTVTFHLLPISGADAVLGIDWLRQLGPITTDYTSLSMKFTYMGRPVELHADISNGPHSVSATQVKRLIHTGSASALFHLSILPTQPDPQTFLPHPIPAIEGLLTQFQKLFQNPSSLPPPRHTVHRINLIPNTTPINVRPYRYPHFQKSEIEKQVTELLSSGLIQPSTSPYSSPVLLVKKKDGTWRMCVDYRALNTAT

SEQ ID NO: 163838 - protein, 209 aa, Glycine max
  Coding DNA Sequence Number=SeqID_47060
  Gene Ontology: Mol. function=transcription regulator activity; Cellular component=nucleus; Biological process=regulation of transcription
  Homolog annotation: Hit_ID=Q1PF17; Match level="QueryCoverage=73%, HitCoverage=49%, E-value=8e-16, Identity=38%"; Hit description=Basic helix-loop-helix family protein
  Pfam annotation: Domain name=HLH; Domain location=167-209; Score =13.6; E_value=0.0052; Accession=PF00010.16; Description=Helix-loop -helix DNA-binding domain
MEIAYNYYLPELEIEDPTFFDQYQMDSFACPLDDFDFESFSGSPESNSSYHFNSESTPNCFPAESHDQSFTPARPTKRLKNTCASDFISHKVSAFSSSQLISFGHFNAPSPSHASQQFQNLDFDEKASSENMDFAAFVSQGSYEDKSFLSSDNRTNQVGITTRNPIQAQEHIIAERKRRENISKRFIALSAILPGLKKMDKASVLGDAV

SEQ ID NO: 163839 - protein, 66 aa, Glycine max
  Coding DNA Sequence Number=SeqID_47061
MGAETEFNDGDEGGRCKYLKPLIFLLGPYVLQVNPLNGITYTVETLRRAWTHRCPMGIVTCTQRNY

SEQ ID NO: 163840 - protein, 40 aa, Glycine max
  Coding DNA Sequence Number=SeqID_47062
MAIDPLWLMLTVIIVAYPIILSSFPLPSNWKMQLPHLLMG

SEQ ID NO: 163841 - protein, 227 aa, Glycine max
  Coding DNA Sequence Number=SeqID_47063
  Gene Ontology: Mol. function=transcription regulator activity; Cellular component=nucleus; Biological process=regulation of transcription
  Homolog annotation: Hit_ID=Q1SYF1; Match level="QueryCoverage=88%, HitCoverage=75%, E-value=6e-21, Identity=32%"; Hit description=Basic helix-loop-helix dimerisation region bHLH
KDSSSASQTEHSSTVSNSSEDDKVFGERPAKTLKIGTSNSSNTEFLSQKKDSSPSYIIFSDNVNQLQAPTLKPKGKVACHGRKGSLENQNFGSVSRSPHHAKDHIIAERMRREKISQQFVALSALIPDLKKGADGQSLGAWGCYKARETAPGASEATGREEQKEAGSGIRVEARVLEKHVLIRIHCGKQKGLFINILKDIENLHLSVINSSILLFGTSKLDITIVAE

SEQ ID NO: 163842 - protein, 56 aa, Glycine max
  Coding DNA Sequence Number=SeqID_47064
MAHEWVGWSRNLQLPLLCVEAKDHQEESRMQGKSLCVSLGLGYGKSCMALVQGAPG

SEQ ID NO: 163843 - protein, 163 aa, Glycine max
  Coding DNA Sequence Number=SeqID_47065
  Homolog annotation: Hit_ID=Q49KC7; Match level="QueryCoverage=35%, HitCoverage=17%, E-value=1e-10, Identity=52%"; Hit description =Transposase
MNNENVNLDFNLNVVLEIENENEGPLLNSDANNVQSKSLNSIDLNIIPISGDGANSQQPISGAGNQSQLPNLNDLPSVEMDFDMSVDKEEDGMADDTEDAAYTGETGETLPKKTKNYGRKRIGLDIERIREIPLSKRTTLRFLSHALEINKTSLIRFHKDGII

SEQ ID NO: 163844 - protein, 377 aa, Glycine max
  Coding DNA Sequence Number=SeqID_47066
  Gene Ontology: Mol. function=transcription regulator activity; Cellular component=nucleus; Biological process=regulation of transcription
  Homolog annotation: Hit_ID=O81348; Match level="QueryCoverage=48%, HitCoverage=54%, E-value=1e-36, Identity=47%"; Hit description =Symbiotic ammonium transporter
  Pfam annotation: Domain name=HLH; Domain location=187-236; Score =41.9; E_value=2.1e-09; Accession=PF00010.16; Description=Helix-loop -helix DNA-binding domain
MENNNTSMDASEASWLSDLETEDGCNLFRQCHLETLLDDDEELLSHEIASAFENLQQPLSSESNTSYSEAPMNSFTEETSFEKPIKQPKTNASSWNSSFTKHFSLSSSPSSPTSKILSFENSNSSPPNPNNTDQFHGIVVSSALSPKQIKTKGASVSLPHTRKRLSENQNFEAESPKGHRSYKSPSHVRDHIIAERKRREKLSQSLIALAALIPGLKKMDKASVLGDAIKYVKELQERMRMLEEEDKNRDVESVVMVKKQRLSCCDDGSASHEDEENSERLPRVEARVLEKDVLLRIHCQKQKGLLLNILVEIQNLHLFVVNSSVLPFGDSVLDITIVAQMGTGYNLTINDLDGLVVGGNINNDIFMFCGVQIPKND

SEQ ID NO: 163845 - protein, 348 aa, Glycine max
  Coding DNA Sequence Number=SeqID_47067
  Gene Ontology: Mol. function=zinc ion binding
  Homolog annotation: Hit_ID=Q2QSD0; Match level="QueryCoverage=48%, HitCoverage=13%, E-value=4e-23, Identity=43%"; Hit description=PHD -finger family protein, expressed
MHPDEQSELEANWKFVKIGHVKSACRGKERSNGETSFPGHRLLVSNDNTHKDPNFPNGTKKNESQQGEQHRKAGTSTSMFELWTDPDFDGMAYFQMERRKMRASKIHNIEGIARTWDAIQAHLSNRASAEVLEVANTNRLSEIIILEELPRLRTWPSQFMRSQVTEDNIAQYFFAHDSDSYIYYEQLVNYMMNNDLALKGHLDGVELLIFPSNILPENFQCKDGMACFSFGVYSEDKRRITQQVHPVSNSLKLKNGDDMAIVDEIPEFESSGDTVLAVGENSDSKGGVANAEHAVVDINNVSLWPKSETQENGSVGIEESLVPPSTPDSDRLQAVAALFLLAEGHMEF

SEQ ID NO: 163846 - protein, 74 aa, Glycine max
  Coding DNA Sequence Number=SeqID_47068
  Subcellular localization annotation: CTP_CleavageSite=45; ConfidenceScore=5.35e-01
MPTHHPKAKNLLTFFGSSQPSSKPASPPIGKKEVVVLTKAKKKSLAESRKKTKIDKTLERKDARQEEVDIISFV

SEQ ID NO: 163847 - protein, 63 aa, Glycine max
  Coding DNA Sequence Number=SeqID_47069
MFIYKEKEKGEREITSRRRERTLESGRFQKDGMGFVIINLVHGASSGTKGERKVEVNKPSSFR

SEQ ID NO: 163848 - protein, 72 aa, Glycine max
  Coding DNA Sequence Number=SeqID_47070
METWTNKDNTSNGDSWEPPQPGTLKCNVDASSERFSTLLEWALAYMRDEKARVIVVRTNFMKPCQSVIQGEA

SEQ ID NO: 163849 - protein, 74 aa, Glycine max
  Coding DNA Sequence Number=SeqID_47071
  Subcellular localization annotation: CTP_CleavageSite=38; ConfidenceScore=5.15e-01
MYGATTSDAFARDVPRGASVAIPTSVVPFVYVALETPTLMASWSWLSQMRGPRVAALQRAAGQGCSDAGAVGQG

SEQ ID NO: 163850 - protein, 69 aa, Glycine max
  Coding DNA Sequence Number=SeqID_47072
  Gene Ontology: Mol. function=RNA-directed DNA polymerase activity; Biological process=RNA-dependent DNA replication
  Homolog annotation: Hit_ID=Q1RW99; Match level="QueryCoverage=94%, HitCoverage=10%, E-value=2e-13, Identity=45%"; Hit description=RNA -directed DNA polymerase
MMWPDGFGVLQFFNQGWILPNHNSNMVVLIPKIPGIEIIKDFRLIALENFQFKIITKVLGDRLAEIAPN

SEQ ID NO: 163851 - protein, 211 aa, Glycine max
  Coding DNA Sequence Number=SeqID_47073
  Homolog annotation: Hit_ID=Q1RVS9; Match level="QueryCoverage=25%, HitCoverage=11%, E-value=2e-07, Identity=50%"; Hit description=Zinc finger, CCHC-type
MATPTPIVPWSFLVDDVDLGKKAHVVAAPAPKSPKKDTFVQALGHACTIPLSQLPVPYLKLKEILRSHKRSIKQGLRLAKTTFMKGFFWQKVFLPPRFLGYVQNLENFGNPWGVGTWLMVMRLFLQLTEIHANCCNRIITTNKLVECCNKLRKILQALGAFAQLELKRSPANVNQQVQVANAKVDEIQQKIQVQGLSDELHLLETNAQVEL

SEQ ID NO: 163852 - protein, 232 aa, Glycine max
  Coding DNA Sequence Number=SeqID_47074
  Gene Ontology: Mol. function=protein dimerization activity; Cellular component=phagocytic vesicle; Biological process=proteolysis
  Homolog annotation: Hit_ID=Q2A960; Match level="QueryCoverage=95%, HitCoverage=51%, E-value=2e-99, Identity=75%"; Hit description =Acetylornithine deacetylase, putative
  Pfam annotation: Domain name=Peptidase_M20; Domain location=90-223; Score=8.1; E_value=0.0005; Accession=PF01546.18; Description =Peptidase family M20M25M40
MAANLLATLGDLERDSFVPLLSKLIGESKHPPELIPQEDRVVKHVLDILLPFSTTSSGGPLLVNHVTYHAGRGNLIIEYPGTVPGKILSFVGCHMDVVTVNPNDWDFDPLSLTVDGDKLRGRGTTDCLGHVALVTELVRKLGETKSNLKSTIVAVFIANEENSAITGVGVDALVKDGLLNKLKDGPLYWIDTADKQPGVGTGGMIPWKLHVTGRLFHSGLAHKVCSYVLHYK

SEQ ID NO: 163853 - protein, 107 aa, Glycine max
  Coding DNA Sequence Number=SeqID_47075
MIAETEPFGSNENGEEEEEGVIEICVPDRGSTHNKKGEVDVRRKDATTRGLCVGPMTGGREGFGGECEVLVNGKVGSCHGKGRQRGFCCWWRRRGFCCWWWLNKEKL

SEQ ID NO: 163854 - protein, 260 aa, Glycine max
  Coding DNA Sequence Number=SeqID_47076
  Homolog annotation: Hit_ID=Q2A962; Match level="QueryCoverage=28%, HitCoverage=36%, E-value=1e-20, Identity=67%"; Hit description=Zinc finger (C2H2 type) containing protein
  Pfam annotation: Domain name=zf-C2H2; Domain location=89-111; Score =21.6; E_value=0.0028; Accession=PF00096.16; Description=Zinc finger, C2H2 type
  Subcellular localization annotation: CTP_CleavageSite=36; ConfidenceScore=5.27e-01
MAAEIGLVSMTQIQNLSQPQHPKTQQQQQPQPKNPNSTTTTSSSTWMWNPRKQQHQQQQVEDDDDSWEVRAFAEDTRNIMGTTWPPRSYTCTFCRREFRSAQALGGHMNVHRRDRARLHQAPVPSSSSNPMTSSLPTSPFINIPPQDLVANAGLCLLYHLPKSPSSTAPPFPPSPTTPSPSTLLSISSYPTTNFLMQTSFNFPGAPATGINTTTTTTVSSLCYNSSKVEQSATSSSIDHNGHLEELDLELRLGHKPTPTS

SEQ ID NO: 163855 - protein, 386 aa, Glycine max
  Coding DNA Sequence Number=SeqID_47077
  Homolog annotation: Hit_ID=Q1SPJ4; Match level="QueryCoverage=99%, HitCoverage=26%, E-value=1e-105, Identity=51%"; Hit description =Thiolase
MVTYSILLQVGATSDLMLAYLDFFLGGDEKRPDLPPRLYQRFPMSIIFGGDGSYMSPFSLHSDNILTSIMSQSVPPTIWYRLVAGLNAQLRLVRRGHLKITFGPVISWLDVYANPKLATYGVCVDLAWFQPTASGYCQFGLVVYATENESMSSSCEGYDDSRITEKQTCLLSSPRNPVHHIRSNEHLMMPRRMSGGILHAKSLRTLKEKKTSYYPFAFIIYNTKPIGHQDLVGLVISIILLGDFILVLLTLLQMYSLSLLSFFLVLFVLPLGVLFPFPSGISALFSQGPRRSAGLARLYALWNLMSLVNVVVAFFCGFIHYTARSHKLSNFQSWNFSMDESEWWILPSGLALCKIIQARLVDCHVANQEIQDPSLYSSDTNVFWNS

SEQ ID NO: 163856 - protein, 143 aa, Glycine max
  Coding DNA Sequence Number=SeqID_47078
  Gene Ontology: Mol. function=transporter activity; Cellular component= coated vesicle membrane; Biological process=intracellular protein transport
  Homolog annotation: Hit_ID=Q1SEA1; Match level="QueryCoverage=99%, HitCoverage=100%, E-value=1e-41, Identity=62%"; Hit description =Longin-like
  Pfam annotation: Domain name=Clat_adaptor_s; Domain location=2-143; Score=67.0; E_value=6e-17; Accession=PF01217.10; Description =Clathrin adaptor complex small chain
MGMRLMLMVNKQGQTRLAQYYEHLIIQESQALEGKILHKCLARNDNQCSFVEHRNYGIVYRRYASVFFLVGVDVDESELAILEFIHLLVETMDRHPGNVCVARYDVSFRKSTFYAGGNGHEWLHCGDKQSKYSVSNQLLDKTS

SEQ ID NO: 163857 - protein, 577 aa, Glycine max
  Coding DNA Sequence Number=SeqID_47079
  Homolog annotation: Hit_ID=Q1SPJ4; Match level="QueryCoverage=97%, HitCoverage=37%, E-value=1e-173, Identity=54%"; Hit description =Thiolase
  Pfam annotation: Domain name=GCC2_GCC3; Domain location=300-357; Score=5.2; E_value=0.03; Accession=PF07699.3; Description=GCC2 and GCC3
VGPGSVLRGPLEASGDDMTPQLYCEVENCPVELLHPPEDCNVNSSLAFTLQICRVEDVIVEGTITGSVVHFHWIRNIDVSYSGVISVSGLGCTGGLGRARYFENGIGGGGGHGGYGGDGYYNGNFIEGGSTYGDVDLPCELGSGSGNNSLAGATAGGGIIVMGSLEHSLSSLTLNGSLRADGESFGDDPRGKDGGITSSIGPGGGSGGTVLLFIQTLALGDSSIISTAGGQGSPSGGGGGGGGRVHLHWSNIPVGDEYVPLASVKGSIITGLLLLKLTYKLVGGFGGGQGLPGKNGSISGTACPRGLYGIFCEECPVGTYKNVSGSDRALCHDCPSDKLPHRAIYISVRGGVAETPCPYKCISDRYHMPNCHTAFEELVYTFGGPWLFGLLLLGLLVLLALVLSVARMKYVAGDDLPAVTPARNDTRLNHSFPFLESLNEIMETNRSEESPSHVHRLYFQGPNTFSEPWHLPHCPPEQVKDIVYEDAFNRFVDDINSLATYHWWEGSIYSILCIIAYPLAWSWLQMCRRKKLQKLREFVRSEYDHACLRSCRSRALYEGLKWPGDRTGLEYRKVQSL

SEQ ID NO: 163858 - protein, 186 aa, Glycine max
  Coding DNA Sequence Number=SeqID_47080
  Gene Ontology: Mol. function=alpha-mannosidase activity; Cellular component=Golgi apparatus; Biological process=carbohydrate metabolic process
  Homolog annotation: Hit_ID=Q1SJM4; Match level="QueryCoverage=85%, HitCoverage=13%, E-value=8e-54, Identity=67%"; Hit description =Glycoside hydrolase, family 38; Galactose mutarotase-like
  Subcellular localization annotation: CTP_CleavageSite=29; ConfidenceScore=5.79e-01
MPFSSSRRGTSWSSSILPSSNPHKSKAPRKGRKRALVKDFIFSNFFAIGLVLSLSLFLLILLRSGVPKPLSTRFRATTRPSRSRKTVIRKPLPTGANLSTLAGAAVDVTTKALYDKIEFLDVDGGAWKQGWSVTYRGNEWDSEKLKVFVVPHSHNDPGWKLTVDEYYDRQSRHILDTIVQTLSKVK

SEQ ID NO: 163859 - protein, 77 aa, Glycine max
  Coding DNA Sequence Number=SeqID_47081
MSDTLESLLTRSPTKFGLELEEFFSRNLEAQRIKHESEKQSRTTEKSLAQKLNLPQSGIDTSNERGLAHITSEDLLP

SEQ ID NO: 163860 - protein, 250 aa, Glycine max
  Coding DNA Sequence Number=SeqID_47082
  Gene Ontology: Mol. function=DNA binding; Cellular component =chromatin; Biological process=chromosome organization and biogenesis (sensu Eukaryota)
  Homolog annotation: Hit_ID=O82166; Match level="QueryCoverage=99%, HitCoverage=100%, E-value=5e-65, Identity=51%"; Hit description =Putative AT-hook DNA-binding protein
  Pfam annotation: Domain name=DUF296; Domain location=72-189; Score =209.1; E_value=1e-59; Accession=PF03479.5; Description=Domain of unknown function (DUF296)
MAGLDLGTASRFVQSLHRPDFNQQQESEEDAKPQDGPQQGDVVGRRPRGRPAGSKNKPKPPVIITRESANALRAHILEVASGCDVFESVASYARRRQRGICILSGSGTVTNVSLRQPASAGAVATLHGRFEILSLTGSFLPPPAPPGATSLSIYLAGGQGQVVGGSVVGELTAAGPVIVIAASFTNVAYERLPLEEEEEQVQISGAAANNNNNSNPYHDPSSGLPFFNLPMNVQLPVDAWAGNSTTRSPF

SEQ ID NO: 163861 - protein, 348 aa, Glycine max
  Coding DNA Sequence Number=SeqID_47083
  Homolog annotation: Hit_ID=Q1SPJ4; Match level="QueryCoverage=70%, HitCoverage=16%, E-value=8e-33, Identity=31%"; Hit description =Thiolase
  Subcellular localization annotation: CTP_CleavageSite=18; ConfidenceScore=5.17e-01
MGRADGLTGSPRHLNNVRRKKRVNRRSSEGEMCTCPLSFLFPHSNSPFHFLFPKTPKPYSLCNQQLLCDDFASFLMAHTLHRPFSFSFFILLLYFTFSFASHHGFSILDSDFDALYADYTPPSPPPPPPLPHPPSLTCQEGLNGTGSLATTCDLNSSLIFSSDVYIEGSGSLNILPGVNLSCPVSGCVIFINVSIEFSLQSGAAIVAGTVLVASRNATLFGGSVINVTGLAGAPPAQTSGTPSGTQGAGGGHGGRGATCVSDNTKLPDDVWGGDAYSWSSLDEPWSYGSKGGTTSKEEKYGGEGGGRIKFEVLDSIDVSGDLLANGGDGGMKGGGGSGGSIFVKAHRM

SEQ ID NO: 163862 - protein, 103 aa, Glycine max
  Coding DNA Sequence Number=SeqID_47084
  Homolog annotation: Hit_ID=Q1SQE1; Match level="QueryCoverage=59%, HitCoverage=18%, E-value=2e-13, Identity=67%"; Hit description=Seed maturation-like protein, putative
MEEKRRRWRGCLETVMHGGDGLLHGVSGGGGHAFGDGGVVEGLDAAEHGGDHGEAAVEVAGGDGVVGEAGGKEAAAATREGEENGGRWRSWKRGRLGWEELKE

SEQ ID NO: 163863 - protein, 914 aa, Glycine max
  Coding DNA Sequence Number=SeqID_47085
  Gene Ontology: Mol. function=RNA-directed DNA polymerase activity; Cellular component=chromatin; Biological process=chromatin assembly or disassembly
  Pfam annotation: Domain name=Chromo; Domain location=794-844; Score =18.4; E_value=0.0066; Accession=PF00385.14; Description='chromo' (CHRromatin Organisation MOdifier
  Pfam annotation: Domain name=RnaseH; Domain location=272-391; Score= -28.9; E_value=0.028; Accession=PF00075.14; Description=RNase H
  Pfam annotation: Domain name=rve; Domain location=525-681; Score =125.2; E_value=1.8e-34; Accession=PF00665.16; Description=Integrase core domain
  Pfam annotation: Domain name=zf-H2C2; Domain location=466-507; Score =8.5; E_value=0.027; Accession=PF09337.1; Description=His(2)-Cys(2) zinc finger
  Pfam module annotation: Pfam domain module=Chromo::RVT_1::RnaseH::rve: :zf-H2C2; Domain location=794-844::12-181::272-391::525-681::466-507
MLTTGIIQPSHSPFSSPILLVKKKDGTWRCCVDYRALNAVTVKDRFPMPTIDELLDDLGRASWFSKLDLRQGFHQIRMAEEDAHKTAFRTHQGHYEFLVMPFGLCNAPSTFQAAMNDALQPFLRRFVAVFFDDILVYSPDLSSHVSHLEAVLSALADREFLLKQSKCSFAQRELNYLGHIISSQGVAPDPDKIAAMLEWPLPTCSTSLRGFLGLTGFYRKFVKGYAAIAAPLNSLLRKDKFAWSPDAHQAFRQLQQAMTETPVLANPNFLIPFTLETDASGTAMGAVLLQEGHPIAYYSKALCPRLQRASAYVRELHAITSAVRKWRHYLLGNSFIILTDHKSLKDLMSQTIQTPEQQTYLCKLLGFDYTIKYKPGAANVVADALSRISPAEATCLTLTAPHFLFLQNLRQALLLDPQYVALLQDIRDHPTNHPDITTHQDLLFRHGRVWIPFATPFTRVLLEEFHSLPLGGHTGVTKTLHRLRQNFDWPHLKEDVRRYVAQCATCQQTKYDTKKSAGLLQPLPIPSQVWEDLSLDFVTGLPLSQGYTVILVVVDRFSKAAHFGALPTHHTAYKVAVLFLDMVCRHHGFPRSLVSDRDPIFISNFWRELFRLSGTKLRMSTAYHPQTDGQTEVLNRTLEQYLRAYVHDQPSRWYRFLSLAEWSYNTTLHSSTGMTPFEVVYGKPPPTVAHYLQGHSSNDVVDSLLTTRVQLHAQLTRRLQRAQELMKTAADRHRRDLSFEISARIGPVAYKLALPASSRIHPVFHVSLLKLHQGPSPASPGTLPELSTDNHPIVNPFAILDWKLDSSVTPPVKRVLVQWDDLPPEEASWESWDELNVLHNLADKVVFDEGGVDNASPCGPVAFVLDLRRIAEPSRIRYRMLHIHGLFGDASFIDPASFDGLTGGLHGTSEESVS

SEQ ID NO: 163864 - protein, 343 aa, Glycine max
  Coding DNA Sequence Number=SeqID_47086
  Gene Ontology: Mol. function=transferase activity, transferring hexosyl groups; Biological process=carbohydrate biosynthetic process
  Homolog annotation: Hit_ID=Q1SQE2; Match level="QueryCoverage=93%, HitCoverage=97%, E-value=1e-133, Identity=66%"; Hit description =Glycosyl transferase, family 8
  Pfam annotation: Domain name=Glyco_transf_8; Domain location=77-301; Score=238.8; E_value=1.1e-68; Accession=PF01501.10; Description =Glycosyl transferase family 8
MFISRSILFVFVFSACLLLFPANGIRSFATTNGYETEVEEVDPFVQFREAPEYRNQQKCTLIDTTNVQLVCDPSLVHVAMTIDWHYLRGSIAAVHSVVKHTSCPQNLFFHFIASDARLESKDVFERIVHTSFPSLGFKVYVFRESLVGNLISPSIREALDNPLNYARSYLADLLDQCIERVIYLDSDVVVVDDVQELWKWKRPCYFNTGVMVMDLVRWREGGYTRKIEKWMEIQKERRIYKLGSLPPFLLAFGGDVEAIEHRWNQHGLGGDNVRNSCRTLHPGPVSLLHWSGKGKPWTRLDAKMPCSVDFLWAPYDLYIPHHHTHHQHHHHQRIAIGSTHSSF

SEQ ID NO: 163865 - protein, 269 aa, Glycine max
  Coding DNA Sequence Number=SeqID_47087
  Homolog annotation: Hit_ID=Q1SQE1; Match level="QueryCoverage=98%, HitCoverage=61%, E-value=1e-76, Identity=60%"; Hit description=Seed maturation-like protein, putative
MVMYTLWNAEYRMSLTRNLDISGSRDEGSDCETRSEVLEVKDGAKTVGDEKIEVVNDLESCSCSGNLKEFGDLPPQALSYIQQLQSELTSVTEGVMQGGSLVWILSFCIGYLSKKEKGPWLNGCVILSACKMVASYVCAWELNAQKQEMMQLEYDKGKWNNLLEYLRSLDPNMVTELSRPSSLEVEDIIHQLVQNILRRFFVDDGSSSFMEQSVEGNVDNRAGSGDELSNTIATSRDYLAKLLFWCMLLGHHLRGLENRLHLSCVVGLL

SEQ ID NO: 163866 - protein, 168 aa, Glycine max
  Coding DNA Sequence Number=SeqID_47088
LLAGFRLDASPCGPVAFVLDLRRIAEPFRIRYRMLTVSTGPTCLPSSAMPEHHTRQVTTDKLEEAVKTLSQDNSALNNKIDTIHASLTAKIDALFDRFAAIAVNSPQPLPPTPVHSSSSSHRHHMKLEVPRFDGHDPLGAFQRTNGSPSHPSTWKDPRYPGISGCVAT

SEQ ID NO: 163867 - protein, 1017 aa, Glycine max
  Coding DNA Sequence Number=SeqID_47089
  Gene Ontology: Mol. function=transcription corepressor activity; Cellular component=nucleus; Biological process=regulation of transcription, DNA-dependent
  Homolog annotation: Hit_ID=Q1SQF0; Match level="QueryCoverage=98%, HitCoverage=73%, E-value=0.0, Identity=76%"; Hit description=Paired amphipathic helix
  Pfam annotation: Domain name=HDAC_interact; Domain location=131-231; Score=208.9; E_value=1.2e-59; Accession=PF08295.2; Description =Histone deacetylase (HDAC) interacting
  Pfam annotation: Domain name=PAH; Domain location=19-65; Score=51.8; E_value=2.3e-12; Accession=PF02671.11; Description=Paired amphipathic helix repeat
  Pfam module annotation: Pfam domain module=HDAC_interact::PAH; Domain location=131-231::19-65
MYSQAFSFCEKVKGKLSSSDDYQTFLKCLHIFSNGIIKRNDLQNLVTDLLGKHSDLMDEFNDFLERCENIDGFLAGVMSKKSLSTDAHLSRSSKLEEKDKEHKRDLDGAKEKERYREKYMGKSIQELDLSDCKRCTPSYRLLPADYPIPTASQRSELGAQVLNDHWVSVTSGSEDYSFKHMRRNQYEESLFRCEDDRYELDMLLESVSSAAKKAEELYNSINENKISVETLNRIEDHFTVLNLRCIERLYGDHGLDVIDILRKNPTHALPVILTRLKQKQEEWSKCRSDFNKVWAEIYAKNHYKSLDHRSFYFKQQDSKNLSTKSLVTEIKEIKEKQQKEDDIIQSIAAGNKQPLIPHLEFEYSDVGIHEDLYKLVRYSCEELFSSKELLNKIMRLWSTFLEPMLGVPSQSHGTERAEDRKTGHNVRNFGAPNVGGDGSPREDTLSINSRVPKSDKNEADGRVTEVKNVHWTTVAASNDKENGSVGGEIVSRDDPLMDKGQKNVECNDKASGFSKQFASGEEGAKNNVSIAIRGENSLNRTNLDASSGCALTPSQPTDVDDSVSKSQGVNVPSVEGCDMATPVPVVNGVLSESSKVKTHDESAGPCKIEKEEGELSPIGDSEEDNYVAYGDSNVQSMAKSKHNVEKRKYQSRNGEDESCPEAGGDNDADADDEDSENVSEAGEDVSGSESAGDECFREDHEEEEDIEHDDVDGKAESEGEAEGICDAQVGGDGTSLPLSERFLSSVKPLTKHVSAVSFVEEMKDSRVFYGNDDFYVLFRLHQALYERILSAKTHSMSAEMKWKAKDASSPDPYSRFMNALYNLLDGSAENAKFEDECRAIIGNQSYVLFTLDKLIYKLVRQLQTVATDEVDNKLLQLYEYEKSRKSGKLNDSVYHANAHVILHEDNIYRLQCSSTPSRLFIQLMDNMNEKPELFAVSIDPNFSFYLHSDFLSVFPNKKEPHGIILHRNKRQYGNLDELSAICSAMEGVKVVNGLECKIACSSSKCGCAAIVKSMVWI

SEQ ID NO: 163868 - protein, 197 aa, Glycine max
  Coding DNA Sequence Number=SeqID_47090
  Gene Ontology: Mol. function=transcription corepressor activity; Cellular component=nucleus; Biological process=regulation of transcription, DNA-dependent
  Homolog annotation: Hit_ID=Q8GWB6; Match level="QueryCoverage=100%, HitCoverage=32%, E-value=6e-62, Identity=65%"; Hit description =Putative transcriptional regulatory protein
  Pfam annotation: Domain name=PAH; Domain location=171-197; Score=4.5; E_value=1.8; Accession=PF02671.11; Description=Paired amphipathic helix repeat
  Pfam annotation: Domain name=PAH; Domain location=82-128; Score=69.4; E_value=1.2e-17; Accession=PF02671.11; Description=Paired amphipathic helix repeat
  Pfam module annotation: Pfam domain module=PAH::PAH; Domain location =171-197::82-128
MKRARDDMYPASQFKRPFASSRADSYGQNQVPGSGGGGGGGGGGGSGNGGGVGGGANASQKLTTNDALSYLKEVKDMFQDQREKYDMFLEVMKDFKAQRTDTAGVIKRVKELFKGHNNLIFGFNTFLPKGYEITLDEDEAPPKKTVEFEEAISFVNKIKVFLLQKRFLSDEHVYKSFLDILNMYRKEHKDIGEVYSE

SEQ ID NO: 163869 - protein, 108 aa, Glycine max
  Coding DNA Sequence Number=SeqID_47091
MTFALIKISNLKIHFLTNDQVDLVQWWFGRAYLMKVVVWTNKYGEWEVGGGPGVVLESRFGEEEASGAAVVVWVSKSDEQEAGGGVVVGGGTMVVLVSGSNEGKSVRV

SEQ ID NO: 163870 - protein, 91 aa, Glycine max
  Coding DNA Sequence Number=SeqID_47092
  Gene Ontology: Mol. function=zinc ion binding
  Homolog annotation: Hit_ID=Q7XYB8; Match level="QueryCoverage=92%, HitCoverage=53%, E-value=2e-13, Identity=47%"; Hit description=18S subunit ribosomal protein
  Pfam annotation: Domain name=zf-LSD1; Domain location=6-30; Score =53.5; E_value=7.2e-13; Accession=PF06943.3; Description=LSD1 zinc finger
MAQLVCGGCHTFLMYIRGATSVQCSCCHTVNLALEANLVAHVNCGNCKMLLRPRQAPLSRNSAPKSYCKIGDRHHDLGFNQISPLRNNECI

SEQ ID NO: 163871 - protein, 82 aa, Glycine max
  Coding DNA Sequence Number=SeqID_47093
MVLSLWSRFPLSRLKNPEKNVRHSRLGQMATPVKIIEISFSKFTSLIFLTTHVKHTYRGPPYARDGSPQYVPGPPYVRNDSP

SEQ ID NO: 163872 - protein, 109 aa, Glycine max
  Coding DNA Sequence Number=SeqID_47094
  Subcellular localization annotation: CTP_CleavageSite=64; ConfidenceScore=5.44e-01
MLKEGVQHRFSETDFESNKFSFSFSFDGTLSLNLPPNSFSFKSLFFSRLPTSRISLPFSPTNFRQSSLSRHLKQVRNIKGAKQPIEVGVRDIGQMCMFLITSTCFWTEI

SEQ ID NO: 163873 - protein, 93 aa, Glycine max
  Coding DNA Sequence Number=SeqID_47095
MCFDFLRIQSFTLVFKYNSKVVVWTKKYGEWEVGGGLGVVLESRSGEEEASGVAVVVWVSKSDEQEAGGGVVVGGGTMVVLVSGSNEGRSVRV

SEQ ID NO: 163874 - protein, 202 aa, Glycine max
  Coding DNA Sequence Number=SeqID_47096
  Gene Ontology: Mol. function=electron carrier activity; Biological process=electron transport
  Homolog annotation: Hit_ID=Q9LS22; Match level="QueryCoverage=83%, HitCoverage=38%, E-value=2e-39, Identity=44%"; Hit description =Arabidopsis thaliana genomic DNA, chromosome 5, BAC clone:F10E10
  Pfam annotation: Domain name=UPF0005; Domain location=48-202; Score =95.6; E_value=1.5e-25; Accession=PF01027.11; Description =Uncharacterised protein family UPF0005
MVPKVYAGQEMAMVENENCIMNGKWKKRVHVFGERVMRFPNKAWQTTWKVGREDPRRLIHAFKVGATLCKGLNRGLGTLLAGLLAFLVGYIANASDRVSQAIIIGAAVFFIGALATYMRFIPYIKKNYDYGLVIFLLTFNLITVSSYRLENVLKIAHDRVYTIAIGCAVCLLMSLLVFPNWSGEDLHNSTVYKLEGLAKSIE

SEQ ID NO: 163875 - protein, 142 aa, Glycine max
  Coding DNA Sequence Number=SeqID_47097
  Gene Ontology: Cellular component=chloroplast
  Homolog annotation: Hit_ID=Q9LQK7; Match level="QueryCoverage=81%, HitCoverage=24%, E-value=3e-23, Identity=46%"; Hit description =Protein NAP6, chloroplast precursor
MNRRRLKLEKGGPFDVSGTERLSLNIRMRKLCTFSDDCLKCGHYSNKSHFHYLESGKLLDDIRLCAFLDDDEKPRIGELHGVGGGVGRVHVVQVDGDVDVAALGDIDEGQIGSGDSVDGPEEVAVGESAEEKEPTKEMAMAD

SEQ ID NO: 163876 - protein, 124 aa, Glycine max
  Coding DNA Sequence Number=SeqID_47098
  Gene Ontology: Mol. function=protein binding; Cellular component =chloroplast
  Homolog annotation: Hit_ID=Q9LQK7; Match level="QueryCoverage=98%, HitCoverage=25%, E-value=2e-48, Identity=74%"; Hit description =Protein NAP6, chloroplast precursor
MQEDSITYELTEVSTGGKLGRCNLHIQQLGPDTVTELSTLHLSVGDQTQDLHSTLVLDHPRGYSRQLHKCIVTHSQGQAVFDGNIKVNRYAQQTDAGQLTRSLLLEPCATVNVKLNLQIVADDV

SEQ ID NO: 163877 - protein, 779 aa, Glycine max
  Coding DNA Sequence Number=SeqID_47099
  Gene Ontology: Mol. function=protein phosphatase type 2C activity
  Homolog annotation: Hit_ID=Q1S8C9; Match level="QueryCoverage=97%, HitCoverage=96%, E-value=0.0, Identity=56%"; Hit description=Protein phosphatase 2C, putative
  Pfam annotation: Domain name=PP2C; Domain location=370-743; Score= -10.4; E_value=2.4e-05; Accession=PF00481.12; Description=Protein phosphatase 2C
SSNHTPNHNHNQNQLVFAETEPLDETLGHSFCYVRSSARFLSPSHSDRILSPSNSLRFSPSHPPDLPETAFKAISGASVSANSSVPKTVLQTDDDDGDDTAVNGFKGTSSFSALPLQPVPRGGGAEDRERRAFFLSGPIESGALSGPLDDAVSSSEGVPFSAPLGGSVYVKKKRKKSIAGLRKAFQRSLSEKKRPWVVPMERKGKTEAKDESETESNVQWALGKAGEDRVHVVVSEEQGWLFVGIYDGFNGPDAPEFLMGNLYRALHKELQGLFWELEESEPQVQGTNPAPAVEDNEAESHNDGEVEKESNSNSLQGSVKRVTFQAEGTESRRRRLWEFLAEDDDDAEDGLDLSGSDRFGFTVDDALSVSKEGSGGSRRWLILSKLKHGLSRHREGHGRRLFPWSLGVGAEEKKVEEENPVAGKEEEKKGRGGRKRKVGPVDHELVLRALSRALEMTELAYLDMTDKLIDTNPELALMGSCLLVVLMRDEDVYVMNVGDSRAIVAHYECEEVHASKESGGGADVESSGECIVEENLAPDEGAVVLGNEGPAQERRLVALQLSTDHSTSIEEAIVRIKNEHPDDNRCIVNDRVKGRLKVTRAFGAGFLKQCIAVMSIVVLGFKVYQTSYSGYGRDVSCNLTFFSVYGTAAHFHYHPLRKWNPACLSCLLFKAAMHRLLKYCMQMYVDLMFLILSSDGLYQYLSNQEVVSEVESFVEKFPDGDPAQHLIEELLLRAAKKAGMDFHELLDIPQGDRRKYHDDVTVMVVSLEGRIWKSSGKYP

SEQ ID NO: 163878 - protein, 93 aa, Glycine max
  Coding DNA Sequence Number=SeqID_47100
MDDDTGVRMTQGSPGSKHHKVQEEGCTSSLLKEVRTSWLASCIMHGYKVGIMQETTKSRHLDSVEYYGYHSVRIFPDCAYLSVIAIRSLFPSS

SEQ ID NO: 163879 - protein, 182 aa, Glycine max
  Coding DNA Sequence Number=SeqID_47101
  Gene Ontology: Mol. function=lipoic acid binding; Cellular component =glycine cleavage complex; Biological process=glycine catabolic process
  Homolog annotation: Hit_ID=P25855; Match level="QueryCoverage=99%, HitCoverage=100%, E-value=1e-69, Identity=73%"; Hit description =Glycine cleavage system H protein 1, mitochondrial precursor
  Pfam annotation: Domain name=GCV_H; Domain location=41-178; Score =219.1; E_value=9.7e-63; Accession=PF01597.9; Description=Glycine cleavage H-protein
  Subcellular localization annotation: CTP_CleavageSite=12; ConfidenceScore=5.12e-01
MALRMWASSTANALKVSSTSRPHLLHPFSFSRCLSSVLDGLKYADSHEWVKHEGSVATIGITDHAQNLNNVSTQVKAEGVQLQDHLGEVVYVELPESGGTVTQKSGFGAVESVKATSDINSPISGEIVEVNKKLTETPGLVNSSPYEDGWMIKVKPSDPSELDSLMGPKEYTKFCEEEDASH

SEQ ID NO: 163880 - protein, 387 aa, Glycine max
  Coding DNA Sequence Number=SeqID_47102
  Gene Ontology: Mol. function=oxidoreductase activity; Cellular component=endoplasmic reticulum; Biological process=electron transport
  Homolog annotation: Hit_ID=O23051; Match level="QueryCoverage=93%, HitCoverage=73%, E-value=3e-73, Identity=43%"; Hit description=Ent -kaurenoic acid oxidase 1
  Pfam annotation: Domain name=p450; Domain location=46-387; Score= -62.4; E_value=3.9e-08; Accession=PF00067.12; Description=Cytochrome P450
MTLLGSLWLILVAALLGYAFLLGLLRRVNEWYYVSRLQGKLQHPLPPGHLGWPLLGNMPTFLRAFKSNPDSFIYDLVSRYGRTGMYRTYLFGSPSIIVCTPETCRKVLTDDENLKLGYPPSTTALTGKRSLHGISNAEHKRLRRLITSPITGHEALSTYIGLIEHASVKRLEELSSMNTPCEFLTELRKFAFKVFTTIFMGSDVDHVDLALFENLYKDLNRGMKSLAINLPGFPFYKALKARKKLMKLLQGLVDQKRRTNNTITKTKRRKLDMMDLLMEVKDEDGRQLEDEDIIDLLLVFLLAGYESSAHGILWTIIYLTEHPLVFQRAKKEQEEIMETRPLSQKGLNLKEIKQMEYLSKVIDEMLRRTSISFANFRQAKVDLNING

SEQ ID NO: 163881 - protein, 55 aa, Glycine max
  Coding DNA Sequence Number=SeqID_47103
MTQSGVYERGGGKILTLGSFNNKAFMATIAQIWKVGGGCRNQRSRKEHLHLEVPK

SEQ ID NO: 163882 - protein, 92 aa, Glycine max
  Coding DNA Sequence Number=SeqID_47104
MVNLNVITYPQTPTPLPTSNKDETRQQHPFHASKKTLSSFVDNNHHEDKEINIEEKNLEGIQRDIVAIAMVPHDSCNKGSKIHSATSHQSSS

SEQ ID NO: 163883 - protein, 188 aa, Glycine max
  Coding DNA Sequence Number=SeqID_47105
  Gene Ontology: Mol. function=DNA binding; Biological process=DNA integration
  Homolog annotation: Hit_ID=Q1SKC8; Match level="QueryCoverage=52%, HitCoverage=23%, E-value=4e-26, Identity=57%"; Hit description =Integrase, catalytic region
MRINTYESSKIYKHKIKTYHDKKLQRQNFQPGQQVLLFNSKLRLFPGKLKSKCSGSFMIKEVRPHGAVELVDHMASTPEKRWIVNGQQLKIYNGGQLEILTRCRKQKGGWADNVIALIAHLHAQCLAGERRAKRDILAKCVGTNSLSLALGLARMSNLDGKHDNGLTETSSSAQLRRGIHLGFFPLHF

SEQ ID NO: 163884 - protein, 133 aa, Glycine max
  Coding DNA Sequence Number=SeqID_47106
  Gene Ontology: Mol. function=nucleic acid binding
MEISSFHQFPNELLSEVLNHFHGLLRKTPTHGYSESVQLNIFLDGLQPQLKQLLDTSAWGKTKMKTPKEAIELIENMTASDHAILRDRAYTSTKRSLLELTARDATLARQIEAMTETFSKLPQQLQAVNPSHS

SEQ ID NO: 163885 - protein, 152 aa, Glycine max
  Coding DNA Sequence Number=SeqID_47107
  Homolog annotation: Hit_ID=Q10EV2; Match level="QueryCoverage=74%, HitCoverage=64%, E-value=1e-16, Identity=36%"; Hit description =Expressed protein
MWDFQREERRKTNGDAFGRRFEEGEGEALGGGADVEVDEAGAGDVDADAHDLEPEEEILGLEAGEGVDHAVAEVAGDVALVMQLVLELGVAGLVKAHPEEPVLAHRELPHALGEQAHGQPVLAQDLVDCRRIAPTQQGGGAATNNDWKDKDG

SEQ ID NO: 163886 - protein, 32 aa, Glycine max
  Coding DNA Sequence Number=SeqID_47108
MTYRLVRFNLEGFGISSIREPLEEMFYRVYGH

SEQ ID NO: 163887 - protein, 49 aa, Glycine max
  Coding DNA Sequence Number=SeqID_47109
MTSTKPGDLHPYDPEPSFIVSECEISVDSMVDNNKTLKELATPDVVYKP

SEQ ID NO: 163888 - protein, 348 aa, Glycine max
  Coding DNA Sequence Number=SeqID_47110
  Gene Ontology: Mol. function=protein serine/threonine kinase activity; Cellular component=cell surface; Biological process =protein amino acid phosphorylation
  Homolog annotation: Hit_ID=Q39203; Match level="QueryCoverage=95%, HitCoverage=43%, E-value=1e-103, Identity=58%"; Hit description =Receptor-like protein kinase precursor
  Pfam annotation: Domain name=Pkinase; Domain location=12-275; Score =77.8; E_value=3.3e-20; Accession=PF00069.15; Description=Protein kinase domain
  Pfam annotation: Domain name=Pkinase_Tyr; Domain location=14-275; Score=24.0; E_value=6e-14; Accession=PF07714.7; Description=Protein tyrosine kinase
  Pfam module annotation: Pfam domain module=Pkinase::Pkinase_Tyr; Domain location=12-275::14-275
VFSYKELQLATRGFSEKVGHGGFGTVFQGELSDASVVAVKRLERPGGGEKEFRAEVSTIGNIQHVNLVRLRGFCSENSHRLLVYEYMQNGALSVYLRKEGPCLSWDVRFRVAVGTAKGIAYLHEECRFHCQGFRFRAGEAHREGLQQGVGDHEGDVGYVAPEWISGVAITTKADVYSYGMTLLELVGGRRNVEAPPSAGGGGGGRESGSETGTKWFFPPWAAQQIIEGNVSDVVDKRLGNGYNIDEARRVALVAVWCIQDDEAMRPTMGMVVKMLEGLVEVSVPPPPKLLQALVTGDSFHGVKADSGNGVSTGGSLSDGNLEVSTADSESYTGNVFSPLDVNVHVSVR

SEQ ID NO: 163889 - protein, 198 aa, Glycine max
  Coding DNA Sequence Number=SeqID_47111
  Gene Ontology: Cellular component=nucleus
  Homolog annotation: Hit_ID=Q9FLH0; Match level="QueryCoverage=97%, HitCoverage=20%, E-value=5e-20, Identity=34%"; Hit description =Putative nuclear matrix constituent protein 1-like protein
MGCLIFERKELASKYEQVKASIDSSEFMCKHDSTMTLSALIEARKREESLKKAVGVTEACIISPLKQRFLLESKVSEAHQLIDEAQKKSTEAEAEAKLLAAASFQAKACGYNGVAGRKLRDVEAREDELKWQIISFKSEYVFALSKRESELNKKERELLDFQVKLASRESDETHKVTAVQEAELIARKTNFEAELQIG

SEQ ID NO: 163890 - protein, 422 aa, Glycine max
  Coding DNA Sequence Number=SeqID_47112
  Gene Ontology: Mol. function=branched-chain-amino-acid transaminase activity; Cellular component=chloroplast; Biological process =branched chain family amino acid metabolic process
  Homolog annotation: Hit_ID=Q9SNY8; Match level="QueryCoverage=88%, HitCoverage=94%, E-value=1e-163, Identity=77%"; Hit description =Branched-chain amino acid aminotransferase
  Pfam annotation: Domain name=Aminotran_4; Domain location=108-404; Score=333.0; E_value=5.1e-97; Accession=PF01063.9; Description =Aminotransferase class IV
MKAHASSWKGVEDRNPIDNSNNQYSTREERRDSESDKKPRALRKQFPLTSQNVLEAASPLRPSATLSSDPYSETIELADIEWDNLGFGLQPTDYMYIMKCTRGGTFSKGELQRFGNIELNPSAGVLNYGQGLFEGLKAYRKQDGSILLFRPEENGLRMQIGAERMCMPSPTMEQFVEAVKDTVLANKRWVPPAGKGSLYIRPLLMGSGPVLGVAPAPEYTFLIYVSPVGNYFKVRHTFLPSPQEGLAPINLIVENEFHRATPGGTGGVKTIGNYAAVLKAQSEAKAKGYSDVLYLDCVHKRYLEEVSSCNIFVVKGNIISTPAIKGTILPGITRKSIIDVARSEGFQVEERLVSVDELLDADEVFCTGTAVVVSPVGSITYLGKRVTYGDGIGVVAQQLYTVLTRLQMGLTEDEMNWTVELR

SEQ ID NO: 163891 - protein, 83 aa, Glycine max
  Coding DNA Sequence Number=SeqID_47113
MITTHTSTNLSLETVLGISIKEKHGDMGNKRGLIFVLNGILIEASLFKTLPDLFVFGRRGSRSRRCGIRSDRYRHRRSPAPPR

SEQ ID NO: 163892 - protein, 253 aa, Glycine max
  Coding DNA Sequence Number=SeqID_47114
  Homolog annotation: Hit_ID=Q9FLH0; Match level="QueryCoverage=39%, HitCoverage=9%, E-value=8e-23, Identity=53%"; Hit description =Putative nuclear matrix constituent protein 1-like protein
MQQERADFLRDVEMQKRNMNTLIEKRHEEIESCLKEREKSFEEEKNNELEYINALKEKAAKESQQVSFEMRRLETERAEISLDREQRKKEWAELNKCIEELKSMKKKLKLRTLKHDDHLNSPKEIEANKNSNGFDTPFVQKSSVVSPPSPVVVSNGQKHLTNDNSLDNVGKRQQRRFSFGEPKVILDVPSPAEDVYRVSDFESEIKKHVNRTVPLVWDGCNVSKWKRGRGNFGIGDPLQDTLKDKKLRSEDNQ

SEQ ID NO: 163893 - protein, 260 aa, Glycine max
  Coding DNA Sequence Number=SeqID_47115
  Homolog annotation: Hit_ID=Q8L8Q8; Match level="QueryCoverage=45%, HitCoverage=92%, E-value=6e-58, Identity=83%"; Hit description =Protein At5g64816 precursor
MKIQGSKINWLERAGDAAAGEDPRPVFGGCDVNLRSLVFAESEELRLDHIYYLILGLNCNSLYSLTLSLTPHTFSVSCSLYSVPFPIAAQPSPSPLTGRLALLDRRSLHILQQSFRRLFEEEEANLVICCVFEMGEIWWSLLGAAIPVVVAGQAFRVKKRRAEEQRLQSARGRERSSDEIFVCERVCTSKRMLKKVGSFSKDPIPDTCVTVCGVSDLDACADACARTVCINQHQVPNWNDICLRRCQSECLKLSSQSQSS

SEQ ID NO: 163894 - protein, 167 aa, Glycine max
  Coding DNA Sequence Number=SeqID_47116
MEEEDFECCLKALKGMRLIVAEFLSYWIFQVLPSKSRTTWNACSKSLSLLYAMILSLGLYCISSTPVYQTSTNPRFHSCKSYSLFISHEIAESYMDNKSPSNKASEELARELLIAISDSLPDKTLDSDFVPESKDADSFARPNGDWDDKFRSELISISYVESPDVKI

SEQ ID NO: 163895 - protein, 70 aa, Glycine max
  Coding DNA Sequence Number=SeqID_47117
MSFCLQRTGRYRVQIAAANEAPSFDVASSSLAIDNANNEKENSQECLGFGSSLSRNGKMKKNLNDMKRRD

SEQ ID NO: 163896 - protein, 457 aa, Glycine max
  Coding DNA Sequence Number=SeqID_47118
  Gene Ontology: Mol. function=cysteine desulfurase activity; Cellular component=mitochondrion; Biological process=metabolic process
  Homolog annotation: Hit_ID=O49543; Match level="QueryCoverage=99%, HitCoverage=100%, E-value=0.0, Identity=77%"; Hit description =Cysteine desulfurase 1, mitochondrial precursor
  Pfam annotation: Domain name=Aminotran_5; Domain location=59-422; Score=419.8; E_value=3.9e-123; Accession=PF00266.9; Description =Aminotransferase class-V
  Pfam annotation: Domain name=Beta_elim_lyase; Domain location=96-347; Score=-87.5; E_value=7.8e-05; Accession=PF01212.11; Description=Beta -eliminating lyase
  Pfam annotation: Domain name=DegT_DnrJ_EryC1; Domain location=96-428; Score=-206.1; E_value=0.045; Accession=PF01041.8; Description =DegTDnrJEryC1StrS aminotransferase family
  Pfam annotation: Domain name=Pyridoxal_deC; Domain location=58-346; Score=-181.1; E_value=0.019; Accession=PF00282.9; Description =Pyridoxal-dependent decarboxylase con
  Pfam module annotation: Pfam domain module=Aminotran_5::Beta_elim _lyase::DegT_DnrJ_EryC1::Pyridoxal_deC; Domain location=59-422::96 -347::96-428::58-346
  Subcellular localization annotation: CTP_CleavageSite=30; ConfidenceScore=5.03e-01
MTSKLIASNLRHQITKSAQNLRRQLLSTAAAAAVPEHDGNNSNSLGMTMKGVRISGRPLYLDVQATSPVDPRVLDAMLPFYISRYGNPHSRTHFYGWESDEAVEHARAQVASLIGASPKEIVFTSGATESNNISVKGVMHFYKDKKRHVITTQTEHKCVLDSCRHLQQEGFDVTYLPVESDGLIDLDKLRAAIRPDTGLVSVMAVNNEIGVVQPMERIGRICKEFNVPFHTDAAQALGKIPIDVEKWNVSLMSLSGHKIYGPKGVGALYMRRRPRIRVEPQMNGGGQERGIRSGTVPTPLVVGMGSACEVAKNEMEYDEKRISALQQRLLNGIREKLDGVVVNGSLERRYVGNLNLSFAYVEGESLLMGLKEVAVSSGSACTSASLEPSYVLRALGVEEDMAHTSIRFGIGRFTTEAEIDRAVELTVQQVEKLREMSPLYEMVKEGINIKDIQWAQH

SEQ ID NO: 163897 - protein, 137 aa, Glycine max
  Coding DNA Sequence Number=SeqID_47119
MIRRPCRLHSTVKNICSLQHSREKKRSYGEATTADNEVVKLGRKDPHPNVEQSSILDATRDKEETDEEQNEHEKQKKTDNVTGMENEILKQKNEQNNNEEKSEHRKDPVDQDTEENSVTNKKESQTMSIRQSRRVIV

SEQ ID NO: 163898 - protein, 978 aa, Glycine max
  Coding DNA Sequence Number=SeqID_47120
  Gene Ontology: Mol. function=protein serine/threonine kinase activity; Cellular component=integral to membrane; Biological process=protein amino acid phosphorylation
  Homolog annotation: Hit_ID=O49544; Match level="QueryCoverage=96%, HitCoverage=97%, E-value=0.0, Identity=54%"; Hit description =Receptor protein kinase - like protein
  Pfam annotation: Domain name=APH; Domain location=685-865; Score= -12.7; E_value=0.046; Accession=PF01636.13; Description =Phosphotransferase enzyme family
  Pfam annotation: Domain name=LRRNT_2; Domain location=26-68; Score =45.2; E_value=2.3e-10; Accession=PF08263.3; Description=Leucine rich repeat N-terminal domain
  Pfam annotation: Domain name=LRR_1; Domain location=122-144; Score =10.0; E_value=3.8; Accession=PF00560.23; Description=Leucine Rich Repeat
  Pfam annotation: Domain name=LRR_1; Domain location=146-168; Score =19.5; E_value=0.012; Accession=PF00560.23; Description=Leucine Rich Repeat
  Pfam annotation: Domain name=LRR_1; Domain location=170-192; Score =18.3; E_value=0.027; Accession=PF00560.23; Description=Leucine Rich Repeat
  Pfam annotation: Domain name=LRR_1; Domain location=194-217; Score =11.2; E_value=2.3; Accession=PF00560.23; Description=Leucine Rich Repeat
  Pfam annotation: Domain name=LRR_1; Domain location=219-241; Score =10.9; E_value=2.6; Accession=PF00560.23; Description=Leucine Rich Repeat
  Pfam annotation: Domain name=LRR_1; Domain location=243-265; Score =16.3; E_value=0.11; Accession=PF00560.23; Description=Leucine Rich Repeat
  Pfam annotation: Domain name=LRR_1; Domain location=267-289; Score =10.0; E_value=3.8; Accession=PF00560.23; Description=Leucine Rich Repeat
  Pfam annotation: Domain name=LRR_1; Domain location=291-313; Score =11.9; E_value=1.7; Accession=PF00560.23; Description=Leucine Rich Repeat
  Pfam annotation: Domain name=LRR_1; Domain location=314-336; Score =12.3; E_value=1.4; Accession=PF00560.23; Description=Leucine Rich Repeat
  Pfam annotation: Domain name=LRR_1; Domain location=338-360; Score =12.2; E_value=1.5; Accession=PF00560.23; Description=Leucine Rich Repeat
  Pfam annotation: Domain name=LRR_1; Domain location=362-385; Score =2.7; E_value=90; Accession=PF00560.23; Description=Leucine Rich Repeat
  Pfam annotation: Domain name=LRR_1; Domain location=410-432; Score =13.1; E_value=1; Accession=PF00560.23; Description=Leucine Rich Repeat
  Pfam annotation: Domain name=LRR_1; Domain location=434-453; Score =6.0; E_value=21; Accession=PF00560.23; Description=Leucine Rich Repeat
  Pfam annotation: Domain name=LRR_1; Domain location=456-478; Score =11.5; E_value=2; Accession=PF00560.23; Description=Leucine Rich Repeat
  Pfam annotation: Domain name=LRR_1; Domain location=480-502; Score =6.0; E_value=22; Accession=PF00560.23; Description=Leucine Rich Repeat
  Pfam annotation: Domain name=LRR_1; Domain location=504-526; Score =11.3; E_value=2.2; Accession=PF00560.23; Description=Leucine Rich Repeat
  Pfam annotation: Domain name=LRR_1; Domain location=528-550; Score =17.7; E_value=0.042; Accession=PF00560.23; Description=Leucine Rich Repeat
  Pfam annotation: Domain name=LRR_1; Domain location=552-574; Score =15.2; E_value=0.23; Accession=PF00560.23; Description=Leucine Rich Repeat
  Pfam annotation: Domain name=LRR_1; Domain location=575-597; Score =3.5; E_value=62; Accession=PF00560.23; Description=Leucine Rich Repeat
  Pfam annotation: Domain name=LRR_1; Domain location=73-95; Score=6.1; E_value=20; Accession=PF00560.23; Description=Leucine Rich Repeat
  Pfam annotation: Domain name=LRR_1; Domain location=97-120; Score =6.6; E_value=16; Accession=PF00560.23; Description=Leucine Rich Repeat
  Pfam annotation: Domain name=Pkinase; Domain location=683-972; Score =133.5; E_value=5.6e-37; Accession=PF00069.15; Description=Protein kinase domain
  Pfam annotation: Domain name=Pkinase_Tyr; Domain location=683-972; Score=98.7; E_value=1.7e-26; Accession=PF07714.7; Description =Protein tyrosine kinase
  Pfam module annotation: Pfam domain module=APH::LRRNT_2::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::Pkinase::...
  Pfam module annotation: Pfam domain module=Pkinase_Tyr; Domain location=685-865::26-68::122-144::146-168::170-192::194-217::219 -241::243-265::267-289::291-313::314-336::338-360::362-385::410 -432::434-453::456-478::...
  Pfam module annotation: Domain location=480-502::504-526::528 -550::552-574::575-597::73-95::97-120::683-972::683-972
MPQPLFLFLLLCLLCSSSGLSQVLSLERETQILLGVKNTQLEDKNKSLKNWVPNTDHHPCNWTGITCDARNHSLVSIDLSETGIYGDFPFGFCRIHTLQSLSVASNFLTNSISPNSLLLCSHLRLLNLSDNYFVGVLPEFPPDFTELRELDLSKNNFTGDIPASFGQFPHLRTLVLSGNLLSGTIPPFLGNLSELTRLELAYNPFKPGPLPSQLGNLSNLETLFLADVNLVGEIPHAIGNLTSLKNFDLSQNSLSGTIPNSISGLRNVEQIELFENQLFGELPQGLGNLSSLICLDLSQNALTGKLPDTIASLHLQSLNLNDNFLRGEIPESLASNPNLKQLKLFNNSFTGKLPRDLGRNSDIEDFDVSTNDLVGELPKYLCQGNKLEHLITFANRFSGTLPDQYGECRSLQYVRIQSNQFSGPVPPSFWALAGLQFLEMSNNRFQGSVSASISRGLTKLILSGNSFSGQFPMEICELHNLMEIDFSKNRFTGEVPTCVTKLTKLQKLRLQENMFTGEIPSNVTHWTDMTELDLSFNRFTGSIPSELGNLPDLTYLDLAVNSLTGEIPVELTNLRLNQFNVSGNKLHGVVPLGFNRQVYLTGLMGNPGLCSPVMKTLPPCSKRRPFSLLAIVVLVCCVSLLVGSTLWFLKSKTRGCSGKSKSSYMSTAFQRVGFNEEDIVPNLISNNVIATGSSGRVYKVRLKTGQTVAVKKLFGGAQKPDVEMVFRAEIETLGRIRHANIVKLLFSCSGDEFRILVYEYMENGSLGDVLHGEDKCGELMDWPRRFAIAVGAAQGLAYLHHDSVPAIVHRDVKSNNILLDHEFVPRVADFGLAKTLQREATQGAMSRVAGSYGYIAPEYAYTMKVTEKSDVYSFGVVLMELITGKRPNDSSFGENKDIVKWITETVLSPSPERGSGDIGGGKDYIMSQIVDPRLNPATCDYEEIEKVLNVALLCTSAFPINRPSMRRVVELLKDHKLS

SEQ ID NO: 163899 - protein, 491 aa, Glycine max
  Coding DNA Sequence Number=SeqID_47121
MEDKNKEHESGFVCNQESQTNNEPQHNQENAQPNVTVGPIAKISSPSPSHDSMPNSNQQQQPPIVQWPCTPQNATEQFLTMHFPTQASPPGALNQWQQFQYQQVFAQTASSFWQPQPPGANVPSFFQPFTDTGFQGGPSSTIQTLLPNMSCHYTFPGFPHSWDPPSYMAQLYQMQHPYVFSFPGAPNFSSATPKVPDRLASVEHSSQNGIMRPPSKLSQKHQQLWEAQSAENVKLWSVINKLQAEVSDYNDRLKKLEEEVSSFKKKAEVPTNKVIGTIPVLTVQPKKRGGPKRSLASVDPSYESHLPAGGKKPALSNYLYQSKSPFGAVKSPIFEKVILKKVENKEITTRSTTTMVQHESNVNILNAVKDVSCNTQINQSNPIMSACQGQVPCGNGVNVNFGKDHDLKVVYSEPSQPDKVLKNSSMGVSAKSVGNTGNGNVGLTSCAPSQDTAKDMLDVARRSFFHNGSFIQQGGNITPGWSLSFANEEDA

SEQ ID NO: 163900 - protein, 110 aa, Glycine max
  Coding DNA Sequence Number=SeqID_47122
MTAIAVVGLGDDNGEAVIGEEGVGGAVMMLPAKRRVSSTANNVVEGPSLPSSTCRCTVNKPFSVVCSLFLSLRPSHNAFEILKCGDTGVTSKPPRSFPVLCPRYNVDCGE

SEQ ID NO: 163901 - protein, 124 aa, Glycine max
  Coding DNA Sequence Number=SeqID_47123
  Subcellular localization annotation: CTP_CleavageSite=73; ConfidenceScore=5.53e-01
MRRQSPTLHDGFLIAKTTGFKSVSASLQPPLHAGNIITAPPTPSSPMTASPLSSPRPTTAMAVIWCTTYLGFRGAMTTAFDVPWIWVLVVQQLWHLVCHKSEFCYGVWCNTILDFGGATIQWQQ

SEQ ID NO: 163902 - protein, 102 aa, Glycine max
  Coding DNA Sequence Number=SeqID_47124
  Subcellular localization annotation: CTP_CleavageSite=44; ConfidenceScore=5.33e-01
MSFPVFPTFSSNKHWWRLRAYSFLGRRFRRVPRRPPAEGCQGIKLTEGANNHKVCLRATGPLGHNSRIETFLWSRAEDAELSGKGANDQIGIYVSIGSLASG

SEQ ID NO: 163903 - protein, 422 aa, Glycine max
  Coding DNA Sequence Number=SeqID_47125
  Gene Ontology: Mol. function=inositol pentakisphosphate 2-kinase activity; Cellular component=nucleus; Biological process=phytate biosynthetic process
  Homolog annotation: Hit_ID=Q93YN9; Match level="QueryCoverage=99%, HitCoverage=92%, E-value=1e-101, Identity=48%"; Hit description =Inositol-pentakisphosphate 2-kinase (EC 2.7.1.158) (Inositol- 1,3,4 ,5,...
  Homolog annotation: Hit description=6-pentakisphosphate 2-kinase) (Ins(1,3,4,5,6)P5 2-kinase)
  Pfam annotation: Domain name=DUF941; Domain location=1-375; Score =406.0; E_value=5.3e-119; Accession=PF06090.3; Description=Domain of unknown function (DUF941)
IGKVVRIRKAPRNGSQSKSVSVRNSIALTPHERVLWKDVHQLISSSDKEIVGQLYVQHVMKPLLGSNSVDAGMHVLVTREFLELVEKNVSGQRPAWRVEAARVDAHCDFGLLMSDHSLFAYGSQGSSLCLSVEIKPKCGFLPLSRFISEVNAIKRRITRFEMHQTLKLLQGEISQLSEYNPLDLFSGSKERILKAIKGLLTTPQNNFRVFLNGSLILGGLGGVAKNTDVCIAKAFEDELKSIIRADDDLCTNNLSTLVTEALQKSGVLDKLLKVQKLDNIDIEGVIHAYYNITSQQCMVCKELSEEQAKIYTPLHSASLDESLRIVKDYLIATTAKDCSLMLCFRPRNEEDSGSVYDNVYLDSTEQSFDYKVYFIDLDLKRLSKVEDYYELDKKIVNCYRQIIKMDQGRNEETGLKASNAAY

SEQ ID NO: 163904 - protein, 46 aa, Glycine max
  Coding DNA Sequence Number=SeqID_47126
MKLIATVEGIASIVLDPDKNTVTVIGEADPLRTVKPVRKFRKSATI

SEQ ID NO: 163905 - protein, 372 aa, Glycine max
  Coding DNA Sequence Number=SeqID_47127
MAHACAEESRRENAREKARERIRIRYFLSQMSGSAKKLTLSTLLFFCTQQVMVWDELIKTKPSAVKWRASQVRHYDLLEELYGSHRATGLVECIPRQIHQAMDRGNVKDLVHPKIMDFDYFVTSGLQCQELLSVQGLDTFVSLEANLKYEGHKFQLSKLSDNIGYHHGQALDAMVRPELQGHNCKNAEDIFFLWAINQRIRIKLAIPHLSTYEEVQENGSLPGWSNRFNKKSLKKFKVIQVDGVWQHADQNMSMPMEHREEGGDSESAEKPQGSQPWAPQVTPDSDMADKRFDDFDKHFEDLQYLYQQDLKPENVLAREDGHVMLSDCDLSIKCGVPKLLRRRKKEEKKEEEKKDAVSHTPNCGRDVIRGMA

SEQ ID NO: 163906 - protein, 68 aa, Glycine max
  Coding DNA Sequence Number=SeqID_47128
  Gene Ontology: Mol. function=transporter activity; Cellular component= intracellular; Biological process=transport
  Homolog annotation: Hit_ID=Q67YM1; Match level="QueryCoverage=86%, HitCoverage=10%, E-value=5e-21, Identity=86%"; Hit description =Putative phosphatidylinositol/ phosphatidylcholine transfer protein
MLQSKPNVMPYEKEELLNAAVYRVDALEAELIATKKALYEALIRQEELLAYIDSQERSKFEMNLTTEL

SEQ ID NO: 163907 - protein, 460 aa, Glycine max
  Coding DNA Sequence Number=SeqID_47129
  Gene Ontology: Mol. function=transporter activity; Cellular component= intracellular; Biological process=transport
  Homolog annotation: Hit_ID=Q94FN1; Match level="QueryCoverage=99%, HitCoverage=73%, E-value=0.0, Identity=72%"; Hit description =Phosphatidylinositol transfer-like protein III
  Pfam annotation: Domain name=CRAL_TRIO; Domain location=161-347; Score=132.2; E_value=1.4e-36; Accession=PF00650.10; Description =CRALTRIO domain
  Pfam annotation: Domain name=CRAL_TRIO_N; Domain location=66-144; Score=51.7; E_value=2.4e-12; Accession=PF03765.5; Description =CRALTRIO, N-terminus
  Pfam module annotation: Pfam domain module=CRAL_TRIO::CRAL_TRIO_N; Domain location=161-347::66-144
MSGPLDRFARPCFEGFSGHDERRERKSDFENSEDDRRTRIGSLKKRAINASSKFRHSLRKKSSRRKTASRSNSVSIEDVRDVKELQAVDEFRQALILDNLLPPRHDDYHTLLRFLKARKFDIEKAKHMWANMIHWRKEYGTDTIMEDFEFGELNEVLQYYPHGYHGVDKEGRPVYIERLGKVDPNKLMQVTTMERYLRYHVQGFEKTFAVKFPACSIAAKRHIDSSTTILDVHGVGFKNLTKSARELIMRLQKIDGDYYPETLCRMFIINAGPGFKLLWNTVKSFLDPKTTSKINVLGNKFHNRLLEIIDASELPEFLGGNCTCMDRGGCMRSDKGPWQDPNILKMVLSGEVQCSRQIVTVSNDEGTVIECDKACYPMPIRSSDTSTAESGSEVEDITSPKASGNYTNPRLTPVHEEARLIGRASGFSEYDEYVPMVDKAVDLGWKEKQVTTQNSYGSTG

SEQ ID NO: 163908 - protein, 89 aa, Glycine max
  Coding DNA Sequence Number=SeqID_47130
MVFSTLSRFFMKERMVAFKGESRVRGEGAEIGSGEEMEEDVVRKDVGEGRRGEVVVGGEVSVGDDENGEGGAIQKIYDEGRGRGEEGGE

SEQ ID NO: 163909 - protein, 94 aa, Glycine max
  Coding DNA Sequence Number=SeqID_47131
  Gene Ontology: Mol. function=DNA binding
  Homolog annotation: Hit_ID=Q8LA58; Match level="QueryCoverage=74%, HitCoverage=21%, E-value=2e-23, Identity=73%"; Hit description=Wound- responsive protein, putative
MVPIQVNKYLAYSDGMRVIESGKLSTQFPGMDGRLFTEMDRPSGQPCAETTEFNLLHNMLKAVVEERYKDAANHVPCEQVWYFLPLLVGVVSAC

SEQ ID NO: 163910 - protein, 1374 aa, Glycine max
  Coding DNA Sequence Number=SeqID_47132
  Gene Ontology: Mol. function=helicase activity; Biological process =viral genome replication
  Homolog annotation: Hit_ID=Q337N5; Match level="QueryCoverage=85%, HitCoverage=82%, E-value=0.0, Identity=38%"; Hit description =Expressed protein
  Pfam annotation: Domain name=DUF889; Domain location=990-1228; Score =203.7; E_value=4.3e-58; Accession=PF05970.5; Description=Eukaryotic protein of unknown function (DUF889)
MTSQHINSGRYTIFNSKLIEHISHDTDDELDITQGDIVTDYSFDDIATEDFAHTDYDDNLEAPYDNENTGYKDIGDPIWQCKQCKAKMCRDSQAKKFQQNIRLYNLMFAFTSPGVKVGTSYSTGRGPPTLRIHGQSHHLIGSLLPMPDNSPKFAQLYIYDTENEVNNRLSQYPIKNNVDEDIIIGIKNMLDTHNPYAQKFRMARDKLDSSAVCDLKLKLISDRQTDGRLYNLPNASEVAALIVGDKHTANNKDIIIEKQIGMLQRINELHPAYLPLQYPLLYPHGEDGYRPNILHKHHPHSHVAKRNKVTMREYFCYRMQSRDNEAQTILHSRRLLHQWVVDGYCMIESQKLNYVRQHQQELRVDKYINLNDCNNQPLTQGNEKGKRIILPSLFVGSLRYMQQLYFDRMAICAHVGFPDLFLTLTCNPAWLEIQRQVAKSNLTAHDCPDVVSRVFKMKLNQLMHDLKSGHVFGPILALAKRGLPYAHILIFLHPSNKYPNPEDIDNIIFAEIPNKDTDPELYQIVNNHMMHGPCGLANKRAPCMVNGKCFRFFPKKFQPATIVDQDGFPVYRRRDTRRTVQKQGSDRITTAIVNDQNQDGTHNQVHDEIKHYLDCRYVSAPEACWKIFAFPMHGHAPAVERLYFHLENQQPVYWKDSEEIGTVLAKSTIKESMFTTWMDSNKIYHHGRDLTYAEYVSKFVYDARKRCWKPRKQGNTIGRLIWVPPSSGELVYMRMMLSSAKGSQCYEDIRTVENVVYHTFREACFAKGFLGSDQEFVGALREANTWGTPHYLRKLFVKLLFMNTMDRPEYVWKQTWQWMANDIVFNHRRQGIQLIDKEKMHLCLTTIENLLQANRKSLRDFPSMPYPLGYAANTHQNNLIYNELAYDGDILAAEFDKCYQWLTDEQASIFNKIMHVVATQSGGVYFLYGYGGTGKTFVWKTLSSAIRSTGGIVLTVASSGIASILLPGGRTTYSKFAIPVPATKNSTCNIYQGSDLAKLLHITKLIIWDEAPMCHRYNIEALDKSLQDIMHNGNPFGGKVIVFGGDGKLAEPNDGYGEITIPNEFLIKDFQDPIQAIVEATYPYILHNYSNGDLLQKRVVLAFTKDVVDKINDYVLSLIPGEEKEYCSADSVDKSDELLSPAFGVLTAEFLNSLKISGIPNHKLIIKVGTPIILLRNLDQADGLCNGTRLIVTRLGSSVVEAAIITGPNIGHRTYIPRMNLSPSDSPRPFKLIRRQFPFMVSFAMTINKSQGQSLAHVGLYLPTPVFLTAIYINTMLYSLPLRRRCYHHNLSSTIKNILSYNQKNEPVHRHGRLSSVYKETLLPYGILGAPQSSGFQRVAKPKTHGFDFNSTINNKKGRVDGIQLDNATLLQIW

SEQ ID NO: 163911 - protein, 242 aa, Glycine max
  Coding DNA Sequence Number=SeqID_47133
  Gene Ontology: Mol. function=DNA binding
  Homolog annotation: Hit_ID=Q8LA58; Match level="QueryCoverage=89%, HitCoverage=72%, E-value=6e-72, Identity=58%"; Hit description=Wound- responsive protein, putative
MHVVYEFNGYINRSEITLNLTFKVWRMSSVQGPVVCPSVRAKQVGFCSIPMIGAVKMNVRRIRSEFWGLNGAKAKPGFLSCHINTRKCKTVHCTFNSPSNDSGSTADNFNEKDEDYVISSVIEAVEVKSGADGFIIKMRDGRHLRCVHNNPQGGHLPDYAPHPAIVLKMEDGTGLLLPIIVLEMPSVLLMAAIRNVPIARPTLYQVVKEMIDKMGYEVGNDAEYVSFDLRPSDAINIAVRCK

SEQ ID NO: 163912 - protein, 74 aa, Glycine max
  Coding DNA Sequence Number=SeqID_47134
MAARPSELRLNHEATGLPRRAGYLTWKSFGSPGEPEASLGELGPRKLNEKILLPPSFVTGVEQCNLASENQKHQ

SEQ ID NO: 163913 - protein, 80 aa, Glycine max
  Coding DNA Sequence Number=SeqID_47135
MTRKHGIIILTFNIEIETFNCHARSLKRTKHKKSKLTIEWSISLQNLLHQETDRRSRNKKSGTIAVVNERKCTVRGETSH

SEQ ID NO: 163914 - protein, 79 aa, Glycine max
  Coding DNA Sequence Number=SeqID_47136
  Gene Ontology: Mol. function=RNA-directed DNA polymerase activity; Biological process=RNA-dependent DNA replication
MAPEDMEKKTFVTLWGTFCYKVMSFGLKNVGATYQRAMVALFHDMMNKEIEVYVVDMIANSKTEEEHLVNLHKLFKRLR

SEQ ID NO: 163915 - protein, 72 aa, Glycine max
  Coding DNA Sequence Number=SeqID_47137
MKVVLAVNEDIDGFVSGTELGNSWTRTREKREWMEALNLLRSKVCIARLRTTENGSPAGRIYICFQGGEGHY

SEQ ID NO: 163916 - protein, 372 aa, Glycine max
  Coding DNA Sequence Number=SeqID_47138
  Gene Ontology: Mol. function=transferase activity, transferring glycosyl groups; Cellular component=integral to membrane; Biological process=metabolic process
  Homolog annotation: Hit_ID=Q8S9A6; Match level="QueryCoverage=99%, HitCoverage=78%, E-value=1e-162, Identity=76%"; Hit description =Glucosyltransferase-3
  Pfam annotation: Domain name=UDPGT; Domain location=1-369; Score= -109.3; E_value=4.1e-05; Accession=PF00201.9; Description=UDP -glucoronosyl and UDP-glucosyl transferase
MALTFELCRATGHHLRRILSYISQTSNLKAIVLDFMNYSAARVTNTLQIPTYFYYTSGASTLAALLYQTIFHETCTKSLKDLNTHVVIPGLPKIHTDDMPDGAKDRENEAYGVFFDIATCMRGSYGIIVNTCEAIEESVLEAFNEGLMEGTTPKVFCIGPVISSAPCRKDDNGCLSWLNSQPSQSVVFLSFGSMGRFSRTQLREIAIGLEKSEQRFLWVVRSEFEEGESAEPPSLEELLPEGFLDRTKEKGMVVRDWAPQAAILSHDSVGGFVTHCGWNSVLEAICEGVPMVAWPLYAEQKLNRVILVEEMKVGLAVEQNNNGLVSSTELGDRVKELMNSDRGKEIRQRIFKMKNSATEAMTEGGSSVVALN

SEQ ID NO: 163917 - protein, 58 aa, Glycine max
  Coding DNA Sequence Number=SeqID_47139
MVFVCGKRNDDKQMKKEITSLVARLLPYIDINRTHEAIEKQNNEEMPCISAYRVYGTN

SEQ ID NO: 163918 - protein, 451 aa, Glycine max
  Coding DNA Sequence Number=SeqID_47140
  Gene Ontology: Mol. function=transferase activity, transferring glycosyl groups; Cellular component=integral to membrane; Biological process=metabolic process
  Homolog annotation: Hit_ID=Q8S9A6; Match level="QueryCoverage=99%, HitCoverage=97%, E-value=0.0, Identity=81%"; Hit description =Glucosyltransferase-3
  Pfam annotation: Domain name=UDPGT; Domain location=4-451; Score= -69.7; E_value=4.1e-07; Accession=PF00201.9; Description=UDP -glucoronosyl and UDP-glucosyl transferase
MKDSIVLYSALGRGHLVSMVELGKLILSHHPSLSITILFLTPPPNQDTPTSPTAFTCDATAKYIAAVTAATPSIAFHRIPQISIPTVLHPHALNFELCRATGHHLRRILNSISQTSNLKAIVLDFMNYSAARVTNTLQIPTYFYYTSGASTLAVFLQQIIIHENNTKSIKELIIPGLPKIHTDDLPEQGKDQVFIDIATCMRDSYGVIVNTFDAIESRVIEAFNEGLMEGTTPPVFCIGPVVSAPCRGDDNGCLSWLDSQPSHSVVFLSFGSMGRFSRTQLREIAIGLEKSEQRFLWVVRSEFEEGDSAEPPSLDELLPEGFLERTKEKGLVVRDWAPQAAILSHDSVGGFVTHCGWNSVLEAVCEGVPMVAWPLYAEQKLNRVILVEEMKVGLAVKQNKDGLVSSTELGDRVMELMDSDRGKEIRQRIFKMKISATEAMSEGGSSVVTLN

SEQ ID NO: 163919 - protein, 187 aa, Glycine max
  Coding DNA Sequence Number=SeqID_47141
  Gene Ontology: Mol. function=transition metal ion binding; Biological process=cytoskeleton organization and biogenesis
MHNCPKFGVSRYKVKDDDECSSDENTKKGPPAKVLWFLSGLTTLIVYLERPKRWKKVKLPYGRRDVRHCIDVIRVEKNVCDSVIGMLFNIQGKTNDGLNACKDLVEMGIREQLHLRSDVGDVFSSFKVHLIVHRVRKIKCCSPVYLRWMYPVERYIKILKGYTKNLHCPEASIIERYIAEEAIEFFF

SEQ ID NO: 163920 - protein, 78 aa, Glycine max
  Coding DNA Sequence Number=SeqID_47142
MTLVSARQRARLPLVQKTTLVSARQQLICPWLTKGVDNHMVRITIRYRRMSPDFTGQDDRNHLYGYPLGYLRTSPDFT

SEQ ID NO: 163921 - protein, 169 aa, Glycine max
  Coding DNA Sequence Number=SeqID_47143
MVKEECKEVSVSSKRLAKKERHFEIKTNIKEISPLRQPPHFLLCKKTLVSIATPLGLEFIPQVKELLDEGIIMHQIPKIGGMMNVLSGATLFCKITRAPNIFMIFVHRDSLDSDQRVLMNPKRIKVILEWPIPPSVEEKSPEFQEPRDLRSNPFQGGGNDAILPHKGIG

SEQ ID NO: 163922 - protein, 127 aa, Glycine max
  Coding DNA Sequence Number=SeqID_47144
  Homolog annotation: Hit_ID=Q1SKD7; Match level="QueryCoverage=91%, HitCoverage=30%, E-value=1e-09, Identity=30%"; Hit description =Ankyrin
MGSSAASEFDSHCFRCVEHQQRFEAIKGWSFHRERRVQLREDNYPDFQGDISRRHWARLVTPLAKFDPEIVIEFYANAWPTEEGVRDMRSRVRGHWVPFDANVSSQFLGDPLILKEDQQCEFSQRRS

SEQ ID NO: 163923 - protein, 151 aa, Glycine max
  Coding DNA Sequence Number=SeqID_47145
  Homolog annotation: Hit_ID=Q1S0F5; Match level="QueryCoverage=89%, HitCoverage=35%, E-value=4e-10, Identity=28%"; Hit description=IMP dehydrogenase/GMP reductase
MGQLQRQAFRKAYGKIWDLAMVEVSTEAIASLAQYYDQPMRCFTFGEFQLSPMELDHGKQVRNGVVGIPRKCLEAKARALAGRGEWAPFIDILALLIFGGVLFPNVDGLVDLATIDAFLAYHDHKESPVVAMLADLYDTFDRRCEKSSTRI

SEQ ID NO: 163924 - protein, 78 aa, Glycine max
  Coding DNA Sequence Number=SeqID_47146
  Gene Ontology: Mol. function=protein serine/threonine kinase activity; Biological process=protein amino acid phosphorylation
  Homolog annotation: Hit_ID=O81833; Match level="QueryCoverage=67%, HitCoverage=6%, E-value=8e-13, Identity=64%"; Hit description =Putative receptor protein kinase
MVDSNIEDSCVLSEVLRCIHVCLLCVQQHAEDRPLMPSVVLMLGSESELAEPKEPGFYIKNDEGEKISISASAPILPK

SEQ ID NO: 163925 - protein, 75 aa, Glycine max
  Coding DNA Sequence Number=SeqID_47147
MFHELSQFLKQRLKTLDSTPSPALLHELDVLLLRLEAAAQQENALFAPLFHLFNIRLSLFPGARWPQPLAEQNRT

SEQ ID NO: 163926 - protein, 74 aa, Glycine max
  Coding DNA Sequence Number=SeqID_47148
PIRKNNVFSTCTLSCSRYNNPQVDVPSTCTTKDVPSMCWDKEFSGREGKNQKNSQAGSFEFSRKGRRKTQKNSG

SEQ ID NO: 163927 - protein, 69 aa, Glycine max
  Coding DNA Sequence Number=SeqID_47149
MDGILISSVVLLADSRFTRPDMGFHPTKLNFVPSDADEAPLDVSICLHAFGIVGCGSFSGVKSCEREGA

SEQ ID NO: 163928 - protein, 169 aa, Glycine max
  Coding DNA Sequence Number=SeqID_47150
MCHLTAYVCVYYDGQICNTNEGTTFVSNNTKTFMVDKVITFTQLLELVHQKLNIDPEQHIQHLHFRCPIFESGQRYMYTSFILRDDADVRQMFNIFDNNPSLPFVELFAIICHNNDPPGNQHGSTSNLEDLGEYETCWLKNHDSDTDSSSGPEGSNLSPSHEPIFKRDW

SEQ ID NO: 163929 - protein, 77 aa, Glycine max
  Coding DNA Sequence Number=SeqID_47151
  Homolog annotation: Hit_ID=UPI00006A2901; Match level="QueryCoverage =40%, HitCoverage=20%, E-value=2e-10, Identity=96%"; Hit description =UPI00006A2901 related cluster
PEPVGCRWTARAASRRERVVACGRGTDWERAFGASSPGVEQSTQNCALNVKVKKFNQARVNGGSNYDSLKVAKCLVI

SEQ ID NO: 163930 - protein, 67 aa, Glycine max
  Coding DNA Sequence Number=SeqID_47152
MENCTKQSLRMTPNSWVEDARTKTQFMGLRKRGREWRIAISNHYAWLQTRGWRMHEGKRNSWCSEKK

SEQ ID NO: 163931 - protein, 143 aa, Glycine max
  Coding DNA Sequence Number=SeqID_47153
AVHVSSTFEFGAEFYDCLSADPQGNPPYSTFVPEPHECYCLALFMCPPLSSAKSLVTGKHVILLFPDRFLRQKKKKKKKKKEWRRESSSQKGQDGRNQCPIFAFLLSPMRGSRLARSVKFRNVAEVKKRCFCAILKFRNFFES

SEQ ID NO: 163932 - protein, 280 aa, Glycine max
  Coding DNA Sequence Number=SeqID_47154
LACPLESHRSCTEKGGANWDQLLANKEGVSVNWGCISYDPVLAIRQLGYPMRGAPLEEEIAPVISRGFNKTSVETLQKVYKAWEVVRKKDKELRGGNNGPIGGYRKTAKREEVEAPEEDEEVQALRTELKQARTVKERFKSVALNIRKENAELRDINIATTKALEQETKRARREEHGRNKFRGAMWGKTNMLAIVSKYQEELNLATDHEHIVEDEYAQVYAEKEARGWVIDWLHPEARMWMDRFALTLNGSQELPRLLAKAKEMADTYSDPEEILRLLDY

SEQ ID NO: 163933 - protein, 396 aa, Glycine max
  Coding DNA Sequence Number=SeqID_47155
  Gene Ontology: Mol. function=transcription regulator activity; Cellular component=nucleus; Biological process=regulation of transcription
  Subcellular localization annotation: CTP_CleavageSite=50; ConfidenceScore=5.36e-01
MENQFFLASGVSQTQQHPLHFEPSPPNPSSVPSWQSLSPPNMGIQLTVMNCAPEQTQDCFYNPNWDKSTADHGLHHFDSSALSSMVSSPAASSNPNNKSNENFIIRELVGKLGPIGSSDEIPQHSPHPLVVASSCMNSNGNNSTYTSCYSTPLSSPPKVNIVHSLVNERLANLGGGKSTMALNSSVAEFSADPGFAERAAKFSCFGSRSFNDRSVQLGVNNAELAQRSAPAMEHGGKLPRVSSSPLLKTLGSQMGAQENKNSAIHQEQEKMEGANSQEESTISEQAPNGEIGVKTSQDMMNSRKRKASSKGKAKETSNSFNPTKGVEGSEDSNSKRSKPNEGDGNENGQVKVEEESKAEEEKQNKSNSKPPEPPKDYIHVRARRGQATDSHSLAER

SEQ ID NO: 163934 - protein, 67 aa, Glycine max
  Coding DNA Sequence Number=SeqID_47156
  Homolog annotation: Hit_ID=Q8RY46; Match level="QueryCoverage=95%, HitCoverage=9%, E-value=7e-22, Identity=73%"; Hit description =Transporter associated with antigen processing-like protein
MWDLVARDRWVIFAAFSTLIVVVVLEISIPHFLTASSFTAQSANLAIFHRNVQLLILLCVASGICGC

SEQ ID NO: 163935 - protein, 198 aa, Glycine max
  Coding DNA Sequence Number=SeqID_47157
MGGCVQNCKSKKLGGLGVKGISLFNEALLGKWRWNLFHSSPGVWCVVLSTKYDGWHGLLREERSSLDSLWSRDLKRVCDSLNDYSSFWSTSWRWRGIWVFGEMIVGVGTDNIQWICIPFSQKCRFSSDFAFLTPESLHSHFWVFSSGQINLKGFHLETNSHIGSVLKHFVEGGAVAFANPVDEIGVELEYLVIAAGRG

SEQ ID NO: 163936 - protein, 134 aa, Glycine max
  Coding DNA Sequence Number=SeqID_47158
MHFPVIHFRVKRVITNFGKRNCGKGSTRAERDESRVEGMILEDKLKACQRSKRSLTEQLSRTEENMWAIIGQYKEKLNLAAIHEQRLEDEHAKVSVLQAEREARERVIDSLHRKAMMWMDRFTFTLNGSQELPR

SEQ ID NO: 163937 - protein, 141 aa, Glycine max
  Coding DNA Sequence Number=SeqID_47159
  Gene Ontology: Mol. function=nucleic acid binding; Biological process= regulation of transcription, DNA-dependent
  Homolog annotation: Hit_ID=Q0ZCD0; Match level="QueryCoverage=70%, HitCoverage=8%, E-value=4e-30, Identity=60%"; Hit description =Integrase
MSPYRVVFGKACHLPVEIEHKEYWAVKTCNFSMDQASEERKLQLSELDEILLEAYENAKFYKEKTKKFHDSMIIKKDFTVGQKVLLYNSRLGLMSVEIKSDSTNKSFKVNEHRLKSFLTNPSLVDVVVEETSLLHPTLPPP

SEQ ID NO: 163938 - protein, 187 aa, Glycine max
  Coding DNA Sequence Number=SeqID_47160
MTVHVAQIIADAIYLFAGTVPTRHPLDPERSNRALGFSALITGLCQFYGVLVIPSKVIRTSITQAFIEKYCTPRQVKGDAQQAADAPPPQQPDPVIPLSVERYLWHLVRQQTANHHGQGQGSPPFVCPTPEQFRAEVTWPGDWPTEEGTGPAASPGEAEEAHMDEDMTDLLGYLGGGGATRPRSPHL

SEQ ID NO: 163939 - protein, 89 aa, Glycine max
  Coding DNA Sequence Number=SeqID_47161
  Subcellular localization annotation: CTP_CleavageSite=65; ConfidenceScore=5.26e-01
MAFFQIYLDYKAQNAQVTNALGNGSVAYTSDVFSKIPMVRSWTNFFEAPNQISGRSNVTRRWIFPMEALWKDMHRHEDVFSCEKIASAR

SEQ ID NO: 163940 - protein, 178 aa, Glycine max
  Coding DNA Sequence Number=SeqID_47162
MIDVRSQATCHTEVEEAMARMKALEKNESRGYDHNKYRREEEVIDPTPLIVPREHILREVYSANLIMYPTKTEWQLGSDQSMWCEFQETYKHETKKHGDAILTRKGPVTRAMSKRLTKDWARAAEEGLRVLMNLRVPKDSMLPHLGVLVGFVGVKTEVRGYVDLETTFSDEGFKTLTI

SEQ ID NO: 163941 - protein, 118 aa, Glycine max
  Coding DNA Sequence Number=SeqID_47163
  Gene Ontology: Mol. function=RNA-directed DNA polymerase activity; Biological process=RNA-dependent DNA replication
  Homolog annotation: Hit_ID=Q1T193; Match level="QueryCoverage=62%, HitCoverage=27%, E-value=2e-12, Identity=47%"; Hit description=RNA -directed DNA polymerase
MRVKISTTLMPQLENDILEVLKHNSSAFAWSLSDMLGIDPNFLCHKLALDPSTKLVIQKKRKSRKDKIRAIVEETRVNSLANVPIYQSFYDAKIKSTQVLFQVQIKTKKTKIKKKAKS

SEQ ID NO: 163942 - protein, 105 aa, Glycine max
  Coding DNA Sequence Number=SeqID_47164
MREAHEIPHHNLADFEPCLKYATEGQAVGGVPLPNTLEDPQFLLQPQPLHFVVGRVPTAMVEKGKLDHIEERLKAIEGGGDYAFADIVELCLVPDVVIPLKFKVS

SEQ ID NO: 163943 - protein, 78 aa, Glycine max
  Coding DNA Sequence Number=SeqID_47165
ATEDRSPSPYSQRDDSSSLMHDILERFGGLQTYVGGRFDALERQVDTRFDKMNSRITKVEEDVTLIRDCLDLPPPPSV

SEQ ID NO: 163944 - protein, 117 aa, Glycine max
  Coding DNA Sequence Number=SeqID_47166
MAEMGKLDHLEERLRAIEGGEDYAFANLGELFLVPNIITPPKFKVLDFDKYKGTTCPKNHLKMYCRKMGAYAKDEELLIHSFQESLTGVVVTWYTNLKPSRVHSWEDLVVVFVRQCQ

SEQ ID NO: 163945 - protein, 126 aa, Glycine max
  Coding DNA Sequence Number=SeqID_47167
MATPFKTKDVNEEITPKDIRSLMEQANYTNKYLQVLGESISKEKIFTKPKDHKLSTSHVPIEKPLFKPFKVSEKTKQKFRELGKQKSPTEKIGDSNSELLSSAQHWCLAQIHLLVLSATTALSMTM

SEQ ID NO: 163946 - protein, 64 aa, Glycine max
  Coding DNA Sequence Number=SeqID_47168
MKRKSFYLHFEGYVMVVTKIIAKMRCGGRDVATIGFRGMSEGKIERELGKEIRESEREFKFVTS

SEQ ID NO: 163947 - protein, 208 aa, Glycine max
  Coding DNA Sequence Number=SeqID_47169
MYNYHEKGRAPNLESVLADFMTYQASSKGDCYSMQQQGTQFEKDYSFADYQWESEWQPYYHNEAEGLSNLDDLLMQFKGTVDSMQQAFKRAETQIGKLVDKMTKVMVKREEEYAEIETHQESILQVNTIHNQLITKEEKDEVSIIPEYPCIATIGYVVGKDKGRLELSVEDQKISFDLFEAMKHPNMSDACFEEQEVEQEIALSASTM

SEQ ID NO: 163948 - protein, 84 aa, Glycine max
  Coding DNA Sequence Number=SeqID_47170
MGEACHPARPSELACHGTSRIVLQCLLLPSGMSRNFTNCLTMGTKYLEVVKGGSHPNNGWSRTKLGYDEPHKGAWCISEPKRHH

SEQ ID NO: 163949 - protein, 249 aa, Glycine max
  Coding DNA Sequence Number=SeqID_47171
  Homolog annotation: Hit_ID=UPI00005F8B74; Match level="QueryCoverage =65%, HitCoverage=36%, E-value=4e-56, Identity=64%"; Hit description =COG0823: Periplasmic component of the Tol biopolymer transport system
GEQVPEVFVVDLPEALADYARAGNAPLQGTAEQLPAPPAGVQQRRITYGKGLALQPRHWLRAAPDGSAIAFLQADEQGIVQLWTVSPNGGAARQITSLRSSIQSAFSWQPDGAAIAFICDNSVMRCEIASGQCTRLTARSAQPPGGDAVVWSPDGKQIAYMREAGLGASHLLALQHAFARRIFGLIVVGAEVIPRQQQRIHHCREGQIDQRQRFNRPAGIVIGQHLCAGARAGVVTLAGTGMRHHAGAA

SEQ ID NO: 163950 - protein, 154 aa, Glycine max
  Coding DNA Sequence Number=SeqID_47172
  Homolog annotation: Hit_ID=UPI00005F94D0; Match level="QueryCoverage =54%, HitCoverage=79%, E-value=3e-26, Identity=65%"; Hit description =COG5645: Predicted periplasmic lipoprotein
  Pfam annotation: Domain name=DUF1375; Domain location=41-115; Score =122.0; E_value=1.7e-33; Accession=PF07119.2; Description=Protein of unknown function (DUF1375)
  Subcellular localization annotation: CTP_CleavageSite=50; ConfidenceScore=5.05e-01
MGDASPDGKDITTELCGCQVTHSSQGHAMTVGMMMMKMMKRFPLTGLLVCCACATSGCSSVMSHTGASQGYYPGTRASAEMLTDDNTSWAIKPLALIDLPFSAVMDTLLLPWDYFRADDDQTKDSPRERVLQSEKMAGTQASLATAAAMPAESH

SEQ ID NO: 163951 - protein, 129 aa, Glycine max
  Coding DNA Sequence Number=SeqID_47173
HSFYLLLSRETSLSTAIPLELEVIPQVKEFLDEGLVCKSLNPCAFLVPKIGIMSHQIPMIGGMMNVLSGATLFCKITHAFNIFMIHIHRNSLGVPMNPKRIKVIPEWSTPPSIRKIWGFHDLTNFHKRC

SEQ ID NO: 163952 - protein, 203 aa, Glycine max
  Coding DNA Sequence Number=SeqID_47174
  Gene Ontology: Mol. function=enzyme inhibitor activity; Cellular component=cell wall; Biological process=cell wall modification
  Homolog annotation: Hit_ID=Q1SUX5; Match level="QueryCoverage=87%, HitCoverage=41%, E-value=3e-26, Identity=37%"; Hit description =Pectinesterase; Pectinesterase inhibitor
  Pfam annotation: Domain name=Pectinesterase; Domain location=37-201; Score=-33.9; E_value=4.2e-19; Accession=PF01095.10; Description =Pectinesterase
MDFIEQHHKKEKPEAAFPSWFSTHERKLLQSSTIKAHIAVAKDGSGNFKTVQDALNAAAKGKEKTRFVIHVKKGVNTIITSARSVQDGYTTYSSATAGIDGLHFIARDITFQNTAGPHKAWHDGLPRHPHGSCTAPILWPMLHLHICPRTFQNTEISIHNSQIRAAPDLRSVVDKYNTFLGRPWQQNSRVVVMKIHGHIGEHF

SEQ ID NO: 163953 - protein, 193 aa, Glycine max
  Coding DNA Sequence Number=SeqID_47175
  Gene Ontology: Mol. function=zinc ion binding
  Homolog annotation: Hit_ID=Q5EAE9; Match level="QueryCoverage=37%, HitCoverage=21%, E-value=6e-20, Identity=58%"; Hit description=RING -H2 finger protein ATL5C precursor
MVCVLTTIISLTLLLLLYIKHCNDNITYGRGGNSTPWMVALFAGRKNFGIDQSVVESLSIFIFGVLQGQKEGLDCAVSLNKFEATECVDTWLDANSMCPLYRYRVDLEDILLVEDTKPFHQTHQQRNNKHECMRLTSNLEKQELMESRRRHLPVGVEEGEKREEEQHSRRWMTLFRRLLDSISATLRKKNVLR

SEQ ID NO: 163954 - protein, 190 aa, Glycine max
  Coding DNA Sequence Number=SeqID_47176
  Gene Ontology: Mol. function=RNA-directed DNA polymerase activity; Cellular component=intracellular; Biological process=RNA-dependent DNA replication
MDIQAAYSCLLGRPWIHEAGAVTSTLHQKLKFVRNGKLITVRGEEALLVSHLSAFSFIGADETEGTSFQGLTLEGKKPEKNEVSFATWKSAQKVVQEGTGVGWGKVVQLLESKNREGLGFASSAGSATNSVGSSSITSTFCSAGFINNSPEANAALEDAPEEIVLAFVTPGKLVRNWDAVDIPSVVHASK

SEQ ID NO: 163955 - protein, 275 aa, Glycine max
  Coding DNA Sequence Number=SeqID_47177
  Gene Ontology: Mol. function=kinase activity
  Homolog annotation: Hit_ID=Q2AFL3; Match level="QueryCoverage=98%, HitCoverage=48%, E-value=7e-41, Identity=36%"; Hit description=P -loop kinase or ATPase distantly related to phosphoenolpyruvate carboxykinase
MGRSVIIDGSIVYTDSSEILSNPGFEKLLREYIDFLKEKNSPLLRTLEAFRIGEEYNVRHFIEYLHLLTLRDVKEITTIINYVNPEDLAKFIESFYSFWRNKHRFMIKRESYTIDNARKTSIVFTATMIAEEFKNLVRNLYRTIMKNIEPDNSNIVRQLPSGAQVTFLVDSFDCNDERFCNFSNIPMVWGAIFDPPVIFYTRSNKRKGVLPVVERNVLSDLKLPNKEKDWYLIPILVADLLMFVYVNKEFLSHAAGLGNLFQFANIMDLKKKEVS

SEQ ID NO: 163956 - protein, 170 aa, Glycine max
  Coding DNA Sequence Number=SeqID_47178
  Gene Ontology: Mol. function=jasmonate O-methyltransferase activity; Cellular component=nucleus; Biological process=fatty acid biosynthetic process
  Homolog annotation: Hit_ID=Q9AR07; Match level="QueryCoverage=73%, HitCoverage=26%, E-value=2e-19, Identity=54%"; Hit description =Jasmonate O-methyltransferase
MLLKSLVKRSFKYTTNSGAGRSKRHVVEYTVSNISEMTLKTLGPEEQPKSAMPIFSGQLLEQRICTIAFFVAGSAQEIIVFCKIHTKTFQRNELNIYYENGNLNGRVHGIASFARAFVHVKYFRRFHLFPSSCLHGNKCYYVGVGLEDETKRENEKLMNDSFYPGKCLKR

SEQ ID NO: 163957 - protein, 226 aa, Glycine max
  Coding DNA Sequence Number=SeqID_47179
  Gene Ontology: Mol. function=nucleoside-triphosphatase activity; Cellular component=membrane; Biological process=transport
  Homolog annotation: Hit_ID=Q92V53; Match level="QueryCoverage=96%, HitCoverage=92%, E-value=3e-86, Identity=55%"; Hit description =Putative oligopeptide uptake ABC transporter ATP-binding protein, consisting of 2 fused ATP-binding domains
  Pfam annotation: Domain name=ABC_tran; Domain location=1-191; Score =217.2; E_value=3.6e-62; Accession=PF00005.17; Description=ABC transporter
GQTIGIVGESRSGKSTLGRALLRLIQADGRIFFGKQEITGLDRKAMRPLRRHLQLVFQDPYGSLSPRQTVGEIITEGLFVHDQNLNRAERDRRAIEALKEVGLDPAARNRYPHEFSGGQRQRIAIARAIILKPEVIILDEPTSALDRSVQGQVIDLLRDLQKAHGLSYIFISHDLSVIKAISDYVIVMRDGKIIEEGETNAIFNRPSAEYTRALIKSAFSAAVEDN

SEQ ID NO: 163958 - protein, 94 aa, Glycine max
  Coding DNA Sequence Number=SeqID_47180
  Subcellular localization annotation: CTP_CleavageSite=53; ConfidenceScore=5.22e-01
MSSDSPSLDDKGAEDDVSLCVSTGSLAPGSQKVQMTTLVSACQRARLPLVDKRASPRTNGLTGHVAKGGVVDKSEAFAPTYPQFVMRNSDLRSS

SEQ ID NO: 163959 - protein, 119 aa, Glycine max
  Coding DNA Sequence Number=SeqID_47181
  Subcellular localization annotation: CTP_CleavageSite=53; ConfidenceScore=5.24e-01
MYPPLFSLNNLVDVPSTRTDPQEMYLLLFSVTTTQVDVPSTCTTKDVPSNVLRQSSQAARIKRILRLCHFEFFNVATCPFGGERGEAHGCAFQRRKDARSRHQRLFVGNVGKTEGNRSK

SEQ ID NO: 163960 - protein, 120 aa, Glycine max
  Coding DNA Sequence Number=SeqID_47182
MTDLVSVEDDVNLRVSTGLSVAIDEGRRMTIICLCVPSDTIVSEWQKGQYDRDCGAADKSKALAPTYPPMRNSDLRADNRKVSLQATSSWVMVTESGVVDKSEAFAPTYPPMRNSDLRSS

SEQ ID NO: 163961 - protein, 113 aa, Glycine max
  Coding DNA Sequence Number=SeqID_47183
  Subcellular localization annotation: CTP_CleavageSite=56; ConfidenceScore=5.46e-01
MGVPGFRSLNGSAIATRSRSNGFGSVSTSGISGCSIASTDTAYSQHRLWITPIIIRASRRLNLALPPFSERGVLPADTLIREMELGICFETSSLRATNCHYSEAYGDPPKLKG

SEQ ID NO: 163962 - protein, 43 aa, Glycine max
  Coding DNA Sequence Number=SeqID_47184
MAEINQGTWGRMQMEDRATTDRSSSLPGAGQAENVTAKQPSIL

SEQ ID NO: 163963 - protein, 57 aa, Glycine max
  Coding DNA Sequence Number=SeqID_47185
MHDNWPSISRSQIELDELESVSILSMTLAWDEFSFSTFQEAHYSLQDSLDQVPDMPF

SEQ ID NO: 163964 - protein, 257 aa, Glycine max
  Coding DNA Sequence Number=SeqID_47186
  Homolog annotation: Hit_ID=Q1SKD7; Match level="QueryCoverage=68%, HitCoverage=46%, E-value=8e-07, Identity=25%"; Hit description =Ankyrin
MGYEKQKPKVQIAKEGVPIAEVKGNQGTFSLGALSALRRAKRERHKFWGVFETPQPLSCPQGMSSRKRRAVPTPGEASNWDTSRFTSEIAWHRYQDNIQLRNILPERNVELGPGMFDEFLQELRRRRWDQVLTHLPEKRIDVALVKEFYSNLYDPEDHSPRFCRVRGQVVRFDADTINDFLDTPVFLEDGEEYPAYTRYLSTHPDPDTIAATLCTPGGRFVLNVDGLPWKLLEGHDETCSDMECPFLLRSCAHFSHF

SEQ ID NO: 163965 - protein, 104 aa, Glycine max
  Coding DNA Sequence Number=SeqID_47187
  Gene Ontology: Mol. function=protein serine/threonine kinase activity; Cellular component=integral to membrane; Biological process=protein amino acid phosphorylation
  Homolog annotation: Hit_ID=Q9FM23; Match level="QueryCoverage=88%, HitCoverage=20%, E-value=8e-29, Identity=62%"; Hit description =Receptor-like protein kinase
  Pfam annotation: Domain name=LRR_1; Domain location=16-38; Score=7.3; E_value=12; Accession=PF00560.23; Description=Leucine Rich Repeat
  Pfam annotation: Domain name=LRR_1; Domain location=40-62; Score =14.5; E_value=0.38; Accession=PF00560.23; Description=Leucine Rich Repeat
  Pfam annotation: Domain name=LRR_1; Domain location=64-85; Score=5.9; E_value=22; Accession=PF00560.23; Description=Leucine Rich Repeat
  Pfam module annotation: Pfam domain module=LRR_1::LRR_1::LRR_1; Domain location=16-38::40-62::64-85
MQLGGIISPIIGKLSRLQRLALHQNSLHGTIPNELTNYTELRALDLSSNSLKGDIPFSIDRLSHLQIMNLSTNFFSGEILDIGVLSTFDKNSYVLFPDKASYFS

SEQ ID NO: 163966 - protein, 209 aa, Glycine max
  Coding DNA Sequence Number=SeqID_47188
MKTTNTAANGTNNQGTPKWIEVKSHVQSGGYECGYYMMHWMWNIVSGGLKNDWTMWFLDGTTLDKETITTIRQKWAAYFLKESQLKWGMVAAATIDSRDEEEVVETLYAMVGMFPHNASNHNSTDLDGKSLPDNSSVLQDLEDNASDALQASATAPVASPSCHESSAGEASKTSWLNEVVGQKQPDLPDSATLLMPSHSNGVVIFFVAF

SEQ ID NO: 163967 - protein, 59 aa, Glycine max
  Coding DNA Sequence Number=SeqID_47189
MATIALLSRYRSKLAYDIGIRGWCLVLDMQRVDFVADLGVAFVVDWVFLVGRVTGNGQD

SEQ ID NO: 163968 - protein, 121 aa, Glycine max
  Coding DNA Sequence Number=SeqID_47190
  Subcellular localization annotation: CTP_CleavageSite=64; ConfidenceScore=5.60e-01
MAKPSSPANLASAIICFFASKKFPHRLKASPGRFARQNPSPHPSVMVHVHGFFKAVLSLPEVLLADSRFTRPDMGFHPTKLNFVPSDADEAPLDVSICLHAFGIVGCGSFSGVKSCEREGA

SEQ ID NO: 163969 - protein, 135 aa, Glycine max
  Coding DNA Sequence Number=SeqID_47191
RLSEQGYIKLKQQLPGLSEGFQGPALREIREKKKKKEEKNEAEVLQNYDHNRLLLRSSFVIQSKGSSSLHIEVNNALVTDAWGAIATYPFAGGRREGSQVDKNGALALTYPPSKRKSDLCSSFKRANQAILFTWK

SEQ ID NO: 163970 - protein, 75 aa, Glycine max
  Coding DNA Sequence Number=SeqID_47192
MPPLWFQFLAFLCTRWGPFLKVGNIYQNAQNETLSMVQRNRVQVDPEKIKAIQEWPTLKSVGDIRSFHGLASFYR

SEQ ID NO: 163971 - protein, 276 aa, Glycine max
  Coding DNA Sequence Number=SeqID_47193
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=9e-19, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLTIRGLHALAFRGLHILAFTGLPVLAIRGLYILTFRGLHTLAIRGLHVLTFRGLHALTFRGLHVLALRTTRPHHQRTTRPTHQKTTCPRLERATPPRLQRTSRLPLQRAARPNLQRTTRPRLEDNTSSPSEDYTSSPSEGLHVLTFRELHALVFKGLDVFTFRGLHLLAFRGLHVFPFKGLHVLTFRGLQALALRTTRPHLQRTTRPHLQRATRPHLQRTTRPHLQRTTHPRLERTMSSPSEDYTSSTLEDYTSSPSEGYTLSPSVSSTSAP

SEQ ID NO: 163972 - protein, 100 aa, Glycine max
  Coding DNA Sequence Number=SeqID_47194
  Subcellular localization annotation: CTP_CleavageSite=20; ConfidenceScore=5.23e-01
MAGRRANCSFMASMSAFICSCASSTSPITLALAQDMGLNQFRFFNMVHDILVKVKLEVTRTSTVLNVFGSRRSSDKWVYDPSMVGSWKMQGSRMSEHENK

SEQ ID NO: 163973 - protein, 230 aa, Glycine max
  Coding DNA Sequence Number=SeqID_47195
  Gene Ontology: Cellular component=mitochondrion
  Homolog annotation: Hit_ID=Q8TGM6; Match level="QueryCoverage=53%, HitCoverage=99%, E-value=9e-10, Identity=42%"; Hit description =Protein TAR1
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSL

SEQ ID NO: 163974 - protein, 193 aa, Glycine max
  Coding DNA Sequence Number=SeqID_47196
  Gene Ontology: Mol. function=metal ion binding; Cellular component =nucleus; Biological process=regulation of transcription, DNA -dependent
  Homolog annotation: Hit_ID=Q9SB61; Match level="QueryCoverage=68%, HitCoverage=52%, E-value=1e-18, Identity=41%"; Hit description=ZF-HD homeobox protein At4g24660
  Pfam annotation: Domain name=ZF-HD_dimer; Domain location=57-116; Score=102.2; E_value=1.5e-27; Accession=PF04770.3; Description=ZF-HD protein dimerisation region
MEFKQHEETELRMPTPTASHDDFGIPPSSQGEEELVAAVIPVVIPVTPTPPTLAQNNDNEKYHECLKNHTIKTGVHTLDGCIKFLPLGEEGTLDALKCLVCNCHRNFHRKETPNDTYLVPYYYHHSSLPLAAYYGEQVGYPRVQGQQCTTLALPSRSRGGGGAQSSREDMEAVSDPTSGATPHGGSNKKRFRT

SEQ ID NO: 163975 - protein, 165 aa, Glycine max
  Coding DNA Sequence Number=SeqID_47197
MASTSSLSECRDTTKLPGGSLNLKFLCVSHLYFSGPEARFERLPKLVRATIAIGHVLLEDKEEADLILEFQNLTHLELGYSDYTRDWIERLEVIKRFPNLQILDIDMGSIDMNARGDEGANWPFPRSVPSCISLHLKTCEQEEETKKQRKVVLGVAITLFYGDTQ

SEQ ID NO: 163976 - protein, 61 aa, Glycine max
  Coding DNA Sequence Number=SeqID_47198
  Gene Ontology: Mol. function=sucrose synthase activity; Biological process=sucrose metabolic process
  Homolog annotation: Hit_ID=Q9FHU4; Match level="QueryCoverage=96%, HitCoverage=11%, E-value=4e-10, Identity=40%"; Hit description =Sucrose synthase
FKEWGFDKGWGNIAGRVKETMKLLYEVVYILDQVRALEEELLHKIELQVLDVKPQILVVSY

SEQ ID NO: 163977 - protein, 79 aa, Glycine max
  Coding DNA Sequence Number=SeqID_47199
  Subcellular localization annotation: CTP_CleavageSite=38; ConfidenceScore=5.11e-01
MASLPTPYTRAVDSALWQDQSSVPLSSSPTAPPYIPPCGSADQCGGPLPPLRQAQPLRSLLQHTIYTFLTSDPSFIDLL

SEQ ID NO: 163978 - protein, 55 aa, Glycine max
  Coding DNA Sequence Number=SeqID_47200
  Homolog annotation: Hit_ID=P93042; Match level="QueryCoverage=60%, HitCoverage=4%, E-value=4e-10, Identity=85%"; Hit description=Root hair defective 3
SQTTKGIWIAKCAGIEPSTIAMDLEGTHGRERGEFGDLLVILASFRASNKKDLIV

SEQ ID NO: 163979 - protein, 70 aa, Glycine max
  Coding DNA Sequence Number=SeqID_47201
MADIHHTFLCMLLSPLTLVNPSLIGLVETKHKKESGEEKTGRQRGNEETGRGSMLQGRSLCLAEHGWAIA

SEQ ID NO: 163980 - protein, 441 aa, Glycine max
  Coding DNA Sequence Number=SeqID_47202
MEEPSEMPTMATCKIALRFIEKGARGRMIQCGNCETAWFNYGEYFFPITAQNLTSCSIMRKIHFPTLVTGCVDQNPRVSVNDYQRIHSSKDYGCPNLVDVVVILNLRNHDEEQLLLYRTCWTLSTTIGINFFKDDSGYSKFMLLNAKKNGIFYHTYYIPSTNLGIKFSKNDFGYFKFMLFTTKNSGVVSPDEHPTFLLMWFCRYFICTCSIDNHIEYNTVSGPIWFLILWARLYFINAFYPGASLLAMTKQGDNCYGLALICLLISLCTSCQSNEISAILEDIKDKLHSLVFKYFTFSLNIVYFFTKWWEFILSTLFSGSIVNCLTRHVDDLSDDEPPSSTLVKHHLSSDTTRFDLVDVVSLLKSPKFKSVPRSTGESSKRDKETTEELFKEVPLTPDTCRTKMTKKIGHCNRQDTLSRSTDSFPILKKLSIPDEALHEYF

SEQ ID NO: 163981 - protein, 67 aa, Glycine max
  Coding DNA Sequence Number=SeqID_47203
MLQKFRSKSHFLEIEMLQLCSQISQSATSRFDLVEVKLGGVELQNREKASALDLGVVALAEGRQKRQ

SEQ ID NO: 163982 - protein, 67 aa, Glycine max
  Coding DNA Sequence Number=SeqID_47204
MDRWQKENEPEENFVGKAVQGVVECEKGEEKNSGAYIQTVIRKQEPLDNIMHQGHLENRSGKVPLVK

SEQ ID NO: 163983 - protein, 234 aa, Glycine max
  Coding DNA Sequence Number=SeqID_47205
MIIDQSLFFSLTKLPSQGAPFEGTIVDDWKFDYSNHDARRMVCNDQADMTGRLLAGSLTFDCRIMHYIIVRILLPCSSNLAQASEEDLILMWVFLTSRQIDWAHLVRYRMHKALRANAPLPYPQMVTLFLHHFQIPLDDEPFVQVKRSFAIGVGAVTSFGYRKDRDGQWMKKDTLPPQDERTPSPPPQRDDSSALMNEVLSELRGLCTYVGARFDSLDGRFEGMDTRITSLKRM

SEQ ID NO: 163984 - protein, 103 aa, Glycine max
  Coding DNA Sequence Number=SeqID_47206
MASTSSLSECRDTPELPGGSLNLMFLCVSHLYFSGPEARFERLPKLGSIDMNARGDEGADWPFPRSIPSCISLNLKTCEEEETKKQRKVVLGVAVTLFYCDTQ

SEQ ID NO: 163985 - protein, 177 aa, Glycine max
  Coding DNA Sequence Number=SeqID_47207
MSSRKRKSGGSRPTTQYDTRRFHSFEAWTRYTNNVLGRHILAERKVEIYHTELDEFKGELERRNFHKRLTNLADTSIDLTLVKEIYANLYSPGGPSPKQVRIRGHLIRIDADNLNDFLETPVVLAEGESLPAYSRYCRMPTDTREIETALCIPGRGYSVGHECRSPHFWADYFYGPV

SEQ ID NO: 163986 - protein, 168 aa, Glycine max
  Coding DNA Sequence Number=SeqID_47208
  Gene Ontology: Mol. function=chitin binding; Cellular component =extracellular region; Biological process=chitin metabolic process
  Homolog annotation: Hit_ID=UPI00006A17C9; Match level="QueryCoverage =82%, HitCoverage=100%, E-value=1e-15, Identity=32%"; Hit description= UPI00006A17C9 related cluster
MMDTLEPYTGAMKGTMREPPANLGYLVFRGLHVFAFRGLNVLTIRGLHVLASKGLYVLTFRGLHVLAFRGLHVLDFRGLHALTFRGLHVLTFRGLHALTFRGLHALTFRGLHVLTFRGLHVLAFRRLHLIPFRGLHLLVFRGLLVLAFRGLHVLAFRGLQALTFRELH

SEQ ID NO: 163987 - protein, 362 aa, Glycine max
  Coding DNA Sequence Number=SeqID_47209
  Homolog annotation: Hit_ID=Q1SS26; Match level="QueryCoverage=54%, HitCoverage=25%, E-value=8e-07, Identity=21%"; Hit description =Unnamed protein product; no similarity, hypothetical start
  Subcellular localization annotation: CTP_CleavageSite=41; ConfidenceScore=5.36e-01
MAEPSKKRKGSSSTAATAAHRRHGPSEAPTAPIHPSLSSPRSSTLFSSDDQRLRYLSQFSSRIILDPKYLDVDFFNDETFDCYQVFQNSGLVDFMSLKLPHYPELVKVHGIPMIIDQSLFFSLTHLPSQGAPFEGTIVDDWKFDYSSHDARRMVCNDQAEMTGRLLAGSLTFDNRIMHYIIVRILLPRSSNLAQASEEDLILMWAFLTGRQIDWAHLVRYRMLKALRANALLPYPQLITLFLRHFQILLDDEPFVQVKHSFAIGAGAVTSFGYRKDRNGQWLKKDALPPQDERTPSPPPQRDDSALMTEVLSELQGLRSYVGEHFDSLDTHFAGMDIRLTQLEEDVGYIRQSFDLPPPPPPS

SEQ ID NO: 163988 - protein, 62 aa, Glycine max
  Coding DNA Sequence Number=SeqID_47210
MKRFETYLRLLMTSSSLQIRLKQEEERLVMEMGESAMLTTTCGKNKATKSQANQKRSGKILP

SEQ ID NO: 163989 - protein, 257 aa, Glycine max
  Coding DNA Sequence Number=SeqID_47211
MAPEDLEQLTQKIRDQLEESITKKMQSQGLALSPEPKVGPSVACVSTKESCDDPSGNDPDTGDSEKYGLYVEENPPSLVALGRLYEGSTTIHNMPLRHYQVKVGVEEVRDVDAPILVPTQEGVVGPDKPADRPDHDVNDPLYLMTLTIPQLFLKPLKVMWDATVFELFNDDFPLYIKHEHLSKIARGGQCLNISVIQLWILHVTKTSMRAGNFDVYGFLKPQSIQRYGQSQFESESYIKNWMQNSKRGVYLGAYLNR

SEQ ID NO: 163990 - protein, 254 aa, Glycine max
  Coding DNA Sequence Number=SeqID_47212
  Homolog annotation: Hit_ID=Q5CDC4; Match level="QueryCoverage=16%, HitCoverage=32%, E-value=2e-15, Identity=100%"; Hit description =LacOPZ-alpha peptide from pUC9
  Subcellular localization annotation: CTP_CleavageSite=48; ConfidenceScore=5.32e-01
APVASVSISCPSCSATDGVGFPSHDVVKRRPVNCNTTHYRANWSSTAVAAALELVDPPGCRNSIFSGRRCRHRWATCRAPGAARSAAAPVRAAPRSADRRPARPVDRRRAARRRARRAGPSGPHPRRRRPARCRCHARRPARTVPRGVSRSLRPLVSRCASCWSLNQLEGAPTGCEPSTPPGVPGERSSVASLRMGKHQAYRYRRPRGGARYQLLFPLVRVNFELGVIMVIAVSCVKLLSAHNSTQHTSRKHKV

SEQ ID NO: 163991 - protein, 124 aa, Glycine max
  Coding DNA Sequence Number=SeqID_47213
  Pfam annotation: Domain name=AT_hook; Domain location=5-17; Score =15.3; E_value=0.051; Accession=PF02178.9; Description=AT hook motif
MVGSKRSRGRPPKMVSPVPVNPPSPVAPPEMESEIHEEDEDGDLANSKQGPANGSETVAQETLIEDQDGIGHKLWVDVISGNRNPAKGRVMQYVAPKVVDGEIDVKIEDEDVAPELKFWETTLI

SEQ ID NO: 163992 - protein, 389 aa, Glycine max
  Coding DNA Sequence Number=SeqID_47214
  Gene Ontology: Mol. function=arginine decarboxylase activity; Cellular component=periplasmic space; Biological process=putrescine biosynthetic process
  Homolog annotation: Hit_ID=P21170; Match level="QueryCoverage=67%, HitCoverage=39%, E-value=1e-123, Identity=84%"; Hit description =Biosynthetic arginine decarboxylase
  Pfam annotation: Domain name=Orn_Arg_deC_N; Domain location=201-389; Score=127.8; E_value=3.1e-35; Accession=PF02784.7; Description =Pyridoxal-dependent decarboxylase, pyridoxal binding domain
  Subcellular localization annotation: CTP_CleavageSite=70; ConfidenceScore=5.04e-01
MARDASCNAPQAKPLSSLSVNQYRWINIWTSILGQGLARLPAFAVSAAASSNGHQCRTGAHSSAISRLVSLSLTRVSYNYMSDKPIADRERRFSSLPPARLVGLFSRVVAAIVADGFVSAECEANHEVAMNDRNASKMLRTYNVAYWGNNYYDVNELGHISVCPDPDVPQARVDLAELVKTRQQDGQRLPALFCFPQILQHRLRSINAAFKRARESFGYQGGYFLVYPIKVNQHRRVIESLVNSGEPLGLEAGSKAELMAVLAHAGMTRSVIVCNGYKDREYIRLALIGEKLGHKVYLVIEKMSEINLVLEEAERLNVIPRLGVRARLASQGSGKWQSSGGEKSKFGLAAVQVLKLVETLREAGRLDSLQLLHFHLGSQLANIRDIATG

SEQ ID NO: 163993 - protein, 86 aa, Glycine max
  Coding DNA Sequence Number=SeqID_47215
MVTLLVFSLGDECTLAYLSCFCRPVVREWRLIYGHAGSLTRLITVKPHLEFSSIGDALSLIVPIAIMYYLKRMISLEASEVMCNHP

SEQ ID NO: 163994 - protein, 442 aa, Glycine max
  Coding DNA Sequence Number=SeqID_47216
  Gene Ontology: Mol. function=RNA-directed DNA polymerase activity; Cellular component=chromatin; Biological process=RNA-dependent DNA replication
  Pfam annotation: Domain name=rve; Domain location=283-411; Score =39.4; E_value=1.3e-08; Accession=PF00665.16; Description=Integrase core domain
MKEEVKKEVLKLLEARLIYPISNSAWVSLVQVVPNKGGMTVVRYNHITVDPKDQEKTDFTCPFSVFAYRRMPFELCNAPTTFQRSSFDCCLTNLELVLRRCLEENMVLNWEKCHFMVQEGLVLGHKISARGIEVDKAKIDAIEKLLPPINAKDEECLAAFQTLKDKLISAPIMVAPNWSKEYELMCDASDYVGDVVHHLCLREILVLTGGLQEFDIIIKDNKGFNSVAADHLSQLVNEEPKKFLRDVCFYVWDDPHLFKIGTDNLLRRYVTTEEAQSILWHYQSSPYGGHYYGYSHLISSYGNAYILVAVDYVSKWVEAIATPKNDAMILIKFLKRNIFSRFGVLRVLISDGGTHFCNAQLQKFLGHYNVRHKKTAVSSRKDWAAKLDNALWAYRTIFKTSIGLSPFQMFYGKACHLPVELEHKAYWALKFLNFDNSLSGEK

SEQ ID NO: 163995 - protein, 92 aa, Glycine max
  Coding DNA Sequence Number=SeqID_47217
  Gene Ontology: Mol. function=DNA binding; Biological process=DNA integration
  Homolog annotation: Hit_ID=Q1SKC8; Match level="QueryCoverage=74%, HitCoverage=16%, E-value=2e-12, Identity=56%"; Hit description =Integrase, catalytic region
MLAAGNRLLPYGNRLPESKTLCSRLRLFLGKLKSKWSSPFLVKEVKPSGAVELINPAAHDPEKIYIINGQRLKIYNGGNMESLTIVIHLQDL

SEQ ID NO: 163996 - protein, 93 aa, Glycine max
  Coding DNA Sequence Number=SeqID_47218
  Pfam annotation: Domain name=G-patch; Domain location=26-70; Score =7.2; E_value=0.024; Accession=PF01585.13; Description=G-patch domain
MAFQSFEVVSIASVDSLPRQPLLSDAAMMVAWVMLGHGYELGMGLGKNNGGSTGLVRVRGNHEKFGLRYNPTHADVRKNISGRKNKGQGPQSG

SEQ ID NO: 163997 - protein, 245 aa, Glycine max
  Coding DNA Sequence Number=SeqID_47219
  Gene Ontology: Mol. function=GTP binding; Cellular component=nucleus; Biological process=SRP-dependent cotranslational protein targeting to membrane
  Homolog annotation: Hit_ID=Q208U9; Match level="QueryCoverage=75%, HitCoverage=60%, E-value=7e-68, Identity=63%"; Hit description=CFM6
  Pfam annotation: Domain name=CRS1_YhbY; Domain location=155-220; Score=53.3; E_value=7.8e-13; Accession=PF01985.11; Description=CRS1 YhbY domain
  Subcellular localization annotation: CTP_CleavageSite=14; ConfidenceScore=5.08e-01
MPYHNFIFLVFHSRQVHISKNLQNTKPSFRSFLLSFSISHDILGSWLPARYISNESVELKTHNDVIRFSLGKSDDINNAKKSQLNKKFKISRKAKLNELKCYRLKAKKKMNSPNPEVRIRYKLEKAKRKETWLIEKLQKFDVPKPPPETYDPEILTEEERHYMKRTVLNMHLHWKNHETVKVICKPCKPGQVHEYAEELARLSKGIVIDIKPNNTIIFYRGKNYVKPEVMSPPNTLSKAKGRDSE

SEQ ID NO: 163998 - protein, 70 aa, Glycine max
  Coding DNA Sequence Number=SeqID_47220
MALDANGRRLLVTSSSFRAPIYQVDDSCLSMWQPSLNYSPSFSVGDSSLYREPWLKPGLSYLVETSSVKD

SEQ ID NO: 163999 - protein, 234 aa, Glycine max
  Coding DNA Sequence Number=SeqID_47221
  Homolog annotation: Hit_ID=Q9ZNU6; Match level="QueryCoverage=31%, HitCoverage=14%, E-value=2e-22, Identity=66%"; Hit description=Light- mediated development protein DET1
MDTTEIVSFYQNSPDELYLLFQQFCDHFHATSRNSMYMNFISSHSNNIHALEQLRSIKDKASSSAQFVKNILESRFIKKITELMDDIRENVSVLTLLAEVLCLLDMIVNSFAHMISTKPVDRYTRPEFTENGPLAIDSKQAINHIKRKYELENMEIVNKEKEKVRYDFLVDKAIAEIEAKCGQKIEECKEEQRQQLMRIEDEHTLLVTQMKQEHDKRQASLIAEHNEQLKRTQL

SEQ ID NO: 164000 - protein, 151 aa, Glycine max
  Coding DNA Sequence Number=SeqID_47222
MGNGETLLVAIFLRLISSSIDEKIRQKHDNHIRKQWRRAFDDGISGQESNVTTEPGDATKDRSSLYNSSGLGGKPQAFGGQGLRVGSFDESLVYRHPDMMIDVYSHATCHIEAKESMARKRAMEKKEFGLASKNGEVKFTAVELVDNEDVK

SEQ ID NO: 164001 - protein, 156 aa, Glycine max
  Coding DNA Sequence Number=SeqID_47223
  Gene Ontology: Cellular component=integral to membrane
  Homolog annotation: Hit_ID=Q1RSX3; Match level="QueryCoverage=66%, HitCoverage=25%, E-value=6e-41, Identity=77%"; Hit description=CBS
  Pfam annotation: Domain name=CBS; Domain location=30-143; Score=14.1; E_value=0.0034; Accession=PF00571.18; Description=CBS domain
MGLTNWYGLIPELFPNVKYVQGIMTGSIVISKGTKYLPTYLITLMDLMNPILEKGHSRVPVYYEQPTNIIGLVLVKNLLTIDPEEEIPVKNVTIQRIPRVPETLPLYDILNEFQKGHSHMAVVVRHCEKTGQQSSNNNADVRDVKVDIDGGERTGT

SEQ ID NO: 164002 - protein, 66 aa, Glycine max
  Coding DNA Sequence Number=SeqID_47224
DSTSDSPQISASPYQLDFTLYASGSYNAQWNAPGLLHDKHTLRSSRILRKMEVVFVIGSAVDRLCG

SEQ ID NO: 164003 - protein, 189 aa, Glycine max
  Coding DNA Sequence Number=SeqID_47225
MPCTIFGDYVDILIGINGGATSELPIVIFQFEKIKTHTGYSKFLMVDTAAFFFLTSIVSIYLGGLMPQWWKLIRKFLFKVEKDAVYGFRFNDSFKVKRICEDDAIIHEFKNDSVPVTPEKMKFGVKCIETDMDDSSTSKSAEFDQCSIDQQEDAIVIDDNAVGFTVKVSNTTLDRGKMPLKMCPTFLNT

SEQ ID NO: 164004 - protein, 202 aa, Glycine max
  Coding DNA Sequence Number=SeqID_47226
MTYSRYTGDGLNGSKELGENIDWDSHASLDILDKSGAISMFLIRDGVLTTLLSFSRPDDELGVDSLFYIDAIETLWEHDDALHVDHLYWFLCYHRVLSTLSYYHFVMPMPEVVIPSEFHLLHVDDVISSSGSNSSYKDTETISPTLMSPQSVLPESQAPPRVDLVNLVLEDEGEKLEEDKSFKEDTVMELEPVEEDSSKESY

SEQ ID NO: 164005 - protein, 77 aa, Glycine max
  Coding DNA Sequence Number=SeqID_47227
MALTELHCIYFSISCSSILSEDEKVVEIAYFKAQHGSTSLITQWVYFTSVSNKVGGCSTNNIPSRGTRSSCNTSFLR

SEQ ID NO: 164006 - protein, 113 aa, Glycine max
  Coding DNA Sequence Number=SeqID_47228
  Subcellular localization annotation: CTP_CleavageSite=85; ConfidenceScore=5.72e-01
MIAVRLQGKNATSNATNVKISTDSQSATGNKTWTSTAPNFVNNLAQSCVGNSQRSYVNSIHISSAPTFASWKMHGMSNYVSASCMSEHKSTFTPYGSHRPGYRAQHLKDCEKV

SEQ ID NO: 164007 - protein, 156 aa, Glycine max
  Coding DNA Sequence Number=SeqID_47229
MAWVIDRCMDSLSLNLYTMQRIDVGNVKNISKNDLRNRNDNSPIGKWLCCALKTMSWSVGRCDCEHYINIILIFQCSAYKKLNTTADGKTHVQRGGYECGYYVMHWMWNIIGAELKSDWTVWFGDGSALDSEAITALRKKWAAYFLKLRTIQCTKL

SEQ ID NO: 164008 - protein, 89 aa, Glycine max
  Coding DNA Sequence Number=SeqID_47230
  Homolog annotation: Hit_ID=P52780; Match level="QueryCoverage=27%, HitCoverage=3%, E-value=6e-10, Identity=100%"; Hit description =Glutaminyl-tRNA synthetase
MAFENGSKKELEKVGLKISKSFPLTRTTLASMESLSLPVEIVLSADMQCEKCQKRVADIITKMNENPQCNVHNHNLDRYTICLQHEGVG

SEQ ID NO: 164009 - protein, 123 aa, Glycine max
  Coding DNA Sequence Number=SeqID_47231
  Gene Ontology: Mol. function=glutamine-tRNA ligase activity; Cellular component=soluble fraction; Biological process=tRNA aminoacylation for protein translation
  Homolog annotation: Hit_ID=P52780; Match level="QueryCoverage=87%, HitCoverage=13%, E-value=3e-49, Identity=85%"; Hit description =Glutaminyl-tRNA synthetase
  Pfam annotation: Domain name=tRNA-synt_1c; Domain location=1-122; Score=-70.6; E_value=1.6e-09; Accession=PF00749.11; Description=tRNA synthetases class I (E and Q), catalytic domain
MGWKPFKITYTSDYFQELYELAVELIKKGHAYVDHQTPDEIKEHREKKLNSPWRDRPISKSLKLFEDMKNGSIEEGKATLRMKQDMQSDNYNMYDLIAYRIKASTQLHFFIAQISRKIMIDFL

SEQ ID NO: 164010 - protein, 82 aa, Glycine max
  Coding DNA Sequence Number=SeqID_47232
MVPQPSLYLLTYFMTLRFTTVQNHRKMYCRTDLKNPFCSSGTSTWLFKENKGGYIPCGSLGLNLNQEVESAYDDDHAGDGKA

SEQ ID NO: 164011 - protein, 100 aa, Glycine max
  Coding DNA Sequence Number=SeqID_47233
  Gene Ontology: Mol. function=unfolded protein binding; Cellular component=cytosol; Biological process=cellular protein metabolic process
  Homolog annotation: Hit_ID=Q75HJ3; Match level="QueryCoverage=87%, HitCoverage=16%, E-value=3e-34, Identity=81%"; Hit description =Putative TCP-1/cpn60 chaperonin family protein
MGWTKHFQWPCRLDQYVIAKFAKSFQMIPRTLAENAGFNAMEIISSLYAEHASGNAKVGIDLEEGVYKDVSTLCIWDLHVTKLFALKYATDAACTVLRVD

SEQ ID NO: 164012 - protein, 671 aa, Glycine max
  Coding DNA Sequence Number=SeqID_47234
  Gene Ontology: Mol. function=protein serine/threonine kinase activity; Cellular component=ubiquitin ligase complex; Biological process=protein amino acid phosphorylation
  Homolog annotation: Hit_ID=Q5ZB74; Match level="QueryCoverage=49%, HitCoverage=43%, E-value=1e-138, Identity=70%"; Hit description =Serine threonine kinase 1-like
  Pfam annotation: Domain name=HSF_DNA-bind; Domain location=482-632; Score=-89.4; E_value=0.021; Accession=PF00447.8; Description=HSF -type DNA-binding
  Pfam annotation: Domain name=Pkinase; Domain location=203-463; Score =99.3; E_value=1.2e-26; Accession=PF00069.15; Description=Protein kinase domain
  Pfam annotation: Domain name=Pkinase_Tyr; Domain location=203-466; Score=80.2; E_value=6.6e-21; Accession=PF07714.7; Description =Protein tyrosine kinase
  Pfam module annotation: Pfam domain module=HSF_DNA-bind::Pkinase::Pkin ase_Tyr; Domain location=482-632::203-463::203-466
MAKVQPISSPMVSRCELTKTGTNILSDPTLYRSMVGALQYSTITRPERSFVVNKASNPDDRRFTSEVAIYFGPNLISWRSKKQQIVARSSTKAEYRSLVQGTTEAKEINQWKEERIAEEATKLPKEAALELAEKEKVKAQAALEAYEEAIKMVEKEAQRRIQAEVKARREAQEKDRALNLLIINDTRYRKYSIKDIEEATQKFSPSLKVGEGGYGPVFRGQLDHTPVAIKILNPDASHGRRQFQQEVEILCSIRHPNMVLLLGACPEYGCLVYEYLENGSLEDRLLMKNDSPPIPWWKRFEIAAEIATALLFLHQTKPEPIVHRDLKPANILLDKNFVSKISDVGLARLVPPSVADSVTQYHLTAAAGTFCYIDPEYQQTGKLTKKSDIYSLGIMLLQIITAKPPMGLAHHVRMAIEKETFSEMLDIMISDVPLEEALAFVKLSLSCTELSKKDRPDLATVVVPELNRLRDFGLAFQNRSHPPHLPTPTRSPRSRISKIMHKWEFVNEHFKRGQKELLSEIKRLKTVPQSSTHPPDAGKPGADENSLSNPGGDDTGSTSTSSSSFKYQGSVETNTTPSHQLSSENKKLKKDNETLSCELARARGEWQKMENPNLRMAMGIKPDQKGVRIRRIDPTAPESKVLKSSDVIHSFDGLILPMMEQLLKTKKVLSI

SEQ ID NO: 164013 - protein, 206 aa, Glycine max
  Coding DNA Sequence Number=SeqID_47235
EDLPERNVMIYHTEFDEFKTGLERRNGHKEFTNFLDGSIDVAIVKEFYANLYDPEDKSPKQVRNLTTLAQTWSILSFSNLAPTSHTSDITLDRARLMYGIIQKMDTNLGYIISSQISMIAQHDSSRLGFPALITTLCKARGVTSDSLSFESLSPAINLAYAKKNFWNLDDLASSLSHPLLAEHMIHRVKLAKRTACTSRLSEEEAR

SEQ ID NO: 164014 - protein, 261 aa, Glycine max
  Coding DNA Sequence Number=SeqID_47236
  Homolog annotation: Hit_ID=Q1SS26; Match level="QueryCoverage=79%, HitCoverage=25%, E-value=4e-09, Identity=21%"; Hit description =Unnamed protein product; no similarity, hypothetical start
  Subcellular localization annotation: CTP_CleavageSite=38; ConfidenceScore=5.58e-01
MEESSKKRNGSSTSAAAHRTSRSGATGASPTPIPPSLSSSTLFSSNEQRIQYSSLFKSRQILDPKYLDLEFFDGKTFDCYQVFQNTSLIPFMSLKLPYYPELVRVFYSNLKIQDGTLISEVHGIPMIIDESLFFSLTQLPSQGAPFASTLVDEWKFDYFSHDARRMVCIDQADTAGRLLVGSLTFDCRIMHYIIVRILMPRSSNLAQASEEDFILMWAFLTGRPIDWAHLIRYHMHNTLRSGAHLPYPQLVTLLLRHFEFH

SEQ ID NO: 164015 - protein, 68 aa, Glycine max
  Coding DNA Sequence Number=SeqID_47237
MSDSVEVLHRSSSFFVRSSIFNRETKAKINSQTKLCLQKSLEAVLRSNTLNGHEELHRSEFLIAIEDT

SEQ ID NO: 164016 - protein, 55 aa, Glycine max
  Coding DNA Sequence Number=SeqID_47238
MNPYFPNKGSPPIECIPLEVNGVLLSQIAIKVIGPLLLDSNSSRDGTNPPFQFPI

SEQ ID NO: 164017 - protein, 92 aa, Glycine max
  Coding DNA Sequence Number=SeqID_47239
MAENLHEITHGNASAWIFFTETIFLTNFKEKREKLPTQLAQASSAHTGELGCFLQKVVPSGGTSRKPQMGPVAICTPYLLNTPLPFFADSFP

SEQ ID NO: 164018 - protein, 145 aa, Glycine max
  Coding DNA Sequence Number=SeqID_47240
  Subcellular localization annotation: CTP_CleavageSite=50; ConfidenceScore=5.19e-01
MAFGTMAARPGELMLTPKVTSSPRRVGSFCLKQFGGPGEPEASLGNNTVRLARIKTSVNDNSWMKLGVLDRRFQEDWTRVAKEGPKILMNLREDFQAHGPSPSFSRKLLKEVSLAIRRWMVPPLTSSPLSSAASPWWKITIEEPH

SEQ ID NO: 164019 - protein, 221 aa, Glycine max
  Coding DNA Sequence Number=SeqID_47241
  Homolog annotation: Hit_ID=Q1S463; Match level="QueryCoverage=47%, HitCoverage=25%, E-value=7e-11, Identity=41%"; Hit description =Eukaryotic aspartyl protease
MVTFKGGGVVVVPPWEDIIASSATSRATLHRPPQEGGGGEKLLSSGDGPSWHAEEETTVLGRNFGIPTNLINKEMTAYSMHVTGRSINSFTEFCTSTRISGYKEDMSCPYNITYGNASTIIGSYAEDYHTFKQVNGDPHATPENSSMIGKFKHTQHGMLLKQKIQLAKNKKGADLMISLITKATNVMDNLNLSSCGKRYIWPGAMVEILQNKCADSVFKAN

SEQ ID NO: 164020 - protein, 271 aa, Glycine max
  Coding DNA Sequence Number=SeqID_47242
  Gene Ontology: Mol. function=protein serine/threonine kinase activity; Biological process=protein amino acid phosphorylation
  Homolog annotation: Hit_ID=Q9LYH3; Match level="QueryCoverage=98%, HitCoverage=41%, E-value=3e-25, Identity=31%"; Hit description =Putative receptor-like kinase
MPSVGQLNTLITQSSLQSMSSTKTFLIVDEGTNVFPPDEDDIAHVFKPLRHMCHGKVVMLKEAVIDDSDIVKGIVEYAQRNRVNTIVVGAPHSSRNTLARTLNLRSGSKKFKGHHDVSTGVMKSAPDYSSVYVISKGKIVGARPAIRPMINVVPSQKENGVRTYSHRRGSTNGRSERSALLEMPRCSSAGQTMNQRSLFSHTSGYSDSSGSHKFESADGNKQDCDLGSTSDSQFLGDMEAEMRMLRLKLKQTMDMYNSTCKDVILAQTKVM

SEQ ID NO: 164021 - protein, 33 aa, Glycine max
  Coding DNA Sequence Number=SeqID_47243
MSSEEVQFRFYAIFALSVISALNEYDSNLVLNK

SEQ ID NO: 164022 - protein, 64 aa, Glycine max
  Coding DNA Sequence Number=SeqID_47244
MGLGHIPFLLPAPYYTKFSSRFRINGEDALVTSWGIRANKPSAAKWLDQLPKQNWVQCFDKGKC

SEQ ID NO: 164023 - protein, 139 aa, Glycine max
  Coding DNA Sequence Number=SeqID_47245
  Gene Ontology: Mol. function=nucleoside-triphosphatase activity; Cellular component=membrane; Biological process=polysaccharide transport
  Homolog annotation: Hit_ID=Q54480; Match level="QueryCoverage=99%, HitCoverage=56%, E-value=2e-65, Identity=89%"; Hit description=ATP -binding protein
  Pfam annotation: Domain name=ABC_tran; Domain location=56-137; Score=- 44.2; E_value=0.0014; Accession=PF00005.17; Description=ABC transporter
MTVAIEFKNVTKRYPLYHHIGSGIKELIFNPKRALSMLSGRSYLAIKDICFQVNKGESVALIGRNGAGKSTSLSLVAGVIKPTSGSVKVSGRVASMLELGGGFHPELTGRENIRLNATLLGLRRKELNKRIDKIIEFSD

SEQ ID NO: 164024 - protein, 104 aa, Glycine max
  Coding DNA Sequence Number=SeqID_47246
MATKGWSFVGASMVEEEENGNSLAFLCTRRGQFSKVGNIYIKTLRIKPRAWFRAIQNAPFTKIPGRNFQDVTHVTQFGIPLRLRLITKGGEFPVHDRVTSTLTA

SEQ ID NO: 164025 - protein, 521 aa, Glycine max
  Coding DNA Sequence Number=SeqID_47247
  Gene Ontology: Mol. function=oxidoreductase activity; Cellular component=membrane; Biological process=electron transport
  Homolog annotation: Hit_ID=Q38Q84; Match level="QueryCoverage=95%, HitCoverage=96%, E-value=1e-123, Identity=48%"; Hit description =Cytochrome P450 monooxygenase CYP82E3
  Pfam annotation: Domain name=p450; Domain location=38-510; Score =346.5; E_value=4.5e-101; Accession=PF00067.12; Description =Cytochrome P450
MDFLPQPTLVVIVITIVLLYNIWRKKSSTIHKIKGLQPPEPSFALPLIGHLHLLGAKTPLARIFASLADKYGPIFQIHLGAYPALVICNQEAIKECFTTNDKVLASRPKSSHGVHLSYNFAGFGFAPYGSYWIKLRKLTMLELLSARRLEFLRPVYESEIDTLIRDLWMYLGGKSDVKVTISEWLERLTFNMITKMIAGKRYFSYLQDVDDVEAHGIVKLIKEFMHISGEFVLSDLIPLLGWLGVHGTVLKNMKRIAKDLDTLVGGWVEEHMKSDTLTNKSWEKHDFIDVMLSVIEDDSVSGHTRDTIIKANVMNLMLAGSDTTSTTMTWTLAMLMKNPHALKRAQEEIDHQVGRERRRVEARDIKDLIYLQAIVKETLRLYPPGPVLVPHEAREDCNIQGYHVPKGTRVFANVWKLHRDPSLWSEPEKFSPERFISENGELDEVHHFEYLPFGSGRRACPGSTFATQVCLLTLSRLLQGFDLHVPMDEPVDLEEGLGITLPKMNPLQIVLSPRLPSEFYQ

SEQ ID NO: 164026 - protein, 56 aa, Glycine max
  Coding DNA Sequence Number=SeqID_47248
MDRDTLGYSVQKGSRNLKELASGDYPVYAITPECHPHGFVRLSRPGMIGGSDWTLL

SEQ ID NO: 164027 - protein, 111 aa, Glycine max
  Coding DNA Sequence Number=SeqID_47249
  Gene Ontology: Mol. function=protein serine/threonine kinase activity; Cellular component=membrane; Biological process=protein amino acid phosphorylation
  Homolog annotation: Hit_ID=Q9SZM7; Match level="QueryCoverage=58%, HitCoverage=11%, E-value=2e-22, Identity=73%"; Hit description =Protein kinase like protein
  Pfam annotation: Domain name=Pkinase_Tyr; Domain location=1-107; Score=-170.1; E_value=0.049; Accession=PF07714.7; Description =Protein tyrosine kinase
MTLSEFMSGGSLYEFLHKQRGVFKLPSLLKVAIDVSKGMNYLHQNDIIHKDLKTANLLMDENEVFHVTKEARAKGFFDILFLDAVEHKYVEEVSSCNAFMVKVVNILLLWE

SEQ ID NO: 164028 - protein, 60 aa, Glycine max
  Coding DNA Sequence Number=SeqID_47250
MDKAPANAPTDVEQPRHAVEACQAIAKRFERLLNLRIVTEGIEAYTAIEDYLRITRGVTA

SEQ ID NO: 164029 - protein, 137 aa, Glycine max
  Coding DNA Sequence Number=SeqID_47251
  Gene Ontology: Mol. function=microtubule motor activity; Cellular component=microtubule associated complex; Biological process =microtubule-based movement
  Homolog annotation: Hit_ID=Q9LY67; Match level="QueryCoverage=55%, HitCoverage=17%, E-value=3e-21, Identity=68%"; Hit description =Kinesin heavy chain-like protein
  Pfam annotation: Domain name=Kinesin; Domain location=8-137; Score= -193.8; E_value=0.034; Accession=PF00225.13; Description=Kinesin motor domain
MVREHLVFQQKSLTKGKRIWCRRRLREENLVQTQVPRILECEEQNKGLLPRVVEGLFDSINSLDIEKTYSVKLSMVEIYMEKVRDLFDLSKDNIQIKEIKSRGIILPGVTEFLIEIHITAMHGVSNLISRKHTSLPK

SEQ ID NO: 164030 - protein, 59 aa, Glycine max
  Coding DNA Sequence Number=SeqID_47252
MEDVKPMKTPIHASDPLSNGKLGKPGGGSAKSKKAVVINNEKYTLGLSFAKETTSEERE

SEQ ID NO: 164031 - protein, 56 aa, Glycine max
  Coding DNA Sequence Number=SeqID_47253
MASKRSPTKARRSRSSVSTSIRREVELALYGGGDGNIEMMKKKSNKVGIRHRCIGP

SEQ ID NO: 164032 - protein, 46 aa, Glycine max
  Coding DNA Sequence Number=SeqID_47254
MPSWGVVVKGDAVVEGFRIERREKEGVGFKKGDAGIKSLHINHPKY

SEQ ID NO: 164033 - protein, 64 aa, Glycine max
  Coding DNA Sequence Number=SeqID_47255
  Subcellular localization annotation: CTP_CleavageSite=58; ConfidenceScore=5.54e-01
MTKDAIHDQTSAAPRLHFPLSSSSSSASRANSPRQICDLVLKKDTSLGKLQLASASVLLMAEGS

SEQ ID NO: 164034 - protein, 64 aa, Glycine max
  Coding DNA Sequence Number=SeqID_47256
MVEVTHSVISIDDEVKDSAFNDEAASVRVQVHTQYEITRFYVPYNRRLKTFNTHLSSHVITPST

SEQ ID NO: 164035 - protein, 96 aa, Glycine max
  Coding DNA Sequence Number=SeqID_47257
MKLKNSPKGANWGIINQKKETLGKEKRAHFGWAKGCSGACQFPAPTLKTLLEDAKNFFQSQTLPRSSTGERLNEVLNKLRKTVTVCRWSIIKIHKL

SEQ ID NO: 164036 - protein, 81 aa, Glycine max
  Coding DNA Sequence Number=SeqID_47258
MGGDYNSWHNHTVNRDLSGCLSLTPQHLTTAIVSLQENFWGGKVLTLTKKHLAELGQSWVVPKSCIARFDFGSGSGIENSE

SEQ ID NO: 164037 - protein, 123 aa, Glycine max
  Coding DNA Sequence Number=SeqID_47259
  Homolog annotation: Hit_ID=Q84XV9; Match level="QueryCoverage=55%, HitCoverage=5%, E-value=5e-13, Identity=60%"; Hit description =Phosphoribosylformylglycinamidine synthase
MIQPSDYDPLVKDQIKPVLFQRRFVIYLSWKKGGPRSSFTTAWSTNVMEIFQACGLTSHGEGLEEIINLEMGFAFDDHDLEYYTKLVREAIKFNPTNVELLDIVQSNIETPNFPCALAPYPGT

SEQ ID NO: 164038 - protein, 80 aa, Glycine max
  Coding DNA Sequence Number=SeqID_47260
MVFASTVVLGGGGTFLGEVEAEKGVNLEVHCVACNKGFYGEVCLLWRRATTLLGRDAERSDDAAGAQCVEGSNAVRARDV

SEQ ID NO: 164039 - protein, 60 aa, Glycine max
  Coding DNA Sequence Number=SeqID_47261
MAEHVWLAWMKLAVPPLHHAFVCNVRFLQRKLSVEKLASTVLWKLSTPCSYTETESWYSF

SEQ ID NO: 164040 - protein, 351 aa, Glycine max
  Coding DNA Sequence Number=SeqID_47262
  Gene Ontology: Mol. function=protein dimerization activity; Biological process=transposition, DNA-mediated
  Homolog annotation: Hit_ID=Q1SR56; Match level="QueryCoverage=39%, HitCoverage=78%, E-value=4e-22, Identity=37%"; Hit description=HAT dimerisation
MAEEKNQSIIPFKPSNLSNSFLILGVKYSNETLREIIATTMMVHEYPFSIVEDEALLKTVNKISLTTDMWKSCHQVVEYMVVTGHFIDAWGIKENVFYVSVDNASYIDSYLKNLKENLSLSTKLVLNGDLFHVRCCAHILNLLVQDGLGKIKDIIQNVRESVKYINHNDARLKAFSDVVEQKHLKERKLILDSPTRCKFRIIGVCFPLLYKTEEISKENVEKVRSALQQLYDEYAALSNEESSSNEMSVGGINSSTIHVPNTSVMTGFYQLMSLVHEKEAVPPMKSELDVYLKEKNTYIPNNGNSSFSALECVGGRVIDEYRSRLNEETIEALICGGDWIHHNYNLKSKTK

SEQ ID NO: 164041 - protein, 41 aa, Glycine max
  Coding DNA Sequence Number=SeqID_47263
MKLGIYECEPEKPGEGVQMSGYLWRVRWVMIRIDLTISQWQ

SEQ ID NO: 164042 - protein, 121 aa, Glycine max
  Coding DNA Sequence Number=SeqID_47264
MAHSIILLFLGDEFWEKSLEKRLLTCFGQSLKVVDDEDQVILLLNSLSRAYENFVDTIIFGRNSLSMEEVKTTLQSWELKRRITDSYGGISSSDQRFNGKRKNEGKEEEFPKKVTKVMQHK

SEQ ID NO: 164043 - protein, 267 aa, Glycine max
  Coding DNA Sequence Number=SeqID_47265
  Gene Ontology: Cellular component=nucleus; Biological process =response to DNA damage stimulus
  Homolog annotation: Hit_ID=Q9ZRT1; Match level="QueryCoverage=72%, HitCoverage=30%, E-value=5e-49, Identity=52%"; Hit description =Protein gamma response 1
MTMDAGDSDTAEGRNEIPEEDFGGLETQTPDVFVAACDISRVKEKPSEIDRGWNLSSPSSGFRDVPKCPSSTKLVSASSTKRPASSWRQTRSHQSRAGPDPHDDFLDTPLENIRENFNKDLNKEDQPCLIQKDISVDSSDDETQDMNAKSSPQKKQKQSSVTVANTRSFKYVEPVRKKAERENLKGVECKQCRKFYDAVLPNAAGKDTDSKQNFRCEHLDGVSRHRYRYVPPMTPEGFWNIGFESEMGWDEELVAGDYPLVSRVYIT

SEQ ID NO: 164044 - protein, 85 aa, Glycine max
  Coding DNA Sequence Number=SeqID_47266
MAENLNTLPSPMTTCLKIPHHSRDSRVLFGEERRSFVKLNRVGVLQSQHVMRKTGHAPIPFTEMGKAHVRVARDEVDWGSKHTCQ

SEQ ID NO: 164045 - protein, 87 aa, Glycine max
  Coding DNA Sequence Number=SeqID_47267
  Subcellular localization annotation: CTP_CleavageSite=18; ConfidenceScore=5.31e-01
MAPTFKAFALFLLLALFSAASAQELSPASSPAPSPEAGAADSVPCSAIMIGASLVLSLMAVFKRWNRSEKEKNGEACEIEKCRTLTI

SEQ ID NO: 164046 - protein, 117 aa, Glycine max
  Coding DNA Sequence Number=SeqID_47268
MVAQLIHDRVVMECLEGVWETLEGNERCRFRGTIRLTATSLVHPEQPARTLQQPVEWILPTPTPYRLVESVQVIEVSSSEEDLEEDTEELPPEPAVDAPDYVLCAYHILLCTLCGYL

SEQ ID NO: 164047 - protein, 337 aa, Glycine max
  Coding DNA Sequence Number=SeqID_47269
  Gene Ontology: Mol. function=catalytic activity; Biological process =cellular metabolic process
  Homolog annotation: Hit_ID=Q9SDZ2; Match level="QueryCoverage=78%, HitCoverage=86%, E-value=3e-69, Identity=49%"; Hit description=2' -hydroxy isoflavone/dihydroflavonol reductase homolog
  Pfam annotation: Domain name=Ldl_recept_b; Domain location=36-78; Score=13.6; E_value=0.041; Accession=PF00058.8; Description=Low -density lipoprotein receptor repeat
MATSPSSMTKIEHSHAILFSPCETHEHSRSQEFKDYNIFKVEHRKDVSFLTSLPGSSQRLQILSADLSNPESIGVFHVATPVDFQVKEPEEVVDSALSEEDQVMDESFWSDVDYLRSSKILKWSYAVSKTSTEKNGLDVVTIAPPLVLGPFICPKLPDSISDALNLSIWLSACACACFNSNNTRIEKCQKAILVEIYVERDKDPLAFNDRIMVHVEDVVRVHIFLLEHPDPKGRYICSSYNTPVERVYQFVSAKYPEVQQRTTDALKQNKGIRIPDLSAKKLIDAGFKFKYGPEEMLDDTVQCCKEKVTCEVAVFPFYVRTVIHIPYNKAMLRLKKP

SEQ ID NO: 164048 - protein, 283 aa, Glycine max
  Coding DNA Sequence Number=SeqID_47270
  Gene Ontology: Mol. function=catalytic activity; Cellular component =cytosol; Biological process=cellular metabolic process
  Homolog annotation: Hit_ID=Q9SDZ2; Match level="QueryCoverage=98%, HitCoverage=98%, E-value=1e-116, Identity=68%"; Hit description=2' -hydroxy isoflavone/dihydroflavonol reductase homolog
  Pfam annotation: Domain name=3Beta_HSD; Domain location=9-255; Score=- 62.7; E_value=2.2e-08; Accession=PF01073.9; Description=3-beta hydroxysteroid dehydrogenaseisomerase family
  Pfam annotation: Domain name=Epimerase; Domain location=8-259; Score =66.7; E_value=7.7e-17; Accession=PF01370.11; Description=NAD dependent epimerasedehydratase family
  Pfam annotation: Domain name=KR; Domain location=6-137; Score=-93.2; E_value=0.059; Accession=PF08659.1; Description=KR domain
  Pfam annotation: Domain name=NAD_binding_4; Domain location=10-225; Score=-25.8; E_value=5.7e-07; Accession=PF07993.2; Description=Male sterility protein
  Pfam annotation: Domain name=NmrA; Domain location=8-274; Score= -109.1; E_value=0.068; Accession=PF05368.3; Description=NmrA-like family
  Pfam module annotation: Pfam domain module=3Beta_HSD::Epimerase::KR::N AD_binding_4::NmrA; Domain location=9-255::8-259::6-137::10-225::8-274
MEESKGRVCVTGGAGYIASWIIKRLLQDGYSVNTTVRPDPASQRLQVFNADLNIPESFSAAIEGCIGVFHVATPVDFESKEPEEIVSKRSIDGALGILKACLNSKSAKRVVYTSSSSAVFYNGKEEEVMDENFWSDVDYLRSSKPFGWPYAVSKTLTEMAVLEFGEQNGLDVVTLIPTFVFGPFICPKLPSSVDATLNFAFGDKGPFGLLLQAPMVHVDDVARAYIFLLEHSNLKGSSLKQIEGIKLSDLSSKKLIDAGFVFKCGLEEMVDDAIQCCQEKGYI

SEQ ID NO: 164049 - protein, 135 aa, Glycine max
  Coding DNA Sequence Number=SeqID_47271
MPPPHSRCVTLALTLALSFSLSLIALLTLVLALGHERSFVVRWKDELEHIWHLLDSNDNMHSVTYNQDLVSLTLLAEWTEPEIFMDSLQIISDHNLSWTVFSSSPSSKVALNQKLILNDTPCTTKLLTQSLLDSY

SEQ ID NO: 164050 - protein, 349 aa, Glycine max
  Coding DNA Sequence Number=SeqID_47272
  Gene Ontology: Mol. function=nucleic acid binding; Cellular component= intracellular; Biological process=regulation of transcription
  Homolog annotation: Hit_ID=Q1SHX5; Match level="QueryCoverage=80%, HitCoverage=81%, E-value=1e-105, Identity=64%"; Hit description=Zinc finger, C2H2-type
  Pfam annotation: Domain name=zf-C2H2; Domain location=188-210; Score =24.8; E_value=0.00031; Accession=PF00096.16; Description=Zinc finger, C2H2 type
  Pfam annotation: Domain name=zf-C2H2; Domain location=272-294; Score =24.1; E_value=0.0005; Accession=PF00096.16; Description=Zinc finger, C2H2 type
  Pfam annotation: Domain name=zf-C2H2; Domain location=298-323; Score =4.8; E_value=3.2; Accession=PF00096.16; Description=Zinc finger, C2H2 type
  Pfam module annotation: Pfam domain module=zf-C2H2::zf-C2H2::zf-C2H2; Domain location=188-210::272-294::298-323
  Subcellular localization annotation: CTP_CleavageSite=92; ConfidenceScore=5.45e-01
PQSNLFHEWFNFMLLHPHYSSSQSNYPFANNYSNNNRFGIQLQQGAASSSSSSFYAAPPSSPPLREALPLINKISLKSSEQHQQNEPSSNVVEEKEEDKNKVDNNKHHESGEDGDEETVTVALHIGLPRMDTSSSDLGPSRVVSTTCMEISEKEEVNMISKHPLDNRLNKGQYWIPTPSQILIGPTQFPCPVCSKTFNRYNNLQMHMWGHGSQYRKGPDSLKGTQPTAMLRLPCFCCAPGCKHNIDHPRARPLKDFRTLQTHYKRKHGIKPYMCRKCGKAFAVKGDWRTHEKNCGKIWYCLCGSDFKHKRSLKDHIKAFGFGHGSFGIDCLQEEDEAASDIEHDGESSM

SEQ ID NO: 164051 - protein, 146 aa, Glycine max
  Coding DNA Sequence Number=SeqID_47273
  Pfam annotation: Domain name=CHORD; Domain location=42-137; Score= -25.3; E_value=0.057; Accession=PF04968.3; Description=CHORD
  Subcellular localization annotation: CTP_CleavageSite=48; ConfidenceScore=5.41e-01
MVFAVSFSQSLLLCKPSSSSSSYQVKCCSRSQNKEATSHIQTKKRCLRCNTLYSDEDNSPLACSFHGHTNGDKGLFSFAPPHQGIDGDWSDKSGVIVYKWNEKNDRPNTGRANWKKRWSCCAEYDENAPPCRRGWHVCYDDGFTLY

SEQ ID NO: 164052 - protein, 179 aa, Glycine max
  Coding DNA Sequence Number=SeqID_47274
MKDKRTEEENLEKQKKKKDSKALSSKAKGKEKEEKDSSKTDVKKENHFATKGHIKIALILQGKHPLALPYLLRLSGRATRDSRVSLPREENAQSCHQCLFGENVEKTEMCGLRTLSVKGSGVVFMHGEGSATSRAYVQSSSKPLEIFHSLCKTPFTKSRQGQPFPYVQEFLQLKRPSVP

SEQ ID NO: 164053 - protein, 70 aa, Glycine max
  Coding DNA Sequence Number=SeqID_47275
MFPKSGRWDFDNNNCRSLDKRNSNKEGMELSTQRCAKPNSNREEVALSTQRCAKHDLQGVFKLPLKNPRE

SEQ ID NO: 164054 - protein, 108 aa, Glycine max
  Coding DNA Sequence Number=SeqID_47276
  Subcellular localization annotation: CTP_CleavageSite=57; ConfidenceScore=5.45e-01
MVQKEMIKRRHACLKNRFLASRSPIQPSRSSLTNPAFATCSTLLRSQSNSLDNDKLEAFAFNTDIHTLIPPMRYFVDEISIVLRARQREGEEREADWLFGAKLGLILE

SEQ ID NO: 164055 - protein, 369 aa, Glycine max
  Coding DNA Sequence Number=SeqID_47277
MEDLNTIGADCVVISCCCQCLMLQILVFVLLKLPGKLIRKTREYAKKLRHRKANNDRRMGREMGSYKDVLLRIHEQSFRIQVEMALTDGADHNCGGCMDEVEKVMEEFYQKGEFAFGSFWGRKGPCGAPTIVNDHNDGCKEKESPRGQFQSHLTSRIMSEDEGTSLTNSDFVIFLVHKKIRIMLLRNSHGPRNQFLSCRLVSFGAHIIFVMPDSTKPSGSSDKLHDAFIRLTNQQLSLGESMNFMTHKIDELFHRVSPLLTTSPPIPSSLSHSSPAPALNHRMKLDVPRFDGTDPLGWIFKINQFFEYHSTREHDCLTIASFYMEGCALAWFQWMTGNSQFTSWSFSSRPCKLDSHRGSTRILSGPYSS

SEQ ID NO: 164056 - protein, 517 aa, Glycine max
  Coding DNA Sequence Number=SeqID_47278
  Gene Ontology: Mol. function=RNA-directed DNA polymerase activity; Cellular component=chromatin; Biological process=chromatin assembly or disassembly
MVRRIRREVQAHQPLTLVQATSLARLQKKKLLYHHQASSRNRVPLPPPSGSPRPNPLPLLLPLPPWPPPPTLKRLTPDEIASRCECGLYFNYDEKYHKEEDPHFPNIDTHDLPPDPPNNPNPYPAQISLNSLEGHLALETLHFFATISVHDIMLLGDSHYYHITMLSNTDSLCAKDLPLEIQTLITMFDALFQTPQTLPSKGLIQPSTSPFSSPVLLVKKHNGFWRFCVDYRALNALTMRDRFPIPTIDELLDELGGAKCFSKLDLLQGYHQIRMHSIDISKTTFRSHHGHYEFKVMPFNLCNAPSSFQATMNMIFWPYLRQFIIVFFDDILIYSGSLEDHLWHLETTFQVLLENQFVPKFSKCFFAKPQVEYLGHLVSHKGVEPLASKVATIHQWLIPWTTKALWSFLGLVGFYRRFIKSYATIAAPLVKATTVEPFQWMAVTQEVFDQLKQALSTASVFALSNFQLPFTVKTNASGVGMGVRSYLNGDTPLLSSTNLSVRTFSKHRHMCGNYLPS

SEQ ID NO: 164057 - protein, 137 aa, Glycine max
  Coding DNA Sequence Number=SeqID_47279
MEDWGIFSTKSLGRIQRIPLWLKCFSWCGGSMGNKDDSRRPPVVLGRIYNLQITLSAPLGAQCNFLSVGIGLSAPLGTQHHSLSVEIALSAPFVLSERSKVVIVKIPMVKLWKHVLGSFRQNLNTIQQLTNPGSRFY

SEQ ID NO: 164058 - protein, 215 aa, Glycine max
  Coding DNA Sequence Number=SeqID_47280
  Gene Ontology: Mol. function=RNA-directed DNA polymerase activity; Cellular component=chromatin; Biological process=chromatin assembly or disassembly
MKKLAGLLCPLPVPHRPWEDLSLDFIIKLSLYHGNTIILVVVDRFSKGIHLGLLPPAHTAHYLHAFVHRWPGAWGKLLPWAEWSHNTSWNAAIGTTPYEITFGRKPFNFPEYIAGSSNLNVVDDMLTNREEIFQAIHKKFLKGQATMKVHADSKRCEVHKKSLTSWPNDSMGLSRSLDVLARWLIIYNYRQKQRYIRFFIALCSNHFEDLQRTLK

SEQ ID NO: 164059 - protein, 56 aa, Glycine max
  Coding DNA Sequence Number=SeqID_47281
MLSHDLHCRTTAPVCRTGLNHAVATFTDEPSVFFLFPFVSMGIFVSSLDFVMFVNI

SEQ ID NO: 164060 - protein, 111 aa, Glycine max
  Coding DNA Sequence Number=SeqID_47282
  Gene Ontology: Mol. function=oxidoreductase activity; Cellular component=endoplasmic reticulum; Biological process=electron transport
  Homolog annotation: Hit_ID=Q9C7S7; Match level="QueryCoverage=81%, HitCoverage=20%, E-value=1e-31, Identity=69%"; Hit description =Endoplasmic oxidoreductin-1 precursor
MQHFFVTLMYDRVLRYPDRVRNLYFTFLFVRRAVTKAEYDTCNPNENLTTQSLIKQLIYNLKLQAACPIPFDEANLWKGRSGLELKQKIQQQFRNIRYYFKLVEVDCALSS

SEQ ID NO: 164061 - protein, 203 aa, Glycine max
  Coding DNA Sequence Number=SeqID_47283
  Subcellular localization annotation: CTP_CleavageSite=97; ConfidenceScore=5.30e-01
MAEVLSFKAPSEFCKLPYKSLVLARISKSKQTTPPSAILVTSNFTNFLDIPMLFSTSQKHVSPSRTCSRGCKPEKRWLKRPQSSPGGRRMVSRSRVEIDAETQRRVLDLLCYHDVRHDCSKHSVIVMEVDGNARKGLVSRVFSSFKMQKRCATGFVATYPSAGGRRETHGIVFQERNMHGVATNVYLRKTSEKPKKTWSTNFK

SEQ ID NO: 164062 - protein, 129 aa, Glycine max
  Coding DNA Sequence Number=SeqID_47284
MGAKYLEVVKRGSHPNKRMVPGRNLGMTVAALYLSLIGDKRETQNDHNLSLRALGHNRAWVACRKMTIIFSACHQTRSPVDGEKVWGMTIISLRPPLDLLSLNDKGRRMTIICLCAFITHHVIGPAASR

SEQ ID NO: 164063 - protein, 257 aa, Glycine max
  Coding DNA Sequence Number=SeqID_47285
MKKKLKEAAKSGSVDGVIDPPSPVRRHVKCKMTRTKKTGEMTTEAAKEITDKIISHFQLTIRIISLYFEHPGHQDPLTAAIGRLEYPGRVCATEVGVTISQYFGLAPRTSRSSSLLPPKELQQLTQQIRDQLEESITEKVTHQLMASFNQMQSQFQSQMQSQGLALPPEPLVGPSGPRVSTKESYVDPSRNDPETGDSERCGLYIEANSDCLVALGRVYEGSTVVHNTRLLPGKVKVSVEEVKDSDAPVLYPLMRFP

SEQ ID NO: 164064 - protein, 75 aa, Glycine max
  Coding DNA Sequence Number=SeqID_47286
MSQVRVGKTIENILLYHVLFWIQIHGLSVGFMLETIGKHLGKPSEGKRPEVKGRKLMAMVAWVEDSGYVRREQSG

SEQ ID NO: 164065 - protein, 62 aa, Glycine max
  Coding DNA Sequence Number=SeqID_47287
MDYDVVVTNDQNEASAKKVLATKSTKDYEQFELELSWTRSPESNFRLKRLGLDAQAGFVVLV

SEQ ID NO: 164066 - protein, 40 aa, Glycine max
  Coding DNA Sequence Number=SeqID_47288
MAHSSYISSSRFPNSSNHTRLKMKKVNWWSLNYCIMGYSK

SEQ ID NO: 164067 - protein, 211 aa, Glycine max
  Coding DNA Sequence Number=SeqID_47289
  Gene Ontology: Mol. function=phosphoribosylaminoimidazolecarboxamide formyltransferase activity; Biological process=purine nucleotide biosynthetic process
  Homolog annotation: Hit_ID=Q84XA4; Match level="QueryCoverage=37%, HitCoverage=13%, E-value=8e-32, Identity=83%"; Hit description =Aminoimidazolecarboximide ribonucleotide transformylase/inosine monophosphate cyclohydrolase
MADLIVMKEIEDTVLCLGVDLSTLNLDAICLPLGEDCSIVSDDEVVYQEENLEFESEFGNIIVADNLPVVPREKFEKLKGVLLLQVRCARNLLCYIRVMMVNLYPFYDKVTSAGGIEFEDGIENVDIGGPAMIRAAVKNHKDVLVMVDTEDYLVLLEFLKGNQDDIKFRLKLEISTFFVAFTGHTTSPLLISGCVIFYSLITRASFTQKTK

SEQ ID NO: 164068 - protein, 113 aa, Glycine max
  Coding DNA Sequence Number=SeqID_47290
MIELCLVPNVVIPLKFKVLNFDKYKGTTCPKNHLKMYNRKMGAYSKNEKFLMHFFQESLTGAIVTWYTNLEPSRVHSWKDLMVAFIRQYQYNFDMALDRMQLQNMCKKEYESL

SEQ ID NO: 164069 - protein, 105 aa, Glycine max
  Coding DNA Sequence Number=SeqID_47291
MGFEKAVRLVGFFVKDLDLGLFDPFKDVKGGVLLDEEEIVAEEDAVDEEHSAEERGNDTQAAMMKVKSLMAQEARPYRCGGKTLVVEGLANQSGGRSSWLVEPEP

SEQ ID NO: 164070 - protein, 164 aa, Glycine max
  Coding DNA Sequence Number=SeqID_47292
  Gene Ontology: Mol. function=RNA-directed DNA polymerase activity; Cellular component=mitochondrion; Biological process=RNA-dependent DNA replication
  Pfam annotation: Domain name=rve; Domain location=64-163; Score=-2.3; E_value=0.0092; Accession=PF00665.16; Description=Integrase core domain
MRELHEGICDHHIGGPSLATKVVHTGYYWPTLRVDTLDFTKRCRQCQEFTDIPCTFADNLQSLSSPWPYAMWGMDILGPLPKALGAVKYLRVIIDYFTKWIETRPLWEITASELEKFTWKHLICRYDLPYAIVTDNDTQFKAQTYKDFLTRLGFKHLITSIEHP

SEQ ID NO: 164071 - protein, 138 aa, Glycine max
  Coding DNA Sequence Number=SeqID_47293
  Homolog annotation: Hit_ID=Q1T192; Match level="QueryCoverage=45%, HitCoverage=10%, E-value=7e-08, Identity=53%"; Hit description =Polynucleotidyl transferase, Ribonuclease H fold
MSMMGVQSVSWMIVLRCPFFLVLASLENRSTLGDIVRAFEDDFCPTSLHVGCTINIEVPPVWGGLVIPSKFYQEVYHEPCLHGAVVWKVLWTRPPSFMARLMASSITKRYRSKCTPSLGRLTTGGVATIFLKAKKACS

SEQ ID NO: 164072 - protein, 251 aa, Glycine max
  Coding DNA Sequence Number=SeqID_47294
MNDPLPALDDEVPNLAPVLCLRNYGQLHLEPLVKQVGPVGGIVPPSTVAPTTGEEGHPTGEVGPIAAIVEVTPERHGLRQSLPLEKFGNYEGEWTLAPRGSTQGVVLRDEGFQMEGLLLAQFGERSALRSNHQRSSKVGSVLAKLLCTWLDYDELFTRCKALLEEKKDSADRVEGIVAEKDELAKVVADLEVRLKELKSKLEASELWATKVRETSKEFEKELTNNNFHQKGKSCLRTGKGVALAPMYPQVR

SEQ ID NO: 164073 - protein, 201 aa, Glycine max
  Coding DNA Sequence Number=SeqID_47295
  Gene Ontology: Mol. function=chitin binding; Cellular component =extracellular region; Biological process=chitin metabolic process
  Homolog annotation: Hit_ID=UPI000044A8F0; Match level="QueryCoverage =81%, HitCoverage=99%, E-value=6e-21, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTGPPNESTSCFLIRTDPRVLEPNAFRRLHVLAIRGLHTLTFRGLHVLAIRGRRTLTLRGLHVLAIRGLHALTFRGLNVLAFRGLHVLVFRGLHALAFRGLDILAIRGLEVLAIGGLHALTFRGLHVLAFRGLHVLAIRGRHALTLRGLHVLAITGLHALTFRGLHVLAFRELHVLVFRGLHALTFRGLTPSPLEDYTSSS

SEQ ID NO: 164074 - protein, 89 aa, Glycine max
  Coding DNA Sequence Number=SeqID_47296
MTCDHSLVLVRCLAPIIRQFVKFQDMPKNQKNIDAQSHPGPLGPSGIFLQKAVASGGSNPARLGELGGNHLPYFAINRGGRQEGRGSAP

SEQ ID NO: 164075 - protein, 82 aa, Glycine max
  Coding DNA Sequence Number=SeqID_47297
MKDGHFKSECLDLEKSKDNKKYFKSKDKKILMSAWEDLDSTSYDKEEEEEANICLMADTTFEEFESGEEDEINGNRMEKDNR

SEQ ID NO: 164076 - protein, 233 aa, Glycine max
  Coding DNA Sequence Number=SeqID_47298
  Gene Ontology: Mol. function=transcription factor activity; Cellular component=nucleus; Biological process=regulation of transcription, DNA-dependent
  Homolog annotation: Hit_ID=Q1T072; Match level="QueryCoverage=97%, HitCoverage=63%, E-value=8e-53, Identity=52%"; Hit description =Pathogenesis-related transcriptional factor and ERF
  Pfam annotation: Domain name=AP2; Domain location=24-89; Score=100.2; E_value=6.1e-27; Accession=PF00847.10; Description=AP2 domain
MEGQSREEYIGSLRRKSSGFSRGVSKYRGVARHHHNGRWEARIGRVFGNKYLYLGTYATQEEAATAYDMAAIEYRGLNAVTNFDLSRYIKWLKPNNNNNKVNSNNLIVSIPNCATNFTPNSNQQQGFNFFNSQESFNNNEEAAMTQPRPAAATSALGLLLQSSKFKEMMEMTSAIDLSTPPSESELPPCTFPDDIQTYFECEDSHRYGEGDDIMFSELNGFVPPMFHCDDFEA

SEQ ID NO: 164077 - protein, 145 aa, Glycine max
  Coding DNA Sequence Number=SeqID_47299
SKSDDMRGYRMVIRTFGHLETASPMTCGDDKSDDMRGYRMVIRTFCHPETVSPMTCGDDKSDDMRGVPYGYPHLLSSRDEESDDMWGVPYGVPYGYPHLLSSRDGEFDDMREYRMVILTFCHLEMASSMTCGGTIWLSAPFVIPR

SEQ ID NO: 164078 - protein, 64 aa, Glycine max
  Coding DNA Sequence Number=SeqID_47300
MVITLHADVRFRWITDRDARKIIKGSSLEIQMVITYLTDVRFRWITYRDARKLSKEAHEKFKWS

SEQ ID NO: 164079 - protein, 189 aa, Glycine max
  Coding DNA Sequence Number=SeqID_47301
  Gene Ontology: Mol. function=RNA-directed DNA polymerase activity; Biological process=RNA-dependent DNA replication
METSLYTNDEAILCRVFPISLEGATLTWYGGLPPRSIDSFDTLIERFSVQYATSRSHCMTLAALASLRQADDESLRKFIGKFGRTVVQIRNLNPEIKLHSMLLALHPSKFVDSLCKKLPGSMDEPHERAKGYIQIEEMSKFWNEVYQVKQKCERCKANTKTDLHKSDKRHKLDKRQPLSKRPGMSVTYH

SEQ ID NO: 164080 - protein, 148 aa, Glycine max
  Coding DNA Sequence Number=SeqID_47302
NNKLGGKRAETDSVPFIIQEQQAEWVNTQRQILHPLSFRNNKLGGKRAETDFVPFIIQEQQAEWVNAQRQILRPLSFRNSKLSGNNKLSGNSKLGGKRVDTNFVPFVIQEQQVERLDCVQQNAETNYGHSASCINQEEQIRQYQDDVL

SEQ ID NO: 164081 - protein, 220 aa, Glycine max
  Coding DNA Sequence Number=SeqID_47303
  Gene Ontology: Mol. function=chitin binding; Cellular component =extracellular region; Biological process=chitin metabolic process
  Homolog annotation: Hit_ID=UPI00006A17C9; Match level="QueryCoverage =58%, HitCoverage=98%, E-value=4e-10, Identity=25%"; Hit description =UPI00006A17C9 related cluster
GLHVLTFRGLHALAFVGLHTLTLRGLHVLTFIWLHALTFRGLEFLALIGLDVLAFRGLHALAFRGLHVPLFRGRHALAFRRRHVLAFGGASSFLLSVPGPPPDIGGRPTVQAQPKEEAIVQLLCIPGQHFNRAAAKRQVQIMRTNMTTITQIWMTLLLSNILASDRNVDLPLQKNQDRTHKTPSEPREVQQGPGVSSFGYGPLSVLQGAHSPQQVHIVLT

SEQ ID NO: 164082 - protein, 130 aa, Glycine max
  Coding DNA Sequence Number=SeqID_47304
MVGLYVICGCGELFCTIARPSPALFALFKSTTKIRIKPNTYQGNPCGVYPDLSSFTGSGIIQIPVACIKRSAPSQAINSWGSGPDGGGCMNNARQSIRGASDLMMEDARTALSNQFMGLRTQWWRMNEQC

SEQ ID NO: 164083 - protein, 145 aa, Glycine max
  Coding DNA Sequence Number=SeqID_47305
  Subcellular localization annotation: CTP_CleavageSite=69; ConfidenceScore=5.45e-01
MIPFTSSELELTIAAYKAPQNFAGTCSSFWAFLVSRSKASAVAILTSLSSSYSFQTLMAMDLNFSSTTRALSNSAFRACTSSLSSEALTSSSLTPLMIAADDPITASPKLSVLSSRRIPCLANSLEYPRVVVTKTPCDERRDAFV

SEQ ID NO: 164084 - protein, 276 aa, Glycine max
  Coding DNA Sequence Number=SeqID_47306
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=63%, HitCoverage=50%, E-value=1e-88, Identity=72%"; Hit description =Photosystem II 44 kDa reaction center protein precursor
  Pfam annotation: Domain name=PSII; Domain location=46-276; Score =24.2; E_value=1.3e-11; Accession=PF00421.9; Description=Photosystem II protein
MGVAGVLGAALLCAIHGATVENTLFEDVTGLWMSALGVVGLALNLRAYDFVSQEIRAAEDPEFETFYTKNILLNEGIRAWMAAQDQPHENLIFPEEVLPRPGGEVIDTLPYFVSGVLHLISSAVLGFGGIYHALLGPETLEESFPFFGAFLLVFKALYFGGWIVSVDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGL

SEQ ID NO: 164085 - protein, 110 aa, Glycine max
  Coding DNA Sequence Number=SeqID_47307
LNKVGYKDKPFIMVEQDRQVFYVQEPCDSRLLLVLRQRPIGINDHNDYSTLDICETPTFFTKMPSIIEENEVDDICANHNDHDEGLNVRYLVQSLNVFGWKMKMITMVFK

SEQ ID NO: 164086 - protein, 202 aa, Glycine max
  Coding DNA Sequence Number=SeqID_47308
MSEAAQGGGATYETKVEMYDSRFDTWRIVGSTPVEFAVRLTVWTPNENVCIGETLYWVTSARVYSVMGFDVGRNRWRELGVPMAEKLEFATLVPRNGALGLVGGTCGGSACIWELNEGDKWCLVDKVPLELGLRLLGEKRIWESVKDIGYGMVICKKVVGEIMGRWEWVWVDGCGYTKGKQVHNCPIRGALVHPSLASSLIF

SEQ ID NO: 164087 - protein, 126 aa, Glycine max
  Coding DNA Sequence Number=SeqID_47309
  Pfam annotation: Domain name=zf-CCHC; Domain location=1-18; Score =21.6; E_value=0.00027; Accession=PF00098.13; Description=Zinc knuckle
MKCFKCLGRGHITSQCPTKKTMIMRGQDFYSSQDEATTSPFSSESEEEKGEESSEEIYPQEEGQPLMVKEECKEVSVSSKSDQGIPMNPKRIKVIPEWPTPLGVEEKSPNFQEPRDLRSNPFQGEE

SEQ ID NO: 164088 - protein, 77 aa, Glycine max
  Coding DNA Sequence Number=SeqID_47310
  Gene Ontology: Mol. function=nucleic acid binding; Cellular component= cytoplasm; Biological process=regulation of transcription, DNA -dependent
  Homolog annotation: Hit_ID=Q1H231; Match level="QueryCoverage=68%, HitCoverage=77%, E-value=6e-19, Identity=79%"; Hit description=Cold -shock DNA-binding domain protein
  Pfam annotation: Domain name=CSD; Domain location=1-59; Score=90.3; E_ value=5.8e-24; Accession=PF00313.12; Description='Cold-shock' DNA -binding domain
MATGNVKWFNDSKGFGFITPDNGGADLFAHFSAIASDGGYRSLSDGQRVTFDVMLSSYLDSRLLAPSLSPAIGNQVM

SEQ ID NO: 164089 - protein, 59 aa, Glycine max
  Coding DNA Sequence Number=SeqID_47311
MTVKKRLSQEVLKVTVELSSSVGLSMHPSLSAASACLARQQNLAEHQYQGRTLSARSVR

SEQ ID NO: 164090 - protein, 196 aa, Glycine max
  Coding DNA Sequence Number=SeqID_47312
  Gene Ontology: Mol. function=DNA binding
  Homolog annotation: Hit_ID=Q1S0F5; Match level="QueryCoverage=95%, HitCoverage=38%, E-value=1e-24, Identity=35%"; Hit description=IMP dehydrogenase/GMP reductase
MIWDLATIEVSVEAIASLTQYYDHPLRCFTFEDFQLVPTVEEFEEILGCPLGGRKPYLFSGFYPSMARISKVVKILAQELNWVKKSRNGVVGVPRRCLEEKAKALANQDEWASFIEILALLIFGVVLFPNVEGLVDLAAIGAFLSLHHGKESPIVTILSNMHDAFDQRCEKSGARIVCCTPALYVWLVSHLFRQER

SEQ ID NO: 164091 - protein, 105 aa, Glycine max
  Coding DNA Sequence Number=SeqID_47313
  Gene Ontology: Mol. function=chitin binding; Cellular component =extracellular region; Biological process=chitin metabolic process
  Homolog annotation: Hit_ID=UPI00006A17C9; Match level="QueryCoverage =75%, HitCoverage=71%, E-value=3e-08, Identity=38%"; Hit description =UPI00006A17C9 related cluster
MTGPLDESISCFLIRVDPWVLVPITFRGLHVLALRGLHVLTFVGLHALTFRGLHVLANRGLHALALRGLHVLTIRGLDALTSRGLHVLALRGLHSLTLGTSYPHR

SEQ ID NO: 164092 - protein, 279 aa, Glycine max
  Coding DNA Sequence Number=SeqID_47314
  Gene Ontology: Mol. function=protein kinase activity; Cellular component=membrane; Biological process=protein amino acid phosphorylation
  Homolog annotation: Hit_ID=Q2QZ78; Match level="QueryCoverage=99%, HitCoverage=59%, E-value=3e-58, Identity=38%"; Hit description=AT hook motif-containing protein, putative
  Pfam annotation: Domain name=DUF889; Domain location=159-279; Score= -18.6; E_value=3.1e-10; Accession=PF05970.5; Description=Eukaryotic protein of unknown function (DUF889)
MAYDKEMLAEQYNTAYQLLTDEQKTIVDTIMSVVNTQSAAVYFLYGYGGTGKTFVWTTLSSSICSNGGIVCIVASSGIASLLFPGGRIAHSKFAIPVPATENSTCNIHQGSELAELLMVTKLIVWDEAPMCHKFAFEALDKSLKDIMQNNLPFGGKIMVFGGDFRQILPIVPKGDGKIGQYNDGFSEITIPDEFLIKNYDDPIHAIVEATYPSLIDNYSDTDYLQKRAVLSSKKEIVDQINDYVLSLIPNHEKEYCSADSIDKSDELLNPAFALLPPEF

SEQ ID NO: 164093 - protein, 103 aa, Glycine max
  Coding DNA Sequence Number=SeqID_47315
  Gene Ontology: Mol. function=aldehyde dehydrogenase (NAD) activity; Cellular component=mitochondrion; Biological process=metabolic process
  Homolog annotation: Hit_ID=Q56YU0; Match level="QueryCoverage=73%, HitCoverage=15%, E-value=3e-25, Identity=69%"; Hit description =Aldehyde dehydrogenase 2C4, cytosolic
MTSLTNGDAGSLNKVPTIKFTKLFINGDFVDSLSGKTFETIDPRTGDVIARISEGDKEDIDIAVKAARHAFDNGPWPRLPGSITAECSNFPWLNDFPKIWGMD

SEQ ID NO: 164094 - protein, 636 aa, Glycine max
  Coding DNA Sequence Number=SeqID_47316
  Gene Ontology: Biological process=regulation of GTPase activity
  Homolog annotation: Hit_ID=Q1SD19; Match level="QueryCoverage=99%, HitCoverage=91%, E-value=0.0, Identity=60%"; Hit description=Arf GTPase activating protein
MAKFSAQEVSALQEGGNQRAKEIYFKEWDPQRHSLPDSRLRDFIKHVYVDRRFSGERTYDKPPRVKGDKDDFHENKRTETYHRSPSYEDTHERRYSDRSSPGGRSPVYDQENRQYGDYKKSPGRPPIINDWRREDRLGDGWKFEDHRISDGNHNVESTSPEQTKDLDSSSPPAVRPVREILGENVVPLRISEPPKTNSGQATNGSALTQRTSSSSSLASSNGTPAEVKLETIKSLIDFDDDPEPPVASAIPQAPQTTVAKHGMPANSNDNNWASFDVAPEAKAPQGPSNINPLESMLTQLSVPVSLPSHVSRAQGDSHVATANSGSCATRLLIFNDSSVSRAGPLTGSALTTTAAGAPIVSSFSTFPASGASVTSFGLTTASTLNNAGQWATLQYQQQQPLLTAAASQPTIQQSTPPVGGALNNQPWTVPSVQGHANTPMPHASHLVPKPANEAKSSVVLHPSTVDIKPSGRSELPEDLFTVKYSPFPAPVPGWQMGPPPSMGISIQYNNAVPMPSYAQPSKSTNPFDVSSEPTPVQAPMFPSMSSLQGALPSVTPSATMHPSNMGNISHAWNPHSSSPSYVSPPQAQTLAPAMGLGAYMGQQMATNMPMPRHQGIGSFATEATAFGFSNPDQQLT

SEQ ID NO: 164095 - protein, 70 aa, Glycine max
  Coding DNA Sequence Number=SeqID_47317
MMPYLGHIHLERTVRIILPCTEPPTKPVTAQCSLALNFICSDLKEQNPCFTLVMVFPFIDFANPEYISSN

SEQ ID NO: 164096 - protein, 678 aa, Glycine max
  Coding DNA Sequence Number=SeqID_47318
  Gene Ontology: Mol. function=carboxylic ester hydrolase activity; Cellular component=extracellular space; Biological process=lipid metabolic process
  Homolog annotation: Hit_ID=Q1SD04; Match level="QueryCoverage=97%, HitCoverage=97%, E-value=0.0, Identity=79%"; Hit description =Esterase/lipase/thioesterase; AB-hydrolase associated lipase region
  Pfam annotation: Domain name=Abhydro_lipase; Domain location=266-329; Score=89.1; E_value=1.4e-23; Accession=PF04083.6; Description=ab -hydrolase associated lipase region
  Pfam annotation: Domain name=Abhydrolase_1; Domain location=343-650; Score=-6.8; E_value=0.027; Accession=PF00561.10; Description =alphabeta hydrolase fold
  Pfam module annotation: Pfam domain module=Abhydro_lipase::Abhydrolase _1; Domain location=266-329::343-650
MHRQSNGNLVWSVKTFTYESLNNVATVINGVSALVLTLLPGKVSILEGIQGWELRPTLRGPRFPRWMDKGVSSFNHFIHELSVDSDVSSLEYSSAEDSDDGYEEYPESPSSQCSRASKPNWILAPIHFLLGIPFRLFQLAYSGSGLSEPPVISGNEHPSQPHFPNRVQSLKDQIIHRTTDRRRGIIEDLHLATEIFIEAVFDVVHKAIHLLLSPSEAFGTLSRLFSSHERRILVDNDVVEEASTSSDTLGENEPTPTDRNTSYRSSLNTDARTCQDVITELGYPYEAIHVITADGYVLLLERIPRRDARKAVYLQHGVFDSSMGWVSNGVVGSPAFAAYDQGYDVFLGNFRGLISREHVNKNISSREYWKYSINEHGIEDIPAMIEKIHQVKTAELRLSKPDIEEESNDGQLYKLCAICHSLGGASMLMYVVTRRIEAKPHRLSRLVLLSPAGFHHDSNLVFSVAEHVLFLLAPIWSRIFPAFYIPTRFFRMLVNKLARDLQNLPAVGGLVQTLVGYVVGGDSSNWVGVLGLPHYNMNDMPGVSFGVALHLAQIKRARRFRMFDYGSAYANVKVYGSPEPVDLGEHYGLIDIPVDLVAGQKDTVIRSSMVKRHYKLMKDAGVDVSYNEFEYAHLDFTFSHREELLSYVMSRLLLVEPNSKNQVNQRALRSRKKGQKMR

SEQ ID NO: 164097 - protein, 213 aa, Glycine max
  Coding DNA Sequence Number=SeqID_47319
  Gene Ontology: Mol. function=hydrolase activity; Biological process =aromatic compound metabolic process
  Homolog annotation: Hit_ID=Q9LK01; Match level="QueryCoverage=97%, HitCoverage=86%, E-value=4e-52, Identity=43%"; Hit description =Hydrolase-like protein
  Pfam annotation: Domain name=Abhydrolase_1; Domain location=19-209; Score=8.3; E_value=0.0018; Accession=PF00561.10; Description =alphabeta hydrolase fold
MAMERIWDKILPLLLPQNYRLITFDWPFAGTVKDQNLYDPVKYSSVEGFADDLITLLNKMDLKAVTFVGHSMSGMIGCIASVKSPQLFKTLILVGASPNDYEGGFNSSDIEQLLSNRETNYENFASGFASLIADPTNEVSVNKYEKEILDKVETPCTIIQTKKDAAVPHNVALYMENKIKGKVTLEIIDTLGHFPQLTAHLKFVEVLKGALAS

SEQ ID NO: 164098 - protein, 714 aa, Glycine max
  Coding DNA Sequence Number=SeqID_47320
  Gene Ontology: Mol. function=metal ion binding; Cellular component =nucleus; Biological process=regulation of flower development
  Homolog annotation: Hit_ID=Q2QPD5; Match level="QueryCoverage=86%, HitCoverage=84%, E-value=0.0, Identity=54%"; Hit description =Fibronectin type III domain containing protein, expressed
  Pfam annotation: Domain name=fn3; Domain location=320-409; Score=6.5; E_value=0.035; Accession=PF00041.11; Description=Fibronectin type III domain
MGEISGVQSLSSSVQSTPEKNGHSDGASKSSELLQQFLKCGPKKELLQMCFDKDKKSISSKGRMSETKSTSKITKKQDTKKVSSFSHQPPRKQPRKGENPTRIIPPLDQSSDFGHSNTWICKNAACRAVLSMDDTFCRRCSCCICHLFDDNKDPSLWLVCTSESAQGDSCGLSCHIKCALQHEKVGVVDHGQLMQLDGGYCCASCGKVTGILGCWKKQLNIAKDARRVDVLCYRIYLSYRLLDGTSKFKDLHQTVQEAKAKLETEVGPVNGVSSKMARGIVSRLHIASDIQKLCSLAIEKADSWLATVPNVNSDSTEGSFPAACKFVFEEVTTSSAKIILIEMSSICSEEIKGYKLWYYKSWDESPTKDPVSVFPKSQRRILISNLKPCTEYTFRIISYTDTRDLGHSEAKCFTKSIEIIKNNPSSSVAMNNEKENLLTRGNSSASKIGPNATMEGYGFKVRDLGKFLRLAWAQEQGYLEEFCCANVKNCCGQSEMVDKLRIPEAQLPSVSRGLDLNVVSVPDLNEELTPPFEYSRDEDNGCSLLQAVEADDDAASHDLEKNGLARSHGSGDSQTWTHGPTGEVSAVDSRIDMCKKRIASTNEETHDCDSTLINGSPLRISDGSCSLDENFEYCVKVIRWLECEGHIKHEFRLKLLTWFSLRATEQERRVVNTFIQTLIDDPGSLAGQLVDSFSDIISNKRLRSGFCSKAGASN

SEQ ID NO: 164099 - protein, 157 aa, Glycine max
  Coding DNA Sequence Number=SeqID_47321
  Gene Ontology: Mol. function=endonuclease activity
  Homolog annotation: Hit_ID=Q1SD02; Match level="QueryCoverage=93%, HitCoverage=49%, E-value=4e-24, Identity=86%"; Hit description =Endonuclease/exonuclease/phosphatase
MIRFLSSRAQYLSEKWGNTPVVLAGDFNSTPQLNIMLYDRKELSGQKRCRPAQVLGENKETVVLSQYDALNLLFPACLSAGQMKRYSDGIVPTRVLDTVSISDLLRAGGLPCKKVGSDHLALVSEFSFSVTNNEPTDIVAAAASPIVDIGEPNNQRS

SEQ ID NO: 164100 - protein, 99 aa, Glycine max
  Coding DNA Sequence Number=SeqID_47322
  Subcellular localization annotation: CTP_CleavageSite=25; ConfidenceScore=5.19e-01
MYVTYRAKDGLGSILASVTGFASVRTQRGHSEHSPSPYMTRGENVSLKSNEQSREKRTKRALGRGEKGLFRFEFPVDAAFWDFCWALQICRKQSNMAHV

SEQ ID NO: 164101 - protein, 122 aa, Glycine max
  Coding DNA Sequence Number=SeqID_47323
  Gene Ontology: Mol. function=aminoacyl-tRNA hydrolase activity; Cellular component=mitochondrion; Biological process=translation
  Homolog annotation: Hit_ID=Q5N9Q7; Match level="QueryCoverage=88%, HitCoverage=43%, E-value=5e-45, Identity=76%"; Hit description =Peptidyl-tRNA hydrolase-like
  Pfam annotation: Domain name=Pept_tRNA_hydro; Domain location=1-122; Score=84.7; E_value=2.9e-22; Accession=PF01195.10; Description =Peptidyl-tRNA hydrolase
FIGDVPVILAKPQTYMNSSGESVGAIVSYYKIPLKQVLVIFDDLDLPFAKLRLLPKGGHGGHNGMKSVINHFKGNSGFPRLRIGIGRPPGKMDPVAFVLRTFTKHEREEVQTDKLALGTWKF

SEQ ID NO: 164102 - protein, 432 aa, Glycine max
  Coding DNA Sequence Number=SeqID_47324
  Gene Ontology: Mol. function=ATP binding; Cellular component =endoplasmic reticulum; Biological process=electron transport
  Homolog annotation: Hit_ID=Q8RXA7; Match level="QueryCoverage=99%, HitCoverage=37%, E-value=1e-177, Identity=67%"; Hit description =Stomatal cytokinesis defective
  Pfam annotation: Domain name=WD40; Domain location=109-159; Score =31.9; E_value=2.2e-06; Accession=PF00400.22; Description=WD domain, G-beta repeat
  Pfam annotation: Domain name=WD40; Domain location=165-201; Score =33.1; E_value=9.7e-07; Accession=PF00400.22; Description=WD domain, G-beta repeat
  Pfam annotation: Domain name=WD40; Domain location=205-242; Score =38.3; E_value=2.6e-08; Accession=PF00400.22; Description=WD domain, G-beta repeat
  Pfam annotation: Domain name=WD40; Domain location=246-300; Score =18.7; E_value=0.021; Accession=PF00400.22; Description=WD domain, G -beta repeat
  Pfam annotation: Domain name=WD40; Domain location=304-370; Score =14.0; E_value=0.54; Accession=PF00400.22; Description=WD domain, G -beta repeat
  Pfam annotation: Domain name=WD40; Domain location=389-427; Score =18.7; E_value=0.02; Accession=PF00400.22; Description=WD domain, G -beta repeat
  Pfam module annotation: Pfam domain module=WD40::WD40::WD40::WD40::WD4 0::WD40; Domain location=109-159::165-201::205-242::246-300::304 -370::389-427
IKIRGFLSHIQQLHNGYWGITSMKAQSVLLLALPSPHSKDTKDENQQPSEATGVGRNWVQSMFSRNKTTRSSSFSHVHRWTSDGGNSATNENGTPRKQDLSSGGQKKLHTNVRILRGHNGAITALHCVTKREVWDLVGDREDAGFFISGSTDCSVKIWDPSLRGSELRATLKGHTRTIRAISSDRGKVVSGSDDQSVLVWDKQTTQLLEELKGHDGPVSCVRMLSGERVLTASHDGTVKMWDVRTDRCVATVGRCSSAVLCMEYDDNVGVLAAAGRDVSIRMVGDTVITGSDDWTARVWSVSRGTCDTVLACHAGPILCVEYSSLDRGIITGGIHCAKNVTIHNAAILSINAGEHWLGIGAADNSLSLFHRPQERLGGFSGTGSKMAGWQLYRTPQKTVAMVRCVASDLERKRICSGGRNGLLRLWDATINI

SEQ ID NO: 164103 - protein, 576 aa, Glycine max
  Coding DNA Sequence Number=SeqID_47325
  Gene Ontology: Mol. function=malate transporter activity; Biological process=response to aluminum ion
  Homolog annotation: Hit_ID=Q5FAM2; Match level="QueryCoverage=85%, HitCoverage=85%, E-value=1e-152, Identity=56%"; Hit description =Putative expressed protein
  Pfam annotation: Domain name=UPF0005; Domain location=55-544; Score =723.3; E_value=1.6e-214; Accession=PF01027.11; Description =Uncharacterised protein family UPF0005
MGPKLAKTGSFRHGLAEKKERLLSAKMRQEEEEEEERRWWWSKWNSVKRVAEKAWEMGRSDPRKIIFSAKMGLALTLISFLIFLKEPPFKDMSRYSVWAILTVVVVFEFTIGATLSKGFNRGLGTLSAGGLALGMAELSELAGEWEELLIIISIFTVGFCATYAKLYPTLKPYEYGFRVFLITYCFITVSGYRTGEFVDTAINRFLLIALGAAVSLGINICIYPIWAGEDLHNLVTKNFMGVATSLEGVVNHYLQCVEYKKVPSKILTYQASDDPVYNGYRSVVESTSKEDSLMGFAVWEPPHGRYKMLRYPWKNYVKLSGALRHCAFMVMAMHGCILSEIQAPAEKRLVFRSELQRVGCEGAKVLRELGNKVKKMEKLDTGDLLYEVHEAAEELQQKIDKKSYLLVNSENWEIGNRPREDQETALQQQGLFNMDEERKFLEYKSLSEAVLDLRTVQVPNTWEGNVSLGDSPAETATDASQNMFRKQISWPAHIYNKSNPVAKEGQESKTYESASSLSLTTFTSLLIEFVARLQNLVDSFEELGEVANFVDPLEQQAPVASRGFWARLCNCFKFKD

SEQ ID NO: 164104 - protein, 518 aa, Glycine max
  Coding DNA Sequence Number=SeqID_47326
  Gene Ontology: Mol. function=oxidoreductase activity; Cellular component=membrane; Biological process=electron transport
  Homolog annotation: Hit_ID=Q8W228; Match level="QueryCoverage=92%, HitCoverage=94%, E-value=1e-168, Identity=59%"; Hit description =Cytochrome P450
  Pfam annotation: Domain name=p450; Domain location=37-504; Score =393.1; E_value=4e-115; Accession=PF00067.12; Description=Cytochrome P450
MYPSTPPLLLLLLLLSTFIIFILSIIFLRRNQSKDGPPGPPALPVIGNLHMLGKLPHRTLEALAHRYGPIMSLRLGQVPHVVVSSSEAAEDFLKAHDAVFASRPRLEASKYFGYGSKGLAFSEYGPYWRYMRKVCTLRLLTASKVDSFAPLRKRELELAVKSLQESAAAKEGEVVVDLSEVVHNVVEEIVYKMVLGSSKHDEFDLKGLIQNAMNLTGAFNLSDYVPWLRAFDLQGLNRSYKRISKALDEVMEKIIKEHEHGSDVQNEQHHRHRDFIDILLSLMHQPIDPYDEQNHIIDKTNIKAILLDMIAGAFETSATVVEWTFSELLRHPRVMKNLQDELDNVVGRDKMVEENDLAKLSYLDIVIKETLRLYPPGPLVPRESTEDAMVQGYFLKKKSRIIINIWAMGRDSKIWSDNAEVFYPERFINKNLDFRGLDLQYIPFGFGRRGCPGIHLGLATVKIVVAQLVHCFSWELPGGMTPGELDMSEKFGLSIPRVKHLIAVPKYRLFREACNESK

SEQ ID NO: 164105 - protein, 119 aa, Glycine max
  Coding DNA Sequence Number=SeqID_47327
  Homolog annotation: Hit_ID=Q8RXA7; Match level="QueryCoverage=98%, HitCoverage=9%, E-value=2e-44, Identity=68%"; Hit description =Stomatal cytokinesis defective
MLKTAINRATSRNDLLTIRDALEVSSDMYKKDSNNVPDYIQRHLISLSIWEELRFWEGYFDYLMEQSSNKSANYASLVTAQLVVLASHMAGLGLPDNDAWYMIETIAERNSIGSKQFVS

SEQ ID NO: 164106 - protein, 220 aa, Glycine max
  Coding DNA Sequence Number=SeqID_47328
  Gene Ontology: Mol. function=malate transporter activity; Biological process=response to aluminum ion
  Homolog annotation: Hit_ID=Q5Z6M4; Match level="QueryCoverage=100%, HitCoverage=56%, E-value=4e-89, Identity=66%"; Hit description =Aluminum-activated malate transporter-like
  Pfam annotation: Domain name=UPF0005; Domain location=1-220; Score =241.3; E_value=2.1e-69; Accession=PF01027.11; Description =Uncharacterised protein family UPF0005
MGTMLAGGLAVGMAELSTLGGKWEELIIIMCTFIVGFCATYTKLYPTLKPYEYGFRMFLITYCFITVSGYQTGEFVDTAINRFVLIALGAAVSLGVNICIYPIWAGEDLHDLVTKNFMGVATSLEGVVNHYLHCVEYKKVPSKILTYQAADDPIYSGYRSAVESTSKEDSLMGFAVWEPPHGHYKMLKYPWKNYVKLSGALRHCAFMVMAMHGCILSEIQ

SEQ ID NO: 164107 - protein, 84 aa, Glycine max
  Coding DNA Sequence Number=SeqID_47329
MVEASGNRLPACVIDYTEEWIVMAAQLLRDRVEMECLEGAWETLEGNTRCRFRGTIRFTATSLVHPDEPARDASVHGGVDSSLD

SEQ ID NO: 164108 - protein, 71 aa, Glycine max
  Coding DNA Sequence Number=SeqID_47330
INEISIDEELGKLDGGHLEEGIAVATTRVIREGTHLSYELERKEIVVETLAVEKSALSQRQGTPMIHLLPA

SEQ ID NO: 164109 - protein, 79 aa, Glycine max
  Coding DNA Sequence Number=SeqID_47331
  Gene Ontology: Mol. function=oxidoreductase activity; Biological process=metabolic process
  Homolog annotation: Hit_ID=Q6V8T1; Match level="QueryCoverage=60%, HitCoverage=75%, E-value=3e-15, Identity=75%"; Hit description =Aldehyde dehydrogenase
MELNCDLGRTFETIDPRKEEVIARVSEGDKEDIDIAVKAARQAFDSGPWPRLPGSVQVCPNICGTLSLVSLMFMGVGDS

SEQ ID NO: 164110 - protein, 247 aa, Glycine max
  Coding DNA Sequence Number=SeqID_47332
  Homolog annotation: Hit_ID=Q9LUI1; Match level="QueryCoverage=21%, HitCoverage=11%, E-value=7e-10, Identity=56%"; Hit description =Extensin protein-like
MVNLMEVALEYVKVENVVEGDGGEGVVGDGGEGTGEGVTGGVGEGNDGGEGNGEGGEGVTGVVGEGVTGVVGEGNGEGVVGEGVEGEGGEGVTGGVGEGNGEGGEGVTGVVGEGNGEGVEGEGGEGVTGVVGEGNGEGVVGEGNGEGVEGEGGEGVTGVVGEGVTGVVGEGVEGDGGEGVTGVAGEGVGEGTNGLHLKELQSTGLEKNDLHCGGGLCAGLAGKQLSLSSNAGNTRHAGGSLVKKLKE

SEQ ID NO: 164111 - protein, 313 aa, Glycine max
  Coding DNA Sequence Number=SeqID_47333
  Gene Ontology: Mol. function=protein binding; Cellular component =cellulose and pectin-containing cell wall; Biological process =protein amino acid phosphorylation
  Homolog annotation: Hit_ID=Q9SN46; Match level="QueryCoverage=80%, HitCoverage=32%, E-value=1e-117, Identity=84%"; Hit description =Extensin-like protein
  Pfam annotation: Domain name=LRRNT_2; Domain location=85-124; Score =19.6; E_value=0.0078; Accession=PF08263.3; Description=Leucine rich repeat N-terminal domain
  Pfam annotation: Domain name=LRR_1; Domain location=158-180; Score =5.1; E_value=32; Accession=PF00560.23; Description=Leucine Rich Repeat
  Pfam annotation: Domain name=LRR_1; Domain location=182-204; Score =7.8; E_value=9.8; Accession=PF00560.23; Description=Leucine Rich Repeat
  Pfam annotation: Domain name=LRR_1; Domain location=206-225; Score =10.5; E_value=3; Accession=PF00560.23; Description=Leucine Rich Repeat
  Pfam annotation: Domain name=LRR_1; Domain location=229-251; Score =3.9; E_value=53; Accession=PF00560.23; Description=Leucine Rich Repeat
  Pfam annotation: Domain name=LRR_1; Domain location=252-274; Score =5.2; E_value=31; Accession=PF00560.23; Description=Leucine Rich Repeat
  Pfam annotation: Domain name=LRR_1; Domain location=276-298; Score =5.9; E_value=23; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1; Domain location=85-124::158-180::182-204::206- 225::229-251::252-274::276-298
  Subcellular localization annotation: CTP_CleavageSite=38; ConfidenceScore=5.06e-01
MKKPKSNDVGLDRASIALFFLVQITVQTLFLSKKKMMMVMKKEATYSSILTLLIATLSLALSDEFGDRGENVTVDPSLVFQNDRLRNAYIALQAWKQAILSDPRNQTTDWVGSQVCSYTGVYCAPALDNPNIRTVAGIDLNHGDIAGYLPQELGLLVDLALFHINSNRFCGTVPHKFDRLKLLYELDLSNNRFAGKFPEVVLRLPSLKFLDLRFNEFEGTVPRELFDKDLDAIFINDNRFVFDLPDNLGNSPVSVIVLANNRFHGCIPASLGNMSNLNEIILMNNAFRSCLPSEIGLLKNLTVFDHGAAQCGA

SEQ ID NO: 164112 - protein, 101 aa, Glycine max
  Coding DNA Sequence Number=SeqID_47334
MDDRKRVGCREEKIVCIGMNPRAYVIMAAKAVAVAVPLSAAAAAGTQVELLVPLRVKLNVTYLSGCRDREQIVPTEWSPIAHGDHHQSLQVPNQITVVGRK

SEQ ID NO: 164113 - protein, 209 aa, Glycine max
  Coding DNA Sequence Number=SeqID_47335
  Gene Ontology: Cellular component=membrane; Biological process =transport
  Homolog annotation: Hit_ID=Q1SD20; Match level="QueryCoverage=96%, HitCoverage=89%, E-value=7e-46, Identity=73%"; Hit description=TMS membrane protein/tumour differentially expressed protein
MEVGESNSGNERRIISKDSSWCSQFRNASNPWMARYAYALIFLVANLLAWAARDYGRGALTEMKRLKGCNGGKDCLDAEVKIALWVVTTVIPFLLPSEFIQIYGEVAHFGAGEPAGGNCIRKSDSATKTDWLSIISFVVAILAIVIATFSTGIDSKCFQDDTPPAQDDVPYGYGFFHFVFATGAMYFAMLLIGWNSHHSMRKYGGLLPS

SEQ ID NO: 164114 - protein, 48 aa, Glycine max
  Coding DNA Sequence Number=SeqID_47336
MVDDEDERKSFILPPVVSRLLLSDNVAHEVLCHHALIWTPHYPHHYLQ

SEQ ID NO: 164115 - protein, 72 aa, Glycine max
  Coding DNA Sequence Number=SeqID_47337
  Subcellular localization annotation: CTP_CleavageSite=28; ConfidenceScore=5.14e-01
TLSARGGGSNNSGNNNLAALNLGFNRIRGYAPTNLRVFPALSFLFIWYNMQHGAIPLEYRQIKSMKRLKGEE

SEQ ID NO: 164116 - protein, 219 aa, Glycine max
  Coding DNA Sequence Number=SeqID_47338
  Gene Ontology: Mol. function=metal ion binding; Cellular component =nucleus; Biological process=regulation of transcription
  Homolog annotation: Hit_ID=Q6SRZ9; Match level="QueryCoverage=90%, HitCoverage=93%, E-value=3e-62, Identity=63%"; Hit description=YABBY- like transcription factor PROLONGATA
  Pfam annotation: Domain name=YABBY; Domain location=4-192; Score =261.1; E_value=2.2e-75; Accession=PF04690.4; Description=YABBY protein
MSSCSIDVAPEQLCYIPCNFCNIVLADKRTQSDPEKEATLGVSVPCSSLFDIVTVRCGHCTNLWSVNMAAAFQSLSWQDVQGFWELFFSRKSKALPLSLGSGHCNPEYRIDTGSTSKCNNRIAMRAPTTHVTEERVVNRPPEKRQRVPSAYNQFIKEEIQRIKANNPDISHREAFSTAAKNWAHFPHIHFGLMLESNNQVKMENVSEKHLMSRAALLNK

SEQ ID NO: 164117 - protein, 86 aa, Glycine max
  Coding DNA Sequence Number=SeqID_47339
  Subcellular localization annotation: CTP_CleavageSite=5; ConfidenceScore=5.03e-01
MEAPRVGSNPAIGTGCHTPKAKGITCYYQSTPFLRLPLLPFLGPHQRSSSVSLLKQILLQRLPHSFPFIHFFCGNEYDRIRSSRWY

SEQ ID NO: 164118 - protein, 125 aa, Glycine max
  Coding DNA Sequence Number=SeqID_47340
  Gene Ontology: Mol. function=ubiquitin-protein ligase activity; Cellular component=ubiquitin ligase complex; Biological process =protein ubiquitination
  Homolog annotation: Hit_ID=Q64HA9; Match level="QueryCoverage=48%, HitCoverage=8%, E-value=3e-09, Identity=52%"; Hit description =Spotted leaf protein 11
  Pfam annotation: Domain name=U-box; Domain location=59-124; Score= -12.9; E_value=0.012; Accession=PF04564.6; Description=U-box domain
MPMFEPPCKNDGFEVQILDLDMAVKDGVLGGGVDYGIVGNGIREKLNLAKMIEELDLCEVSSVFICPISLEPMHDLATLCIGQTYERCNILKWFSLDHFTCLTTMQELWDDSLTPNTTLHCLIST

SEQ ID NO: 164119 - protein, 57 aa, Glycine max
  Coding DNA Sequence Number=SeqID_47341
MDGRIILAKVDCTQEGDLCRRTWEAKLKRKVCMDVTNLVLIKLKTILILQASFVRLS

SEQ ID NO: 164120 - protein, 170 aa, Glycine max
  Coding DNA Sequence Number=SeqID_47342
  Gene Ontology: Mol. function=sequence-specific DNA binding; Cellular component=nucleus; Biological process=regulation of transcription, DNA-dependent
  Homolog annotation: Hit_ID=O22300; Match level="QueryCoverage=83%, HitCoverage=33%, E-value=3e-71, Identity=88%"; Hit description =Homeobox protein knotted-1-like LET12
  Pfam annotation: Domain name=ELK; Domain location=72-93; Score=33.7; E_value=6.2e-07; Accession=PF03789.4; Description=ELK domain
  Pfam annotation: Domain name=Homeobox; Domain location=94-151; Score=- 9.9; E_value=0.054; Accession=PF00046.19; Description=Homeobox domain
  Pfam module annotation: Pfam domain module=ELK::Homeobox; Domain location=72-93::94-151
MKACMHTMMRVLCTGVSPGEGTGATMSDDEDDQAESNANLYEGSLDGGETLGFGPLVPTESERSLMERVRHELKHELKQGYKEKIVDIREEILRKRRAGKLPGDTTSLLKAWWQSHSKWPYPTEEDKARLVQETGLQLKQINNWFINQRKRNWHTNNPSSSSNSKSKRKR

SEQ ID NO: 164121 - protein, 77 aa, Glycine max
  Coding DNA Sequence Number=SeqID_47343
  Gene Ontology: Mol. function=protein-tyrosine kinase activity; Cellular component=membrane; Biological process=protein amino acid phosphorylation
  Homolog annotation: Hit_ID=Q1SP36; Match level="QueryCoverage=85%, HitCoverage=4%, E-value=3e-22, Identity=73%"; Hit description =Octicosapeptide/Phox/Bem1p; Protein kinase
MWELLTGEEPYADLHYGAIIGGIVSNTLRPPVPLSCDPEWRGAGHLSHQRSERPTFTEIANELRSIATKVSPGGENY

SEQ ID NO: 164122 - protein, 194 aa, Glycine max
  Coding DNA Sequence Number=SeqID_47344
  Homolog annotation: Hit_ID=Q1SP36; Match level="QueryCoverage=44%, HitCoverage=5%, E-value=6e-12, Identity=50%"; Hit description =Octicosapeptide/Phox/Bem1p; Protein kinase
MAFDQNSTLLGLRPLDVAALVAEEPLFSPATVTPPTPNSIGELFYKSSASAMWCVCPIVHTTVSPAAATTFGFNYDASSFSNRVVAGNALNLGKLLGCNGLDKAFNDANGFGYGVGGVRGNGEVAIVGDHGGGSGGGGGEEGCGYLEEDLDALVKRSPDGSAKLKVFLFSVFETECSSFDAMNGIGNTDWMVVL

SEQ ID NO: 164123 - protein, 64 aa, Glycine max
  Coding DNA Sequence Number=SeqID_47345
MTIYVDCQRVTLTVIVSCCYDYGALRCHRVAKVVMEAMGEVTREDVRCMECGICIERVTTMTDP

SEQ ID NO: 164124 - protein, 63 aa, Glycine max
  Coding DNA Sequence Number=SeqID_47346
  Subcellular localization annotation: CTP_CleavageSite=29; ConfidenceScore=5.08e-01
MGGGNRRSKGGNRKSNNSSGSGIPKSRKRGSDVKTALFVEGGFLSDWHLPSPTQIPGADDNIK

SEQ ID NO: 164125 - protein, 76 aa, Glycine max
  Coding DNA Sequence Number=SeqID_47347
  Subcellular localization annotation: CTP_CleavageSite=43; ConfidenceScore=5.04e-01
MGTWMMHAAAAWIAGPTACMWSMNPGSDTCWSWVLRSLSGWVVANVESGQLWASLTATSAASHTSFWVFGSPDTHP

SEQ ID NO: 164126 - protein, 176 aa, Glycine max
  Coding DNA Sequence Number=SeqID_47348
  Pfam annotation: Domain name=RRM_1; Domain location=34-104; Score =17.5; E_value=0.0035; Accession=PF00076.12; Description=RNA recognition motif. (a.k.a. RRM, R
MTADPRKYYVRDRPGQHHNYHQVNWRDRADITLFYFTRFPEDATEEELWFQFKQMGDVREIFIPKLRNKEGRKYGFERFNGVSDANRMERKLDNIIVGGLKLHANIPKYRRGKARQEQYVAKHVRQMEGENGKGRVATPPNVRRTYAEAVVSHTENRGQRRSTTSILALYGSSQSS

SEQ ID NO: 164127 - protein, 139 aa, Glycine max
  Coding DNA Sequence Number=SeqID_47349
  Homolog annotation: Hit_ID=Q9FL72; Match level="QueryCoverage=57%, HitCoverage=28%, E-value=3e-28, Identity=75%"; Hit description =Arabidopsis thaliana genomic DNA, chromosome 5, P1 clone:MDK4
  Pfam annotation: Domain name=DUF1223; Domain location=6-124; Score= -87.8; E_value=0.00082; Accession=PF06764.2; Description=Protein of unknown function (DUF1223)
  Subcellular localization annotation: CTP_CleavageSite=49; ConfidenceScore=5.38e-01
MAPRLWSCFSSSSSKASTTRGGGGGGAGFVDSLLQPSRPAPDSLQVFLRGALRTKVDNDGANILVALYENGLVTDCPRGENKGRVLSNDYVVRKLEKLCTVKDITAKKTVSGTVNFTLLLTPYSGDGERSLNLWPEQFY

SEQ ID NO: 164128 - protein, 82 aa, Glycine max
  Coding DNA Sequence Number=SeqID_47350
  Subcellular localization annotation: CTP_CleavageSite=72; ConfidenceScore=5.04e-01
MQIATVTGDTSNRWFFATATGEIASGFATSVSDIAMQWFFATATGKIASGFAISVGDIAMQWCCRRRVGQARAAEFQWFSPL

SEQ ID NO: 164129 - protein, 135 aa, Glycine max
  Coding DNA Sequence Number=SeqID_47351
MVIPPSEKLLANTNGDTLGTSEKSLPFAPLRAALQAFPVPTPVASLVAITTGYFASGSGGKPCGRPRWYRQRVWRNGLHAGVSPCKKETPLQPMSVSFVMHVGVSVLDWKWMIKYGANRCQTDNLLNESNTTLLG

SEQ ID NO: 164130 - protein, 217 aa, Glycine max
  Coding DNA Sequence Number=SeqID_47352
  Subcellular localization annotation: CTP_CleavageSite=53; ConfidenceScore=5.65e-01
MATPPSSSPSPLPPPTEVASQSSFTLKQTRKATRLRSLATRLAGANRPMVHIDLATGKADGPHKKKLRTYLAIVACDKVNVTYENWKQVPAAQKDLIWEDIQGAVGPAKHADRLDHEVDDPLYLMTLNIPQLFLKPLQVMWDAIVFQLFNSYFPLYIKHEDLSEISHGGQCLSISIIQLWIFHLSEIGMRAGNFDVYGFLEPQSIQRSGQSQFESKS

SEQ ID NO: 164131 - protein, 182 aa, Glycine max
  Coding DNA Sequence Number=SeqID_47353
  Homolog annotation: Hit_ID=Q8H6Q8; Match level="QueryCoverage=28%, HitCoverage=1%, E-value=6e-08, Identity=52%"; Hit description=CTV.20
  Subcellular localization annotation: CTP_CleavageSite=14; ConfidenceScore=5.14e-01
MSRLLRSFSRISFRSNSSSSTSSRNSNLLSDQDNQTQEVAPKHNLFDEEVRFEDINQNMDEWNILEIPQDQLYVPETMKDKHNFDYIIKTVENNIPLGQDIGEEFHLLSKNSIYEHSRKYKYLHIGCVQVAIKPLIDMGIDAAVLMCLRDIRHNKFEDSLIGTVESSLGQGPVYFNCYPNKT

SEQ ID NO: 164132 - protein, 133 aa, Glycine max
  Coding DNA Sequence Number=SeqID_47354
MDQLISDVIYCLEGSRPQDAQWTRRSPTGPWGFQLWLRASVSPTGCPFPLAWSRHHNIGIVPTRHPVDPEKSNRALGFPALVTGLCQSYRVPVPPSKDRTRKTPSGPGEAQQGPGVSSSGYGPLSDLQGARPP

SEQ ID NO: 164133 - protein, 126 aa, Glycine max
  Coding DNA Sequence Number=SeqID_47355
  Homolog annotation: Hit_ID=Q9AVH2; Match level="QueryCoverage=62%, HitCoverage=40%, E-value=1e-36, Identity=69%"; Hit description =Putative senescence-associated protein
VCKGILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQA

SEQ ID NO: 164134 - protein, 165 aa, Glycine max
  Coding DNA Sequence Number=SeqID_47356
MEFLRECPNVYEILITLGFPDYEMCGLNVFLCYVERHEKCLELPTLTGRSKKQIFSFVWDHVEEVEGQESMSWEAPTEGTYKVNFDASDIKDVGTGLGMVARDQSGQIIATTTYLYEAELNFREVEVAAFRWTIIKANGVYLTDCLNLVHCWNSHRVVESSSMAW

SEQ ID NO: 164135 - protein, 215 aa, Glycine max
  Coding DNA Sequence Number=SeqID_47357
MDAVATGSELNKSGSGGSERSEDSGGAGGGGIFEYSGWVYHLGVNSIGHEYCHLRFLFIRGKYVSMYKRDPHDNPGLKPIRQGIVGPTLMVEELGRRKVNNGDLYVLRFYNRLDETKKGEIACATAGDARGWMEAFDLGQATGMKKPWEGCVYNAEYELSRGVSARDKLNMEAEINLEGHRPRVRRYAHGLRKLIRIGQGTKEVCSYLKTTMLMD

SEQ ID NO: 164136 - protein, 408 aa, Glycine max
  Coding DNA Sequence Number=SeqID_47358
  Gene Ontology: Mol. function=transmembrane receptor activity; Cellular component=integral to membrane; Biological process=transport
  Homolog annotation: Hit_ID=Q9FYQ8; Match level="QueryCoverage=99%, HitCoverage=64%, E-value=0.0, Identity=84%"; Hit description =Endosomal protein-like
  Pfam annotation: Domain name=EMP70; Domain location=2-366; Score =470.8; E_value=1.7e-138; Accession=PF02990.7; Description =Endomembrane protein 70
MYNKYPSPIRCDPSSVAMPIKEGQPLTFTYEVTFEESDIKWPSRWDAYLKMEGAKVHWFSILNSLMVITFLAGIVLVIFLRTVRRDLTRYEELDKEAQAQMNEELSGWKLVVGDVFRAPSNPALLCIMVGDGVQILGMAVVTILFAALGFMSPASRGTLITVRLWRTIGCGDQKGWISVAWKAACFFPGIAFLILTTLNFLLWGSHSTGAIPFSLFVILILLWFCISVPLTLIGGLFGARAPHIEYPVRTNQIPREIPQQRYPSWLLVLGAGTLPFGTLFIELFFIMSSIWMGRVYYVFGFLLVVMILLVVVCAEVSLVLTYMHLCVEDWRWWWKSFFASGSVAIYIFLYSVNYLVFDLKNLSGPVSATLYLGYSLFMVLAIMLATGTVGFLSSFWFVYYLFSSVKLD

SEQ ID NO: 164137 - protein, 191 aa, Glycine max
  Coding DNA Sequence Number=SeqID_47359
  Homolog annotation: Hit_ID=UPI000016344C; Match level="QueryCoverage =91%, HitCoverage=30%, E-value=3e-14, Identity=29%"; Hit description =protein binding
MALMMAERWKELAFARDDQNNETALHVLALNHKINHGQKQHEFFELVNFLWKSILGQQNFSGAIRIISEPSKLLFNAAKVGNFGFLSELISSHPSLIWEVDDKRQSIIHTAVSHRHSSIFNLIHEIGSAKDVILSYIVQENNTILHLAAKLAPPGRLGLVSGAPFQMCLELIWFEVTPVGEKGRKPGKSIY

SEQ ID NO: 164138 - protein, 144 aa, Glycine max
  Coding DNA Sequence Number=SeqID_47360
  Gene Ontology: Mol. function=protein serine/threonine kinase activity
  Homolog annotation: Hit_ID=Q337P5; Match level="QueryCoverage=77%, HitCoverage=16%, E-value=5e-10, Identity=30%"; Hit description =Pleckstriny domain-containing protein, putative, expressed
MNGKGVLAKSVGVIDATADTVFEVILSTEQQKRYEWDTLMCDLELIDSYDGHYDVVYGTYDSKYLSRWHSKQDFVFSRQWFRGQDGTYTILQFPAIHKKKPQRSGYRRAKVNLSTLISPNGGECVDFSLMGTVTVPLISELSGN

SEQ ID NO: 164139 - protein, 94 aa, Glycine max
  Coding DNA Sequence Number=SeqID_47361
MKLDNIFIGDWKLNVHVTKIVQGEVKVQRQVSGYGKKVCPPNEMDLEKVGSMEISGSAFDSNIGPIPPAPGTIEPATCRPTRATNKPKYLEDYA

SEQ ID NO: 164140 - protein, 82 aa, Glycine max
  Coding DNA Sequence Number=SeqID_47362
MARRLYVDDSASSRAHMGMAHVSIRVKGQKKRLCITSNSSSYGESSDEDYGEPRRVDGVVPTSEVFQNAILEMVKKPNLNSE

SEQ ID NO: 164141 - protein, 509 aa, Glycine max
  Coding DNA Sequence Number=SeqID_47363
  Gene Ontology: Mol. function=RNA-directed DNA polymerase activity; Cellular component=chromatin; Biological process=chromatin assembly or disassembly
MERFCDTHMPAHRCLVKLIHEYLGEIVAGRVVLRGSGDLVQESLVSLIPRQCLRQLVQKKAYTGLCSRSQVVAPLAHGRGYRMKFADVSGSLLKLRAQLFAEKGNWTGLLKQNSTYGGAGSIRLQGGGNGSVILDELSIKACKTQEAAKIRRGGGDWPGSRGLYLVGVWCYPLWGNDVPEIVQTLLCKDALGTTVPGGTIDEYIIKEDSHKPSQERPEKIIHGGLESRGGIRQPERHHRELIMALMCAKSGFWYIVLMHANLVKALPEIKLQKPGSPADFVHNTGADHVGFQHEADLTFKLVLLGCGGRYGEEVAVVVGPGRVARNGEEAGLTAIPRVWAIRFSCWVEAGLGQRGTSTFIYGNGANELQPLNSKNDVGATYGKLVKVNREEMTLKKERDVWAFDIASDGTAITNHNAHRRGREMGQMRNVFGTGMPDSALSLMWETLGGSSGERCSRTIGEEGGAEVQEWQLELEVGRSDTGHGVSPLEAWPEQQLEGVSGVEAPVLPD

SEQ ID NO: 164142 - protein, 197 aa, Glycine max
  Coding DNA Sequence Number=SeqID_47364
  Homolog annotation: Hit_ID=Q337P5; Match level="QueryCoverage=41%, HitCoverage=11%, E-value=2e-10, Identity=38%"; Hit description =Pleckstriny domain-containing protein, putative, expressed
LKEYIAANPALHHENGTTIVHSKLSDASISSAEYEDEMQDEFYDAITADSSTSDEESDDDQKLVLQEPRVKLKNISWAITTLALKRTAAPDLTEELDPHVTHITIPSDLHGSLCKGKDDNDTNCWASPSGKGFMIRGKNYLKDSSKVVGGDPLLKLIAVDWFTVDKSADRISLHPKCLVQGWGEDAQFAFDMLIKKT

SEQ ID NO: 164143 - protein, 170 aa, Glycine max
  Coding DNA Sequence Number=SeqID_47365
  Gene Ontology: Mol. function=protein serine/threonine kinase activity
  Homolog annotation: Hit_ID=Q337P5; Match level="QueryCoverage=81%, HitCoverage=19%, E-value=9e-31, Identity=49%"; Hit description =Pleckstriny domain-containing protein, putative, expressed
  Pfam annotation: Domain name=DUF1336; Domain location=1-161; Score =176.1; E_value=8.5e-50; Accession=PF07059.3; Description=Protein of unknown function (DUF1336)
MLDPCLTFNIIDQVILQLASTLILFLVPAKPNYSLVLYYAADRPINKNSLLAKFVDGSDAFRDSRFKLIPSIVEGYWMVKRAVGTKACLLGKAVTCKYFRQDNFLEIDVDIGSSSVARSVIGFVLGYVTSLVVDLAILIEAKEEAELPEYILGTVRLNRLKLESAVPLEV

SEQ ID NO: 164144 - protein, 547 aa, Glycine max
  Coding DNA Sequence Number=SeqID_47366
  Gene Ontology: Mol. function=ATP-dependent helicase activity; Cellular component=intracellular; Biological process=RNA processing
  Homolog annotation: Hit_ID=Q3SA53; Match level="QueryCoverage=91%, HitCoverage=32%, E-value=1e-168, Identity=54%"; Hit description =Dicer-like 4
  Pfam annotation: Domain name=DEAD; Domain location=50-220; Score =64.2; E_value=4.3e-16; Accession=PF00270.19; Description=DEADDEAH box helicase
  Pfam annotation: Domain name=Helicase_C; Domain location=383-464; Score=67.4; E_value=4.7e-17; Accession=PF00271.21; Description =Helicase conserved C-terminal domain
  Pfam annotation: Domain name=ResIII; Domain location=46-216; Score =32.7; E_value=8.4e-08; Accession=PF04851.6; Description=Type III restriction enzyme, res subunit
  Pfam module annotation: Pfam domain module=DEAD::Helicase_C::ResIII; Domain location=50-220::383-464::46-216
MPDGESSAVAGGQVSMEPSLSLSDQLQSLSLSQVKNHDDSVKKDPRKIARRYQLELCKKAMEENIIVYLGTGCGKTHIAVLLMHEMGDLIRKPQKNICVFLAPTVALVHQQAKVIADSTDFKVGTYCGSSKRLKHHQDWEQEMGQYEVLVMTPQILHHNLSHCFITMEMIALLIFDECHHAQVKSNHAYAVIMKVFYKSNSTKVPRIFGMTASPVVGKGASSEANLAKSINSLEHILDAKVYSVEDKELQSFVTTPVINIYHYVSTASGETSLHLKIEEIKRQCIATLGRSIEDHQKRMNTKKLLNRMHDNVIFGLQNLGIWGALQASHILLSGDHSERHELVEADGNSSDDSLCDKYLAQAAELFTSQCMIARSLSYILQKLKLLRQWRSDFLVGVHAGLKSMSRKTMNIIVDKFRSGELNLLVATKVGEEGLDIQTCCLVIRFDLPETVASFIQSRGRARMPQSEYAFLVDSGNKKEIDVIDGFKEDEYRMNMEVTFRTSKETYIIPEERIFRIDSSGASVSSGYSISLLHQYCSKLPHDEYELI

SEQ ID NO: 164145 - protein, 505 aa, Glycine max
  Coding DNA Sequence Number=SeqID_47367
  Gene Ontology: Mol. function=ATP-dependent helicase activity; Cellular component=intracellular; Biological process=RNA processing
  Homolog annotation: Hit_ID=Q3SA53; Match level="QueryCoverage=99%, HitCoverage=29%, E-value=1e-167, Identity=60%"; Hit description =Dicer-like 4
  Pfam annotation: Domain name=Ribonuclease_3; Domain location=297-406; Score=135.9; E_value=1.1e-37; Accession=PF00636.16; Description =RNase3 domain
  Pfam annotation: Domain name=Ribonuclease_3; Domain location=88-219; Score=123.2; E_value=7.6e-34; Accession=PF00636.16; Description =RNase3 domain
  Pfam annotation: Domain name=dsrm; Domain location=434-499; Score =30.5; E_value=5.7e-06; Accession=PF00035.15; Description=Double -stranded RNA binding motif
  Pfam module annotation: Pfam domain module=Ribonuclease _3::Ribonuclease_3::dsrm; Domain location=297-406::88-219::434-499
MTEPQELDEYLIYLPPELCELKVIGFSKDIGSSISLLPSIMHRLGNLLVAIELKHMLSSSFPEAAEISAIRVLEALTTEKCQERFSLERLEVLGDAFLKFAVARHFFLMHDSLHEGDLTKRRSNAVNNSNLFKLAIKRNLQVYICDQTFDPTQFYALGRPCPRVCSNETEESIHFCLNSVMQQGKATETRCSKNHHWLHRKTIADVVEALVGAFLVDSGFKAAIAFLSWIGIQVDFEASQVVDICIASASYSPLSSEVDIPSLEGKLGHHFFHKGLLLQAFVHPSYNKLGGGCYQASRLEFLGDAVLDYLITSYLFSAYPKLKPGQLTDLRSLSVNNKAFACLAVDRSFDNFLLCDSSGLSEAIKKYVDYVRRPVSDNGIKEGPKCPKALGDLVESCVGAILLDSGFNLNKVWKIMTSFLDPIMKFSSSLQLSPVRDLRELCQSHNLELEFLPVPSKLTKRFSVEAKVSGNGVCETASATGQNKKEACRIASQLLFLKFKVKQSC

SEQ ID NO: 164146 - protein, 628 aa, Glycine max
  Coding DNA Sequence Number=SeqID_47368
  Gene Ontology: Mol. function=DNA-dependent ATPase activity; Cellular component=nucleus; Biological process=DNA replication initiation
  Homolog annotation: Hit_ID=Q6KAJ4; Match level="QueryCoverage=99%, HitCoverage=85%, E-value=0.0, Identity=74%"; Hit description =Putative minichromosome maintenance deficient protein 5
  Pfam annotation: Domain name=AAA_3; Domain location=375-506; Score= -8.7; E_value=0.0029; Accession=PF07726.2; Description=ATPase family associated with various
  Pfam annotation: Domain name=AAA_5; Domain location=375-522; Score= -6.8; E_value=0.0059; Accession=PF07728.4; Description=ATPase family associated with various
  Pfam annotation: Domain name=MCM; Domain location=317-628; Score =621.9; E_value=5.4e-184; Accession=PF00493.13; Description=MCM235 family
  Pfam annotation: Domain name=Mg_chelatase; Domain location=341-528; Score=-135.9; E_value=0.0018; Accession=PF01078.11; Description =Magnesium chelatase, subunit ChlI
  Pfam module annotation: Pfam domain module=AAA_3::AAA_5::MCM::Mg _chelatase; Domain location=375-506::375-522::317-628::341-528
MSGWDEGAVYYSDQALAGDDGSGARGEAGTDSNHSLIQKFKEFIRNFETTNNVFPYRESLLHNPKFLLVDMGDLDTFDSDLPDKLRSNPADVLPLFEAAAAQVLVNLKTKVAGDTGDMEDQTPGDVQILLTSKEDPVSMRSLGAQYISKLVKIAGITIAASRTKAKATYVTLICKNCKKGKQVPCRPGLGGAIVPRSCDHVPQPGEEPCPIDPWLVVPDKSRYVDQQTLKMQENPEDVPTGELPRNLLLSVDRHLVQTVVPGSRLTIMGIFSIYQASNSNTSHKGAVAIRQPYIRVVGIEETNETNSRGPAAFTQDEIEEFKKFASEPDAYKNICSMIAPSIFGHEEVKKAVACLLFGGSRKNLPDGVRLRGDINVLLLGDPSTAKSQFLKFVEKTAPIAVYTSGKGSSAAGLTASVIQDSGTREFYLEGGAMVLADGGVVCIDEFDKMRPEDRVAIHEAMEQQTISIAKAGITTVLNSRTSVLAAANPPSGRYDDLKTAQDNIDLQTTILSRFDLIFIVKDVRMYSQDKIIANHIIKVHKSAGGRMGESRTFKEENWLKRYLQYCRTQCHPRLSESATTLLQNHYVKIRQDMRQQANETGEAAAIPITVRQLEAIVRLSEALAKMKL

SEQ ID NO: 164147 - protein, 196 aa, Glycine max
  Coding DNA Sequence Number=SeqID_47369
  Gene Ontology: Mol. function=ATP-dependent helicase activity; Cellular component=intracellular; Biological process=RNA processing
  Homolog annotation: Hit_ID=P84634; Match level="QueryCoverage=90%, HitCoverage=10%, E-value=2e-21, Identity=37%"; Hit description=Dicer- like protein 4
  Pfam annotation: Domain name=dsrm; Domain location=112-185; Score =41.5; E_value=2.8e-09; Accession=PF00035.15; Description=Double -stranded RNA binding motif
MGVDVQAQGWKAKSKTLEEVLESTSKMEPKLIGYDETPIDVTDTNTAKHIVVNADPYNNSNPEICPMQLTDEICSPCVKPFGQRLQSSAKGKLSQIFENRDCGSDSSGTGTARSRLYELCAAYCWKPPSFECCKKEGPDHLKQFTCKVTLEIEEAQNLILEFVGEPLSKKKDAAESAAEGALWYLQHEGFLPSIGN

SEQ ID NO: 164148 - protein, 522 aa, Glycine max
  Coding DNA Sequence Number=SeqID_47370
  Homolog annotation: Hit_ID=UPI000016344C; Match level="QueryCoverage =65%, HitCoverage=56%, E-value=1e-25, Identity=27%"; Hit description =protein binding
MDNIITEGHSISRPPYFDGRNYIEWKERMKIFIQSVDFKLWLLIKNGPKVPTKLVDNEEVEKSEDEYDEEDMKNLELEAKAKNILHCALNPDVFEIFSEGPKTSKQMWDELDRVFNRERTGDYTPTPQGQFSSDPTAPDTSQFNSPDLYFLQDTSESLDKFMELCVPLHKLALEGNWPAAKVILQKDGRLKHAAITTGWTTLLHVAAGANHAPFMEELLEELNDDQYISLQDYQGNTAFCFAVASGNMKIVNLLRERDPYLPTKRGGNDYIPIQIAAMQAKCDMTRYLYHISKEAFNDKDKIMLFFTLIKTRSYGMAFDMALQWQELAYARDHNKATALHLLAKYQNPLDSCCHCPDMDGYLPINPDTKHVMFQLVNFLWKTILHHKGHSQAMGIISEPSQLLYDAAEVGIFGFLSELISTYPNNIIWEVDDKGQSIIHTAVSYRHASIFNLVHEIGFIKDIIISYIVKEHNPSCFRKKTKNNTLLHLAAKLAPPDRLEIVSGAAFQMCLEIIWFEVTPLFH

SEQ ID NO: 164149 - protein, 1269 aa, Glycine max
  Coding DNA Sequence Number=SeqID_47371
  Gene Ontology: Mol. function=transferase activity
  Homolog annotation: Hit_ID=UPI000016344C; Match level="QueryCoverage =94%, HitCoverage=83%, E-value=2e-68, Identity=31%"; Hit description =protein binding
  Pfam annotation: Domain name=Ank; Domain location=109-141; Score =17.3; E_value=0.055; Accession=PF00023.20; Description=Ankyrin repeat
  Pfam annotation: Domain name=Ank; Domain location=261-293; Score=7.8; E_value=2.3; Accession=PF00023.20; Description=Ankyrin repeat
  Pfam annotation: Domain name=Ank; Domain location=40-74; Score=11.8; E_value=0.62; Accession=PF00023.20; Description=Ankyrin repeat
  Pfam annotation: Domain name=Ank; Domain location=5-35; Score=1.1; E _value=22; Accession=PF00023.20; Description=Ankyrin repeat
  Pfam annotation: Domain name=Ank; Domain location=75-107; Score=4.3; E_value=7.4; Accession=PF00023.20; Description=Ankyrin repeat
  Pfam annotation: Domain name=Ank; Domain location=758-793; Score =10.8; E_value=0.86; Accession=PF00023.20; Description=Ankyrin repeat
  Pfam annotation: Domain name=Ank; Domain location=794-824; Score =14.3; E_value=0.27; Accession=PF00023.20; Description=Ankyrin repeat
  Pfam annotation: Domain name=DUF308; Domain location=1186-1211; Score= 9.2; E_value=2.9; Accession=PF03729.4; Description=Short repeat of unknown function (DUF308)
  Pfam annotation: Domain name=DUF308; Domain location=454-479; Score =8.1; E_value=3.8; Accession=PF03729.4; Description=Short repeat of unknown function (DUF308)
  Pfam module annotation: Pfam domain module=Ank::Ank::Ank::Ank::Ank::An k::Ank::DUF308::DUF308; Domain location=109-141::261-293::40-74::5 -35::75-107::758-793::794-824::1186-1211::454-479
HRYLTQCVPLHKAALEGDWKEAKKILDQDPALLNSAITKGWATVLHIAVGANHESFVEELLKLMSREDLELQDIKGNTAFCFAAAVGNVHIAERMRRKNASLPMIRGGEGVTPLHLAVLQGRSEMAWYLFDKTRETLYDDDWFQVFLICVNSRLYELALEMLNQKESLAFARGDNDETALHVLARKPLDCGCRSKNMKDPPVLKLTRRVWDIFLTLDDSKMMTAIREPSQVTFIAAEVGNFEFLSVIMSTYPDLIWELNTMGQSIIHVAALHRHASIFNLIHEIGPSKDLLLTFWDDEGSTLLHSVAEIAPTDRLNVVSGAALQMMLELTWFEEVKKNMQPSYIERPNHEGIVPRELFTEKHKELLKKGESWMKRTASSCMVVSTLIATGVFSAAFSVPGGTKDDSGSPNYLKKHLFTVFAISDALALTLSTASTLIFLSILISRYAEEDFLRSLPFKLIFGLVSLFLSIVSMMGAFSSAFFITYYHAKTWVVPITIAVTPTWATEVPLTIVEVTLVKEDFVNMTPKSPRDMSAHNHRTTIACDSHPHTTHHRHHRRTHGLRDLKEKLRMEKARDGLFEGLRDVTKERMKIFIQSVDFKLWLLIKNGPKVPTKLVDNEEVEKSEDEYDEEDMKNLELEAKAKNILHCALNPDDFEIFSEGPKTSKQMWDELDRVFHRERTGDNSSTPQGQLSSDPTAPDTSQFSSPDLYFLQETRESMNKFLELCVPLHKLALEGNWQAAKVILGKDSRLKHAAIADGWATLLHVAVGANHASFVKELLQEFDNDQYISLQDYRGNTAFCFAVASGNMEIVELLKGRDPHLPTRRGGSDYIPIQFAAMQGNCDMTRYLYDISKEAFEDTDKIMLFFTFIKTGNYHMALKMADEWVELAYARDDNNETALHLLAVNQNPLDSCCHCPEMEGSFRINPDTKHVMFQLVNFLWKKILQHKDHSEAMRIISEPSQLLYDAAEVGNFGFLSELISAYPGKIIWEVDNNGQSIIHTAVSYRHASIFNLVHEIGFIKDILISYIVKENNTLLHLAAKLAPPDRLAIVSGAAFQMCLEIIWFEEVKKIMPPSFINLKNSDGLTAQQLFIKEHEGLRGKGEEWMKRTAEFCMLISTVIATAIFAAAINIPGGIDDDTKKPNYLNKASFQVFAIADAAAFIFSATAILIFLSILISRYAVYDFHKSLPLKLIFGLITLFISIACMMVAFGSSFFITYYYGLKVLPDSVAGPFSTAMRDYSTKLFTTVMFSRENNTLRASLTTEELEDHN

SEQ ID NO: 164150 - protein, 111 aa, Glycine max
  Coding DNA Sequence Number=SeqID_47372
  Gene Ontology: Mol. function=DNA-dependent ATPase activity; Cellular component=nucleus; Biological process=DNA replication initiation
  Homolog annotation: Hit_ID=Q6KAJ4; Match level="QueryCoverage=91%, HitCoverage=13%, E-value=2e-39, Identity=77%"; Hit description =Putative minichromosome maintenance deficient protein 5
MINSCTRSHLATEENVQEAVRLFTVSTMDAAKSGINQQINLTPDMANEIKQAETQIKRRIGIGNHISERRLIDDLSRMGMNESIVRRALIIMHQRDEIEYKRERRVVFRKA

SEQ ID NO: 164151 - protein, 69 aa, Glycine max
  Coding DNA Sequence Number=SeqID_47373
MEQYRTLDRIFFKFIIMKKNLILIPESRRRGRTLSKNRCAEISGVQKTNNQTIKFLPFSNDRRESQDIP

SEQ ID NO: 164152 - protein, 1270 aa, Glycine max
  Coding DNA Sequence Number=SeqID_47374
  Gene Ontology: Mol. function=RNA-directed DNA polymerase activity; Cellular component=chromatin; Biological process=chromatin assembly or disassembly
  Pfam annotation: Domain name=Chromo; Domain location=1171-1219; Score= 29.1; E_value=1.6e-05; Accession=PF00385.14; Description='chromo' (CHRromatin Organisation MOdifier
  Pfam annotation: Domain name=RVP_2; Domain location=291-425; Score= -50.3; E_value=0.0083; Accession=PF08284.2; Description=Retroviral aspartyl protease
  Pfam annotation: Domain name=rve; Domain location=868-1024; Score =52.5; E_value=1.4e-12; Accession=PF00665.16; Description=Integrase core domain
  Pfam module annotation: Pfam domain module=Chromo::RVP_2::RVT _1::Retrotrans_gag::rve; Domain location=1171-1219::291-425::551 -720::103-193::868-1024
MADHTTRKTTTDRLEDAVARLTNSQASLSDKYTELSGKVDSILDHLRSRDTHHIQPTPTTSSSHRSPIKLDIPRFDGRDPLGWIFKIQQLFDYQHTPEEERITVASFYLDGAALSWYQWMHNNGFITSWTGFLQALKSRFAPSFYEDPKGALFKLTQCGSVNEYLTDFERLANRVIGLPPPFLLSCFISRLTPETRREVLALQPISLPQATTLAKLQEDKPKPPFMQRTPEEMAFRREKGLCYNCDEKWSSGHRCKGQIQLFIADSSTPEPELDSTSPPEGEITNSGELDPPIESDYPHVSLHALSGLSSSDTFRLYGVIKQAHLTVLIDSGSTHNFLQPRVAQFLHLPTQPTHPLRVLVGNGSVLDCSQVCPQLSLQGHPFEITFHLLPISGADAVLDIEWLKQFGPITTDYTTFVTKFSHLGRNIELHADVEIGPEPVSAPQIKRLLRTGSTSALFHLAILPSSLTTHSSTSPTHPIPAIATLFPQFQHLFQNPQGVPPSREITHRITLPPTTAPVNVRPYRYPHYRKAEIEKQVSELLSAGLIRTSTSPYSSPVLLVKKKDGTWRLCVDYRALNSVTIRDRFPIPTIDELLDELGHATWFSKLDLRQGFHQIQMNEADIEKTAFRTHHGHYEYLVMPFGLCNAPSTFQAAMNSLLGPFLRHFATVFFDDILVYSDSLASHITHLRTIFQALVQGQFYLKETKCLFAQRKLEYLGHVVSGKGVEPEPSKVQAITQWPPPSSPKDLRAFLGLTGFYRKFVRGYASIAAPLTTLLCKDAFEWSLSSQAAFDHLKVAMTSATVLALPNFFEPFIIEIDASATTMGAVLMQQGHPLAFFSKMFGPRLLLASTYIRELHSIITAVRKWRQYLLGRPFTIMTDHKSLRELMTQVIQTPEQHYYLSKLLGYDYNIQYKTGAKVATLFLDLVCKHHGFPKSIVSDHDPIFISSFWRELFRLSGTRLRMSTAYHPQSDGQTEVMNIVLEQYLRSFVHSQPSSWFRYLALAEWSYNTSLHSSSGLTPFEVIYGRPHPVVPHYIPDMTNNEVVDSLITSRQHIHEKLQRRLRKAKEAMKHYADMKRDDVTFNVGQWVYVQLKPFRQQSVTGVTHSKLSKRFFGPFQIIARVGAVAYRLQLPEDSRIHPVFHSSLLRAYHGPPPPSDKPWPLQVIGLKPVPNPLCILDSKMDSVTSPPTPMVLVQWDGQPPEDTTWEPWADIREAYHLEDKVVIGDESIVSSRSLHEGPAAEPGTSISGTSMDRPTRTITRPKHLRDYVS

SEQ ID NO: 164153 - protein, 61 aa, Glycine max
  Coding DNA Sequence Number=SeqID_47375
MHQAQVHSNNYKKRVKPRRREQPQSRPKSQAMYDGLDARKRVTSNRTKRKDFIRKSLLGIE

SEQ ID NO: 164154 - protein, 489 aa, Glycine max
  Coding DNA Sequence Number=SeqID_47376
  Gene Ontology: Mol. function=protein binding; Cellular component =nucleus
  Homolog annotation: Hit_ID=Q6YS10; Match level="QueryCoverage=98%, HitCoverage=97%, E-value=1e-73, Identity=35%"; Hit description =Transducin / WD-40 repeat protein-like
  Pfam annotation: Domain name=WD40; Domain location=148-188; Score =2.6; E_value=18; Accession=PF00400.22; Description=WD domain, G-beta repeat
  Pfam annotation: Domain name=WD40; Domain location=191-264; Score =3.0; E_value=16; Accession=PF00400.22; Description=WD domain, G-beta repeat
  Pfam annotation: Domain name=WD40; Domain location=310-349; Score =25.6; E_value=0.00018; Accession=PF00400.22; Description=WD domain, G-beta repeat
  Pfam annotation: Domain name=WD40; Domain location=357-395; Score =11.3; E_value=1.8; Accession=PF00400.22; Description=WD domain, G -beta repeat
  Pfam module annotation: Pfam domain module=WD40::WD40::WD40::WD40; Domain location=148-188::191-264::310-349::357-395
MAPRKLTDYERKRLENIRRNDEVMASLKLHSKATQLSNFKRPRVEQTKSHNVKPKIQTPIVIRRSLRTRVIPPHSTTPSKTEPSSSGPLSMSDARHGTHSHSSFIQSLMCMAKKQAQTVRDKVGRFLNDVSVKEEKMETSLRLKSLHLDPENIARVVPGRITDVRFFPSTSVKMIAAGNRFGHIGFWNVGQREVHLYHPHLAQISGILIQPHCFSKGAFEVKGEAKEESKLCFTAAESHISYEFRSSSVNIYTSCYDGTVRLMDAEKEIFDLVVDSDECIFALSQPTNEANCLYFAEGYGGLTIWDNRIGKRSSHWVLHKRRINTVDFNCENPHIVATSCSDGTACTWDLRYTDGDKLTPLRIFTHDRALQSAYFSPSGSSLAITSMDTTIGIYSGVNLEDATLIYHNNQNSTRLSTFRAKWGWDDSYLFIGNTKRGVDVVSAVERRRVMTLESPYLSAFPCRLDTHSYEVGMLVGATNGGQVYTWTSR

SEQ ID NO: 164155 - protein, 872 aa, Glycine max
  Coding DNA Sequence Number=SeqID_47377
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q9M2A0; Match level="QueryCoverage=99%, HitCoverage=92%, E-value=0.0, Identity=78%"; Hit description=ATPase 8, plasma membrane-type
  Pfam annotation: Domain name=E1-E2_ATPase; Domain location=26-247; Score=302.7; E_value=7e-88; Accession=PF00122.10; Description=E1-E2 ATPase
  Pfam annotation: Domain name=Hydrolase; Domain location=251-537; Score=72.2; E_value=1.6e-18; Accession=PF00702.16; Description =haloacid dehalogenase-like hydrolase
  Pfam module annotation: Pfam domain module=E1-E2_ATPase::Hydrolase; Domain location=26-247::251-537
MEVAAIMAIVLANGGGKPPDWQDFVGIVVLLIINSTISFIEENNAGNAAAALMAGLAPKTKVLRDGKWSEEEAALLVPGDLISIKLGDIVPADARLLEGDPLKIDQSALTGESLPVTKNPGSEVFSGSTCKQGEIEAVVIATGVHTFFGKAAHLVDSTNNVGHFQKVLTSIGNFCICSIAIGMLIEIIVMYPIQQRAYRDGIDNLLVLLIGGIPIAMPTVLSVTMAIGSHRLSEQGAITKRMTAIEEMAGMDVLCSDKTGTLTLNKLTVDKSLIEVFPTGMDKDTLVLYAARASRTENQDAIDASIVGMLSDPKEARAGITEVHFLPFNPVDKRTAITYIDGQGNWHRSSKGAPEQIIELCELKGEVLKKAHKVIDEYANRGLRSLGVSRQTVSEKNKESAGESWEFLGLLPLFDPPRHDSAETIRRALDLGVNVKMITGDQLAIGKETGRRLGMGTNMYPSSSLLGNSKDPAIASIPVDELIEKADGFAGVFPEHKYEIVKRLQEMKHICGMTGDGVNDAPALKKADIGIAVADATDAARSASDIVLTEPGLSVIVSAVLTSRAIFQRMKNYTIYAVSITIRIVFGFMLVALIWKFDFSPFMVLIIAILNDGTIMTISKDRVKPSPLPDSWKLKEIFATGVVLGAYMAIITVVFFFLVHDTDFFTRVFGVEPIVDNEEQLNSALYLQVSIISQALIFVTRSRSWSYVERPGILLITAFFAAQLVATVIAVYAHWDFARVNGVGWGWAGAIWVFSIVTYIPLDILKFLIRLGLSGRAWDNMLENKTAFTTKKDYGRGEREAEWAVAQRTLHGLQVGESNKANQHDQSEIAEQAKRRAEAARLRELHTLKGHVESVVKLKGIDIDTIQQHYTL

SEQ ID NO: 164156 - protein, 309 aa, Glycine max
  Coding DNA Sequence Number=SeqID_47378
  Homolog annotation: Hit_ID=Q6YS10; Match level="QueryCoverage=75%, HitCoverage=43%, E-value=2e-27, Identity=33%"; Hit description =Transducin / WD-40 repeat protein-like
  Pfam annotation: Domain name=WD40; Domain location=58-97; Score=27.0; E_value=6.5e-05; Accession=PF00400.22; Description=WD domain, G-beta repeat
MVAAGSNTGNLGFWNVGQSGSHFWHLDSTTLLVQANEANCLYFAEGSGPLTIWDIKIGKLLSHRVLHKSRINTIDFNCQNPHIVATSSSDGNACTWDLRYTDADKLTPLRIFSHDGALQSAYFSSSGCNLATTRYGVCSILKLLLFNTENMMTLPPGKNMFRLHVIHVTDITHADTTIAIYSGVDLEDAGVICPNNRKSTPLSTLRAKWGWDDSYLLIGNVKRGVDVVSAVQRKTVMTLESPYMSVIPCRLNTHSYEVGMLEGATTGGQWCLSVSVLDFNNHVTRVMAGGVSESSRGVKALFHVKHLEI

SEQ ID NO: 164157 - protein, 63 aa, Glycine max
  Coding DNA Sequence Number=SeqID_47379
MRDASVEGLETRRNTSSGCSSLIGTCGNDVLVVLSAFGCSSSDELARSSSSLLSTAGSVEGWK

SEQ ID NO: 164158 - protein, 90 aa, Glycine max
  Coding DNA Sequence Number=SeqID_47380
MEPFMKYESDNAETKKHIWTLQLTQEMLDHPEPLKLPHCTEVLLRACDNHMTVLRRHGPPLQWKVETLNPAIGGKGVIQPWYDFLEGGIL

SEQ ID NO: 164159 - protein, 81 aa, Glycine max
  Coding DNA Sequence Number=SeqID_47381
  Subcellular localization annotation: CTP_CleavageSite=42; ConfidenceScore=5.58e-01
MPNNVNLMCFNFSFSASSARSARRLSLPVLSAPNFLSGYSLTCSKRENGAKRAYEDRKPFLRMKLEKSGIQLREHELERRE

SEQ ID NO: 164160 - protein, 100 aa, Glycine max
  Coding DNA Sequence Number=SeqID_47382
  Subcellular localization annotation: CTP_CleavageSite=43; ConfidenceScore=5.36e-01
MAVATRGGKDGCSFCSLFSFHIFISVLFSLLLVSTLSVLFTTNASTSNDDGNPRKLDVVGLYLRPKKKGCSGCGSLFDGGDGAWRGCKKEEEGASRMTFF

SEQ ID NO: 164161 - protein, 223 aa, Glycine max
  Coding DNA Sequence Number=SeqID_47383
  Gene Ontology: Mol. function=hydrolase activity, hydrolyzing O -glycosyl compounds; Cellular component=extracellular region; Biological process=carbohydrate metabolic process
  Homolog annotation: Hit_ID=Q84N00; Match level="QueryCoverage=99%, HitCoverage=57%, E-value=1e-65, Identity=58%"; Hit description =Putative class 5 chitinase
  Pfam annotation: Domain name=Glyco_hydro_18; Domain location=10-209; Score=51.6; E_value=2.6e-12; Accession=PF00704.18; Description =Glycosyl hydrolases family 18
MNDLGLLFKEWRAAVSAEAAATGREPLLLTAAVYFSVDYFLSETTSLRYPVDSINENLDWVNVMSYDLNGPWSNHTGPPAGLFDPKNNASVSYGLGSWIRGGVIPKKVVMGLPLYGRTWQLLEPNVHGIGAPASGPGPGSNGAMALFQVLEFNNETGANVVCDKETASVYSYSGSYWVGYDDPKTVAVKVGFAQALSLHGYFFWAAGLDTSDWKISTQGTGNF

SEQ ID NO: 164162 - protein, 164 aa, Glycine max
  Coding DNA Sequence Number=SeqID_47384
  Gene Ontology: Mol. function=protein binding; Biological process =defense response
  Homolog annotation: Hit_ID=Q1T032; Match level="QueryCoverage=98%, HitCoverage=37%, E-value=2e-20, Identity=47%"; Hit description =Disease resistance protein
MAEAVFKVVLENLSSLAATELGTLLGFNGEKKKLHNMFTAIKAKFQDAEEKQFSNEAIKDWLGKLTDASYELDDVLEECAYEELCLNRIMKTIIEASLRQPCEDLDKPYNWERLKFVLACGAKGSSILVTTHLSEVATIMRTIMHPPHELTKLSNKDYWELLKD

SEQ ID NO: 164163 - protein, 144 aa, Glycine max
  Coding DNA Sequence Number=SeqID_47385
  Gene Ontology: Mol. function=protein binding; Biological process =defense response
  Homolog annotation: Hit_ID=Q1SWW3; Match level="QueryCoverage=81%, HitCoverage=21%, E-value=7e-17, Identity=61%"; Hit description =Disease resistance protein
MVDLFRQSSYIVVIYIATNIFCNQLCKIMKKIVHFEAFNFAHHLSQYPEKNDLRYSSSHTPSPSSSASNNPFDEMNPLAIQITSMEEPFAPQASTNFNLSQLYGLSSHTSSKTSKYFFLEADLGVYIVVTPDPSPHKVVEAMLR

SEQ ID NO: 164164 - protein, 414 aa, Glycine max
  Coding DNA Sequence Number=SeqID_47386
  Gene Ontology: Mol. function=protein binding; Cellular component =chloroplast envelope; Biological process=carbohydrate metabolic process
  Homolog annotation: Hit_ID=Q67VC5; Match level="QueryCoverage=94%, HitCoverage=75%, E-value=1e-145, Identity=46%"; Hit description =DeliriumA-like
  Pfam annotation: Domain name=LRR_1; Domain location=148-171; Score =8.7; E_value=6.8; Accession=PF00560.23; Description=Leucine Rich Repeat
  Pfam annotation: Domain name=LRR_1; Domain location=177-197; Score =6.6; E_value=17; Accession=PF00560.23; Description=Leucine Rich Repeat
  Pfam annotation: Domain name=LRR_1; Domain location=205-231; Score =0.8; E_value=2e+02; Accession=PF00560.23; Description=Leucine Rich Repeat
  Pfam annotation: Domain name=LRR_1; Domain location=233-259; Score =4.3; E_value=44; Accession=PF00560.23; Description=Leucine Rich Repeat
  Pfam annotation: Domain name=LRR_1; Domain location=261-284; Score =3.0; E_value=77; Accession=PF00560.23; Description=Leucine Rich Repeat
  Pfam annotation: Domain name=LRR_1; Domain location=289-315; Score =3.8; E_value=56; Accession=PF00560.23; Description=Leucine Rich Repeat
  Pfam annotation: Domain name=LRR_1; Domain location=317-343; Score =3.5; E_value=64; Accession=PF00560.23; Description=Leucine Rich Repeat
  Pfam annotation: Domain name=LRR_1; Domain location=346-372; Score =6.1; E_value=21; Accession=PF00560.23; Description=Leucine Rich Repeat
  Pfam annotation: Domain name=LRR_1; Domain location=36-62; Score=8.1; E_value=8.8; Accession=PF00560.23; Description=Leucine Rich Repeat
  Pfam annotation: Domain name=LRR_1; Domain location=376-398; Score =4.7; E_value=38; Accession=PF00560.23; Description=Leucine Rich Repeat
  Pfam annotation: Domain name=LRR_1; Domain location=64-86; Score=2.1; E_value=1.2e+02; Accession=PF00560.23; Description=Leucine Rich Repeat
  Pfam annotation: Domain name=LRR_1; Domain location=92-119; Score =9.0; E_value=5.9; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1; Domain location=148-171::177-197::205-231::233-259::261-284::289-315::317 -343::346-372::...
  Pfam module annotation: Domain location=36-62::376-398::64-86::92-119
MLVRVSYNKEEVSFAANGITAAGLRAFDGVLQSNITLKTLDLSGNLVGDEGAKCLCDILVNNSSIEKLQLNSADLGDVGAKAIAEMLKKNSSLRVLELNNNMIEYSGFSSLAGALLENNSIRNIHLNGNYGGALGANALAKALESNKSIRELHLHGNSIGDEGICSLMTGLSSHKGKLTLLDIGNNSLTAKGSFHVAEYIRKSRNLLWLNLYMNDIGDEGAEKIAVALKENRSISTLDLGGNNIHVDGVNAIAQVLKDNLVITTLELSYNPIGPDGAKALAEVLKFHGNIKTLKLGWCQIGAKGAECIADALKYNTTISILDLRANGLRDEGAQSLARSLKVVNEALTSLDLGFNEIRDDGAFAIAQALKSNDDVAVTSLNIASNFLTKFGQGALADARDHVLEMTEKEINIFL

SEQ ID NO: 164165 - protein, 287 aa, Glycine max
  Coding DNA Sequence Number=SeqID_47387
  Gene Ontology: Mol. function=peptidase activity; Cellular component =integral to membrane; Biological process=aromatic compound metabolic process
  Homolog annotation: Hit_ID=Q84SE0; Match level="QueryCoverage=90%, HitCoverage=69%, E-value=1e-93, Identity=61%"; Hit description =Putative TPA: Cgi67 serine protease
  Pfam annotation: Domain name=Abhydrolase_2; Domain location=54-261; Score=-79.3; E_value=0.069; Accession=PF02230.7; Description =PhospholipaseCarboxylesterase
MGNVTGTVAAKFAFFPPEPPTYDVSREEDGRVVVSGVTADKNVDVHILHTKGGNEIVATFWKHPFARFTVLYSHGNAADLGQMHDLFIELRAHLRVNIMSYDYSGYGASTGKPSEFNTYCDIEAVYNCLKNEYGIKQEELILYGQSVGSGPTLHLASKLQKLRGVVLHSAILSGIRVLYPVKMTFWFDIFKNIDKIRHVNCPVFVIHGTNDDIVDWSHGKRLWELSKEKYDPLWVKGGGHCNLETFPEYIKYLRKFINAMEKLSLTKQTNKQLTQNPRNQNHGLIEG

SEQ ID NO: 164166 - protein, 89 aa, Glycine max
  Coding DNA Sequence Number=SeqID_47388
MRFAVNPIIPPRYLTEDDQIVDCVNPDYEARELCTAMRAFTLDGKSMDEYLCKIKGYVDELADVGVPIRHEEYVDFWTNGLGYLKKGVN

SEQ ID NO: 164167 - protein, 311 aa, Glycine max
  Coding DNA Sequence Number=SeqID_47389
  Gene Ontology: Mol. function=hydrolase activity
  Homolog annotation: Hit_ID=Q5SMM1; Match level="QueryCoverage=87%, HitCoverage=84%, E-value=4e-82, Identity=57%"; Hit description =Diadenosine tetraphosphatase and related serine/threonine protein phosphatases-like
MLKIECHGIDLFMICINSQRPEQISMSVCAKFMPCDFGEENLEVIKSVVNLEFAKAVILGNHDAWFTKQFSGSKEKDKVQLQLECLGKEHVAYQRSDFPQIKVSVVGGRPFSIGGKPMFRKKLLLARYGVKDMDESAKRIQKAALGTPEDHFLILLAHNGPTGLGSDSNDICGKDWEFEGDGDHGDPDLAQAISLLKENNQISIPLVVFGHMHKELAYGNGFRKMIVVGADNTIYLNGAIVPRVKRLGGDEDKKSLDDESALASPEAKGTRRAFTLVEISEGRVAKIAESWVSVVEDRTTLEEEHILFESS

SEQ ID NO: 164168 - protein, 689 aa, Glycine max
  Coding DNA Sequence Number=SeqID_47390
  Gene Ontology: Mol. function=glycerophosphodiester phosphodiesterase activity; Cellular component=anchored to membrane; Biological process=glycerol metabolic process
  Homolog annotation: Hit_ID=Q9FGT9; Match level="QueryCoverage=98%, HitCoverage=90%, E-value=0.0, Identity=54%"; Hit description =Arabidopsis thaliana genomic DNA, chromosome 5, TAC clone:K21L19
  Pfam annotation: Domain name=GDPD; Domain location=357-643; Score =71.3; E_value=3.1e-18; Accession=PF03009.8; Description =Glycerophosphoryl diester phosphodiesterase family
  Subcellular localization annotation: CTP_CleavageSite=77; ConfidenceScore=5.04e-01
MFRSLFLISLLLHTIVAQKPALPNLPTPQVPPQKWSTLSGNEPLVIARGGFSGLFPEGSPDAIGLSQGISVFLCNLQVAKDGGAFCVTGTTLDNTTTISLVDPKEKTYNVDGKDVRGHFSLDYPGLLIDQNVSMTQAIFSRPNFYDGTSPVLNLDALLSGKSPPRLWLNVQNAALYTENGVQVVDIVLELLSFYQIEFVSSTSIGFLKSISGKSNKATKVVFKLLNNNKVEPSTKKPYGSIVKDLATIKSFASGIMVPKEYIWPVKPDKYLGPPTTLVADAHKSGLEVYASGFANDFFSSYSYNYDPIAEYLQFLDRGDSVDGVVTDFPATASNAIACFAHNNTLPKKGPTLIISNNGASGVYPGSTDLAYQQAIDDGADIIDCSVQMTKDGIAFCSNSTDLTSDTTAMPKFMSRSSNVPELQPKSGIFSFDLTWSEIQTLKPQMVSKGSDFLRNPANKTSGKFVTLSAFLELAKAKAVPGILVNIQNAPYLASQKGLDIVDAVSTALSNATFDKQAKQQVLIQSDDSSVLSRFKDIPSYKRVMLLKDKMGDVPRQTVEEIKKHADAVNLPKTSIIKVSNSILVGMTNVVKELKDANLTVFVHNLKNEYTTLAFDYWSDPNVEIATYVQTAKVDGIVTDFPATASRFMRSPCSDPTHDPTILPAKPGDLLNTIPTELLPPAQAPLPPLE

SEQ ID NO: 164169 - protein, 390 aa, Glycine max
  Coding DNA Sequence Number=SeqID_47391
  Homolog annotation: Hit_ID=Q38JC8; Match level="QueryCoverage=47%, HitCoverage=100%, E-value=8e-90, Identity=79%"; Hit description =Temperature-induced lipocalin
  Pfam annotation: Domain name=Lipocalin; Domain location=224-367; Score=-5.1; E_value=0.088; Accession=PF00061.13; Description =Lipocalin  cytosolic fatty-acid binding
  Pfam annotation: Domain name=Lipocalin_2; Domain location=218-365; Score=271.3; E_value=2e-78; Accession=PF08212.2; Description =Lipocalin-like domain
  Pfam module annotation: Pfam domain module=Lipocalin::Lipocalin_2; Domain location=224-367::218-365
VLNMRLENGNKFSSRGLKSGDEGGSRALQSPQESGVNLGAGGEGFEVLNLIGAVKLALKNGAGEVVVLELLLLLEVPVGLDGGRDLLGVDEEPYVHALHAGLQGLPGRALHRLVDESGGSSSPAATALSPPLPLSCCGEWRHGWSWAWAWAWAFEEVIAEAVASMVGIEKKERARWEGTEDCSKTLQTPSAFCPYVVIKKRNAFTTMVTKAMEVVKDLDVKRYMGRWYEIACFPSRFQPSDGTNTRATYTLRDDGTINVLNETWSGGKRGFIEGTAYKADPNSDEAKLKVKFWVPPFLPIIPVTGDYWLLYIDQDYHYAVIGQPSRNYLWILSRKNHMDEETYNQLVERAKDEGYDVSKLHKTPHSDSPPEEEGPQDTKGVWWIKSLLGK

SEQ ID NO: 164170 - protein, 90 aa, Glycine max
  Coding DNA Sequence Number=SeqID_47392
MDLPPSNLLAGGAATLSLLILLQPSLAVLFFDDRYHRCARSEPHQFPNLRTLPHWRCLNAVFGRGVWSERRERVRRGREDYHVRETHTGL

SEQ ID NO: 164171 - protein, 247 aa, Glycine max
  Coding DNA Sequence Number=SeqID_47393
  Gene Ontology: Mol. function=protein binding
  Homolog annotation: Hit_ID=Q67VC5; Match level="QueryCoverage=41%, HitCoverage=15%, E-value=2e-18, Identity=48%"; Hit description =DeliriumA-like
  Subcellular localization annotation: CTP_CleavageSite=18; ConfidenceScore=5.50e-01
MAFTSTLSLYSHPQVRLRCQRLQSLAFTAAGVAQFAPLPPLNCRRTCSPRSFVVRASSSVEGSRARAGGSRRVYRQSQANAPLSSAPVKQIANVVAPVAAFFALTFGSSLDRGCHRFTSALRLTERVVVFARVIWKLVEKLLVPTPKQLKYSTGESQSPSQGLKWSFAAGTNLLSQLGEKIERQSRQKLNEFARELRSFPSIDMSGRNFGDEGLFFLAESLAFNQAYAEIIECSFLQLLNGRNLLNS

SEQ ID NO: 164172 - protein, 60 aa, Glycine max
  Coding DNA Sequence Number=SeqID_47394
MAILIANTSTTFHRDERFGNTHAINGFMIPTWLAHEEGIRIMYEQTCRTKRYAICRSKRQ

SEQ ID NO: 164173 - protein, 86 aa, Glycine max
  Coding DNA Sequence Number=SeqID_47395
MGFHPTKLNFVPSDADEAPLDVSICLHAFGIVGCGSFSGVKSCEREGCMSVNVGGLVPPHCSLKSVVSDDACPGACFVQRDATTLS

SEQ ID NO: 164174 - protein, 411 aa, Glycine max
  Coding DNA Sequence Number=SeqID_47396
  Gene Ontology: Mol. function=chitin binding; Cellular component =extracellular region; Biological process=chitin metabolic process
  Homolog annotation: Hit_ID=UPI00006A17C9; Match level="QueryCoverage =89%, HitCoverage=100%, E-value=3e-48, Identity=30%"; Hit description= UPI00006A17C9 related cluster
MEAMKEQMATMMEAMMSMKKIMEANAVAVIATSVVAKRVKTLMLHALTFRGLHVLAFKGLHVLTIRGLHVLAFRRLLALPFRGLHILAFRRLHVLAFRELHVLAFRGLHSLTFKGLHILALRGVHILSFRGLHVLPFRGLHAVAFRGLHVLVFRGLLVLAFRGLHALAFRGATRPRFRGLHIIAFRGLHVLPFRRLHALTFRGLQVLACRGLHALDFRGLHALFFRGLHALTFRGLHVLAFRGLRVLAIRGLHGLAFRGLLALPFRGLHVLDLRVLHVLTFRRLHTLTLRGIHATLIGLNVLAFRGLHVLAFRGLHALAFRGLHDLTIRGLHLLALRGLHAHAFRRLHALTFRRLHALTFRGLHATFRGLHVLAFRGLHVLAFRGLHALAFRGLHVLLFKWLYTLAFKGLH

SEQ ID NO: 164175 - protein, 137 aa, Glycine max
  Coding DNA Sequence Number=SeqID_47397
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=100%, E-value=5e-17, Identity=28%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTSPSEDYTSSPSEGYTPSPSEGYTQSLEDYTSSPSEDYMSSPFEGCMPSPLLDYTSSPSEGYTPSSSEGYTPSPLEDYTSSLLEDFTSSPIEGITHSPSKDYTSPPSEGYTPLPLEDYTSSPLEACTPSPLEGYMA

SEQ ID NO: 164176 - protein, 301 aa, Glycine max
  Coding DNA Sequence Number=SeqID_47398
  Gene Ontology: Mol. function=phosphopantetheinyltransferase activity; Biological process=macromolecule biosynthetic process
  Homolog annotation: Hit_ID=UPI000034ED87; Match level="QueryCoverage =65%, HitCoverage=32%, E-value=3e-55, Identity=52%"; Hit description =magnesium ion binding / phosphopantetheinyltransferase
  Pfam annotation: Domain name=ACPS; Domain location=154-221; Score =52.2; E_value=1.8e-12; Accession=PF01648.10; Description=4' -phosphopantetheinyl transferase superfamily
MISLRDKARLMMNIYCFGRNLVTTAASYLPPVQLPTQREVHFWYILPDEVKSTTLLNRYLEILSPCEKENIFRMRGEQLRKGALLARALVRTTLARYQTNFQIDPKSLKFMKNNYGKPELDWQYADDWSLPHLHFNISHTSSLIACGVTVGSPIGIDVEEKQRRLKNDILAFAQRFFSPHEIEMLTHIADPELRLQEFIKLWTLKESYVKAIGRGFSASPFKTFTIRLRDHHVKGDIHAPPLITSKAPDITVVEASDDVKNPSNNWQFVLLELAEYIASMLVAQHHYHEWLHVCMEMDVFQ

SEQ ID NO: 164177 - protein, 177 aa, Glycine max
  Coding DNA Sequence Number=SeqID_47399
  Gene Ontology: Mol. function=RNA-directed DNA polymerase activity; Biological process=RNA-dependent DNA replication
  Pfam annotation: Domain name=AT_hook; Domain location=66-78; Score =14.9; E_value=0.061; Accession=PF02178.9; Description=AT hook motif
MRMLRWMCGKTRQDKIRNGAIREKVGVAPIVEKMVENRLRWFGHVERRPVDSVMRRVDQMERRQTIRGRGRPKKTIREVIKKDLELNDLDRSTVAENIGYRDLTTKFDMDRVKHASEIAHADKFGSIWKVLVISYRLETVMMAKRVFLLDDGKLKELPQSTMLDGQKDSLLSSGLVI

SEQ ID NO: 164178 - protein, 90 aa, Glycine max
  Coding DNA Sequence Number=SeqID_47400
MASPPQNSDLIFPAADVAGELNPGRNTHFHVDPTSSEVDASKEQAQAKQKKNERQKKDALQTIKSAIIISGIVVAVAGAAFAITKKLREK

SEQ ID NO: 164179 - protein, 91 aa, Glycine max
  Coding DNA Sequence Number=SeqID_47401
MKIKKKGMFYSITFLNFLNSDQELPMDPKKIKVIPKWPTPPSVEQRIPEFQEPMDLRSNPFQGGGNMIPQIQDQFQDSPLSVLRCHEACNA

SEQ ID NO: 164180 - protein, 104 aa, Glycine max
  Coding DNA Sequence Number=SeqID_47402
MALGVMAARPGVLLLQSDVTLLAQTSWEVKIRTRISFERSCYSIVSQPTLWREGNARAHECVFQGRKARGVATNVYLRKTSEKSERVFPSLLRILNCDEEVRPT

SEQ ID NO: 164181 - protein, 347 aa, Glycine max
  Coding DNA Sequence Number=SeqID_47403
  Homolog annotation: Hit_ID=Q9SJN3; Match level="QueryCoverage=83%, HitCoverage=98%, E-value=3e-22, Identity=33%"; Hit description =Expressed protein
  Subcellular localization annotation: CTP_CleavageSite=55; ConfidenceScore=5.33e-01
MDNTQWKFLDIDDSDLSSFVRPFNPNKSSSSSRALIPSLTGVVQAIMVDLETLVSACAGGCSDQKIAYEPHVDDGDHHPDSPPASFWLSGDAEYDWWDRNAVYQRNESTKGNSIVSSTNLNANSNNNSQRFSKNLKSKAAIIGLPKPQKASFADASSRRNHRPPGNARLFPKRSASVGGKLENSVAEPSSPKVSCIGRVRSKRDRNRRLRTRQRSISSTATATTASTSIAAAVVTRQKSTRSQRKKTGFFESVREIFRSGRRGKPVQKPDLPQEDSLSSSKKKKKRSLGKKAWGSTTGSTRSRNDASFEESVSSAAAPPGLGSMNRFASGRRSESWGVGDYEIHMSH

SEQ ID NO: 164182 - protein, 58 aa, Glycine max
  Coding DNA Sequence Number=SeqID_47404
MALGIMAARPGELLLQPKGLDTSPSVDLVPNLVDTICLERCAPLCGGCWDSRMSSGVD

SEQ ID NO: 164183 - protein, 89 aa, Glycine max
  Coding DNA Sequence Number=SeqID_47405
MIACTTPVRLGISALELEDDLFGLKGRTKDESASGNLMVYVRALGNPLLCVRVSGNSMFCIRATEKPLLCVRTLGNPLFWVRVLGNPIL

SEQ ID NO: 164184 - protein, 376 aa, Glycine max
  Coding DNA Sequence Number=SeqID_47406
  Homolog annotation: Hit_ID=Q6ZLE2; Match level="QueryCoverage=82%, HitCoverage=44%, E-value=3e-26, Identity=27%"; Hit description=F-box protein family-like
  Pfam annotation: Domain name=DUF295; Domain location=292-341; Score =11.1; E_value=0.035; Accession=PF03478.8; Description=Protein of unknown function (DUF295)
  Pfam annotation: Domain name=F-box; Domain location=34-81; Score =43.2; E_value=9.1e-10; Accession=PF00646.23; Description=F-box domain
  Pfam module annotation: Pfam domain module=DUF295::F-box; Domain location=292-341::34-81
MSGRRRRKLKLLSDTITDSRRAAVEVENENLELQTWSDLPTELLELILSRLSLDDNVRASVVCKRWHSVATSVCVVNQSPWLMYFPKFGDWYEFYDPVHRKTYSIELPELSGSRVCYTKDGWLLLYRPRTHRVFFFNPFTQEIIKLPRFEMSYQIVAFSCAPTSSDCVLFTVKHVSPTVVAISTCYPGATEWTTVSYQNRLPFVSSIWNKLVFCNGLFYCLSLTGWLGVFDSSERTWSVLSVPPPKCPENFFAKNWWKGKFMTEHEGDIIVIYTCSNENPIIFKLDLTLLEWEEMTTLDGVTLFASFLSSHARTDLHGIMRNSVFFSKVRFYGKRCISFSLDGYRYYPRKQWHDWGEQDPFENIWIEPPKDFSGFT

SEQ ID NO: 164185 - protein, 145 aa, Glycine max
  Coding DNA Sequence Number=SeqID_47407
MRSARFLEEIEFAGKENIRGVVFNEERVIHNGQVFVCTIAQEIELVINNNVIPNIIQEQEKESSLGQEKGSLCIKEEKELCINGTEKQHGSQGKKWTNYVVPFGNTIRVERGVTRPCTSGAFVEVLPPSRAILEVKHLGFFNPDT

SEQ ID NO: 164186 - protein, 124 aa, Glycine max
  Coding DNA Sequence Number=SeqID_47408
  Gene Ontology: Mol. function=RNA-directed DNA polymerase activity; Biological process=RNA-dependent DNA replication
  Homolog annotation: Hit_ID=Q1SZU6; Match level="QueryCoverage=77%, HitCoverage=27%, E-value=4e-31, Identity=64%"; Hit description=RNA -directed DNA polymerase (EC 2.7.7.49)-fruit fly (Drosophila melanogaster) transposable element BS
MGRVRGNNKVGIERHVKKKYHQYLCPTSIPIEVWKYIGEQGFMSLTKLFNGILRSKKMPNEWRKSTLVLIFKNNEDIQNCVDYRVIKLMSYTMKLWEKVIGHRLRIETRIVENQFDFMQGMSTT

SEQ ID NO: 164187 - protein, 483 aa, Glycine max
  Coding DNA Sequence Number=SeqID_47409
  Gene Ontology: Mol. function=ubiquitin thiolesterase activity; Cellular component=intracellular; Biological process=ubiquitin -dependent protein catabolic process
  Homolog annotation: Hit_ID=Q69MX3; Match level="QueryCoverage=98%, HitCoverage=72%, E-value=3e-81, Identity=61%"; Hit description =Putative U4/U6.U5 tri-snRNP-associated 65 kDa protein
  Pfam annotation: Domain name=UCH; Domain location=291-483; Score= -28.1; E_value=9.3e-05; Accession=PF00443.19; Description=Ubiquitin carboxyl-terminal hydrolase
  Pfam annotation: Domain name=zf-UBP; Domain location=132-199; Score =10.5; E_value=0.0079; Accession=PF02148.9; Description=Zn-finger in ubiquitin-hydrolases and other protein
  Pfam module annotation: Pfam domain module=UCH::zf-UBP; Domain location=291-483::132-199
MASKREREASDRVEDEGVDNESKRQRLDEDSSPSPPPVSIANPLSGLANNYADIDEEEDYVRRERGSINERRNDGSQHNGHKKYGEADDSDEEDDSHEQFSGRNRQVEVRKDCPYLDTVNRQVLDFDFEKFCSVSLSNLNVYACLVCGKYYQGRGKKSHAYTHSLEAGHHVYINLRTEKVYCLPDDNFLATYFCFYGHQPLAGNNVDISIFCPMYATCCWMKNDSYPFWKLKFHAMDLPKSSRGLPQQPCCSGQPGNLLLCTLKRFAAKEVEQLDKNKQWSRALDGSSYLPGMVGLNNIKETDFVNVTIQSLMRVTPLRNFFLIPENYQHCKSPLVHRFGELTRKIWHTRNFKGQVSPHEFLQAVMKASKKRFRIGAQSDPVEFMSWLLNTLHADLKTSKKNTSIIYECFQGELEVVKEIPNKVISDKKENNAEKLSDGVNERYAFVKETSKMPFLMLGLDLPPPPLFKDVMEKNIIPQLMIR

SEQ ID NO: 164188 - protein, 121 aa, Glycine max
  Coding DNA Sequence Number=SeqID_47410
  Gene Ontology: Mol. function=electron carrier activity; Cellular component=integral to thylakoid membrane; Biological process =electron transport
  Homolog annotation: Hit_ID=Q7YJW0; Match level="QueryCoverage=96%, HitCoverage=35%, E-value=3e-32, Identity=63%"; Hit description =Apocytochrome f precursor
MALNEKRGSPTWIGNYVSDLPNLIVEIFRINDLTMQARNAFSFFAQQGYENPQEAIGRIVCANFHLANKPVDIEVPQVVLPNTIFEAVVRIPYDMQVKQVLANGKKGSFECGGCSYFIGRF

SEQ ID NO: 164189 - protein, 301 aa, Glycine max
  Coding DNA Sequence Number=SeqID_47411
  Homolog annotation: Hit_ID=Q9LKA0; Match level="QueryCoverage=62%, HitCoverage=73%, E-value=2e-65, Identity=61%"; Hit description =Similarity to SF16 protein
  Pfam annotation: Domain name=IQ; Domain location=75-95; Score=22.4; E_ value=0.0016; Accession=PF00612.17; Description=IQ calmodulin-binding motif
MDGKEIMSPKKWFKAIIRLRKPKEDKSKLAKVQSTPEKSNESSEEKQEDTLEEALSIPSEGLAVERTVPTRLIEDIAATRIQNAFRAFLARRTLHHLRGAVKFEALIQDHMAREQTVTALNYIHTWSRMQDQIKARRLYMITEARIKQKRLENQLKLEAKIHELQVEWSGGSETMEEILSRLHQREEAAVKRERAMAYAYSHQWRPNCSQYLGHATYSLGKESWGWSWKERWVAARPWEIRVRFQGPMTKKTNGQPQRSKVDKKDHNYNNNNNNNNNNRKVPLSKPELSNGKENNNIPELS

SEQ ID NO: 164190 - protein, 282 aa, Glycine max
  Coding DNA Sequence Number=SeqID_47412
  Gene Ontology: Mol. function=RNA-directed DNA polymerase activity; Cellular component=nucleus; Biological process=RNA-dependent DNA replication
MNTCLFHVVAFARRNKNFIPKLAKEDGAEVTDQGEMCSITKKYFEDIFSACQENYDPIIEVVKHIISAQGNEFLLTQFSEEDFRDVLFHIDVDKALGPDDSGKIPQGVNDTNMVLIPKCNNPSSMKDLRPISLCNVVYKILSKAMANRLKFLLLGCVAEEQATFIANRSISNNIIVASEVIHYLRCRKKGKRGEVALKIDISKAYDEVNCGDLKAILTKIYGASGIAGMPSYRRRTRLLLKFMFRKKKDDKGWFVRAATNVRRGMPKVHEGEAQVILQTLTD

SEQ ID NO: 164191 - protein, 110 aa, Glycine max
  Coding DNA Sequence Number=SeqID_47413
MPSSHQKQQLLLKADEQKIISQKHSWTSISSKIKLIAPHVKPLAHDHRCPKELKKKDVEAYGEDAVVVVTEDGVVEGDVIEVVLLVGEVVVHHTDRRYHQGGGGGWCSWG

SEQ ID NO: 164192 - protein, 116 aa, Glycine max
  Coding DNA Sequence Number=SeqID_47414
  Subcellular localization annotation: CTP_CleavageSite=39; ConfidenceScore=5.14e-01
MTLQMTNSPTNPSSSHWNLQSSIRHRNSRRPARRFDEINDKGDESGKIEIRKRKCGIIKCLACKRVKHASYFSKRVSFENRVIDKGNIDDAEAQTESESERQFRALFCKTKGERLK

SEQ ID NO: 164193 - protein, 100 aa, Glycine max
  Coding DNA Sequence Number=SeqID_47415
MNVNEDEIMLDLTDQQKLEKEKNDLQLCNVGLAEKLDIWFNRSRNFLKASSILVHEEGFSLRDSKQRKYTKTARRNIEEIRGNRYFAKQENQTRAASGFS

SEQ ID NO: 164194 - protein, 231 aa, Glycine max
  Coding DNA Sequence Number=SeqID_47416
  Gene Ontology: Mol. function=endonuclease activity
  Homolog annotation: Hit_ID=Q2HUP4; Match level="QueryCoverage=65%, HitCoverage=61%, E-value=1e-54, Identity=59%"; Hit description =Endonuclease/exonuclease/phosphatase
MADQPKFHPALTITNVKSPIPITLDVEHGMYHSWAALFKVLVRVHDLHHHIISPTEAQEVAAYAASKAADTALRKRLDALGCYNSKQGFPHFRERVWVKKLVHDRRIRFGTWNIGTLTGKSMEIVDVMVRRKINFMCLQETKWTGEKAKELDNSGFKLWYTGKIRSRNGVGIIVDKEWKKDVVDVGLAEHFKVKFWEDLEGVHQDIPQGEKVFLGGDLNGHVGSVARGFEG

SEQ ID NO: 164195 - protein, 90 aa, Glycine max
  Coding DNA Sequence Number=SeqID_47417
  Gene Ontology: Mol. function=intramolecular transferase activity, phosphotransferases; Biological process=metabolic process
  Homolog annotation: Hit_ID=Q6Z8J0; Match level="QueryCoverage=76%, HitCoverage=20%, E-value=2e-15, Identity=61%"; Hit description =Putative phosphoglycerate mutase
MANVGQVVIEGYTFMKRIAALILIWHGESLWNEKNLFTGCVDVLLSKKGIDEAIEAGKKISSIPSEVGVYAYTRILFVWKAAMALGDHYQ

SEQ ID NO: 164196 - protein, 49 aa, Glycine max
  Coding DNA Sequence Number=SeqID_47418
MGPIFPPYAGTYADLISWRRVMHCFSYCWRPLPADYKCNRFTVPNPPPK

SEQ ID NO: 164197 - protein, 56 aa, Glycine max
  Coding DNA Sequence Number=SeqID_47419
MQWVKSYQSNQLAIHGASADGAFDRDEPCGHGSAIPYSASSFAEVALEAPALVATW

SEQ ID NO: 164198 - protein, 57 aa, Glycine max
  Coding DNA Sequence Number=SeqID_47420
MGRASRTGDFMHGGQWCWRFDPSCLVKQQQQQKAAGLGNLGAGKRHSHWRFVLFFRL

SEQ ID NO: 164199 - protein, 75 aa, Glycine max
  Coding DNA Sequence Number=SeqID_47421
MFVRNLNNIHSFNKLDTKSYGDSKVQGETPQNVASKVLEDAPPSNKTKCCYCSLGPAKEGRAPNNKFNNMGSYGE

SEQ ID NO: 164200 - protein, 277 aa, Glycine max
  Coding DNA Sequence Number=SeqID_47422
  Gene Ontology: Mol. function=transporter activity; Cellular component= 1-2nm peptidoglycan-based cell wall; Biological process=transport
  Homolog annotation: Hit_ID=P0AFY6; Match level="QueryCoverage=89%, HitCoverage=64%, E-value=2e-77, Identity=59%"; Hit description =Protein sbmA
  Pfam annotation: Domain name=SbmA_BacA; Domain location=112-277; Score=3.6; E_value=2.2e-10; Accession=PF05992.3; Description =SbmABacA-like family
  Subcellular localization annotation: CTP_CleavageSite=70; ConfidenceScore=5.41e-01
MLSSSDTTDNRQINAGSGIKSTHNSGVPMFKSYFPRPALFFSSAAIWSLIAIFAWFGFFNDFPARFPALQAAMQQPLPTNASRFIHASQLWFYAYYWIMGGAFALVWRIIDNHPWQRWSVWGSLLIIFVTWFGVQVGVGVNAWYGPFYDMIQQALTKAGSVSINQFYVQVLAFLGIALIAVVIGVMNSFFVSHWVFRWRTAMNNYYMHNWQRLRLVEGLGHQLYPGHHDAGGVSAGTGDAIASCERSADPRQYPLCAGDRRAAVVAVWYRAAGAGGD

SEQ ID NO: 164201 - protein, 332 aa, Glycine max
  Coding DNA Sequence Number=SeqID_47423
  Gene Ontology: Mol. function=chitin binding; Cellular component =extracellular region; Biological process=chitin metabolic process
  Homolog annotation: Hit_ID=UPI0000E478AA; Match level="QueryCoverage =58%, HitCoverage=26%, E-value=2e-22, Identity=34%"; Hit description =PREDICTED: similar to cortical granule protein with LDL-receptor -like repeats
DCTSSPSEGYTSSSSKGCTPSPPEGYTSLPSEGYTSSPPEDCTSFAFRGLHVLAFIGQYILAFRGLHVLTSRGLGLHVLTFRGLYVLAFGGLHVLAFRGMHVLAFRGLHVLASRGLHILSFRGLYVLIFGGLHILTFRGLHVLAFRGLHVLAFRGLSVLAFRGLHILTFRGLHVLAFRGLYILAFRGLHVLAFRKLKRPRLQFPPAKVSAGLCHHDIGIVPTRHPVDPKKSNKVLGFPALITGLCQFYGVPVATSKVIRPSINRAFIEKYSAPRRAQGEVPQQLRDGQQQATDAPPPPLGSTSAHLQRLECCPRPMADRQATKSKAKCKKKY

SEQ ID NO: 164202 - protein, 96 aa, Glycine max
  Coding DNA Sequence Number=SeqID_47424
  Subcellular localization annotation: CTP_CleavageSite=25; ConfidenceScore=5.31e-01
MSISPYGSISWSVSFRRIVPTRHPVDPEKSNRVLGFPALVTGLCPSYRVPVPPARGSAHKTPSGPRGAQQGPGVSSSGYGPLDRARKTPSGPEEVQ

SEQ ID NO: 164203 - protein, 204 aa, Glycine max
  Coding DNA Sequence Number=SeqID_47425
  Homolog annotation: Hit_ID=Q1RTJ9; Match level="QueryCoverage=96%, HitCoverage=58%, E-value=8e-18, Identity=34%"; Hit description =Cyclin-like F-box; F-box protein interaction domain
MPGYHLVGSCNGLHCGVSEIPEGYRVCFWNKATRVISRESPTLSFSPGIGRRTMFVFGYDPSSDKYKVVAIALTMLSLDVSEKTEMKVHGAGDSSWRNLKGFPVLGTLPKVGGVYLSGTLNWVVIKGKEIIHSEIVIISVHLEKETCISLFLPDDFCFVDTNIGVFRDSLCVWQDSNTHLGLWQMRKFGDDKGMVSLKFLSFPQ

SEQ ID NO: 164204 - protein, 154 aa, Glycine max
  Coding DNA Sequence Number=SeqID_47426
MMTKVMTKSSKVNQRMSSKCSRWNQEQFNTQEEKLKNTSRFKRKVEHKNQDSRIKLQESRSRFKIQESREDLIKIIMKRIFQKLRSTWIFLKTCLPKSFYSLSRILSHKSLVCRQRIKLNVLMMPKDYMNHMLLKDLLKTKQLEIFKMDDQDSL

SEQ ID NO: 164205 - protein, 108 aa, Glycine max
  Coding DNA Sequence Number=SeqID_47427
MATLPASPPPPPSPPPPPSTRPVVHVDPETGKADSPYKKKLRTYLGIVAHDKVDVTYETSKEVPATQKDLIWEDIQFKSDLTRKWALAADKDNVDDAVCEKYDISKEK

SEQ ID NO: 164206 - protein, 485 aa, Glycine max
  Coding DNA Sequence Number=SeqID_47428
  Gene Ontology: Cellular component=intracellular; Biological process =intracellular protein transport
  Homolog annotation: Hit_ID=Q2V732; Match level="QueryCoverage=95%, HitCoverage=68%, E-value=0.0, Identity=82%"; Hit description=VHS and GAT domain protein
  Pfam annotation: Domain name=GAT; Domain location=7-92; Score=49.2; E_ value=1.4e-11; Accession=PF03127.5; Description=GAT domain
MEVPIELENKLLGYSILTPFYESKNEGIRQEVIVDLVEQCRTYKQRVVHLVNSTLDESLLCQGLALNDDLQRVLAKHESISSGTSTKNENHTQNSKPAPAGALVDIDAPLVDTGDTSKQTDGRSSSNVEAGSQTLNQLLLPAPPTSNGSTIPAKVDPKWDLLSGDDYNSPKADSSNVLVPLGEQPPASPVSQQNDLVLFDMFSNGNNAPTSVNSQPPQPTNVAGQTSPYGPQFQQQQTVVTSQGGFYPNGNAPNAGSPQYEQSLYTQSTGPAWNGQVAQQQQQQQQPPSPVYGSQGSGSLPPPPWEAQPADNGGPLAGTQYPHMQNAGHPMGPQTMGNDQGVGMYMQSNANSHTSGMNNHVGSNQMGLQPQHVQGVAGPYMGLAPHQMQGGPVMYSQQMYGNQFIGYGYDQQQGVHYQQLGVPYIERQMYGMSVRDDSSLRNPYQASTTSYVPSGKPSKPEDKLFGDLVDMAKVKPKPTPGRAGS

SEQ ID NO: 164207 - protein, 91 aa, Glycine max
  Coding DNA Sequence Number=SeqID_47429
  Subcellular localization annotation: CTP_CleavageSite=60; ConfidenceScore=5.05e-01
MDSCIWSNMAYNQRTKQHLELANSVVWHVKSQKSNVKSPFTPFHRSKNHAICSPLQVKVSSAPFQSAEILSPQNRIFITQTRQDEWLYLGT

SEQ ID NO: 164208 - protein, 365 aa, Glycine max
  Coding DNA Sequence Number=SeqID_47430
  Homolog annotation: Hit_ID=Q2V732; Match level="QueryCoverage=42%, HitCoverage=27%, E-value=1e-67, Identity=85%"; Hit description=VHS and GAT domain protein
  Pfam annotation: Domain name=VHS; Domain location=207-315; Score= -32.7; E_value=0.019; Accession=PF00790.9; Description=VHS domain
MAKWSLTEMIKEADTDGDGVLPREGLKACGRRCSFAGSYGRTPSSAGYIFIHFHTRGRRFFSRKNLRLQPQAPNNNNVVYPKAIYAIQIENQSQWEDEGREPKWRTKACVGENKGPWRRTREPKWRKLARRRKNTNEEHEGREKTNAGCTDEEEAQKKKKSIKLASIFVSLNRETRACGVRIVLRSHRWSVYGHRRIADLAKFRIAAVTGNGEFHGGTRYERHAHRARLGHEHRDLRHAQSRPWTIIKNCGDIVHMHVAERDVLHEMVKIVKKKPDFHVKEKILILIDTWQEAFGGPRARYPQYYAAYQELLRAGAVFPQRSEQSAPVFTPPQTQPLASYPQNIHDSDAHQDTAQSSAESEFPTL

SEQ ID NO: 164209 - protein, 80 aa, Glycine max
  Coding DNA Sequence Number=SeqID_47431
  Gene Ontology: Mol. function=1-(5-phosphoribosyl)-5-[(5 -phosphoribosylamino)methylideneamino]imidazole-4-carboxamide isomerase activity; Cellular component=chloroplast; Biological process=amino acid biosynthetic process
  Homolog annotation: Hit_ID=O82782; Match level="QueryCoverage=88%, HitCoverage=23%, E-value=1e-24, Identity=76%"; Hit description=1-(5 -phosphoribosyl)-5-[(5- phosphoribosylamino)methylideneamino] imidazole-4-carboxamide ...
  Homolog annotation: Hit description=isomerase, chloroplast precursor
MKSPCRLGIDEELVALLGKHSPIPVTYAGGVTEMSDLERIKTAGMDRVNVTVGSALDIFGGNLAYEEVVAWHAQQNASAV

SEQ ID NO: 164210 - protein, 119 aa, Glycine max
  Coding DNA Sequence Number=SeqID_47432
MSAKYSITDFIHSNFIGLTQISLIESRTSCQTFIDCRTCIHVVGSHLYGKGVTFDTSTWKLAYRDINHIGHNLVKGSTWKLAYMEAHGSWLIGISIILVIRKHFLDQVDPEDAYGSSDP

SEQ ID NO: 164211 - protein, 83 aa, Glycine max
  Coding DNA Sequence Number=SeqID_47433
  Subcellular localization annotation: CTP_CleavageSite=64; ConfidenceScore=5.51e-01
MIRSLALHLAARFRHNHNLVRLSSSSSAASASTLHHATPSPSSSEPVHITQNCVRIQLCLFLCAAETESGNKIQACLFFSAIP

SEQ ID NO: 164212 - protein, 285 aa, Glycine max
  Coding DNA Sequence Number=SeqID_47434
  Gene Ontology: Mol. function=1-(5-phosphoribosyl)-5-[(5 -phosphoribosylamino)methylideneamino]imidazole-4-carboxamide isomerase activity; Cellular component=chloroplast; Biological process=amino acid biosynthetic process
  Homolog annotation: Hit_ID=O82782; Match level="QueryCoverage=66%, HitCoverage=62%, E-value=2e-86, Identity=83%"; Hit description=1-(5 -phosphoribosyl)-5-[(5- phosphoribosylamino)methylideneamino] imidazole-4-carboxamide ...
  Homolog annotation: Hit description=isomerase, chloroplast precursor
  Pfam annotation: Domain name=His_biosynth; Domain location=51-270; Score=-49.7; E_value=1.7e-07; Accession=PF00977.11; Description =Histidine biosynthesis protein
  Subcellular localization annotation: CTP_CleavageSite=64; ConfidenceScore=5.49e-01
MRSLAAPHSFRVFVNSPIFRPIKLPFLTLNPLSSPSRRSPASVQCAVQFRPCIDIHKGKVKQIVGSTLQDLKGGDGSDPVTNFESDKSAAEYAALYKQDGLTGGHVIMLGADPLSKASALEALHAYPGGLQVGGGINSDNCLSYIEEGASHVIVTSYVFNNGQMDLGRLKDLVQIVGKDRLVLDLSCRKKDGKYAIVTDRWQKFSDVFVDPDVMEFLANFADEFLVHGVDVEGKKGREFREKVNLENKMLYYLRECNGDNLLEKFYGVVDYGNGDPQGDRMHWKK

SEQ ID NO: 164213 - protein, 839 aa, Glycine max
  Coding DNA Sequence Number=SeqID_47435
  Gene Ontology: Mol. function=transferase activity, transferring hexosyl groups; Cellular component=mitochondrion; Biological process= metabolic process
  Homolog annotation: Hit_ID=Q1T4I9; Match level="QueryCoverage=67%, HitCoverage=97%, E-value=0.0, Identity=62%"; Hit description =Pentatricopeptide repeat
  Pfam annotation: Domain name=PPR; Domain location=131-165; Score=0.9; E_value=5.8; Accession=PF01535.11; Description=PPR repeat
  Pfam annotation: Domain name=PPR; Domain location=166-200; Score =21.6; E_value=0.0027; Accession=PF01535.11; Description=PPR repeat
  Pfam annotation: Domain name=PPR; Domain location=201-235; Score =41.0; E_value=4.1e-09; Accession=PF01535.11; Description=PPR repeat
  Pfam annotation: Domain name=PPR; Domain location=236-270; Score=1.9; E_value=4.4; Accession=PF01535.11; Description=PPR repeat
  Pfam annotation: Domain name=PPR; Domain location=274-308; Score =44.3; E_value=4.2e-10; Accession=PF01535.11; Description=PPR repeat
  Pfam annotation: Domain name=PPR; Domain location=309-343; Score =53.2; E_value=8.8e-13; Accession=PF01535.11; Description=PPR repeat
  Pfam annotation: Domain name=PPR; Domain location=344-378; Score =44.6; E_value=3.3e-10; Accession=PF01535.11; Description=PPR repeat
  Pfam annotation: Domain name=PPR; Domain location=379-413; Score =52.5; E_value=1.4e-12; Accession=PF01535.11; Description=PPR repeat
  Pfam annotation: Domain name=PPR; Domain location=414-448; Score =39.1; E_value=1.6e-08; Accession=PF01535.11; Description=PPR repeat
  Pfam annotation: Domain name=PPR; Domain location=449-483; Score =50.3; E_value=6.5e-12; Accession=PF01535.11; Description=PPR repeat
  Pfam annotation: Domain name=PPR; Domain location=484-518; Score =41.3; E_value=3.4e-09; Accession=PF01535.11; Description=PPR repeat
  Pfam annotation: Domain name=PPR; Domain location=519-553; Score =54.5; E_value=3.6e-13; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=131-165::166 -200::201-235::236-270::274-308::309-343::344-378::379-413::414 -448::449-483::484-518::519-553
MVIGKLTGPVQGSVFQSLSISTISELLSNQHWSELKPHFRTTKPAIFLDQLFNAGVDSELVLRFFQWSQKEFRISYGLETTGKVLHLLANSKKYSKVRSFLDKLVKNEKHTVSSVFHSLLLGGDRPCANALITDMLVLAYVTNLEIHSACEVFRRVQDYGFKLSLNSCNPLLSALVKGNETGEMQYVYKEMIKRRIQPNLTTFNIFINGLCKAGKLNKAEDVIEDIKAWGFSPNIVTYNTLIDGHCKKGSAGKMYRADAILKEMLANKICPNEITFNTLIDGFCKDENVLAAKNAFEEMQRQGLKPNIVTYNSLINGLSNNGKLDEAIALWDKMVGLGLKPNIVTFNALINGFCKKKMIKEARKLFDDIAEQDLVPNAITFNTMIDAFCKAGMMEEGFALHNSMLDEGIFPNVSTYNCLIAGLCRNQNVRAAKKLLNEMENYELKADVVTYNILIGGWCKDGEPSKAEKLLGEMLNVGVKPNHVTYNTLMDGYCMEGNLKAALKVRTQMEKEGKRANVVTYNVLIKGFCKTGKLEDANRLLNEMLEKGLNPNRTTYDVVRLEMLEKDSILTSAHIDLILNGLPDDYRTICSILNNLCDPLNLDDVTSMLLAEESSIEKSHKKNLGSLNLAEGSNSNSASEAQVHLTQGNTHSSSNYDSKYGNKRGVMVVVHTVEVEPVGEGVADSLMFSVRFVANLGTKPLIAGTKMMQATPPSPLNQIPNLIPKPITPNRNPNSPYLYSPYPFYPYFPFMPPFGFPPPPQNHSPKPNSYPSPQANASGTSSNSRYPNSGASHHVTNVSQNIQQVTPFEGPDQITIGNGQGLPIDSSSFERGVSTWQSW

SEQ ID NO: 164214 - protein, 548 aa, Glycine max
  Coding DNA Sequence Number=SeqID_47436
  Gene Ontology: Mol. function=oxidoreductase activity, acting on the CH-CH group of donors, NAD or NADP as acceptor; Cellular component =endoplasmic reticulum membrane; Biological process=electron transport
  Homolog annotation: Hit_ID=P93472; Match level="QueryCoverage=99%, HitCoverage=100%, E-value=0.0, Identity=83%"; Hit description=Cell elongation protein diminuto
  Pfam annotation: Domain name=FAD_binding_4; Domain location=78-199; Score=25.3; E_value=4.6e-05; Accession=PF01565.13; Description=FAD binding domain
MSDLEAPLRPKRKKVWVDYFVQFRWILVIFVVLPISFTIYFLTYLGDVRSEWKSYKTRQKEHDENVKKVIKRLKQRNPSKDGLVCTARKPWIAVGMRNVDYKRARHFEVDLSAFRNVLEIDKERMIARVEPLVNMGQISRVTVPMNLALAVVAELDDLTVGGLINGYGIEGSSHKYGLFADTVVAYEIILADGTLVRATKDNEYTDLYYAIPWSQGTLGLLVAAEIKLIPVKEYMKLAYKPVVGTLQDLAQAYCDSFAPRDGDQDNEEKEDIASKEEAKKKGNKINSVGWWFKPWFYQHAQTALKKGEFVEYIPTREYYHRHTRCLYWEGKLILPFADQFWFRYLFGWLMPPKVSLLKATQGDAIRNYYHEMHVIQDMLVPLYKVGEALEWVHREMEVYPIWLCPHKLFKLPVKTMIYPEPGFELHRRQGDTQTAQMYTDVGVYYAPGPVFRGEVFDGAEAVRKMENWLIENHGFQPQYAVSELSEKNFWRMFDAGLYEHTRRKYGAVGTFMSVYYKSKKGRKTEKEVQEAEQAHLETAYAEADQPVD

SEQ ID NO: 164215 - protein, 694 aa, Glycine max
  Coding DNA Sequence Number=SeqID_47437
  Homolog annotation: Hit_ID=Q9LT26; Match level="QueryCoverage=83%, HitCoverage=86%, E-value=0.0, Identity=60%"; Hit description=Genomic DNA, chromosome 3, P1 clone: MPN9
  Pfam annotation: Domain name=C2; Domain location=431-516; Score=51.0; E_value=4e-12; Accession=PF00168.20; Description=C2 domain
MEHATNISQFHIPQNWNAIWRLKVSSKICVFVMESDEGVPSHKTKTFKEGLNISHEGSDKKQDEGCFDGVKGGEKEIYMRKRLFANSGSRKFRRKCTVRFCAVPSSDNNHPNWNADFANSARRTATTFVLKRISNNNNNNNNNNNNDNDVIVTELQAPPPSVQLGSNFTGFSEDPIVDKLRTQLGVIHPIPSPPINRNVIGLFVFFFFVGVVFDKLWTWRRRRSKNNSGGGEDGLGVWPQVPTSFSLLLEKDLQRKESVEWVNMVLGKLWKVYRGGIENWIIGLLQPVIDNLKKPDYVQRVEIKQFSLGDEPLSVRNVERRTSRRVNDLQYQIGLRYTGGARMLLMLSLKFGIIPIVVPVGVRDFDIDGELWVKLRLIPTEPWVGAVSWAFVSLPKIKFELSLFRLFNLMVAVGVKSGETQEGNKDSVGELSVTLVDARKLSYIFYGKTDPYVILSLGNQVIRSKKNSQTTVIGPPGMPIWNQDFHMLVSNPRKQKLFIQVKDVLGFADLTIGTGEVDLGSLKDTVPTDRIVVLQGGWGFLGKRSSGEILLRLTYKAYVEDEEDDKTEVYAIYTDVSDDELSDSEVNGTNEKDERDSAYETDKESFMDVLAALIVSEEFQGIVASETGFSKVLDSGSNAGPRVSKSQVPNVEPIPSSSDNSEGFGGSALLWLAVITSISLLIALNVGGSSLFNP

SEQ ID NO: 164216 - protein, 216 aa, Glycine max
  Coding DNA Sequence Number=SeqID_47438
  Gene Ontology: Mol. function=transferase activity, transferring hexosyl groups; Cellular component=intracellular; Biological process= metabolic process
  Homolog annotation: Hit_ID=Q1T4I9; Match level="QueryCoverage=81%, HitCoverage=73%, E-value=1e-76, Identity=46%"; Hit description =Pentatricopeptide repeat
  Pfam annotation: Domain name=PPR; Domain location=125-160; Score =12.1; E_value=0.28; Accession=PF01535.11; Description=PPR repeat
  Pfam annotation: Domain name=PPR; Domain location=161-195; Score =49.2; E_value=1.4e-11; Accession=PF01535.11; Description=PPR repeat
  Pfam annotation: Domain name=PPR; Domain location=55-89; Score=44.6; E_value=3.3e-10; Accession=PF01535.11; Description=PPR repeat
  Pfam annotation: Domain name=PPR; Domain location=90-124; Score=50.8; E_value=4.6e-12; Accession=PF01535.11; Description=PPR repeat
  Pfam module annotation: Pfam domain module=PPR::PPR::PPR::PPR; Domain location=125-160::161-195::55-89::90-124
MGGIKELRTIIGRLQLCLLVMLWVLFIEDVTWGGGCLDCNLWDKMVGLGLKPNIVTFNALINGFCKKKMIKEARKLFDDIAEQDLVPNAITFNTMIDAFCKAGMMEEGFALCNSMLDEGIFPNVSTYNCLIAGLCRNQNNVRAAKKLLNEMENYELKANVVTYNILIGGWCKDGESSKAEKLLGEMLDVGVKPNHVTYNTLMDGYCMEGNLKAALK

SEQ ID NO: 164217 - protein, 167 aa, Glycine max
  Coding DNA Sequence Number=SeqID_47439
  Gene Ontology: Mol. function=uracil DNA N-glycosylase activity; Biological process=base-excision repair
  Homolog annotation: Hit_ID=Q9LIH6; Match level="QueryCoverage=67%, HitCoverage=34%, E-value=3e-27, Identity=56%"; Hit description =Uracil-DNA glycosylase-like protein
  Subcellular localization annotation: CTP_CleavageSite=45; ConfidenceScore=5.23e-01
MEQKRGQQNTFIPVFPFPPLQRGKKTNSSTLSLEQKSRVEYNKLLAKSKRNLKLCIERVSKSKESDSAGVKLEELLVEETWLDALPDELQKPYALTLSKFVGSEISCGGDDVVFPPTHLIFNALNSTPFHTVKAVILGQCHKLRTLDKEVRAKVFIGMQQNVLLYDF

SEQ ID NO: 164218 - protein, 75 aa, Glycine max
  Coding DNA Sequence Number=SeqID_47440
  Gene Ontology: Mol. function=ubiquinol-cytochrome-c reductase activity; Cellular component=mitochondrial envelope; Biological process=mitochondrial electron transport, ubiquinol to cytochrome c
  Homolog annotation: Hit_ID=Q1S6K7; Match level="QueryCoverage=86%, HitCoverage=77%, E-value=3e-17, Identity=71%"; Hit description =Ubiquinol-cytochrome C reductase, UQCRXQCR9 like
  Pfam annotation: Domain name=UCR_UQCRX_QCR9; Domain location=14-74; Score=55.0; E_value=2.5e-13; Accession=PF05365.2; Description =Ubiquinol-cytochrome C reductase, UQCRXQCR9 like
MDSVPRRSRGGGVFESLYKVLMRRNSVYVTFIIAGAFLGERLRFQFLRFQAVDYGVHKIWEHNNVGVLNLLLCSN

SEQ ID NO: 164219 - protein, 92 aa, Glycine max
  Coding DNA Sequence Number=SeqID_47441
  Gene Ontology: Mol. function=pepsin A activity; Biological process =proteolysis
  Homolog annotation: Hit_ID=Q9FSZ9; Match level="QueryCoverage=60%, HitCoverage=15%, E-value=2e-16, Identity=66%"; Hit description =Putative extracellular dermal glycoprotein
SQAPNTKPHPFILPIKKDPATNLYYSSVGIDTPRHNFDLDIDLSGQNLWYDRDTDYNSSSYRPTPCGSKQCPRDGQCLDCYGPFQPSCTNNT

SEQ ID NO: 164220 - protein, 278 aa, Glycine max
  Coding DNA Sequence Number=SeqID_47442
  Gene Ontology: Mol. function=pepsin A activity; Biological process =proteolysis
  Homolog annotation: Hit_ID=Q9FSZ9; Match level="QueryCoverage=98%, HitCoverage=87%, E-value=4e-81, Identity=55%"; Hit description =Putative extracellular dermal glycoprotein
  Subcellular localization annotation: CTP_CleavageSite=56; ConfidenceScore=5.24e-01
MALSNRVAQTTHVDFIFISQIQVSGIRSGCTNAHKFTSNLVGGLPKGSKGMLGLARSELAVPTQLALLKKLPLKFSLCLPSSNNIGFTNLLIGPEGHEQSQDVSKYIQTTPLVVNHFDTGPLFEEDRKGNGGTKISTITRFAELQTFVYKPFVRGFLKKAADRRLKRVASVAPFEACFDSRSIGNSFTGFVVPTIDLVLQGGVQWTIHGANSMVMVKKNVACLAFVDGGTMATMSFFKASIVLGAHQLEENLLAFDVASSKLSFSSSLLLHNVTCSHL

SEQ ID NO: 164221 - protein, 90 aa, Glycine max
  Coding DNA Sequence Number=SeqID_47443
  Gene Ontology: Mol. function=dihydroxy-acid dehydratase activity; Cellular component=mitochondrion; Biological process=branched chain family amino acid biosynthetic process
  Homolog annotation: Hit_ID=Q9LIR4; Match level="QueryCoverage=75%, HitCoverage=11%, E-value=7e-23, Identity=72%"; Hit description =Dihydroxy-acid dehydratase
MDCDETEDPGVRKKYFLSNVNDGGPIGLIQNGDVINVDIKNRRIDVLVSDEEMEARRKKWTAPPYKANRGALYKYIKNVTPASSGCVTDE

SEQ ID NO: 164222 - protein, 86 aa, Glycine max
  Coding DNA Sequence Number=SeqID_47444
MAQVAPKSCRVGYTSFQIGETAPSLLVEEAELLRNYREGSAKTLIFETGTEIVQSGLSFNHNPSLGSNTKLHKNKVGLLLAPIVAI

SEQ ID NO: 164223 - protein, 867 aa, Glycine max
  Coding DNA Sequence Number=SeqID_47445
  Gene Ontology: Mol. function=cellulose synthase (UDP-forming) activity; Cellular component=membrane; Biological process=cellulose biosynthetic process
  Homolog annotation: Hit_ID=Q1EG93; Match level="QueryCoverage=99%, HitCoverage=100%, E-value=0.0, Identity=67%"; Hit description =Cellulose synthase
  Pfam annotation: Domain name=C1_3; Domain location=7-40; Score=8.4; E_ value=0.053; Accession=PF07649.3; Description=C1-like domain
  Pfam annotation: Domain name=Cellulose_synt; Domain location=162-861; Score=1589.0; E_value=0; Accession=PF03552.5; Description=Cellulose synthase
  Pfam module annotation: Pfam domain module=C1_3::Cellulose_synt; Domain location=7-40::162-861
MMESGAHFCNSCGEQIGLDANGELFVACHECYFPICKACFEYEINEGRKVCLRCATPYSDRVKDNDGTKVYENQSTTAAQINVSQDVGLHARHVSTVSTVDSELNDESGNPIWKNRVESWKEKDKKKKKKKKSVPKAENEAPIPPEQQMEEIQSSEASAAEPLSMVIPISKTRLAPYRTVIIVRLIILGLFFHYRVTNPVDSAFGLWLTSIICEIWFAFSWVLDQFPKWSPVNREAFVDRLSARYERPGEPSQLAAVDFFVSTVDPLKEPPLITANTVLSILAVDYPVDKVSCYVSDDGAAMLTFESLVETADFARMWVPFCKKFSIEPRAPEFYFSQKIDYLKDKVQPSFVKERRAMKREYEEFKVRVNALVAKAQKTPDEGWTMQDGTSWPGNNSRDHPGMIQVFLGHSGAHDVEGNELPSKAVREAMCFLMDPVVGRDLCYVQFPQRFDGIDRSDRYANRNTVFFDVNMKGLDGIQGPMYVGTGCVFNRQALYGYSPPSMPKLPKSSSCCCCPSKKQTKDVSELYRDAKREELDAAIFNLREIDNYDEYERSMLISQMSFEKTFGLSTVFIESTLMENGGLPESSDPSMLIKEAIHVISCGYEEKTAWGKEIGWIYGSVTEDILTGFKMQCRGWRSVYCMPLRPAFKGSAPINLSDRLHQVLRWALGSVEIFFSRHCPLWKIHHTNVTSVLELRWSGVTIEALWRNEQFWVIGGVSAHLFAVFQGFLKMLAGVDTNFTVTAKAADDTEFGELYIIKWTTLLIPPTTLIIINIVGVVAGFSDALNGGYESWGPLFGKVFFAFWVIFHLYPFLKGLMGRQNRTPTIVILWSVLLASVFSLVWVKINPFISRPDSASISQTCISIDC

SEQ ID NO: 164224 - protein, 144 aa, Glycine max
  Coding DNA Sequence Number=SeqID_47446
MTLLGLGYALYAGLYFDPIGCSCMESSSKEDCSMSKGGDETVVDVDDFVKGTKDPKQVINSLNILAQKDVAQGFQTLIQLLSDSPFCLDRSLELPKNLKTEIFASSSDEGRYQGNGIAQKSCMGKLWILMNKYTRGFTVFEFMA

SEQ ID NO: 164225 - protein, 50 aa, Glycine max
  Coding DNA Sequence Number=SeqID_47447
MSQVLLVMHLWMSGMKEDVHLPSFDTYFCIYKISPSSIDYAQPLVTALKN

SEQ ID NO: 164226 - protein, 59 aa, Glycine max
  Coding DNA Sequence Number=SeqID_47448
RFWFNANVNGRGEDKRACKNKDGDFGGKAPGSLPVQELQARYSLLDTSKSLGVLEFYLL

SEQ ID NO: 164227 - protein, 61 aa, Glycine max
  Coding DNA Sequence Number=SeqID_47449
MGVEDDISLCMVPDSECDGLRKSVYTDDHLGISACHLTSQDDKGAEDDVSLRMSTGLLAPD

SEQ ID NO: 164228 - protein, 144 aa, Glycine max
  Coding DNA Sequence Number=SeqID_47450
MVNEDEWVRAAMADDTVVVELLLRLKQGTVSHKSHHQLIPFSWGVKQPRSRSRLSAAVSRCDAAVSTRCSPTTPLSWSAGTDSYEDSSRHHHHHAAISKSLVFSPKYPCEVRTSRNSVICRRTVVFRGGSNGLACVTKHSLPSE

SEQ ID NO: 164229 - protein, 64 aa, Glycine max
  Coding DNA Sequence Number=SeqID_47451
MESGIEKKIKGICMESGSKIARTEDGGKEKTVVAAGCVVEGFLVKLMLTSPALFTITFILHLIK

SEQ ID NO: 164230 - protein, 231 aa, Glycine max
  Coding DNA Sequence Number=SeqID_47452
  Gene Ontology: Mol. function=metal ion binding; Cellular component =intracellular
  Homolog annotation: Hit_ID=Q9SYM2; Match level="QueryCoverage=90%, HitCoverage=60%, E-value=2e-15, Identity=31%"; Hit description =Putative salt tolerance-like protein At1g78600
RFLLTGVRVGLEAIDPGASLTSLKSDSGEKVSDTKSSSVSRKVSTVPQPSNYNEVLPIEVGGVGEFPPAKVSFGGGSTDGNISQWTIDEFIGLNEFSQHYDYMEGSSRSSDSSFVRDCRLYGSAPSLMHTHTHTHIPEKGQADGGKLGDSDSPVLKSGEEDMEEEDDYLERVPDSSWTVPQIPSPPTASGLCWPKDPQYSSDSVLFVPDISFSLIQQSQISSICLRRWRQL

SEQ ID NO: 164231 - protein, 46 aa, Glycine max
  Coding DNA Sequence Number=SeqID_47453
MADSLILVVTGETQDPGTMYVLFYTLHVKTMDSAIGKKASTMLFET

SEQ ID NO: 164232 - protein, 305 aa, Glycine max
  Coding DNA Sequence Number=SeqID_47454
  Gene Ontology: Mol. function=NADH kinase activity; Biological process= metabolic process
  Homolog annotation: Hit_ID=Q500Y9; Match level="QueryCoverage=98%, HitCoverage=87%, E-value=4e-81, Identity=53%"; Hit description=NADH kinase
  Pfam annotation: Domain name=NAD_kinase; Domain location=1-300; Score= -29.9; E_value=0.00069; Accession=PF01513.11; Description=ATP-NAD kinase
ILQFLENRRKVHHDAINFCQAILQKKSIEWKAVHRNNLSQPINDVDLVVTVGGDGTLLQASHLMDDKIPVLGVNSDPTQIDEVEEFGSEFDAHRSTGHLCAATVENFEQVSILLQNLQFDTKVVHKLMSCKPAAQVLDSILEGQIVPSELTRIMMSVNGLDLSTYALNDILIAHPCPASVSRFSFRIKEGDQPCSPLVNCRSSGLRVSTATGSTAAMQSAGGFPMPILSQDLQYMLREPISLGATSNYMHGLIKRNQTIVATWTCRKGVIYIDGSHVNYTFKDGDIIAISSKAPVLKVLLPHKFL

SEQ ID NO: 164233 - protein, 148 aa, Glycine max
  Coding DNA Sequence Number=SeqID_47455
  Subcellular localization annotation: CTP_CleavageSite=63; ConfidenceScore=5.24e-01
MVVVRLVIVVMMMMSMVVMATITGVVMMVAVATLIAAMVVMMVVTMTALIAVTMVVVGPVMINVMVVKAVVEVVIAVVMVIVTVIAAYINGGDSNGSESSDSGGGSDQSGNNSNGSESSDSGGGSDQSGNNSCDSSSVSDGVTKSCVI

SEQ ID NO: 164234 - protein, 93 aa, Glycine max
  Coding DNA Sequence Number=SeqID_47456
MSECECDFKRRKSQWGDHPIGDEARDEWSGDHPIREEARAEVEWGPSSILASETAAASSGPTLLVDPTFFIFSYTAPPFGKIVRCSRLFVLLL

SEQ ID NO: 164235 - protein, 1444 aa, Glycine max
  Coding DNA Sequence Number=SeqID_47457
  Gene Ontology: Mol. function=RNA-directed DNA polymerase activity; Cellular component=chromatin; Biological process=chromatin assembly or disassembly
  Pfam annotation: Domain name=RVP_2; Domain location=402-525; Score= -28.4; E_value=0.00016; Accession=PF08284.2; Description=Retroviral aspartyl protease
  Pfam annotation: Domain name=RnaseH; Domain location=895-1012; Score=- 20.0; E_value=0.0042; Accession=PF00075.14; Description=RNase H
  Pfam annotation: Domain name=rve; Domain location=1148-1304; Score =119.8; E_value=7.9e-33; Accession=PF00665.16; Description=Integrase core domain
  Pfam annotation: Domain name=zf-H2C2; Domain location=1089-1130; Score=13.0; E_value=0.0067; Accession=PF09337.1; Description=His(2) -Cys(2) zinc finger
  Pfam module annotation: Pfam domain module=RVP_2::RVT_1::Retrotrans _gag::RnaseH::rve::zf-H2C2; Domain location=402-525::635-804::112 -202::895-1012::1148-1304::1089-1130
MGDRLDLLEEQMGEVKSTLQALALQMQEQSTSIAQQMQQQSLVLSELSKQIGQKVNENSNESEKSMDDYYESRFSGKKVKLPVFEGDDPVAWITRAEIYFDVQNTSEEMRVKLARLSMEGATIHWFNLLMETEDQLTWEKLKKSLIARYGGRRLENPFEELSTLKQTGSVEEFVEAFELLSSQVGRLPEEQYLGYFMSGLKQPIRRRVRTLNPQNRMQMMRMAKDVEEELKEEDDDGDRAYGKKLLGRSEPSGLGSKFRSGFNPGQKEMSRSTNSGWANPSRKTGSVGSNSKSTSSLSSTGKKGEYDRRSGGSEKWKGVRNEEMEERRAKGLCFKCGGKYHPTLHKCPERALRLLILGEGETMNDDGEIVAMEAEGSEEEEDQEAECNLIGILGKMGEYQTMKIEGKLANVTVEVLIDSGASHNFISPKLTMALGLTVTPTTVRSIKLGDGHRVMSEGVCRGVRIALGTQNFVIDALVLELGGLDVVLGVSWLSTLGKVVMDWKDLSMQFWHKDEMVTLQGQSGRQLQQGFLNSFLEDRKREFSNEWWWSPNVKIEGGKEQINKGIAEVLGSFPQIFQEQITLPPEREQVHQINLLPNHGPVNVRPYKYPHHQKEEIEKQVAELLQAGVIRPSMSAFSSPVILVKKKDHSWRMCVDYRALNKATVPDKYPIPIVDELLDELYGATVFSKIDLKSGYHQIRVHEDDVHKTAFRTHNGHYEYLVMPFGLMNAPATFQSTMNHIFRPFLRKFVLVFFDDILVYSSSEQEHLTHLKQVLTVLMKHCFVANRSKCKFGCLQVDYLGHIISGEGVSVDPEKIKCILEWPEPKNVKGVRGFLGLTGYYRKFVKDYGKIARPLTDLTKKDNFLWRETAREAFNQLKKIMTTSPVLVLPNFSIPFEVECDAAGRGIGAVLMQNKQPIAYFSKALSDKNLAKSVYEKELMALVLSIQHWRHYLLGREFVVYTDHKSLKHFLQQRISSPDQQCWLAKLLGYQFEVKYKPGPENKAADALSRCYDEGELTALKSGPTWVDSKQLLQEVKQDASVQQIIAEVELNPSAKPGFSVQQGVLLYQGRLVLGKNSPSIPALLKEFHETPMGGHSGYLRTYRRIAENLYWVGMQKTIRDYVRACDVCQRQKYAATSPGGLLQPLPLPNAIWEDISMDFITGLPKSKGFEAVLVVVDRLSKYSHFILMKHPYNAKTVAELFVKEVVRLHGVPNSIVSDRDPLFVSHFWRELFKLQGTTLKMSSAYHLETDGQSEVINRCLESYLRCFAADQPKTWSYLIPWAEYWYNTTYHISLGKSPFEVVYGRQPPNLMRFLSNETKVAAVALELQDRDEALNQLKLQLLKAQQQMKYYADLKRKNVQFEVGDWVFLKLRPHRQQSVVRRINQKLAARFYGPFQIIAKVGEVAYKVQLPEQSRIHPVFHVSLLKKAIGDYQVQGELPKELE

SEQ ID NO: 164236 - protein, 134 aa, Glycine max
  Coding DNA Sequence Number=SeqID_47458
  Gene Ontology: Mol. function=protein binding; Cellular component =membrane
  Homolog annotation: Hit_ID=Q9AT39; Match level="QueryCoverage=78%, HitCoverage=29%, E-value=1e-47, Identity=89%"; Hit description =SHOOT1 protein
MDLITPLMHPMHPPLIPATSSLSNSFPTNGKYDEALEKFESILGSKPEPEEAAVASYNVACCYSKLNQIQAALSSLEEALNAGFEDFKRIRTDPDLANARASEEFDPLLKRFDESFINENAINAIKSLFGFGKK

SEQ ID NO: 164237 - protein, 262 aa, Glycine max
  Coding DNA Sequence Number=SeqID_47459
  Gene Ontology: Mol. function=protein binding; Cellular component =membrane
  Homolog annotation: Hit_ID=Q9AT39; Match level="QueryCoverage=79%, HitCoverage=63%, E-value=1e-78, Identity=71%"; Hit description =SHOOT1 protein
  Subcellular localization annotation: CTP_CleavageSite=65; ConfidenceScore=5.92e-01
MSLPTTTSGHSSLYSAFTLPRTTQIHPTLFSPTTKLFSSRSPSYSGVSHCFSNTLSPRPLPFAVKASSGVGSEASKQENDNSEEEEEEPYEEYEVEIEQPFGLKFAKGRDGGTYIDAIAPGGSADKAGVFNVGDKVIATSAVFGTEIWPAAEYGRTMYTIRQRIGPLLMKMQKRYGKNIDSGGELTEKEIIRAERNSGFISNRVREIQFLFYRKTSLLYFHVGYKHPLSILKLAKISDAKCFEEKGTERAQGKGFEGRITTV

SEQ ID NO: 164238 - protein, 93 aa, Glycine max
  Coding DNA Sequence Number=SeqID_47460
  Pfam annotation: Domain name=Chromo; Domain location=1-55; Score =31.8; E_value=2.5e-06; Accession=PF00385.14; Description='chromo' (CHRromatin Organisation MOdifier
MYPVKVLGSRVTVQGGVSIPQSLIQWNKKSIDDVTWEDNAVIRGQFPNFSLEDKALSEEGGNDRNVNEELGLDSPKPKVWRVYERKRGKRVTK

SEQ ID NO: 164239 - protein, 104 aa, Glycine max
  Coding DNA Sequence Number=SeqID_47461
  Subcellular localization annotation: CTP_CleavageSite=35; ConfidenceScore=5.21e-01
MFPIFSANDMSKKDIYINCQPKKPKYNILNFSFTKVMKRRRRMEATNFPNLFTILPNLGILSLNVTCHAIMAIFTNIKNKVAAAFFVNFSGVIEYLLEHLVATV

SEQ ID NO: 164240 - protein, 100 aa, Glycine max
  Coding DNA Sequence Number=SeqID_47462
MTINGDNVVGGDKGDINGGDSDECGISGGENYSDVDCSGTERGDIVVSGDDNINGGSNNVGNNNNDNIDNGDNNSGDNDVRDDNVNDNDDHSDDGVICAV

SEQ ID NO: 164241 - protein, 59 aa, Glycine max
  Coding DNA Sequence Number=SeqID_47463
MVRCGGCKFVCWVDPKRGRINWREVRTKTKKEEGFSKRKRERDSVEGCGSHQSIEFHPM

SEQ ID NO: 164242 - protein, 694 aa, Glycine max
  Coding DNA Sequence Number=SeqID_47464
  Gene Ontology: Mol. function=protein binding; Cellular component =cytoplasm
  Homolog annotation: Hit_ID=Q10CW7; Match level="QueryCoverage=80%, HitCoverage=79%, E-value=1e-123, Identity=46%"; Hit description =YT521-B-like family protein, expressed
  Pfam annotation: Domain name=YTH; Domain location=484-575; Score =169.8; E_value=7.1e-48; Accession=PF04146.6; Description=YT521-B -like family
ATGNQYGSVDSGNAANGQIPSYDRSVTPVLQDFIDPTMCYLPNGYPSTAYYYGGYDGTGNEWDDYSRYVNSEGVEMTSASIFTFLLSKILGVYGDNGSLLYHHGYGYAPYGPYSPAGSPVPTMGNDGQLYGPQHYQYPPYFQPLTPTSAPFTPTPAVLPQGEVSTSVAADQKPLPVEAANGNSNGVSNGGNAKGNNAAAPIKQANQNSSFSSKASNERVAMPGRGPTSGYQDPRFGYDGVRSPIPWLDAPLFSDGQPRPVSSTTITSSISGGNNTASRSQTFRPNSQFMGLHHPRPMPAMGATHSFINRMYPNKLYGQYGNTVRSGMGYGTHGYDSRANGRAWLAVDSKYKTRGRSGGYFGYGNENVDGLNELNRGPRAKGGKNQKGFAPTILAVKGQNLPASLGTDEEKDKTSTVPDRDQYNKADFPEEYTDAKFFVIKSYSEDDIHKSIKYNVWASTQNGNKKLDAAYHEAQQKPGGCPVFLFFSVNTSGQFVGLAEMIGPVDFNKSVEYWQQDKWNGCFPLKWHVVKDVPNNLLRHITLDNNENKPVTNSRDTQEVWEGKPADEKIEINGEVNTQKSEVSSEVLKESLAEKDSDDHKVPENGCATKTGDAPKGAKPVVPESKIVANGSEDRDWLPSEDKDLYIEIGWAELLHRMLAPIPSHWVLFTVSSFTLLLSTGVEARWEILKNIVGF

SEQ ID NO: 164243 - protein, 39 aa, Glycine max
  Coding DNA Sequence Number=SeqID_47465
MATYPDAFPEDSSSEVIDRRPDLEMSKWRGYNSGAHEKR

SEQ ID NO: 164244 - protein, 143 aa, Glycine max
  Coding DNA Sequence Number=SeqID_47466
  Gene Ontology: Mol. function=oxidoreductase activity
  Homolog annotation: Hit_ID=Q1T3K1; Match level="QueryCoverage=97%, HitCoverage=40%, E-value=2e-31, Identity=50%"; Hit description=2OG -Fe(II) oxygenase
MDYEPPFLETYKALVQNHVDDSKNDSSLVERCELPVIDLGKFNYERDECEKEIAEAANKWGFFQVVNHGISQELLKSLEFEQKKLFYQPFVNKSAKFNFSSLSAKTYRWGNPFATNLRQLSWSEAFHFYLSDISWMDQHHSMR

SEQ ID NO: 164245 - protein, 478 aa, Glycine max
  Coding DNA Sequence Number=SeqID_47467
  Gene Ontology: Mol. function=protein dimerization activity; Cellular component=nucleus; Biological process=regulation of transcription, DNA-dependent
  Homolog annotation: Hit_ID=Q5D1M3; Match level="QueryCoverage=99%, HitCoverage=56%, E-value=0.0, Identity=83%"; Hit description=Class III HD-Zip protein 4
  Pfam annotation: Domain name=MEKHLA; Domain location=329-478; Score =291.5; E_value=1.6e-84; Accession=PF08670.1; Description=MEKHLA domain
ALRNVRQIAQESSGEVQYGGGRQPAVLRTFSQRLCKGFNDAVNGFVDDGWSLMGNDGVEDVTIGINSSPNKFFSSHYNTSMLPAFGGGVLCAKASMLLQNVPPALLVRFLREHRSEWANYGVDAYSSACLKASPYAVPCARPSGFPSSHVIIPLAHTIEHEEFLEVVRIEGNAFPPDDVALACDMYLMQLCSGIDENAIGACAQLVFAPIDESFADDALLLPSGFRIIPLDPKTDGPASTRTLDLASTLETGSGNARSAGESDLNNYNLRSVLTIAFQFTFENHLRDNVAVMARQYVRNVVRSVQRVAMAIAPSRISTQLGPKSLPGPPEALTLARWICKSYSLHTCTELFSVESTSGDAILKQLWHHPDAILCCSVKTNASPVFTFANQAGLDMLETTLVALQDIMLDKVLDEAGRKFLCIEFSKIMQQGFAYLPAGICVSSMNRPVSYEQAIAWKVLDDDDSNHCLAFVFMNWSFV

SEQ ID NO: 164246 - protein, 87 aa, Glycine max
  Coding DNA Sequence Number=SeqID_47468
MEDQGCTTKKTAFYIAQLTSVIAKTDVNESTVAFFRLRFRDCNHIVEIVFATYPLSSCLSQIGLHFRDCNHIVEFAFVEFVSALPSK

SEQ ID NO: 164247 - protein, 95 aa, Glycine max
  Coding DNA Sequence Number=SeqID_47469
  Subcellular localization annotation: CTP_CleavageSite=31; ConfidenceScore=5.09e-01
MSSHQFGGSNKRILLHVIYCCPSAPTNEGSRSSKVPTTRYKNCKGNSLSVPTQHSHLGKLGSKCRGHLIMHEQLPFAHGDQPESLGSSKLSDMPP

SEQ ID NO: 164248 - protein, 236 aa, Glycine max
  Coding DNA Sequence Number=SeqID_47470
  Gene Ontology: Mol. function=sequence-specific DNA binding; Cellular component=nucleus; Biological process=regulation of transcription, DNA-dependent
  Homolog annotation: Hit_ID=Q6Q4E9; Match level="QueryCoverage=89%, HitCoverage=24%, E-value=3e-98, Identity=84%"; Hit description =PHAVOLUTA-like HD-ZIPIII protein
  Pfam annotation: Domain name=Homeobox; Domain location=36-94; Score =64.0; E_value=5e-16; Accession=PF00046.19; Description=Homeobox domain
  Pfam annotation: Domain name=bZIP_1; Domain location=75-135; Score =10.5; E_value=0.011; Accession=PF00170.11; Description=bZIP transcription factor
  Pfam module annotation: Pfam domain module=Homeobox::bZIP_1; Domain location=36-94::75-135
MKECGGSLGGEGKEEEDYSKQRDSASNKQQLMDCGKYVRYTPEQVEALERVYIECPKPSSSRRQQIIRECPLLANIETKQIKVWFQNRRCREKQRKEASRLQTVNRKLSAMNKLLMEENDRLQKQVSQLVYDNGFMKQQIHTASATTTTDNSCESVVVSGQRQHQNPKIQHPQWDANNPAGLLAIAQETLAAFLSKATGTAVNWVQMIGMKPGPDSIGIVAVSRNCSGVAARACGL

SEQ ID NO: 164249 - protein, 379 aa, Glycine max
  Coding DNA Sequence Number=SeqID_47471
  Gene Ontology: Mol. function=transferase activity, transferring phosphorus-containing groups; Cellular component=membrane; Biological process=two-component signal transduction system (phosphorelay)
  Homolog annotation: Hit_ID=Q3BU56; Match level="QueryCoverage=33%, HitCoverage=96%, E-value=8e-55, Identity=87%"; Hit description =Chemotaxis response regulator CheY
MGLQHRLAGTRGAQRFFSGMAQLDHGGDAEESGAALERVIAAEHRVELIAVLRCLLQRHQLFAEAIQDFLCLDDEIGSDVVGYRAHAYSPRSDNRSSASFCETAWRSSPFSAGPASSGSGSGRSRSGCGGCARAARPGPAAGLRRAAVRSGCGIPRPGPGCGAWPARSSPPRGPGARRHRPVHRLRSARSAVHPAPVPVRGPAARAHSSSAACAARPVRRCAAARRPRHRTPVRPGLPAGAGRGRSCRPWYPSGAGRQAFEDLAELLFQRLRGERLDDVAVHAALGGFDDLLTLGFCRDHQHRQGLQLGIGTDRLEQLDAGHHRHVPVGDHEIERLALQQRQRSMPVLGFGGVGEAQIAQQVLDDSTHGREVVDDQDAH

SEQ ID NO: 164250 - protein, 120 aa, Glycine max
  Coding DNA Sequence Number=SeqID_47472
  Gene Ontology: Mol. function=RNA-directed DNA polymerase activity; Biological process=RNA-dependent DNA replication
MDVIAKLPPPTDERGVRSFHVHVGFYRSFIKDFFKIAKLLSNLLEFDLEIKDKKRSENLVVDHLFRLVSKEVTSKEQDVHDTFPDEALLVVHEYCWDVANCKAVMVIPEGMNWQQKKRFF

SEQ ID NO: 164251 - protein, 191 aa, Glycine max
  Coding DNA Sequence Number=SeqID_47473
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=98%, HitCoverage=27%, E-value=2e-95, Identity=92%"; Hit description=DNA -directed RNA polymerase beta' chain
  Pfam annotation: Domain name=RNA_pol_Rpb1_1; Domain location=5-162; Score=-105.4; E_value=1.2e-05; Accession=PF04997.3; Description=RNA polymerase Rpb1, domain 1
MDSSLIEWKELGEEGSPDNENEWEDRKVGRRKNFLVRRIELAKHFLRTNIEPEWMVLCLLPVLPPELRPIIQIDGGKLMSSDINELYRRVIYRNNTLIDLLTTSRSTPGELVMCQEKLVQEAVDTLLDNGIRGQPMRDGHNKVYKSFSDIIEGKEGRFRETLLGKRVDYSGRSVIVVGPSLSLHRCGCPAK

SEQ ID NO: 164252 - protein, 192 aa, Glycine max
  Coding DNA Sequence Number=SeqID_47474
  Gene Ontology: Mol. function=sequence-specific DNA binding; Cellular component=intracellular; Biological process=regulation of transcription, DNA-dependent
  Homolog annotation: Hit_ID=Q76FX2; Match level="QueryCoverage=67%, HitCoverage=59%, E-value=4e-24, Identity=43%"; Hit description=CCAAT- box binding factor HAP5 homolog
  Pfam annotation: Domain name=CBFD_NFYB_HMF; Domain location=67-131; Score=67.8; E_value=3.5e-17; Accession=PF00808.13; Description =Histone-like transcription factor (CBFNF-Y) and archaeal histone
  Pfam annotation: Domain name=Histone; Domain location=61-133; Score =28.9; E_value=1.8e-05; Accession=PF00125.14; Description=Core histone H2AH2BH3H4
  Pfam module annotation: Pfam domain module=CBFD_NFYB_HMF::Histone; Domain location=67-131::61-133
MDQNKQGEAAEGGNIGHPAHGKNQEEQSNPMIAPTNPPKKKSLEEQLNDFWAAQREEAKMTTNFKTHSLPLSRIKKIIKTDKDVKMISAETPVVFAKACEMFIKELTIRAWANTEARKGKILSQRDLVSAISQTASFDFLDDIMPKDAGLPRTSIASTENAYLNMPPQQNVAGLPYDAPTMAFPNLNHHAPN

SEQ ID NO: 164253 - protein, 311 aa, Glycine max
  Coding DNA Sequence Number=SeqID_47475
  Homolog annotation: Hit_ID=O64438; Match level="QueryCoverage=72%, HitCoverage=97%, E-value=1e-108, Identity=89%"; Hit description=ARG10
MDASAADNSIPLSLPTKQTVMIPFSVMIITLAKAKRSEREKNVGDLQQFRGVAAGGAGGCRQQNAVAEDDGGEAAEPVRGEQGVGGVAAGGRTRAVGLHAPQRVTVASQDEIFCLFEGALDNLGSLRQQYGLAKSANEVVLVIEAYKALRDRAPYPANRVVCHLSGSFAFIVFDKSTSTLFVASDQAGKVPLYWGITADGYVAFADDADLLKGSCGKSLASFPQGCFYSTAVGGLRCYENPKNKITAIPAEEEEIWGAFFKNRESVICPNSNIRLMSVQTALGTKGKCEVILELKKLELNILYVTRIVSCN

SEQ ID NO: 164254 - protein, 195 aa, Glycine max
  Coding DNA Sequence Number=SeqID_47476
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=83%, HitCoverage=11%, E-value=1e-51, Identity=56%"; Hit description=Chromo
MNKGESSVNVRPYRYLDSQKNELERQVAAMLEADMIRPSRSPFFSLVLLVKKKDGSWRCCVDYRALNAITIKDRFPMTTIDELLDEIGNASWFSKLDLRQGFHQIRMHDNDIPKMAFRTHYGHYEFKVMPFGLTNAPFIIATVFFDDILVYSPSFPAHLQHFDENHETGLIQAKGPSGEGQRSKWRRTKPPSGEG

SEQ ID NO: 164255 - protein, 43 aa, Glycine max
  Coding DNA Sequence Number=SeqID_47477
MGFESDMGRDQGYPISNGYGDDIINFNLSGIRYGYRDILESRD

SEQ ID NO: 164256 - protein, 168 aa, Glycine max
  Coding DNA Sequence Number=SeqID_47478
  Gene Ontology: Mol. function=alpha,alpha-trehalose-phosphate synthase (UDP-forming) activity; Biological process=trehalose biosynthetic process
  Homolog annotation: Hit_ID=P93653; Match level="QueryCoverage=94%, HitCoverage=16%, E-value=5e-40, Identity=60%"; Hit description =Trehalose-6-phosphate synthase
  Subcellular localization annotation: CTP_CleavageSite=29; ConfidenceScore=5.36e-01
MVGFQSDHKPGNKCNGNSNSFPVPDRHVRLMRGRELRKSSKASPDSNNISNVVSEYSEHNLRLREDNSNSAAPFERYLEGVAAAAAAARGAREDGRPFRQRLLVVANRLPVSAIRKGEDLWSLEISAGGLVSALLGVKEFEVRWIGWAGVNVPDEIGQKALTKALAEK

SEQ ID NO: 164257 - protein, 292 aa, Glycine max
  Coding DNA Sequence Number=SeqID_47479
  Gene Ontology: Mol. function=transcription regulator activity; Cellular component=nucleus; Biological process=regulation of transcription
  Homolog annotation: Hit_ID=Q9M8K6; Match level="QueryCoverage=53%, HitCoverage=82%, E-value=2e-51, Identity=66%"; Hit description =Putative helix-loop-helix DNA-binding protein
  Pfam annotation: Domain name=HLH; Domain location=1-50; Score=42.0; E_ value=2e-09; Accession=PF00010.16; Description=Helix-loop-helix DNA -binding domain
  Pfam annotation: Domain name=efhand_like; Domain location=187-265; Score=85.2; E_value=1.9e-22; Accession=PF09279.1; Description =Phosphoinositide-specific phospholipas
  Pfam module annotation: Pfam domain module=HLH::efhand_like; Domain location=1-50::187-265
MSHIAVERNRRRQMNEHLKVLRSLTPCFYIKRGDQASIIGGVIEFIKELHQVRQALESQKRRKSLSPSPGPSPRTLQPTFHQLDSSSMIGTNSFKELGASCNSPVADVEVKISGSNVILKVICHRIPGQVAKIITVLESLSFEVLHLNISSMEETVLVDSRSKAASDDVETNIQRVLLLALAEAPLEINTLFDEYFENELMTPSHLKRFLVKVQRQKKAIEEDAQAIIDSFKNFHRRGVGLNLETFFKYLFSDDNPPLLPSHGVVKVVDFGVVGAQTQSGVMTQLKLEHTVG

SEQ ID NO: 164258 - protein, 317 aa, Glycine max
  Coding DNA Sequence Number=SeqID_47480
  Gene Ontology: Mol. function=pepsin A activity; Biological process =proteolysis
  Homolog annotation: Hit_ID=Q9FSZ9; Match level="QueryCoverage=98%, HitCoverage=99%, E-value=2e-70, Identity=43%"; Hit description =Putative extracellular dermal glycoprotein
MDLVIDLGGPILWNGCDNHYNSSSYNPVHCESKKCPAGSACTGCNGPFKPGCSNDTCGAYILNPFADAIFSGDLGDDVLFLSHTSLSLSGLISGFTSIDDTSLLNNLPKSGKGILGLGSLFIGGAPQIASSKLTLFTTPLVVNPFSTAPVFTEGRLINFKSSLLSIDNKGHGGTKISTMNPFTVVHSAIFKPLVREFSKQAGQRKIRKVAPVAPFGVCFDFSTIGRTVTGLDLPSIELELEGGVKWTIYGGNSMVLVNKKVACLGFVDGGKEPRTSVVIGGHQLEDNLLEFDLVSSKLNFSSSLLLHDNARCSHFRS

SEQ ID NO: 164259 - protein, 325 aa, Glycine max
  Coding DNA Sequence Number=SeqID_47481
  Gene Ontology: Mol. function=alpha,alpha-trehalose-phosphate synthase (UDP-forming) activity; Cellular component=alpha,alpha-trehalose -phosphate synthase complex (UDP-forming); Biological process =trehalose biosynthetic process
  Homolog annotation: Hit_ID=P93653; Match level="QueryCoverage=88%, HitCoverage=32%, E-value=1e-126, Identity=72%"; Hit description =Trehalose-6-phosphate synthase
  Pfam annotation: Domain name=Trehalose_PPase; Domain location=154 -325; Score=110.3; E_value=5.7e-30; Accession=PF02358.7; Description =Trehalose-phosphatase
MEAIFLNKLKSHIHHIYNQKYALTAFTGRYVYILPVSYSDVALVTSLRDGMNLFAGAAQSLGAGAILVNPWNITEVATAIAKALNMPSAEREKRHKHNYEHVKTHTAQEWAETFVSELNDTVVEAQIRTKQVPPRLPTETAVERYLQSNNRLLILGFNGTLTEPVEREGDRFKERELTVHPELKLPLAELCSDPKTTVVVLSGSGRAVLDENFKEYDIWLAAENGMFLNPSKGEWMTTMPEQLNMEWVDSVKHVFDYFTDRTPRSYFEEREASLVWSYRHADAEFGRLQARDMLQHLWTGPISNASVDVVQGSRSVEVRAANVTK

SEQ ID NO: 164260 - protein, 107 aa, Glycine max
  Coding DNA Sequence Number=SeqID_47482
WFCTSNPKASLLHLFSNRIVQQSPPVEILRLDLPTAIVAQRHAPPPPHHRKTSTLSSATPTPSSMCFSSKTSTLHSHANSNGRSGFSAKALTIIFLAPMVPKDMTPP

SEQ ID NO: 164261 - protein, 156 aa, Glycine max
  Coding DNA Sequence Number=SeqID_47483
  Gene Ontology: Mol. function=bile acid:sodium symporter activity; Cellular component=membrane; Biological process=sodium ion transport
  Homolog annotation: Hit_ID=Q606Y6; Match level="QueryCoverage=61%, HitCoverage=40%, E-value=2e-08, Identity=29%"; Hit description=Bile acid transporter family protein
  Subcellular localization annotation: CTP_CleavageSite=24; ConfidenceScore=5.51e-01
ITLRCNSQPQPLPNLFASKSPRVSGSNVAPLRCGISSNEYSANEGRSVGEWLVLAGEVLSTGFPLWVTIASVLGLMKPSYFNWVTPKLSIMGLNIIMLGMGMTLTLDDLRGVLAMPKEVLSGTASNIITYLARANVALSVIMTTASTISAMVGTTF

SEQ ID NO: 164262 - protein, 112 aa, Glycine max
  Coding DNA Sequence Number=SeqID_47484
MDSLCGEVNVLKMIFFLVFQRWATRVYVNNDEACYHGRKEVGLPSQMARFSKTITAISRQQREIKSGFLNRIGIGAKYSTPKDPLNVQVTKIKCLDAEDTCNINISLTSPGE

SEQ ID NO: 164263 - protein, 303 aa, Glycine max
  Coding DNA Sequence Number=SeqID_47485
  Gene Ontology: Mol. function=porin activity; Cellular component =nuclear pore; Biological process=transport
  Homolog annotation: Hit_ID=UPI000016318A; Match level="QueryCoverage =64%, HitCoverage=55%, E-value=1e-46, Identity=42%"; Hit description =transporter
  Pfam annotation: Domain name=Cornifin; Domain location=104-301; Score= -49.4; E_value=0.071; Accession=PF02389.6; Description=Cornifin (SPRR) family
  Subcellular localization annotation: CTP_CleavageSite=23; ConfidenceScore=5.80e-01
MKITLSTAFGQSSSSPFGSQSVFGQTNSSSNNPFAPKPFGSTAPFGSQTGGSIFGGTSTGVFGTAQPSSPFGASSSPAFGSSQPAFVSSSTPAFGSSSSSFGGSSVFGQKPAFGGFGSTPTQTTPFGAAQPSQPAFGSSIFGSSTPFGASSQPAFGATSNPAFGATSTPAFGATSTPAFGATSTPAFGATSTPSFGATSTPAFGATSSPAFGATSAPAFGSTSTPAFGSTGSAFGVSSTPVFGSGGAFGASSNPMFGSSSTSAFGTSSSPFGATSTPAFGASSTPAFSFGSTPQAFGQSSSAF

SEQ ID NO: 164264 - protein, 89 aa, Glycine max
  Coding DNA Sequence Number=SeqID_47486
  Gene Ontology: Mol. function=oxidoreductase activity; Cellular component=membrane; Biological process=potassium ion transport
  Homolog annotation: Hit_ID=Q39224; Match level="QueryCoverage=78%, HitCoverage=19%, E-value=3e-17, Identity=56%"; Hit description=SRG1 protein
MVLISEEANSSLEIPVIDMQRLLSVESGSSELDKLHPACREWGFFQLINPGVSSSLVEKVKLEIQDFFNLPMSETYIISNGIYRSVDHQ

SEQ ID NO: 164265 - protein, 145 aa, Glycine max
  Coding DNA Sequence Number=SeqID_47487
  Homolog annotation: Hit_ID=Q39224; Match level="QueryCoverage=26%, HitCoverage=13%, E-value=1e-09, Identity=61%"; Hit description=SRG1 protein
  Pfam annotation: Domain name=2OG-FeII_Oxy; Domain location=71-145; Score=5.8; E_value=0.032; Accession=PF03171.10; Description=2OG -Fe(II) oxygenase superfamily
MKTLAMEETIKNLSGTSLLVSSVQELAKQNLSSVPQRYIQPQNEDIVSLLSVESCSSKLAKLHLACKQWGFFQTMRMNYYPPCPQPEKVFGLTSHSDAASEVEGLQIRKDGMPSESISTTCPATTPSVLIDFTNSPVTPTTPICL

SEQ ID NO: 164266 - protein, 738 aa, Glycine max
  Coding DNA Sequence Number=SeqID_47488
  Gene Ontology: Mol. function=porin activity; Cellular component =nuclear pore; Biological process=transport
  Homolog annotation: Hit_ID=UPI000016318A; Match level="QueryCoverage =92%, HitCoverage=65%, E-value=1e-154, Identity=45%"; Hit description= transporter
  Pfam annotation: Domain name=Nucleoporin2; Domain location=565-738; Score=109.3; E_value=1.1e-29; Accession=PF04096.4; Description =Nucleoporin autopeptidase
  Subcellular localization annotation: CTP_CleavageSite=57; ConfidenceScore=5.40e-01
IQGTAVSCANVVESHCIFFLAGSQTPTSTFGNTGGQSGFGGQQRGGSRVASYTATTEADSGTSGQTAKLESISAMPIYKDKSHEELRWEDYQLGDKGGSLPSTQSTGLTGFGSSTTQTNAFSPSPVFGQSSANPFSSTAPNSNPFAQKSSPFSSGFGTSAAPAFSSSAFGSSTSAAAPSLFGSSPSPFGANSSSTPGFGQSPSLFNTAPAQATSSPFGNSIFGNTQSSPLFSSAAPTGGQTGSAFGQNTSPFGQTTTPSFSQSSLFSSPSSGLVGSIFSSSAPLTSNNLTGFGQTAPSISTPFQPAQPAQSSGAFGFSNFGQTQPVGASSFGGTPGIFGQNNFGLVSSTPQSSVAVQAVPNTNPFGTLPALPQMSIGRVGTTPSIQYGISSMPALDKPAPVRISSLLTSRHLSQRRIRLPVRKYHSKNDGPKVAFFSDDEDTPTTPKADALFIPRENPRALIICPMEQWPGKVSEKPSTFKDRSIPVNENGNISKDASVTPDRTTSQDKDKEKSAVENGVVKEQAQPITTKPTSNGSNEDHSLQKADVYKTLSGHRAGEAAIVYEHGADVEALMPKLRRSDYYTLPRIHELAAKERAEPGFCSHVKDFVVGRQGYGSIRFLGETDVRRLDLESLIQFNNREVIVYMDDLKKPPVGQGLNKPAEVTLLNIKCFDKKTGHQYTEGPKIEKYKEMLKRKAEDQGAEFLSYDPTKGEWKIRVSHFSIYKLVEDENSWINDDN

SEQ ID NO: 164267 - protein, 834 aa, Glycine max
  Coding DNA Sequence Number=SeqID_47489
  Gene Ontology: Mol. function=protein translocase activity; Cellular component=chloroplast outer membrane; Biological process =intracellular protein transport
  Homolog annotation: Hit_ID=Q1RV20; Match level="QueryCoverage=99%, HitCoverage=65%, E-value=0.0, Identity=63%"; Hit description=AAA ATPase; AIG1
  Pfam annotation: Domain name=AIG1; Domain location=190-381; Score =55.3; E_value=3.2e-15; Accession=PF04548.7; Description=AIG1 family
  Pfam annotation: Domain name=MMR_HSR1; Domain location=190-288; Score= 16.3; E_value=3.2e-05; Accession=PF01926.13; Description=GTPase of unknown function
  Pfam annotation: Domain name=Miro; Domain location=191-308; Score= -8.1; E_value=0.033; Accession=PF08477.3; Description=Miro-like protein
  Pfam module annotation: Pfam domain module=AIG1::MMR_HSR1::Miro; Domain location=190-381::190-288::191-308
MEGDVGQHGDREIDDSVLDGEIGSHVEEIGGNGEREINGSVSDEKGDGLVFGSTEAANKFLEDLELHQSRDAERIVTDSDEEEESDDEGEGKELFDTATLAALLKAASGADQDGGSITITSQDGSRLFSVERPAGLGSPLQSEESIAAQVLYRMTLVAGRQSGQMFSVESAKETASRLEAEGRDDFDFSVNILVLGKAGVGKSATINSIFGETKTSINACGPATTSVKEIVGVVDGVKLRIFDTPGLKSSALEQNFNMKVLSAVKKLTKKSPPDIVLYVDRLDLQTRDMNDLPMLRSITSVLGSSIWRNVIVTLTHAASAPPDGPSGAPLSYEVFVAQRSHTVQQTIGQAVGDLRLMNPSLMNPVSLVENHPSCRKNRDGQKVLPNGQSWRPLLLLLCFSMKILSDASNSTKTQESFDHRRLFGFRPRSPPLPYLLSSLLQTHTYPKLPADQSGPDNGDSDVEMADLSDSDLDEDEDEYDQLPPFKPMKKSQVAKLTKEQQKAYFDEYDYRVKLLQKKQWREELRRMREMKKKGNTKENDYGYMEEDDQENGSPAAVPVPLPDMAMPPSFDSDNPAYRYRFLEPTSQLLTRPVLDNHGWDHDCGYDGVNIEQSLAIINKFPAAVTVHVTKDKKDFTIQLDSSVAAKLGENGSAMAGFDIQSVGKQLSYSVRGETKLKNFKRNKTSAGVSVTYLGENVCTGLKVEDQIAVGKRLVLVGSTGVVKSKTDSAYGANVEVRLREADFPIGQDQSSLSLSLVKWRGDLALGANLQSQISVGRGYKVAVRAGLNNKLSGQITVRTSSSDQLQIALVAILPIAKAIYKNFWPGASENYSIY

SEQ ID NO: 164268 - protein, 214 aa, Glycine max
  Coding DNA Sequence Number=SeqID_47490
  Gene Ontology: Mol. function=transcription factor activity; Cellular component=nucleus; Biological process=regulation of transcription, DNA-dependent
  Homolog annotation: Hit_ID=Q84JP1; Match level="QueryCoverage=72%, HitCoverage=75%, E-value=3e-45, Identity=60%"; Hit description =Nuclear transcription factor Y subunit A-7
  Pfam annotation: Domain name=CBFB_NFYA; Domain location=119-175; Score=137.5; E_value=3.6e-38; Accession=PF02045.6; Description=CCAAT- binding transcription factor (CBF-BNF-YA) subunit B
MASSYTIFKLKQNVYPDNEDDGQQQSESQIQSPSANGISDPDISTQNVNVQYATPGQLGTGHAMVPPVYPYPDPYYRSIFAPYDTQPYPPQAYSGQPMVHLQLMGIQQAGVPLPTDAVEEPVFVNAKQYHGILRRRQSRAKAESENKVIRNRKPYLHESRHKHALRRPRGCGGRFLNSKKDENQHDDVTSADKSQSNINLNSNKNDQTSSDRTS

SEQ ID NO: 164269 - protein, 317 aa, Glycine max
  Coding DNA Sequence Number=SeqID_47491
  Gene Ontology: Mol. function=phosphatidylinositol-3,4,5-triphosphate binding; Cellular component=intracellular; Biological process =regulation of GTPase activity
  Homolog annotation: Hit_ID=Q1RV25; Match level="QueryCoverage=98%, HitCoverage=91%, E-value=1e-145, Identity=80%"; Hit description=C2; Arf GTPase activating protein
  Pfam annotation: Domain name=ArfGap; Domain location=4-126; Score =154.9; E_value=2.1e-43; Accession=PF01412.9; Description=Putative GTPase activating protein for Arf
  Pfam annotation: Domain name=C2; Domain location=163-242; Score =102.7; E_value=1.1e-27; Accession=PF00168.20; Description=C2 domain
  Pfam module annotation: Pfam domain module=ArfGap::C2; Domain location=4-126::163-242
MQSKRRLQDLLLQKDNRFCADCNAPDPKWASANIGVFVCLKCCGVHRSLGSQISKVLSVTLDEWSSDEIDAMIEVGGNSSANSIYEAYFPEGFTKPGPDATHDQRVKFIRLKYEHQEFLQPSLRIVSGKSNPPKSISKGIMDSFRITSDSQHMEGMVEFIGMLKVKVIKGTDLAIRDMMTSDPYVILKLGQQTVQTTVIKSNLNPVWNEELMLSVPQQFGILNLNVFDYDLFSADDIMGEADIDLQPLITSAIAYGDARMFDDMQIGKWLKSNGNALIDDSIVNIVDGKVKQVISLKLQNVESGELDLELEWMPLDY

SEQ ID NO: 164270 - protein, 579 aa, Glycine max
  Coding DNA Sequence Number=SeqID_47492
  Gene Ontology: Mol. function=binding; Cellular component =intracellular; Biological process=metabolic process
  Homolog annotation: Hit_ID=Q1RV29; Match level="QueryCoverage=99%, HitCoverage=94%, E-value=0.0, Identity=55%"; Hit description =Tetratricopeptide-like helical
  Pfam annotation: Domain name=PPR; Domain location=173-207; Score =40.8; E_value=4.8e-09; Accession=PF01535.11; Description=PPR repeat
  Pfam annotation: Domain name=PPR; Domain location=274-308; Score =39.3; E_value=1.3e-08; Accession=PF01535.11; Description=PPR repeat
  Pfam annotation: Domain name=PPR; Domain location=309-342; Score=4.3; E_value=2.3; Accession=PF01535.11; Description=PPR repeat
  Pfam annotation: Domain name=PPR; Domain location=345-379; Score =14.2; E_value=0.16; Accession=PF01535.11; Description=PPR repeat
  Pfam annotation: Domain name=PPR; Domain location=411-445; Score=2.9; E_value=3.4; Accession=PF01535.11; Description=PPR repeat
  Pfam annotation: Domain name=PPR; Domain location=7-41; Score=12.8; E_ value=0.23; Accession=PF01535.11; Description=PPR repeat
  Pfam annotation: Domain name=PPR; Domain location=71-105; Score=28.6; E_value=2.2e-05; Accession=PF01535.11; Description=PPR repeat
  Pfam module annotation: Pfam domain module=PPR::PPR::PPR::PPR::PPR::PP R::PPR; Domain location=173-207::274-308::309-342::345-379::411 -445::7-41::71-105
MPRRTVVSWTTLVDGLLRLGIVQEAETLFWAMEPMDRDVAAWNAMIHGYCSNGRVDDALQLFCQMPSRDVISWSSMIAGLDHNGKSEQALVLFRDMVASGVCLSSGVLVCGLSAAAKIPAWRVGIQIHCSVFKLGDWHFDEFVSASLVTFYAGCKQMEAACRVFGEVVYKSVVIWTALLTGYGLNDKHREALEVFGEMMRIDVVPNESSFTSALNSCCGLEDIERGKVIHAAAVKMGLESGGYVGGSLVVMYSKCGYVSDAVYVFKGINEKNVVSWNSVIVGCAQHGCGMWALALFNQMLREGVDPDGITVTGLLSACSHSGMLQKARCFFRYFGQKRSVTLTIEHYTSMVDVLGRCGELEEAEAVVMSMPMKANSMVWLALLSACRKHSNLDLAKRAANQIFEIEPDCSAAYVLLSNLYASSSRWAEVALIRRKMKHNGVVKKPGSSWLTLKGQKHKFLSADRSHPLAEKIYQKLEWLGVKLKELGYVPDQQFALHDVETEQKEEMLSYHSERLAIAFGLLSTVEGSAITVMKNLRVCGDCHNAIKLMAKIVDREIVVRDSSRFHDFKNGICSCGDYW

SEQ ID NO: 164271 - protein, 1193 aa, Glycine max
  Coding DNA Sequence Number=SeqID_47493
  Gene Ontology: Mol. function=nucleoside-triphosphatase activity; Cellular component=membrane; Biological process=defense response
  Homolog annotation: Hit_ID=Q1RV15; Match level="QueryCoverage=12%, HitCoverage=39%, E-value=3e-57, Identity=77%"; Hit description =Protein kinase
  Pfam annotation: Domain name=LRR_1; Domain location=433-454; Score =0.5; E_value=2.3e+02; Accession=PF00560.23; Description=Leucine Rich Repeat
  Pfam annotation: Domain name=LRR_1; Domain location=529-552; Score =10.2; E_value=3.4; Accession=PF00560.23; Description=Leucine Rich Repeat
  Pfam annotation: Domain name=LRR_1; Domain location=554-575; Score =10.7; E_value=2.9; Accession=PF00560.23; Description=Leucine Rich Repeat
  Pfam annotation: Domain name=LRR_1; Domain location=577-599; Score =6.3; E_value=19; Accession=PF00560.23; Description=Leucine Rich Repeat
  Pfam annotation: Domain name=LRR_1; Domain location=601-622; Score =16.1; E_value=0.13; Accession=PF00560.23; Description=Leucine Rich Repeat
  Pfam annotation: Domain name=LRR_1; Domain location=847-871; Score =1.7; E_value=1.4e+02; Accession=PF00560.23; Description=Leucine Rich Repeat
  Pfam annotation: Domain name=LRR_1; Domain location=928-951; Score =1.7; E_value=1.4e+02; Accession=PF00560.23; Description=Leucine Rich Repeat
  Pfam annotation: Domain name=NB-ARC; Domain location=164-429; Score= -98.1; E_value=0.0005; Accession=PF00931.13; Description=NB-ARC domain
  Pfam annotation: Domain name=Pkinase_Tyr; Domain location=1081-1190; Score=-163.2; E_value=0.019; Accession=PF07714.7; Description =Protein tyrosine kinase
  Pfam module annotation: Pfam domain module=LRR_1::LRR_1::LRR_1::LRR _1::LRR_1::LRR_1::LRR_1::NB-ARC::Pkinase_Tyr; Domain location=433 -454::529-552::554-575::577-599::601-622::847-871::928-951::164 -429::1081-1190
MHRGLASIITGIREMGSRLSKARGSLKNESEGTSSGKNEVSYEELSRLMRIRDLMSLLLTYPMKMDEGGKLKSCISAFPEWKAQLLSTDHDTIVMDKPWRVLTEKALGCMKGFMPTEIISKIESGERSIFNHNDADAIPKAILHLTVDLAVNQLIQTLFSGDYYARYISLSSRNLAEKRSVVNKIEAAFEEKHNMFGIDKDFLSALWINSSTYKTDAEIRVQEEINNKMAAGFSETKGGEEKMNRHLVIVVDADSNKKLDLHKVRFPTGVVVVLITTELKDDDFRITSMMDLNIRTQDHLLPWELFCSYVGSSKVCSSLVIQRIAVQIVKECHGHLLAVVLVANYLKNVEDVKQWQVALDKLSSSLNPSYDYRDSDGIGISRVMVNAFVDIIWEDIDDTQKLCLELSLSVHNIKIGKRLAILVSDWADILSGHTQEMKLNSNEFGEYIRHIRVLLDRFVFLKIERGDVYLPVETYDIIKSLHTLNPSIIRHDALGFLEPPCIERWHNLIRIELMDDKICELPESPECPKLRVLLLQGNVDLMDIPDSFFEHMPLLQQLDLSYTSIRDLPSSVSKLTQLKKFYLRGCDLFMELPPQIGLLKNLEELDLDGTLITHLPKEIRELINLRSLTLCFDGYHHVLGHGNKGKQISNSTIIPTGLISNLTQLNYLNIKVDPEDERWNDNVNIVFVEIIGLKRLETVSIYIPKANLLKLIPVHKSLNFRLVVGNHMRRFISRVTPELEEKFKRCDYSIKFVNGVNVPNVVKMTLGNFKALYLDRHMTIKSLSDFELRNLSGLQICVLAECNQMETIVDRSYLHDGPALPNLEFLSVFYMKNLKSLCERPNPSFLRLKSIALHTCPMLTTVFTEDSLKDLSLLEEIIIEDCPKVTTLIRHDSSEIKTRFTMPKLRKISLLYLPELVNIFNGLHVEHDVEKMVFYYCPKLQSLSQWELSKASVKIIIGESVWWEALKWNAAEWGDAGRPNVFERIFSPISEEADIMTQLAAHQETQLSTDHDEFLSLMCISFVLISLIDSPKRQNQGTKQRHDDSKLPSNPEEVEDLRRDSAANPLIAFTYDELKIITENFRQDRVLGGVGFGRVYKGFISEELIRKGLPTLDVAVKVHDGDNSHQGHREWLSQVEFWGQLSHPNLVKVIGYCCEDNHRVLIYEYMSRGGLDNYLFKYGYVSIHVIIDGLWIS

SEQ ID NO: 164272 - protein, 1047 aa, Glycine max
  Coding DNA Sequence Number=SeqID_47494
  Gene Ontology: Mol. function=protein-tyrosine kinase activity; Cellular component=integral to membrane; Biological process=protein amino acid phosphorylation
  Homolog annotation: Hit_ID=Q7EYF8; Match level="QueryCoverage=99%, HitCoverage=98%, E-value=0.0, Identity=57%"; Hit description =Putative phytosulfokine receptor
  Pfam annotation: Domain name=LRRNT_2; Domain location=5-51; Score =53.3; E_value=8.2e-13; Accession=PF08263.3; Description=Leucine rich repeat N-terminal domain
  Pfam annotation: Domain name=LRR_1; Domain location=103-125; Score =14.5; E_value=0.39; Accession=PF00560.23; Description=Leucine Rich Repeat
  Pfam annotation: Domain name=LRR_1; Domain location=127-149; Score =17.3; E_value=0.054; Accession=PF00560.23; Description=Leucine Rich Repeat
  Pfam annotation: Domain name=LRR_1; Domain location=151-173; Score =13.3; E_value=0.9; Accession=PF00560.23; Description=Leucine Rich Repeat
  Pfam annotation: Domain name=LRR_1; Domain location=175-197; Score =14.0; E_value=0.56; Accession=PF00560.23; Description=Leucine Rich Repeat
  Pfam annotation: Domain name=LRR_1; Domain location=199-221; Score =13.0; E_value=1; Accession=PF00560.23; Description=Leucine Rich Repeat
  Pfam annotation: Domain name=LRR_1; Domain location=251-273; Score =10.5; E_value=3; Accession=PF00560.23; Description=Leucine Rich Repeat
  Pfam annotation: Domain name=LRR_1; Domain location=277-298; Score =15.9; E_value=0.15; Accession=PF00560.23; Description=Leucine Rich Repeat
  Pfam annotation: Domain name=LRR_1; Domain location=300-319; Score =8.6; E_value=7.1; Accession=PF00560.23; Description=Leucine Rich Repeat
  Pfam annotation: Domain name=LRR_1; Domain location=326-347; Score =5.9; E_value=23; Accession=PF00560.23; Description=Leucine Rich Repeat
  Pfam annotation: Domain name=LRR_1; Domain location=348-369; Score =10.9; E_value=2.6; Accession=PF00560.23; Description=Leucine Rich Repeat
  Pfam annotation: Domain name=LRR_1; Domain location=392-413; Score =14.0; E_value=0.53; Accession=PF00560.23; Description=Leucine Rich Repeat
  Pfam annotation: Domain name=LRR_1; Domain location=415-434; Score =11.3; E_value=2.2; Accession=PF00560.23; Description=Leucine Rich Repeat
  Pfam annotation: Domain name=LRR_1; Domain location=439-461; Score =5.4; E_value=28; Accession=PF00560.23; Description=Leucine Rich Repeat
  Pfam annotation: Domain name=LRR_1; Domain location=463-486; Score =9.4; E_value=4.9; Accession=PF00560.23; Description=Leucine Rich Repeat
  Pfam annotation: Domain name=LRR_1; Domain location=489-511; Score =17.5; E_value=0.049; Accession=PF00560.23; Description=Leucine Rich Repeat
  Pfam annotation: Domain name=LRR_1; Domain location=513-535; Score =13.6; E_value=0.73; Accession=PF00560.23; Description=Leucine Rich Repeat
  Pfam annotation: Domain name=LRR_1; Domain location=537-556; Score =11.7; E_value=1.9; Accession=PF00560.23; Description=Leucine Rich Repeat
  Pfam annotation: Domain name=LRR_1; Domain location=559-581; Score =8.6; E_value=6.9; Accession=PF00560.23; Description=Leucine Rich Repeat
  Pfam annotation: Domain name=LRR_1; Domain location=79-101; Score =12.7; E_value=1.2; Accession=PF00560.23; Description=Leucine Rich Repeat
  Pfam annotation: Domain name=Pkinase; Domain location=765-1044; Score= 2.9; E_value=9.7e-09; Accession=PF00069.15; Description=Protein kinase domain
  Pfam annotation: Domain name=Pkinase_Tyr; Domain location=756-1044; Score=-2.4; E_value=2.5e-12; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::Pkinase::Pkinase_Tyr; Domain ...
  Pfam module annotation: Pfam domain module=location=5-51::103 -125::127-149::151-173::175-197::199-221::251-273::277-298::300 -319::326-347::348-369::392-413::415-434::439-461::463-486::489 -511::513-535::537-556::559-581::...
  Pfam module annotation: =79-101::765-1044::756-1044
MAELPSQDILALLEFKKGIKHDPTGYVLSSWNEDSVDVDGCPSSWNGVLCNGSDVAGIVLDNLGLAADANLSVFSNLTKLVKLSMSNNSISGKLPGNIAEFKSLEFLDVSNNLFSSSLPVGIGKLSSLQNLSLAGNNFSGSIPDSISGMASIQSLDLSCNSFSGPLLASLTKLTNLVSFNLSHNCFTGKIPKGFELIFSLEKIDLHGNMLEGHLDDEFILFSSASYVDFSENMLVSSNSQQQKSLPQLSESIKYLNLSHNRLTGSLVSGGKQPNFEYLKVLDLSYNQLSGELPEFDFVYELMVLKLSNNRFSGFVPSGLLKGDSLVLTELDLSGNNLLGPVSIIASTTLYFLNLSSNGFTGELPLLTGSCAVLDLSNNKLEGNLTRMMKWGNIEFLDLSRNHLIGSIPEVTQFFRLNYLNLSHNFLSSSLPKVLTQYPKLRMLDVSSNQLDGKFLIDLVTMPTLQELHLGNNTISGGISLSSFPPRPFNLQILELSYNHFNGSFPAEFGSLTGLKVLNIAGNHFSGSLPTTIANMSSLDSLDISENNFTGPLPNNIPKGLKKFNASNNDLSGVVPENLRKFPSSSFYPGNDRLHFPNDPSGSTNKSDESSNRKSISSIVKVIIIVSCVVAVLFMLVLLVVIIHYTRISRSPSEYATAKDMREHAQPQTTGPGHAKDSIGALVVSAEDFVTSQKGSSSEIISHDEKMAAATRFSPSKNSHFSSPGSSDSVSVGNHARLYARSADKLTGELYFLDDAITLTHEELSGAPAEVLGRSSHGTSYKATLEHGLLLRVKWLREGMATKRKEFTKEAKKIANIRHPNVVGLKGYYWGPTQHEKLIISDYISPGSLASFLYDRPGQEDPPLTWALRLKIAVDIARGLNYLHFDRAVPHGNLKATNVLLDTCDLHARVADYCLHKLMTQAGTFEQMLDAGVLGYRAPELSASKKPMPSFKSDVYAFGIILLELLTGRCAGDVVSGEKEGVDLANWVRLHVAQGRGSECFDDALVQEISNSIVEKGMNEVLGIAIRCIRSVSDRPGIRTIYEDLSSI

SEQ ID NO: 164273 - protein, 181 aa, Glycine max
  Coding DNA Sequence Number=SeqID_47495
  Gene Ontology: Mol. function=protein kinase activity; Cellular component=chloroplast; Biological process=protein amino acid phosphorylation
  Homolog annotation: Hit_ID=Q1RV15; Match level="QueryCoverage=96%, HitCoverage=45%, E-value=6e-68, Identity=73%"; Hit description =Protein kinase
  Pfam annotation: Domain name=Pkinase; Domain location=2-181; Score= -57.4; E_value=3.9e-05; Accession=PF00069.15; Description=Protein kinase domain
  Pfam annotation: Domain name=Pkinase_Tyr; Domain location=1-181; Score=-123.6; E_value=7e-05; Accession=PF07714.7; Description =Protein tyrosine kinase
  Pfam module annotation: Pfam domain module=Pkinase::Pkinase_Tyr; Domain location=2-181::1-181
MATPAIPPLSWSMRMKIAFGAAKGLAFLHEAEKTVIYRCFKTSNILLDQEYNSKLSDFGLAKFGPVGDKSHVSTRVMGTYGYAAPEYLATGHLYIKSDVYSFGVVLLELLTGRRSLDTTFDGEQKLAEWAHSLLKEKKKLLKIIDPRLDGDYPIKAVHKAAMLAYHCLNRDPKARPLMREI

SEQ ID NO: 164274 - protein, 146 aa, Glycine max
  Coding DNA Sequence Number=SeqID_47496
  Gene Ontology: Mol. function=amidophosphoribosyltransferase activity; Cellular component=chloroplast; Biological process=purine base biosynthetic process
  Homolog annotation: Hit_ID=Q1S399; Match level="QueryCoverage=50%, HitCoverage=13%, E-value=3e-27, Identity=78%"; Hit description =Purine/pyrimidine phosphoribosyl transferase
MPISIQWCPFSESVFPLNLDPQPTSITHKPLKFDETSFRSENNNTVASLSHNQRPKPKRVANGDKLVLGDEDKRVSPFELFIGVNDSQNEGFLFRGFDEVENNLSVGGGDFRDEAHAGDGLEDVVVDGDNFGTFLAAVLEGKVVEA

SEQ ID NO: 164275 - protein, 379 aa, Glycine max
  Coding DNA Sequence Number=SeqID_47497
  Gene Ontology: Mol. function=nucleoside-triphosphatase activity; Biological process=defense response
  Homolog annotation: Hit_ID=Q9T048; Match level="QueryCoverage=91%, HitCoverage=35%, E-value=3e-14, Identity=27%"; Hit description =Putative disease resistance protein At4g27190
  Pfam annotation: Domain name=NB-ARC; Domain location=138-378; Score= -12.9; E_value=1.8e-09; Accession=PF00931.13; Description=NB-ARC domain
MSGVEVVAPLVGEVGALGVGELHTTIASKIASSRNLDDNYNILLKDMEKLLAIKKDKEREIQRNNHKDTTNAYKLWTNRVSDAAEEVQKLKVKYKEKMLPWWRIRRRSRLSENMVKKSNCVRELVKDECLRDFLVDKPPEPVLKELNVPRISGYPTLQDALEKTLGLLRNNKIKVIGVCGTKGVGKTTIMRNLNNNEEVAKLFEIVIFVKATTDDHMLQEKIANRLMLDIGTNKEHSDDVARRIHKELEKKKYLLILDEVEDAINLEQLGIPTGINGSKVVIATRFPRVYKLNRVQRLVKVEELTPDEAWKMFRDTVHAFNPKIDSLDIQPIAQLVCQRCSCLPLLIYNIANSFKLKESASSWSVGLEDLKPWPELQNQ

SEQ ID NO: 164276 - protein, 197 aa, Glycine max
  Coding DNA Sequence Number=SeqID_47498
  Gene Ontology: Mol. function=carboxypeptidase activity; Biological process=intracellular signaling cascade
  Homolog annotation: Hit_ID=Q5VQ36; Match level="QueryCoverage=41%, HitCoverage=19%, E-value=3e-18, Identity=50%"; Hit description=Leaf senescence protein-like
  Subcellular localization annotation: CTP_CleavageSite=30; ConfidenceScore=5.13e-01
MLEKTMKTSSTMFQDRHHNHSSGKKERCLSLTLGKGVPFVLTSLLMASIFSLFFLYNPNPLTLTPHQGHDMFENPSDPKQEEHPITTTKVSPSKPQKEQKTCDLSKGNWVPVLRGSSTYYTNSSCTTIPDSKNCFKQGRVDTDFLNWKWKPEQCDLPRFDPRTFLHMVRGKKMAFIGDSVARNHVDSLLCLLSQVSV

SEQ ID NO: 164277 - protein, 182 aa, Glycine max
  Coding DNA Sequence Number=SeqID_47499
  Gene Ontology: Mol. function=calmodulin binding
  Homolog annotation: Hit_ID=Q9FL13; Match level="QueryCoverage=97%, HitCoverage=98%, E-value=2e-61, Identity=60%"; Hit description =Arabidopsis thaliana genomic DNA, chromosome 5, P1 clone:MSN9
MSQQGFAIELYLEPALENQVLKAWNVLARRQISTELIEMESRPHITLFSAPFLEPSKLDSLLKVFASKHDPLPLTFSSLATFPNNLLFLAPTPSLSLLHFQSQLCDAIRKEGIEIAHEFAFNSWIPYCSVAHHVPQNRMPEAFSLLRELKLPVSGYAMDVALVQFSPVREIFSFVLGNNVDS

SEQ ID NO: 164278 - protein, 387 aa, Glycine max
  Coding DNA Sequence Number=SeqID_47500
  Gene Ontology: Mol. function=protein binding; Biological process =defense response
  Homolog annotation: Hit_ID=Q9SE90; Match level="QueryCoverage=93%, HitCoverage=36%, E-value=4e-10, Identity=24%"; Hit description=RPS2 protein
  Pfam annotation: Domain name=LRR_1; Domain location=245-269; Score =7.9; E_value=9.5; Accession=PF00560.23; Description=Leucine Rich Repeat
  Pfam annotation: Domain name=LRR_1; Domain location=26-48; Score=4.9; E_value=35; Accession=PF00560.23; Description=Leucine Rich Repeat
  Pfam annotation: Domain name=LRR_1; Domain location=271-301; Score =2.1; E_value=1.2e+02; Accession=PF00560.23; Description=Leucine Rich Repeat
  Pfam annotation: Domain name=LRR_1; Domain location=3-24; Score=11.6; E_value=2; Accession=PF00560.23; Description=Leucine Rich Repeat
  Pfam annotation: Domain name=LRR_1; Domain location=325-347; Score =9.4; E_value=4.9; Accession=PF00560.23; Description=Leucine Rich Repeat
  Pfam annotation: Domain name=LRR_1; Domain location=50-71; Score =10.5; E_value=3.1; Accession=PF00560.23; Description=Leucine Rich Repeat
  Pfam module annotation: Pfam domain module=LRR_1::LRR_1::LRR_1::LRR _1::LRR_1::LRR_1; Domain location=245-269::26-48::271-301::3-24::325 -347::50-71
MSSLLLLDLYGSMITQLPSSLSKLTGLRGLFLNRCELLESLSSEIGSLQFLEVLDIRDTKVTFIPLQIGCLTNLRCLRIPFVASEDDAQNVHVISKLHRLEELTIQVISYEQWCNDAENISDVVFPPQSFLENFFQEVNHGVEDDSAIIEVLPKTDAFELVCHKDIKKLSNFAGIVCLERIRGLLIKKCNKVLTIVSADTSSNTMNGIQIETRVILPNLEKLYLENLLNLKCVFRGPLHSGTFSKLHTLSLKNCPSLREIFSNGAIQHFSELQNLKLEDCSKIEILISKDIEPEKDVLPKLEMLLLVNLPNFNTICSTHTLAWSSLELLRIHNCPKLKTLPLDSDNAVNLKSIKGQQEWWDELEWTNNDEVYQRLQPIFAASNEYFS

SEQ ID NO: 164279 - protein, 419 aa, Glycine max
  Coding DNA Sequence Number=SeqID_47501
  Gene Ontology: Mol. function=oxidoreductase activity, acting on single donors with incorporation of molecular oxygen, incorporation of two atoms of oxygen; Cellular component=cytoplasm; Biological process=response to salicylic acid stimulus
  Homolog annotation: Hit_ID=Q5GQ66; Match level="QueryCoverage=99%, HitCoverage=65%, E-value=0.0, Identity=83%"; Hit description=Alpha -dioxygenase
  Pfam annotation: Domain name=An_peroxidase; Domain location=1-401; Score=252.0; E_value=1.3e-72; Accession=PF03098.6; Description =Animal haem peroxidase
DASVVYGSNGEVLQRVRTFKDGKIKISKDGHLLHNENGTAIAGDIRNSWAGVSTLQSLFIQEHNAVCDTLKKHYPHLGDEELYRHARLVTSAVIAKVHTIDWTVELLRTDTLLAGMRANWYGLLGKPFKDTFGHVGGVILGGLVGLKRPENHGVTYSLTEEFATVYRMHSLLPDNLQLRDISATPGPNKSLPLIKEIPMKNLIGLQGEKTLSEIGLARQLVSMGHQACGALELWNYPEWLRDLVPQEIDGTDRPDHVDLAALEIYRDRERSVARYNQFRRALLLIPISKWEDLTDDKEAIQVLEEVYGDDVEELDVLVGLMAEKKIKGFAISETAFVIFLLMATRRLKADRFFTSNFNEETYTKKGLEWVNTTESLKDVIDRHYPEMTHKWLNSSSAFSVWDSPPNTHNHIPLYLRVPH

SEQ ID NO: 164280 - protein, 68 aa, Glycine max
  Coding DNA Sequence Number=SeqID_47502
  Homolog annotation: Hit_ID=Q1SKM8; Match level="QueryCoverage=46%, HitCoverage=3%, E-value=2e-08, Identity=78%"; Hit description =Adenosine/AMP deaminase active site
MCQGLLCILQKAERFMCLKLEWSHWIGKEYFKSGSRENDIQRTNIPHIRLEFRDKEKIELLLVSIFYL

SEQ ID NO: 164281 - protein, 280 aa, Glycine max
  Coding DNA Sequence Number=SeqID_47503
  Gene Ontology: Mol. function=NAD+ ADP-ribosyltransferase activity; Cellular component=nucleus; Biological process=protein amino acid ADP-ribosylation
  Homolog annotation: Hit_ID=Q1T4R9; Match level="QueryCoverage=88%, HitCoverage=74%, E-value=3e-39, Identity=39%"; Hit description=IMP dehydrogenase/GMP reductase
  Pfam annotation: Domain name=PARP; Domain location=9-206; Score= -35.7; E_value=2.1e-05; Accession=PF00644.10; Description=Poly(ADP -ribose) polymerase catalytic domain
MQQPIENSVGKGLMKVEEESEEYESIKNVFLKGMGFVGHATDAMAIYKNMLSFSVARQARWVSFKIFSKAVAIKSGGDANIGYAWYGSSLDDLLEIVSGGFHGCKKHDDNDDDECHGIGIPLFAANFSLDSAMCTVADEHGFRHVLLCKVILGKVEAVHAGSKQSQPSSKQYDTGVDDISAPRRHTIWTAYLNTHIHPNYIICFKSRDAWGTKTSITICVISQFIGKSFKPFETSTNVYVTQRLPDLQRTKDFTRTMGKQSEIDCRRRTAAFGNHNPVTM

SEQ ID NO: 164282 - protein, 216 aa, Glycine max
  Coding DNA Sequence Number=SeqID_47504
  Gene Ontology: Biological process=response to stress
  Homolog annotation: Hit_ID=Q1SJW3; Match level="QueryCoverage=99%, HitCoverage=100%, E-value=4e-62, Identity=57%"; Hit description=UspA
  Pfam annotation: Domain name=Usp; Domain location=17-194; Score=34.2; E_value=4.6e-07; Accession=PF00582.16; Description=Universal stress protein family
MAQGMASNRNRNPCAQEARKVMVVADPTRESAGALQYALAHAVIEQDELILLHVENPSSWRNTISTFLKMPSLGSSTTASLDLGGGGGGGAAAAPDGEGLDFLEEMKHACSVSQPKMKVRVVKVEMDGRDKASIVLSQSKTHGVDVVVIGQKRNITSAILGYKRPASGSMKGVKAIDTAEYLIQNSSCTCVSVQRKGQNGGFVLNSKTHRNFWLLA

SEQ ID NO: 164283 - protein, 376 aa, Glycine max
  Coding DNA Sequence Number=SeqID_47505
  Homolog annotation: Hit_ID=Q1SJW4; Match level="QueryCoverage=96%, HitCoverage=98%, E-value=1e-113, Identity=56%"; Hit description=F -box protein interaction domain; Galactose oxidase, central
MKSFLTSVKSFISNHFLRFTQRDTLLILDRFHWKDKICGHHLFLLDVKRKKLKQLHVPKVTDSDMGFKMVCSCNGLLCVIHYSLDQNSTIFLWNPTTTQTMRIMEPENALLPYKVPPHCLLGFYLNTSDSDYQVVRLHSFRDTNNACFGDYFTKICSVRVEKYSLRRGSWREIKYSNNQCVTVNGCLFWTENSVTLEETLFWVAMEVNDKFSNEMIISFNTHNNVISKIELPPLVKDCNEVHKKLAVYKDSVAVIICSETETMAQCLDLWGFYDKYEGVECWCKLHTIGMFSRLERPVGVLKNEILISTDRVIHSVGGTIALLPEDDLGAEFSYNVFNYVENFRTSYGGNLDVEEADPLERKGVSLHDLFFSSVNI

SEQ ID NO: 164284 - protein, 224 aa, Glycine max
  Coding DNA Sequence Number=SeqID_47506
  Homolog annotation: Hit_ID=Q8RZK0; Match level="QueryCoverage=36%, HitCoverage=29%, E-value=7e-32, Identity=76%"; Hit description=Beta 1,3-glucanase-like
  Pfam annotation: Domain name=X8; Domain location=111-194; Score =163.4; E_value=5.9e-46; Accession=PF07983.3; Description=X8 domain
MNARSWHLVLFSLCLFFGSGLGTTKILINGKKQEIFSSSELGTQLDDVPIVNPTTPDTGNPYMGNPNIPQTPDTSGPNPTTPTTNPTTPTTTPTTPTTTPTTPTTTSSGGQWCVANQGASDTALQVALDYACGFGGADCSAIQPGASCYNPNTVRDHASYAFNDYYQKNPAPTSCVFGGTASLTSNDPSTEQVSNTYHHASNISRPVGNFEYSMDSSSHHSSFI

SEQ ID NO: 164285 - protein, 595 aa, Glycine max
  Coding DNA Sequence Number=SeqID_47507
  Gene Ontology: Mol. function=RNA-directed DNA polymerase activity; Cellular component=chromatin; Biological process=chromatin assembly or disassembly
  Pfam annotation: Domain name=RnaseH; Domain location=327-447; Score= -34.4; E_value=0.092; Accession=PF00075.14; Description=RNase H
  Pfam annotation: Domain name=zf-H2C2; Domain location=524-565; Score =27.1; E_value=6.1e-05; Accession=PF09337.1; Description=His(2) -Cys(2) zinc finger
  Pfam module annotation: Pfam domain module=RVT_1::RnaseH::zf-H2C2; Domain location=87-273::327-447::524-565
MLPSENNTTDTTTLPSELQSLLLKYDALFQQQQSLPPRRDTDHHIHLLPQSSPVNVRPYRYPHFQKREIEIQVDMMLQKGLIQPSSSPFSSPVLLVRKQDGSWRFCVDYRALNAVTVKDRFPIPMIDELLDELGGACYFSKLDLLQGYHQIRMHEADIPKTAFRTHHGHYEFRVMPFGLCNAPSSFQSTMNTLFGPFLRQFVIVFFDDILVYSASFQDHLQHLETAFQTQVEYLGHLVSYRGVEPVASKISVIQQWPLPRTTKALRSFLGLAGFYRRFIRGYATIAAPLVKATTTDPLQWSQSAQIAFDRLKEALSTAPVLALPDFTKPFTLETDASGVGMGAVLSQQGHPLAFFSKPFTPKLLCSSTYVRELCAITTAVRKWRQYLLGHHFTIITDHRSLKELLGQVIQTPEQHLYMARLLGYDYDIQYRSGTCNQATDALSRLPDPNASLTMLLSVPCLSFLKELRNQLNDNDDFQTLRRNILLHPPNFPDYTVTQDLILYRSRIWLPRELPLIQTLLQEFHSTPTGGHAGVTKTTTRILENFYWPKLREDVARFVAQCKDCQITKYESKKTAGLLCPLPTPHRPWDDLSMKF

SEQ ID NO: 164286 - protein, 233 aa, Glycine max
  Coding DNA Sequence Number=SeqID_47508
  Homolog annotation: Hit_ID=Q1SFJ5; Match level="QueryCoverage=51%, HitCoverage=56%, E-value=2e-35, Identity=60%"; Hit description=Cold acclimation WCOR413
  Pfam annotation: Domain name=WCOR413; Domain location=39-194; Score =53.6; E_value=4.7e-14; Accession=PF05562.2; Description=Cold acclimation protein WCOR413
  Subcellular localization annotation: CTP_CleavageSite=71; ConfidenceScore=5.29e-01
EKEEMSRMAMRVSPSASSALSLLNCKQPPPVSCIRVPCLSRSSPPSLSYTFNPLRSFIGHGGSRSPGFRVHCYAPAPLTPPNLQWISTISSVVLILARGTAVPKSYIVPLFALQAPAGVVSWIKGRYGVWTAFLALLIRLFFYIPGELELPFLALLLLMVAPYEAMKLREANRPHVNNISRELNANVAVLGLPVGSEPKTVDPPPGFSMSGGVGVITGVGGLGGLTNVGVGGG

SEQ ID NO: 164287 - protein, 406 aa, Glycine max
  Coding DNA Sequence Number=SeqID_47509
  Gene Ontology: Mol. function=oxidoreductase activity; Cellular component=integral to membrane; Biological process=potassium ion transport
  Homolog annotation: Hit_ID=Q2R0H4; Match level="QueryCoverage=88%, HitCoverage=99%, E-value=1e-138, Identity=65%"; Hit description =Oxidoreductase, aldo/keto reductase family protein, expressed
  Pfam annotation: Domain name=Aldo_ket_red; Domain location=53-399; Score=107.0; E_value=5.5e-29; Accession=PF00248.11; Description =Aldoketo reductase family
  Subcellular localization annotation: CTP_CleavageSite=64; ConfidenceScore=5.54e-01
MSLTISHASSTRPSLVTTSGAVGSRDRWSCCIATHLLLLNMLKAMSGVPLFNLAPNLTVSRLCLGSMSFGEQNTLAESFQLMDQAFHAGINFFDSAEMYPVPQRAHTCGRSEECLGRWISQRKIPRDSLVIATKVAGPSGQMTWIRGGPKCLDAANITEAIDNSLLRMQMDYIDLYQIHWPDRYVPMFGETEYDPVQQYASISIDEQLEALSAAVKAGKASGIIRYVGLSNETPYGLMKFIQVAEKYASHLKIVSLQNSYSLLCRTFDSAMAECCHQESISLLAYSPLAMGILSGKYFSPGGGPTEARLNLFKGKYSEGESRYNLSKKIIKAATMEYLDIAKTYGLHPVSLAIAFVLRHPLVASAVFGATKSWQLQEVLNACKIELASEVIEDINKIHLRFPNPCP

SEQ ID NO: 164288 - protein, 173 aa, Glycine max
  Coding DNA Sequence Number=SeqID_47510
  Gene Ontology: Mol. function=serine-type peptidase activity; Cellular component=outer membrane-bounded periplasmic space; Biological process=proteolysis
  Homolog annotation: Hit_ID=Q1SJV5; Match level="QueryCoverage=92%, HitCoverage=77%, E-value=5e-35, Identity=64%"; Hit description =Peptidase S41
  Pfam annotation: Domain name=Peptidase_S41; Domain location=44-171; Score=-15.8; E_value=8e-05; Accession=PF03572.8; Description =Peptidase family S41B
MQQLHLSLLPTAPEVVTNEGLVEEAWEIVNDIFLATDAEEGNYFEQFHSDKIITRMLSSLADPYTRFLSPREFSMMARYDMTGVGINLKEVPDENGDLRLEVLGIILDGPAHSAGVRQVASALHDNCRAVLVGKRTYGKGLIQSVFDLDDGSGVVITVGKYVTPNHKEITAME

SEQ ID NO: 164289 - protein, 618 aa, Glycine max
  Coding DNA Sequence Number=SeqID_47511
  Gene Ontology: Mol. function=protein binding
  Homolog annotation: Hit_ID=Q1SJW0; Match level="QueryCoverage=94%, HitCoverage=77%, E-value=0.0, Identity=61%"; Hit description =Ubiquitin-associated
MERLMNVQNCCSDSVRVCDGLSSSQHGGLQSPWAANPGQVSMADIVRMGRPQAKASMPNSSLHSGSHQNDFALPSASQNNLHSVQVHASKLSETNNDHGFAIDSNVEQTDEWPSIEHQPAVSVSLVVDGHPTSEYHTNSSNSGEANQQLKTHVNEFVAEDDPVENPDIVGSAKSISEENPESTSVFDGSLYKDINSYQPHRHPFENNEAEDGVSSVATNLEQLNLHSNDQGTEPEEENSSVVIPNHLQLHSAECLNLSFGSFGSANDASLSGSGPYASRPLKSNLEDTSGANDVSTIGSSDVRHVTSTYFAAIFWSFLVYLCIALLASTVQTAREDIPYSPFPATQSMPSKYSNIASSIGGPSITMSEALRANNISTPQPNPQALPGANVATGPALPQHLAVHPYSQPTLPLGHFANMIGYQFLPQSYTYMPSAFQQAFPGNSTYHQSLAAMLPQYKNSISVSSLPQSAAVASGYGFGSSTSIPGGNYPLNPPAAPTSTTIGYDDVINSQYKDNNHMISLQQNENSPMWVHGPSSRTMSAVPANTYYSFQGQNQQPGGFRQNQQPSQQHFGSLGYPNFYHSQTGISLEHQQQNPREASLAGSQTQPPKQSPQIWQNSY

SEQ ID NO: 164290 - protein, 100 aa, Glycine max
  Coding DNA Sequence Number=SeqID_47512
  Subcellular localization annotation: CTP_CleavageSite=52; ConfidenceScore=5.05e-01
MVSHAEQGKTLLSSNVIHILVKVVMLVRMIRTRLPAAVQAKSCPDMHSSWAMASSLKSSAWLLLWLNSHYWPSSKISGSPWNWLRAFASKGIHCPLTHER

SEQ ID NO: 164291 - protein, 91 aa, Glycine max
  Coding DNA Sequence Number=SeqID_47513
  Subcellular localization annotation: CTP_CleavageSite=14; ConfidenceScore=5.19e-01
MSRLLRSFSRISFRSNSSSSSSSRNSNLLNDQDNQTQEVAAKQNLFDEEVRFEDINQNMDDWNIPEIPQDQLYVPETIKDKYNFDYIIKTV

SEQ ID NO: 164292 - protein, 192 aa, Glycine max
  Coding DNA Sequence Number=SeqID_47514
MRGYCMVIHTFFHPEAASPMTCGGGKTDDMWGYRMVIRTFRQPGANKPVDAQRLTSSSAPSVNLANKARVEPDDMQGYRMVICTFCHPEAASPMTYVKSDDMQGYRMVIRTFCHPEAASPMTCGGTGQTSPLTCRDLRRLLHLLSSRPMESDDMRGYRMVICTFHQPGANEPVDAQRLTSSSAPFVIPTHGV

SEQ ID NO: 164293 - protein, 100 aa, Glycine max
  Coding DNA Sequence Number=SeqID_47515
MSSDLASLDEKGADNHTRVQKTMLVSACYQTLSLTDSKRVCAGYRIGRLHVPTDSQVAIAKVRGEKIAGAQDLVGNQRETTTLGRGVATYPSAGGRRVTR

SEQ ID NO: 164294 - protein, 793 aa, Glycine max
  Coding DNA Sequence Number=SeqID_47516
  Gene Ontology: Mol. function=binding; Cellular component =intracellular; Biological process=RNA processing
  Homolog annotation: Hit_ID=Q1SFI7; Match level="QueryCoverage=99%, HitCoverage=82%, E-value=2e-97, Identity=49%"; Hit description =Involucrin repeat; RNA-processing protein, HAT helix
GIASLELQSESCFDGEIPMTTCYKDDEIYCIINDIMDSSVGLTSSIALKRYRVIGELLYHKACELYSKISPFEANIRRHYFHVRPLDANQLQNWHNYLDFIEPQGDFDWAVKLYERCLIVCANYPEYWMRYVDFMEAKGGREIANYSLVRATEIYLKKVPEIHLFNARFKEQIGDVLAARAAYIQSGKETDSDFVENVISKANMEKRLSTNSVDAAGDVLIDGVRTLPQNKLLLEAWNRHIKLFPDSVRTAKRRRLINLMDKREEVFVVMPNQASRDSSSDLDAAHLHKKDKKVLLLKYCDNQSDATKDELMLTKNHNARSNNDTDTCNLQIMESEYKIEENGRELPLPISEEPRDNDPENNVSSANLVEVKERSITKNLKNSCSSESDVSSEELLRQTACGNQSSQALQIPSKENTAFSKGTCELEPEELKPLSPSSISLNPQESTCPDSGPMVSQEECDAIPESCKSNSRAVVGGHTTNQDNSASTQDSESAQIPIEINSPYSARHRDQRARKPLLPPRSSGNSGGNWHKMRNAGQFRRGPKFGYRGNTHRKQHQRQQLPPQQIHPPERGSQMAVAPGYSSQPVLQIQQCNQGQNQFHSAATPTDFAAASCWPMQNMQIQNTSSQSQTPANTTSHVLQHAMQGNERYGYMQNDQEYNQLWQYYQQQQQQLQLQQHYIQLQQQSFQQGLSQQQLQHSLLEPLQPQQLQQQVLQQQQQQYFQQQQPLQQEHPENLMQQQQPSTQSSSHPVADQGQAIVTLQGHGAVLSQQSDKLGPISSPVVHHPQEKSTQQE

SEQ ID NO: 164295 - protein, 85 aa, Glycine max
  Coding DNA Sequence Number=SeqID_47517
MKESKPLNPRKTNDFCSQASLQACESPSDSIYAFLTLWCRNLPFGGRATRGSLVRLPREENTRSRHQRLFEENVEKTGKGVVYEL

SEQ ID NO: 164296 - protein, 179 aa, Glycine max
  Coding DNA Sequence Number=SeqID_47518
  Gene Ontology: Mol. function=binding; Cellular component =intracellular; Biological process=RNA processing
  Homolog annotation: Hit_ID=Q1SFI7; Match level="QueryCoverage=62%, HitCoverage=10%, E-value=3e-46, Identity=69%"; Hit description =Involucrin repeat; RNA-processing protein, HAT helix
MREEERRVGCVMKEDWESERSREKLVVGIVVLNPESRTYLSSHPHLNDGAVRCSSLSHRSLMAPILSSASDDNLDLQEVISKGSLDFDEWTLLISEIEKLYPDDAEKICLVYNHFLSKFPLCHGYWRKYAAHMTCLCTTDKVVEVFEKAVLAATYSVGMWVDYCSFGMSAFEDPSDIRR

SEQ ID NO: 164297 - protein, 278 aa, Glycine max
  Coding DNA Sequence Number=SeqID_47519
  Gene Ontology: Mol. function=acyltransferase activity; Cellular component=integral to membrane; Biological process=lipopolysaccharide core region biosynthetic process
  Homolog annotation: Hit_ID=Q7VUL3; Match level="QueryCoverage=99%, HitCoverage=93%, E-value=1e-128, Identity=78%"; Hit description =Putative acyltransferase
  Pfam annotation: Domain name=Lip_A_acyltrans; Domain location=1-269; Score=210.6; E_value=3.6e-60; Accession=PF03279.4; Description =Bacterial lipid A biosynthesis acyltransferase
MRPANRQRIGAALGWLAMRLARSRTRIVRRNLELCFPEQPAQVRERWVREHFRALAQSIVDRGVLWYGTPEAIQDMVTQSGAERINELTAQGRSVILLAPHFIGLDAAATRLTMEVPSAATMYTPQSDPHIDAVVAAGRARFNEVFLVSRKDGVRELLRHLRAPRPVYYLPDMDFGRQGSVFVPFFGIPAATLLATAQLAKKWNAAVLPILDFWNPETGRYHAEVLPPLENFPGDDTLEEATARLNRELEAWVRRCPSQYYWVHRRFKTRPPGEPKIY

SEQ ID NO: 164298 - protein, 386 aa, Glycine max
  Coding DNA Sequence Number=SeqID_47520
  Gene Ontology: Mol. function=nucleotidyltransferase activity; Cellular component=ribosome; Biological process=metabolic process
  Homolog annotation: Hit_ID=Q1SFI4; Match level="QueryCoverage=92%, HitCoverage=53%, E-value=1e-129, Identity=66%"; Hit description =Photosynthetic reaction centre, H-chain, cytoplasmic
MEQKHIFHGFQYGEKDQWSSLSDQIVGVNSKLLQEALQSLERPAKRQVNITTTKMKACSHTVGWKVAELVGAIEAKLINSIQISEEYFLNGGKNKLFRDMQEKGLELMSKGKMAIVFLLNDKEHQGSISDSNKVENEAIDTSVLHMFQKVKDHVSVPLILVSSAQQIQSFRNLFTSNNYFAFDSEKVWFLEEEKLPVISSLPKGQNKYKILMKSPWEILQSPVGSGGLISLFSNHSIADNLIDMGVEYIEVCCTSEKMAGGNSLLLGLINSREAKIGIQISPKITDSEENFDLIFSMDFVKKLTKQSNKLQFDAIPKAHSFVEKVDKEWVTLTSSTPNSYELSCSIYSSLNACSLDKLSFQVFLRPNVLLKVVDTCKAIVMSEVIG

SEQ ID NO: 164299 - protein, 243 aa, Glycine max
  Coding DNA Sequence Number=SeqID_47521
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=100%, E-value=1e-38, Identity=29%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
DYTASPSKGLHTITFRGIHDLAFRGLHVLTIRGLHVLTFRGVHALTFRGLHVLAFIGLHVLPFSGVHVLTFRGLHIVAFRGLHVITSKGLHILAFRGLHSLTFRGLHVLAFRGLHALTFKRLHLLAFRRLHILAFRGLHALTFNGLPVLAFRGLHGLTFRGLHALTLKGLQVLAFRGLHTLAFRGVNALAFRGLHVLTFRGLHVLTFRGQHALTLKGLYALAFSGLHTLTFRRLLVPSIKGLH

SEQ ID NO: 164300 - protein, 155 aa, Glycine max
  Coding DNA Sequence Number=SeqID_47522
  Homolog annotation: Hit_ID=Q1SFH9; Match level="QueryCoverage=94%, HitCoverage=38%, E-value=3e-46, Identity=67%"; Hit description=SH3; tRNA-binding arm
MDALRKQASKLREQVAKQQQAVIKQFSSSGYESSDVVVIDEVEMQRHHQLEKLYRATRSGKDFQKEIVKAAETFTAIGYKHIETVLIACVQELEAPTGTKLSEDCCKYGAENNSDNILAKAASVYGDARKHVEKEHEELNRLLSTQVDFSYVVQV

SEQ ID NO: 164301 - protein, 307 aa, Glycine max
  Coding DNA Sequence Number=SeqID_47523
  Homolog annotation: Hit_ID=Q1SNE2; Match level="QueryCoverage=92%, HitCoverage=82%, E-value=1e-39, Identity=42%"; Hit description =Expressed protein, putative
MPSGARKRKAAKKNKAKKNSINPSTNKPKGNGDLKSRDEKGSDGGEGNSPAFREHGDHRNPFNDGSEDLEERGPSAAQPHAPDVVGSLEEVVSDVKIDQVLGGKEDGVVLVERGLKSEECFESKTASFENGNGGNTPKGQSLAEKNSKDGNCNSVEEAVASHKLVKSIDSSPSKMTSITEMPPVEETVNSPADSSVNLVTAMASVSEVEKSDTGMLLEKSVVHPVEVTNLAMKINDDNVYSLTNDNVTMSSVEEPKPKECDSKMLTSPSASPFTKFTNGKEHIKDSSCSIGSKFGAKDLLVELLWIV

SEQ ID NO: 164302 - protein, 245 aa, Glycine max
  Coding DNA Sequence Number=SeqID_47524
ALPSQTKPNPKEDLKVVSTRSGKPHAEYKETEKLNSLEKEKEAPSKESPTKDKEAPIEWSSKIGKENEEPGSFTLPCMIGYSFFEKWLYDLGASIVKDVLGKVDKFVLLTDFMTLDMEKDEDVSIILGHPFLNTCDMVIEVRRGSLIPKCFGGSLIVEDLHKDLSSDGDEILMFLQAQSDVKPMRNQRFEELERSSGPKPKLPIEEPPTSSIPSSTVNGKLNKAIQNDHFHFPFIDQMLEKLSSH

SEQ ID NO: 164303 - protein, 294 aa, Glycine max
  Coding DNA Sequence Number=SeqID_47525
  Gene Ontology: Mol. function=hydrolase activity, hydrolyzing O -glycosyl compounds; Cellular component=cell wall; Biological process= carbohydrate metabolic process
  Homolog annotation: Hit_ID=Q8LG58; Match level="QueryCoverage=91%, HitCoverage=93%, E-value=1e-103, Identity=66%"; Hit description =Probable xyloglucan endotransglucosylase/hydrolase protein 16 precursor
  Pfam annotation: Domain name=Glyco_hydro_16; Domain location=31-212; Score=337.9; E_value=1.7e-98; Accession=PF00722.11; Description =Glycosyl hydrolases family 16
  Pfam annotation: Domain name=XET_C; Domain location=236-288; Score =84.0; E_value=4.7e-22; Accession=PF06955.3; Description=Xyloglucan endo-transglycosylase (XET)
  Pfam module annotation: Pfam domain module=Glyco_hydro_16::XET_C; Domain location=31-212::236-288
MAKYETYLRASALLLAPLLMCLFGVTAEGDFFEDIDITWGEHGGVNILGSNSLVLSLDQSSGSGFRSNAEYLYGRIDMQIKLVSGNSAGTVTAYYLSSEGPNHDEIDFEFLGNLSGEPYIVHTNIYTQGIGNREQQFYLWFDPTKYFHTYTIVWNPQRIIFMVDNVPIRVFNNYEARGVPFASSQAMRLYSSLWCADQWATRGGLVKTNWSYAPFKAYYRNFDAKACVWSKGSSSCPSSPPSMTHNTWQAQDLDADGRRSLRWVQKYYMIYNYCKDYKRFPQGRPRECRLSRFS

SEQ ID NO: 164304 - protein, 400 aa, Glycine max
  Coding DNA Sequence Number=SeqID_47526
  Gene Ontology: Mol. function=translation elongation factor activity; Cellular component=intracellular; Biological process=signal transduction
  Homolog annotation: Hit_ID=Q1SFH4; Match level="QueryCoverage=76%, HitCoverage=42%, E-value=1e-117, Identity=74%"; Hit description=Zinc finger, RanBP2-type; AAA ATPase; Translation elongation factor Tu
  Pfam annotation: Domain name=GTP_EFTU; Domain location=291-400; Score= 2.9; E_value=1.9e-07; Accession=PF00009.17; Description=Elongation factor Tu GTP binding domain
MDRILLIRLWQSSSLELTFGIEDVTKSPGASKLARSLFQSLQQQIAKETVLFPKPDDGFLTDGSNFYKLDNVRGEFHEIHKDFSTQSHPHLNIDPFKFNVPSPDDVVYTGLRSSKTGLKDKATNSNSQLSSSTREKNELSVQSNAESSDNLSSLMQKSRQDSSTESKLSKKVAIDLQTSGKTSNSLPESLSKDKDNNINKINSSKNGTIDIQSSKEKSGSLSTRSKVKESDNISSSSIKDGKPESISSSFSNMVVDVRFGNSDNTNAKGTHSRVSYKPEKWMLPEQAEDTLTQLNLAIVGHVDSGKSTLSGRLLHLLGRISQKEMHKYEKEAKLQGKGSFAYAWALDESSEERERGITMTVAVAYFDTMRYHVVVLDSPGHKDFVPNMISGATQADAAIL

SEQ ID NO: 164305 - protein, 131 aa, Glycine max
  Coding DNA Sequence Number=SeqID_47527
MDDKKVRNDHNLSPHVIGLTVSELQKEQKDHNLSLRATGHNRFGWQKTRSYLDGKKVRNDHNDRLWMAKRCVMTIICLRMSSGSPPLDDNRRRMTINCLCVASDTIVSDCRKVVRKDHNLSLHMMGLTASG

SEQ ID NO: 164306 - protein, 83 aa, Glycine max
  Coding DNA Sequence Number=SeqID_47528
  Subcellular localization annotation: CTP_CleavageSite=61; ConfidenceScore=5.33e-01
MKQTSFLSDHCSFSLEDNLAHQWAKRASTAKRSFNALSTTEESGRASSSRPCAKREISALNAAVVFSQTQRMTGAKLKSTYSR

SEQ ID NO: 164307 - protein, 111 aa, Glycine max
  Coding DNA Sequence Number=SeqID_47529
AHPEGGPPSSGSNPDSHGRQCPLWRRFQRDKKLSPKANSRIQPDPDDVRRPLAIPHRQPDGCDISRKARMENYTRQSLRMAPNSLVEESNGKITKTTFPSQEDPHLTVEDT

SEQ ID NO: 164308 - protein, 164 aa, Glycine max
  Coding DNA Sequence Number=SeqID_47530
RHCLMGSRGKRTTKATGRQDSAAKSQKKVIADVAKDLDLEPDSVEHDVDIQMENTVQDADQHIPEPGIQDNNEIPTTSVTAMIDEFAKERVAARQSEVDKMMMQVPLQDLCEYNYHSHALYEEDCLRHPFTIKSWTRYIAHLSARKASFDEISFIFERAIKELP

SEQ ID NO: 164309 - protein, 91 aa, Glycine max
  Coding DNA Sequence Number=SeqID_47531
  Gene Ontology: Mol. function=protein binding
  Homolog annotation: Hit_ID=UPI00005879FE; Match level="QueryCoverage =98%, HitCoverage=66%, E-value=7e-22, Identity=43%"; Hit description =PREDICTED: similar to MGC82986 protein isoform 2
  Pfam annotation: Domain name=B9; Domain location=4-81; Score=36.6; E _value=3.5e-08; Accession=PF07162.2; Description=B9 protein
MAELHILGTLVGASEFPKATLCCQWELTAGEKWTPIEGDLSGQTHVDVPLIRVQVYYQDMFGRNELYGYGFAHIPSSPGLHKIDISTWRPV

SEQ ID NO: 164310 - protein, 63 aa, Glycine max
  Coding DNA Sequence Number=SeqID_47532
MLVLSVPKGANKVLMMPKYYLKMVVIIKRGENVNEYHASFDDAKKGTARDDAIAMGRHVNPLR

SEQ ID NO: 164311 - protein, 140 aa, Glycine max
  Coding DNA Sequence Number=SeqID_47533
SQDEATSSPSPSESEEAKGEESSKEIYPKEEGKPLMVKEECKETLVSIAIPLRLEFIPQVKELLDEGVPMNPKRIKVIPEWPTLPTPLIELVRNHVPSWEDAQEMGVEKKSPEFQEPRDLRSNPFQGGGNDAILPRKGIG

SEQ ID NO: 164312 - protein, 144 aa, Glycine max
  Coding DNA Sequence Number=SeqID_47534
  Gene Ontology: Mol. function=RNA-directed DNA polymerase activity; Biological process=RNA-dependent DNA replication
MVVKSHSVAQHVTDLEEVFGEICKYDTRLNLEKCTFWNGSRKFLGFMITHGGIEANPNKCKAILKMHSATNFGEVQKLNGRLASLSRPKPRAPLLLYLSVAEEAISSAFVQEDGSRSSIILEGPNNVTLEQALKFNFRASNNHA

SEQ ID NO: 164313 - protein, 82 aa, Glycine max
  Coding DNA Sequence Number=SeqID_47535
MESSQVPIDSNSNSSANKIEEKAGDGNTQAILLMKLSNDMQHNIIKDRKRGGGRIEKERTNGPQKQGLLVYETRKNQRYKLN

SEQ ID NO: 164314 - protein, 106 aa, Glycine max
  Coding DNA Sequence Number=SeqID_47536
MVQSYHPRALDRRLQKDGAIDAGEGPRVLMSFMWRLQSPFLLLHSAAIILQKVKDSIDEEDLRPTSSTWSYIKRDSFRLKQDQALGFLDPVQNPYTSDQLSSIGEN

SEQ ID NO: 164315 - protein, 143 aa, Glycine max
  Coding DNA Sequence Number=SeqID_47537
MGLAKPPDRPNHDVDDPLYLMTLTITQLFLKSLQVMWDVIVFGVFNENFPLYIKHEDLSEIAHGGQCLSNSVIQLWILSDNYLKGIINKSVLFFNTFALALVGNINILIVQYESMFALNNSLKGLDDTPQSKSKAAARWIVVK

SEQ ID NO: 164316 - protein, 77 aa, Glycine max
  Coding DNA Sequence Number=SeqID_47538
MTIGNALAFVNQLRWILEVGSSRCGVSMENNGGLWWIMVVMGDGESPWDVRNGFGRKKEEEMTFFLSYTKAKADTLK

SEQ ID NO: 164317 - protein, 81 aa, Glycine max
  Coding DNA Sequence Number=SeqID_47539
  Homolog annotation: Hit_ID=Q5CCK4; Match level="QueryCoverage=46%, HitCoverage=4%, E-value=6e-16, Identity=94%"; Hit description =Transcription factor B3-EAR motif family
  Pfam annotation: Domain name=B3; Domain location=17-79; Score=2.9; E _value=0.036; Accession=PF02362.12; Description=B3 DNA binding domain
MASLTDVLPPFVAFAQAFVVVLTAILTSSLYYMDASPKGKEWIFQFRFWPNNNSKMYVLEGVTPCIQSMQLQAGDIGKTLS

SEQ ID NO: 164318 - protein, 771 aa, Glycine max
  Coding DNA Sequence Number=SeqID_47540
  Gene Ontology: Mol. function=exonuclease activity; Biological process= DNA repair
  Homolog annotation: Hit_ID=Q60GC1; Match level="QueryCoverage=95%, HitCoverage=82%, E-value=1e-164, Identity=46%"; Hit description =Exonuclease-1
  Pfam annotation: Domain name=XPG_I; Domain location=138-230; Score =111.1; E_value=3.3e-30; Accession=PF00867.9; Description=XPG I-region
  Pfam annotation: Domain name=XPG_N; Domain location=1-99; Score =112.3; E_value=1.4e-30; Accession=PF00752.8; Description=XPG N -terminal domain
  Pfam module annotation: Pfam domain module=XPG_I::XPG_N; Domain location=138-230::1-99
MGIQGFLPLLKSIMVPVHIKDLKGCSVAVDTYSWLHKGALSCSTELCKGMPTTRHIEYCMHRVNLLRHFGVKPILVFDGGLLPMKSEQENKRARARKDNLARAVEHESDGNSAAAYECYQKAVDISPQIACELIQVLKQENLQYIVAPYEADAQMTFLAISGQVDAVITEDSDLIPFGCPRIIFKMDKFGQGVQFQYSMLQKNKELSFEGFNRQMLLEMCILSGCDYLQSLPGMGLKRAHASIKKFRSYDKVLKHLRYSGVSVPPFYEESFKKAIFTFQYQRVYDPINENIVHLSNIPDDIGDDYTLTWDTPMPKDIAQRIAKGDLDPITKMPFEGENLTARLAIAGTSQFKTHHSESAKKKIDLPVQKNLLTKGGMQGNILLFTGILPDAVDALSNVSLAMKGFASLEAKRKFRAPRVSPSAANETKNSTASVIDSEDWGSVPPPNSHVEYGSATNISEFTESPCHMSMVGEEKKSPEHTVLRQPRQPIHKPCLGLHKDHEHTNVEDTVEGKTREATQKVIVRSAYFQHKQVEKNVYDEKQDCLSSGVVIDKRKNALSDSDFCNNDFKNKDQVVHDLLEGKSREGTRKVIVRSAYFQHKQVEKNVCDNKQDCLSSGIVIDERKIAISDSDLCNNLLKNKDLKRKISPNDNIQNENLQPRQMHRSSPPHNNGCCDHNVDGPFTENNAEEENFGTKISHLGQYSEIAEKSMERFVSVMSSFRCTSGTRVSGLRAPLKDVRNTSGNRPKKTVDFGQYAYVPKQTKTRRIAPGN

SEQ ID NO: 164319 - protein, 893 aa, Glycine max
  Coding DNA Sequence Number=SeqID_47541
  Gene Ontology: Mol. function=alpha,alpha-trehalose-phosphate synthase (UDP-forming) activity; Cellular component=alpha,alpha-trehalose -phosphate synthase complex (UDP-forming); Biological process =trehalose biosynthetic process
  Homolog annotation: Hit_ID=P93653; Match level="QueryCoverage=96%, HitCoverage=100%, E-value=0.0, Identity=60%"; Hit description =Trehalose-6-phosphate synthase
  Pfam annotation: Domain name=Glyco_transf_20; Domain location=109 -520; Score=693.0; E_value=2.2e-205; Accession=PF00982.11; Description=Glycosyltransferase family 20
  Pfam annotation: Domain name=Trehalose_PPase; Domain location=554 -803; Score=169.7; E_value=7.5e-48; Accession=PF02358.7; Description =Trehalose-phosphatase
  Pfam module annotation: Pfam domain module=Glyco_transf_20::Trehalose_ PPase; Domain location=109-520::554-803
VQLFTCLFHNVIEDYPSIVEYLKAKRMPGNNFNCVPLTPRSRLERLLRERELRKSFKLVQPTEEARDGSKEGEQFYGDSYISENEISGNHKEEEVTETNADARGFTGKQRLLVVANRLPVSAVREGVESYRLDISVGGLEFDTRWIGWAGVNVPDDVGQRALTKALAEMRCIPVFLDEEIVNQYYNGYCNNILWPLFHYLGLPQEDRLATTRTFQSQFDAYKKANQMFADVVNKHYEEGDVVWCHDYHLMFLPKCLKQYNDKMKVGWFLHTPFPSSEIHRTLPSRSELLRSVLAADLVGACTRILGLEGTPEGVEDHGKLTRVAAFPIGIDSDRFTQALELPEVQEHMKELKERFAGRKVMLGVDRLDMIKGIPQKILAFEKFLEENSHWRDKVVLLQIAVPTRKDVPEYQKLTSQVHEIVGRINGRFGTLTAVPIHHLDRSLDFHELCALYAVTGAAQSLGAGAILVNPWNITEIAASIGYALEMSADEREKRHQFNFKHVKTHTSQEWAATFVSELNDTIVEAQLRTRQVPPLLPNKVAVDCYSKSNNRLIILGFNATLNEPVDALGRAAAELSWTKYYQENFMCFWIFSNNFFRTNNYFVQNFSEFNMWLAAENGIFLRHTSSEWMTTMPENLNMDWVDSVKHVFEYFTERTPRSHFELREMSIVWNYKYADVEFGRIQARDLLQHLWAGPISNASLDVVQGGRSVEVRTIGVSKGAAIDRILGEIVHKKGMKTPIDYVLCVGHFLAKSGSYPNDRTSIDKDEDVYQFFEPELPSESPPVPRAMLSKSNSYRPSSLSKLPATTKTSSKAAQYKKQRSLSNIEKRELDQWRPMCGDKIALHEGSSVLDLKGDNYFSCVVGRKRSSARYLLKTSDDVVNLLRDLAEHSSSPT

SEQ ID NO: 164320 - protein, 156 aa, Glycine max
  Coding DNA Sequence Number=SeqID_47542
  Gene Ontology: Mol. function=uracil DNA N-glycosylase activity; Cellular component=mitochondrion; Biological process=base-excision repair
  Homolog annotation: Hit_ID=Q9LIH6; Match level="QueryCoverage=63%, HitCoverage=30%, E-value=7e-37, Identity=74%"; Hit description =Uracil-DNA glycosylase-like protein
  Pfam annotation: Domain name=UDG; Domain location=1-123; Score=81.3; E_value=3e-21; Accession=PF03167.9; Description=Uracil DNA glycosylase superfamily
MGLSFSVPEGVKVPSSLVNIFKELHQDLGCSIPTHGNLQKWALQGVLLLNAVLTVRKHHANSHAKKGWEQFTDGIIKDNLTEDGRVVFLLWGNNAREKSRNHRVFRDQMWSEEFLARLKKLEEAWKAAKNVGDKFPANTVYNKSKEPMKWIPAGEY

SEQ ID NO: 164321 - protein, 246 aa, Glycine max
  Coding DNA Sequence Number=SeqID_47543
MEYWSWSLGVGQWIICKAAEKFTESLLSDFSFAKTKKWTVGLIFHRLSIDSSTPPPVLHLQVLLPKMMKLRLRSLESKETLKIEVLDSCSLFQLKDTISRTISSSSSFLHISLNRKDEIHAPSSEEPLNSLGVSAGDLIFYSLNPTILTLETLLHKLETAPRDGPTIQDSPETLTNDSTSVPDAKKPPTLDTAEPKSMEIIDGSDETVVVGTNSEPFFMTRVLKEALGNNVNDFKLLVFTVHGVVL

SEQ ID NO: 164322 - protein, 163 aa, Glycine max
  Coding DNA Sequence Number=SeqID_47544
  Gene Ontology: Mol. function=hydrolase activity, acting on ester bonds; Biological process=lipid metabolic process
  Homolog annotation: Hit_ID=Q1SQ99; Match level="QueryCoverage=57%, HitCoverage=27%, E-value=6e-12, Identity=46%"; Hit description =Lipolytic enzyme, G-D-S-L
MVQTYSKGVNYASGSAGIRKETGSHLIEQLTLKDLDELGARKFALIGVGLIGCIVHNKSLFMGKLGQYGLTSTLKHHSFLMKSLNQLLIVSIKNYLMSYFSSLTVLWSHRIWPQLKVPQSYQGFQNLLEGKTIMVVDHNTPFKLPHRAEYVDVEATKIAISVR

SEQ ID NO: 164323 - protein, 122 aa, Glycine max
  Coding DNA Sequence Number=SeqID_47545
MSSDPIYYVTQSDIREKSYCRLNWLRASIQFNILRDSIGHPIKKLLSLELAQSLNIQFREFRYITGLNRTSEVSTFNIERLVILRDSIRHPSKKLLSLEFSQSFNFQLRASRYITGLIRTSE

SEQ ID NO: 164324 - protein, 215 aa, Glycine max
  Coding DNA Sequence Number=SeqID_47546
  Gene Ontology: Mol. function=sequence-specific DNA binding; Cellular component=nucleus; Biological process=regulation of transcription, DNA-dependent
  Homolog annotation: Hit_ID=Q533S0; Match level="QueryCoverage=82%, HitCoverage=73%, E-value=7e-42, Identity=56%"; Hit description=MADS box protein AGb
  Pfam annotation: Domain name=K-box; Domain location=49-162; Score =76.2; E_value=1.1e-19; Accession=PF01486.8; Description=K-box region
MQGKFSDFQITYPQHGLRIQDRKSGASHIESPCTVCVKASIERYKKASSDSSSGGRSASEANAQFYQQEAAKLRVQISNLQNHNRQVALVVHRISSITPIFGKHVLNCRQMMGEGLSTMNGKDLKNLETKLEKGISRIRSKKIAQEIYLHNDNQLLRAKIGEGERSHHNVNGLSGTTSYESMQSQFDSRGFFQVTGLQPNNNNQYAGQDMSLQFV

SEQ ID NO: 164325 - protein, 148 aa, Glycine max
  Coding DNA Sequence Number=SeqID_47547
  Gene Ontology: Mol. function=sequence-specific DNA binding; Cellular component=nucleus; Biological process=regulation of transcription, DNA-dependent
  Homolog annotation: Hit_ID=Q64FN4; Match level="QueryCoverage=51%, HitCoverage=31%, E-value=2e-33, Identity=90%"; Hit description=MADS4
  Pfam annotation: Domain name=SRF-TF; Domain location=25-75; Score =115.2; E_value=1.8e-31; Accession=PF00319.9; Description=SRF-type transcription factor (DNA-binding and dimerisation domain)
MAFPNQSMSSESPQRKMGRGKIEIKRIENTTSRQVTFCKRRNGLLKKAYELSVLCDAEVALIVFSNRGRLYEYANNSFFHVRNIVYAASDGVKHKEPNPFCDFLIWWAHRSGVRDRYRSTMVVNYSSTRKGFREIMKACEISQSLKLS

SEQ ID NO: 164326 - protein, 51 aa, Glycine max
  Coding DNA Sequence Number=SeqID_47548
MEDWNNLFTPQRLIKLNQVRKNLKRKVVEENESLEQPLHFTPQELNPTLKS

SEQ ID NO: 164327 - protein, 77 aa, Glycine max
  Coding DNA Sequence Number=SeqID_47549
MLSCSLMDSMTCRQPKPDGVEATVELPMVSKTILDLILGEESFLQHLGRWWVRLDGASGGAREWPETEKSLQQKEEE

SEQ ID NO: 164328 - protein, 184 aa, Glycine max
  Coding DNA Sequence Number=SeqID_47550
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q9FJZ3; Match level="QueryCoverage=82%, HitCoverage=35%, E-value=5e-63, Identity=68%"; Hit description =Mannan endo-1,4-beta-mannosidase
MKLGFFMVFLVLYMILERGILLLPQVEAAAADGFVKVRGVQLMLNGRPYYANGYNAYWLMYMASDPSQRNKVSSVFQKGTNHGLNIARTWAFSDGGYKPLQYSPGSYNEDMFRGLDFVISEARRYGTKLVLSLVNNYDNFGGKKQYVDWARSEGQAIDSEDDFFTNPLVKEYYKNHVKEKRGRD

SEQ ID NO: 164329 - protein, 252 aa, Glycine max
  Coding DNA Sequence Number=SeqID_47551
  Gene Ontology: Mol. function=protein serine/threonine kinase activity; Cellular component=integral to membrane; Biological process=protein amino acid phosphorylation
  Homolog annotation: Hit_ID=Q9FXF2; Match level="QueryCoverage=82%, HitCoverage=27%, E-value=2e-52, Identity=41%"; Hit description =Receptor-like serine/threonine kinase
  Pfam annotation: Domain name=LRR_1; Domain location=147-169; Score =7.0; E_value=14; Accession=PF00560.23; Description=Leucine Rich Repeat
  Pfam annotation: Domain name=LRR_1; Domain location=171-192; Score =5.3; E_value=29; Accession=PF00560.23; Description=Leucine Rich Repeat
  Pfam annotation: Domain name=LRR_1; Domain location=194-215; Score =7.7; E_value=10; Accession=PF00560.23; Description=Leucine Rich Repeat
  Pfam annotation: Domain name=LRR_1; Domain location=52-74; Score=6.7; E_value=16; Accession=PF00560.23; Description=Leucine Rich Repeat
  Pfam annotation: Domain name=LRR_1; Domain location=75-97; Score=7.4; E_value=12; Accession=PF00560.23; Description=Leucine Rich Repeat
  Pfam annotation: Domain name=LRR_1; Domain location=99-121; Score =11.8; E_value=1.7; Accession=PF00560.23; Description=Leucine Rich Repeat
  Pfam module annotation: Pfam domain module=LRR_1::LRR_1::LRR_1::LRR _1::LRR_1::LRR_1; Domain location=147-169::171-192::194-215::52 -74::75-97::99-121
MWISNNKWFTEDAHMNLFGLLQDYSWQLGTNNIFKQLNLPSMLPPYLVKLPHLRHVDFALNYLSGTIPKEWGSTKLTNISLFVNRISGEIPKELGSITTLTYLILSSNKLSGKLRVTFAKFQNLTDLRIGDINGPSQDFPMLRNMTGMAILVLRNCHITGELPIYFWSMKDLNMLDASFNKLVGEIPVAAHVGHLRFLFLTGNMLSGNVPEPVLMDGSSVDLSYNNFMWQEPDQPACRDDLSECKVFHNNYS

SEQ ID NO: 164330 - protein, 211 aa, Glycine max
  Coding DNA Sequence Number=SeqID_47552
  Homolog annotation: Hit_ID=P31687; Match level="QueryCoverage=30%, HitCoverage=11%, E-value=2e-18, Identity=76%"; Hit description=4 -coumarate--CoA ligase 2
MEKEKVKDEILEYICGRHQMGPSTIPIIFGPTGPLADNVLIFFGSKNYASNNVVVNYVRDRTSGELLTCVKHKEKISFITKFQFYKPGLGPCTPPSSPAPTPPTSSTSTLPPLASPSPVPSPPTPASSTWPPLAPSRTPQRPNLLNLCNASNDADHGGGEEGEDELGGVLEEDHDDVTLADSEVGQSNDDLAGNEVRLGVGEGFGGRFSKQ

SEQ ID NO: 164331 - protein, 231 aa, Glycine max
  Coding DNA Sequence Number=SeqID_47553
  Gene Ontology: Mol. function=hydrolase activity; Cellular component =beta-galactosidase complex; Biological process=carbohydrate metabolic process
  Homolog annotation: Hit_ID=Q27U85; Match level="QueryCoverage=94%, HitCoverage=96%, E-value=8e-68, Identity=58%"; Hit description=(1-4)- beta-mannan endohydrolase
MAWELMNEIRCPSDQSGNTVQGWITEMASYLKSIDGNHLLEAGLEGFYGLSKQESNPSFHVGTDFITNNQIPGIDFATVHSYPDQWLPGSSNEDQILFLVRWLNDHIQDSQNIQKPVLFAEFGVATKNISTDSTLRDQFFNLVYSAIYSSASDSGAAVGGLFWQLLAEGMDSFRDGYEVPLDESCSTATLIAQESEKLNRIRMKIFPRVKNSKKWNKAREVRIPRWQGGAN

SEQ ID NO: 164332 - protein, 192 aa, Glycine max
  Coding DNA Sequence Number=SeqID_47554
  Gene Ontology: Mol. function=DNA binding; Cellular component=nucleus; Biological process=regulation of transcription
  Homolog annotation: Hit_ID=UPI00000529F6; Match level="QueryCoverage =98%, HitCoverage=18%, E-value=1e-39, Identity=42%"; Hit description =transcription factor
  Pfam annotation: Domain name=JmjN; Domain location=1-38; Score=48.7; E_value=1.9e-11; Accession=PF02375.7; Description=jmjN domain
MEFEDTLGYIAKIHSQDEPYGICRIVPPACWVPPCLLQEKDLWENAKFPTCIQQIDLLQNREPTRKKIRGRKRKRRKQSKMGMGTRTAKSGSEANVASEPEEKFYFGLNDANEYEKVSDSSHQHRWKPFVEEIEGEYWRIIEQPTDEVEVYYGADLEIGSLGSGFPKTLSLTKNESDRYALSGWNLNNFPGL

SEQ ID NO: 164333 - protein, 135 aa, Glycine max
  Coding DNA Sequence Number=SeqID_47555
MEAETQMTQQKGEEAYLDVDGAVQCTSSMSEEKNLQSTTNTLTIMLKKNTQKKNRLKKKIHSCRRKKKGSRRSREKKKKRLGAQMFFKKGQGVCLHVVSKFYIPINGLEMAETSRGKMEGKKEEDVGVVLWSGVR

SEQ ID NO: 164334 - protein, 243 aa, Glycine max
  Coding DNA Sequence Number=SeqID_47556
  Gene Ontology: Mol. function=chitin binding; Cellular component =extracellular region; Biological process=chitin metabolic process
  Homolog annotation: Hit_ID=UPI00006A17C9; Match level="QueryCoverage =92%, HitCoverage=100%, E-value=1e-36, Identity=32%"; Hit description= UPI00006A17C9 related cluster
GSHRGLHVLTFKGLHVLAFRGLHALPFKGLHVLTFRGLHAFTFRGLHILTFRGLHALTFRGLHILAFSGLHALAFRRLHILAFIGLHDLTFKVLHALTFRGLHVLTFIGVHTLTFRGLHVLAFRGLHAFAFKGLHALAFRGLHVLLLRGLHVLTFRGLHVLPFKGLHAFAFRRLHVLLSRGLHALTFRGLHFLAFRVLHTLAFRGLHVHVFRGLHALTFIRLHHLAFIGLQICAFRELKVLRP

SEQ ID NO: 164335 - protein, 100 aa, Glycine max
  Coding DNA Sequence Number=SeqID_47557
MIAKGAQPLPLSLQRPFIEKWGRRLLPSSPRRAGGFLLKQHARPSELVASYRPLALLAKPVKRKSIKDIKCISKSLGALKSIKMDNRDGLRMPSDLIVFG

SEQ ID NO: 164336 - protein, 106 aa, Glycine max
  Coding DNA Sequence Number=SeqID_47558
MTQFMFRQEKYCVEVEAQEKSPVKEHESREKDEEKDEKQVQQQWENPFAKRKPHAKRVFGHVLSRESQALSDQPLHLRLIWSAKLAKDELSQLQFDLNLAKLQPDR

SEQ ID NO: 164337 - protein, 217 aa, Glycine max
  Coding DNA Sequence Number=SeqID_47559
YVGAKASLLSTAPPFPIMTCESDDVWRYRMVIRTFRQPGANKPIDMQGLMSSSAPFVNQGKASLDGKFDDMRGYRMVICTFRQPGAKKPVDGQGLMSSSAPFVNQEGSKPFDAQGLTNGESDDMRGYRMVIHTFRQPGANKPVDTQGLTLSSVPFVNQGGSKPVDVDGKSDDMRGYRMVIRTFCHLEMASPMTCGGTVWLSAPFVNQRQTSPLTRKD

SEQ ID NO: 164338 - protein, 379 aa, Glycine max
  Coding DNA Sequence Number=SeqID_47560
  Gene Ontology: Mol. function=transporter activity; Cellular component= integral to membrane; Biological process=auxin mediated signaling pathway
  Homolog annotation: Hit_ID=Q673E7; Match level="QueryCoverage=95%, HitCoverage=81%, E-value=2e-79, Identity=44%"; Hit description =Putative auxin efflux carrier protein 7
  Pfam annotation: Domain name=Mem_trans; Domain location=9-378; Score =134.0; E_value=4e-37; Accession=PF03547.8; Description=Membrane transport protein
MIDGVAIYNIVAALVPLYVPMILAYASVLWWKIFTPEQCSGINRLVALYSVPFLNFNFLAFNNPYAMNLRFIAADTLQKVIILGALFLWSAFTKCGNLDWTITLFSLSTLPNTLIVGVPLLTAIGAKSLISNQFPENGGSIASFTVDSDVNSLNGNEPLQADVEMKENGELHVVVRSHSFNNDSPCNCSTSNHCSEAEICSMQRSLSFNTTRDLKREGSKEEMSKIDQEKMSRKDACNHLSNGVKHESIDMSPNLKAMGDKEVGIVNVVQYPLSEGLKEEKIEEGDAYKKQQQMPRGSVMTRLVLTMVWRNLIRNPNTYACVLGLAWSLISFRWNIKMPSIAKGSILILSKTGTGMAMFSLGTSLQHFFSFLPDDVIFN

SEQ ID NO: 164339 - protein, 147 aa, Glycine max
  Coding DNA Sequence Number=SeqID_47561
MTSNGVVASEYGGNSFVNGYANNVMESEDANRSLVKYVNDNGVAAKVVEYFAEALKWKEDGRKKRLEEIGKGDAWLKKQTGEAPIEKPISQGVVGATLVVEELGRRKENFGNYMEVTFRKRQFLKKIKLPSTAKNHIFINRQKPPVL

SEQ ID NO: 164340 - protein, 210 aa, Glycine max
  Coding DNA Sequence Number=SeqID_47562
  Gene Ontology: Mol. function=protein dimerization activity; Biological process=regulation of transcription, DNA-dependent
  Homolog annotation: Hit_ID=Q1SYN6; Match level="QueryCoverage=91%, HitCoverage=27%, E-value=1e-55, Identity=53%"; Hit description=Zinc finger, BED-type predicted
MDLEVVGSALKKIRDRIKYVRASEARKIAFKECVLQVRGIDAKVGLRMDVATRWNSTYVMLESETKYQHAFGCLAIRDRNYVHCPSNDEWKRAEKMCEFLKPFNVMTNLISSASYPTSNRYFMQVWKIESLLREYVVSHDLVIRVMALKMFAKFTKYYREYYEILVIGAILNPRWKFKVIWFAYTKIDPSTCEEKIINLRKKIENCLTNM

SEQ ID NO: 164341 - protein, 60 aa, Glycine max
  Coding DNA Sequence Number=SeqID_47563
MRETQSSYGLLRFKPKIPKTWRSMIAEWVCKKSSDNSTLDTTVSVTSGEHEGGHRVGEAQ

SEQ ID NO: 164342 - protein, 202 aa, Glycine max
  Coding DNA Sequence Number=SeqID_47564
  Gene Ontology: Mol. function=GTP binding; Cellular component=nucleus; Biological process=small GTPase mediated signal transduction
  Homolog annotation: Hit_ID=Q8LIM1; Match level="QueryCoverage=97%, HitCoverage=33%, E-value=2e-84, Identity=71%"; Hit description =Putative GTP binding protein
  Pfam annotation: Domain name=MMR_HSR1; Domain location=56-170; Score =58.4; E_value=2.3e-14; Accession=PF01926.13; Description=GTPase of unknown function
  Pfam annotation: Domain name=NOG1; Domain location=122-168; Score =29.2; E_value=3.5e-06; Accession=PF06858.4; Description=Nucleolar GTP-binding protein 1 (NOG1)
  Pfam module annotation: Pfam domain module=MMR_HSR1::NOG1; Domain location=56-170::122-168
MELDKYGDSLYRCKCVKVVALGHMCTVIKRVDPSLAYLEQVRQHMARLPSIDPNTRTVLICGYPNVGKSSFINKIMRVDVDVQPYAFTTKSLFVGHIDYKYMRYQVIDTPGILDRPFEDYNIIEMCSITALTHLRAAILFFLDVSGSCDLQPLEGISKENMKLVNEMKAEALKTLVGQGGEPTDNNSVLLTVSTLTEKEQLL

SEQ ID NO: 164343 - protein, 378 aa, Glycine max
  Coding DNA Sequence Number=SeqID_47565
  Homolog annotation: Hit_ID=Q52GZ3; Match level="QueryCoverage=30%, HitCoverage=11%, E-value=8e-47, Identity=76%"; Hit description=DNA -dependent RNA polymerase
  Pfam annotation: Domain name=RNA_pol; Domain location=3-341; Score= -108.2; E_value=4.1e-07; Accession=PF00940.10; Description=DNA -dependent RNA polymerase
MLDTPLGESAPLMLRKLSKQLSSEDWTWNNLNTLCWAIGSISGSMMEEQIDRKLVKQTVRTSVYGVTFVGAREQIKRRLEEKGLITDEKLLFAAACYAAKVTLTALGEIFGAARVIMGWLGDCAKVIAFENQPVCWTTPLGLPVVQPYCKTERHLIAREVLDVAAPIIQPSVTTDEIDRVVHAATIAASANFNVEAVAVQLTQREGELIQEKSEVKKLTNFLKQFRLAYVSPESTVVGAGHLVDHPKKIALHYLKGQCLRKTILESKLKTCRHCLRKLSSKTMSSYPSLKVNTFNDVTFYDDQQLSLYYSIKMIILKFAVATRQYMRFHLSKKIPVEWISILRKICWYLVLSPHDPMQSSLINSTLENKNVKQVASIT

SEQ ID NO: 164344 - protein, 66 aa, Glycine max
  Coding DNA Sequence Number=SeqID_47566
  Homolog annotation: Hit_ID=Q9AYI2; Match level="QueryCoverage=96%, HitCoverage=20%, E-value=7e-07, Identity=41%"; Hit description =Putative lipase-like protein
MGGTISLNIHFKQHTAWNGVALIAPLCKVYLLEFKAPYNVLLYNDKPRLGTAESHTGARTTFGRSK

SEQ ID NO: 164345 - protein, 270 aa, Glycine max
  Coding DNA Sequence Number=SeqID_47567
  Gene Ontology: Mol. function=RNA-directed DNA polymerase activity; Cellular component=extracellular region; Biological process=RNA -dependent DNA replication
  Homolog annotation: Hit_ID=Q1T5K4; Match level="QueryCoverage=95%, HitCoverage=27%, E-value=3e-35, Identity=38%"; Hit description=RNA -directed DNA polymerase
MDLEVFALILYIRSCQWKPNGGVLHEKMNKTSLVREAEDKDLLAGVKVSNGNLKLPLLQYVDDAIFFFRKGIKDTITLKTILRCFELVTGLKVNFSKSSLVSINVDQRDCLSCARILNCNTMSFPFTYLGLPVGADTRKISTWQPVIDKLKKKLAQWRRRHLSFGGRICLMRWGRRGKRLGALLGKWVWMLVSERVGLWREVLMEKYGFRDFDKFIGGYYDHKGSHYERNRGLGSKESCSSRRGWGKYELLVFKVGGRSEVGVGMLGGGT

SEQ ID NO: 164346 - protein, 143 aa, Glycine max
  Coding DNA Sequence Number=SeqID_47568
MGEGLLGGGLGLEVKLFSMGVGGSSGGVYRVKYAYKLLRMMKDRRVEEGIRKVWNKLVPLKLVNHSLATFCQTVSQIRYYAWGNIANNCMVGVLGNQIKGAAMKVNDAILPRKGPVTRSMSKRLQEDWARAAEEGPRVLMNLR

SEQ ID NO: 164347 - protein, 207 aa, Glycine max
  Coding DNA Sequence Number=SeqID_47569
MEGDQRTYRKGKAKYSMPTRDEDGGIWKGMDKAINLVNVYSHCAFNEKLALWEELLQLRRTVGEGLWCLERVGNNGGIQQRGREILEFNNFIENMELVELPSVGRKFSRIKEAGPKPFKVFNHWIEKPGFVDYVRQMFTSYDVRGWGAIILKEIKLLKKGIRKCCVEKLGGFQAIVDGNMARVNLLDGKEELGMITLDEVYEREELL

SEQ ID NO: 164348 - protein, 330 aa, Glycine max
  Coding DNA Sequence Number=SeqID_47570
  Homolog annotation: Hit_ID=Q9FFD9; Match level="QueryCoverage=43%, HitCoverage=38%, E-value=7e-18, Identity=34%"; Hit description =Genomic DNA, chromosome 5, P1 clone:MQK4
  Subcellular localization annotation: CTP_CleavageSite=26; ConfidenceScore=5.16e-01
MMWLASICTTVAFASASYIVVVFLVLCAQRGRRKEKNLFMSGSNSGSETDLDVSPIMLFDDDASSFKGFDHLILLYACFWRLKNIEKMKTLRSQSVCVFATLVFQGGVINKASKLVGMRLYEGGWHCIRTFGSGWAICGHYSLVYDFKGFERGSIASTVDVHLYNCSSSRVDFLSSDGKIICSSNQSCMLKFISEPIRLITTFLKIVPLVTGYISETQSLNVKMRGFVEEDIPTSCLKLTLEQRAEYSPGAGIPQMYYDSSVVIESELPLFKRIIWHWKICIFAWITMMAFMMELLFVLVCYLPIIIPRTTQRSGSARGTGTQNNLQALS

SEQ ID NO: 164349 - protein, 231 aa, Glycine max
  Coding DNA Sequence Number=SeqID_47571
  Gene Ontology: Mol. function=jasmonate O-methyltransferase activity; Cellular component=nucleus; Biological process=fatty acid biosynthetic process
  Homolog annotation: Hit_ID=Q9AR07; Match level="QueryCoverage=85%, HitCoverage=52%, E-value=7e-56, Identity=53%"; Hit description =Jasmonate O-methyltransferase
  Pfam annotation: Domain name=Methyltransf_7; Domain location=1-230; Score=174.4; E_value=2.9e-49; Accession=PF03492.6; Description=SAM dependent carboxyl methyltransferase
MASLETGSVRYPTFGYKEMVPGGLEDGSGRALNKQKIYLSKSSPKCVLDAYSRQFKNDFSVFLASRSQEIVAGGRMVLSLMGRETMDPTTDHSCYQWELLARSLMTMVSEGLLEEEKVDSFDAPYYAPCLEEMKMEIQKEGSFIVDEHEAYEIDWDAGMKLQSDSPTVTPLTSGERVARTIRAVVESMLEPHFGCHIMDELFRRYAEVVEDHLSKTRTTYINLVISLVKQG

SEQ ID NO: 164350 - protein, 193 aa, Glycine max
  Coding DNA Sequence Number=SeqID_47572
  Gene Ontology: Mol. function=oxidoreductase activity; Cellular component=microsome; Biological process=aromatic compound metabolic process
  Homolog annotation: Hit_ID=Q9FVQ0; Match level="QueryCoverage=99%, HitCoverage=50%, E-value=1e-63, Identity=60%"; Hit description =Flavin-containing monooxygenase, putative
PAGLATAACLNKYSIPNVVLERDDCHASLWRKRAYDRLKLHLGKDFCNLPHMPFPPDFPTFVPRVDFLRYLDNYVTRFKISIRYNRNVESASMDEQNNGKWRVVVKDTTTNADEVYVANYLVVATGENSEGYVPQIEGLEGFEGKHMHCSEYLNGRDLYGKHVLVVGCGNSGMEIAYDLSNWGANTSIVVRGP

SEQ ID NO: 164351 - protein, 68 aa, Glycine max
  Coding DNA Sequence Number=SeqID_47573
  Subcellular localization annotation: CTP_CleavageSite=62; ConfidenceScore=5.21e-01
MLKLLQFQAKRREGSSSYCLAKRSICAYSLSVLRNPRREFSQRCARSVRRKLAQRVICLFPRSARPTR

SEQ ID NO: 164352 - protein, 128 aa, Glycine max
  Coding DNA Sequence Number=SeqID_47574
  Subcellular localization annotation: CTP_CleavageSite=30; ConfidenceScore=5.21e-01
MGLSWFGTTIYVFVVKYQGQRSSFDQLMVSSTMCNSQDFSRMPLQALSDGPPEPLVVPVPEIDGLRYTAHKLVSPTPLSGYAITNHGLRAVLGNLVLLLAWERPVLSTPYMKNNRALIQHQQLSKSPQ

SEQ ID NO: 164353 - protein, 849 aa, Glycine max
  Coding DNA Sequence Number=SeqID_47575
  Gene Ontology: Mol. function=DNA binding; Cellular component=nucleus; Biological process=regulation of transcription, DNA-dependent
  Homolog annotation: Hit_ID=Q948S5; Match level="QueryCoverage=97%, HitCoverage=87%, E-value=1e-151, Identity=40%"; Hit description=Myb
  Pfam annotation: Domain name=Myb_DNA-binding; Domain location=29-74; Score=45.3; E_value=2e-10; Accession=PF00249.21; Description=Myb -like DNA-binding domain
MDSGEMIGLDGIPIEVWKWVNHLDPTIKKEAWTQEEELALIHYHQSFGNKWAELSKVIPGRTDNAIKNHWNSSVKKKLDSYLASGLLTQFESVPHAGNLNQPTRLQCSRDDNGPKSTEGEEVSDCSQGSANAVYFPSATGPSSVDLQTGEAYRPNEECSLGKDHSPSRACSEPYYVSIDDVTICIPEIAHQEACTSQFIEQQSHEPGNSICGDCQFNLHSLPNVSSMVLGQESSELQRDFIAPCEICDMISETGGTSTSQLTCPQCSNNYKGISSSQSVPLVLSASDDRLGPTANGNQLFGMEDHHFVSRACANFTYVNNISSSCVDGVGSAVMEEPHDILKGTSKLVPVNNFGCGSDAKQTCNPTAEKTNVHTEKEGSGSLCYEPPRFPSLDIPFFSCDLVQSGSDMQQEFSPLGIRQFMMSSMNCLTPFRLWDSPSCDDSPDALLKSAAKTFTGTPSILKKRPRDLLSPLSDKRMDKKLETDMASSTFTRNFSSLVAAFGDNETRKADMPSYSYPLQKQNSRASVDDDNKENCGHTYKWEQLMNCSPIKSATLDEKNSQRDTVDGNSQHNVKQRPLDSKMKTTEIEQQQSGILVEHDMNDLSLSSPDQVGLKSDRGLDSSAKITKGLNKSLEAASNQSGHLKLSSKNPCPRVNSCSPCVRAKEHEGLSVAVTRVQAPGDNSGEQTRKDGGFETCSIFGGTPFGTPSAWKSPWFFNTFLSSPRLDTEITIEDFGYFMSPGDRSYDALGLLKHISEQTAATYANAQEILGNETPKALPKDASENDKDKDHENNYPVNQSGNHSQLPSNALIERRTLDFSECETPGRDENSKSSAMSFSSPSSYLMKGCR

SEQ ID NO: 164354 - protein, 183 aa, Glycine max
  Coding DNA Sequence Number=SeqID_47576
MGEVTQGSVTKLFTLELVTLFKVMSLGGVELTSATNFLRAGSKEMLDLSGSQKRNTRHLSFGICKVNATILLVSIISINLTMPIELNHNRGEASSSVPQSEGPDWWELLRVVGQWRWKRRWPWRFKEREWSSSLEEVCGRNCWRENMMMSFHFSGVRESENGSRVRLGSGNSSSSWLRFVLYN

SEQ ID NO: 164355 - protein, 120 aa, Glycine max
  Coding DNA Sequence Number=SeqID_47577
MKREKGREREREREREREREREREREREREVTGGDGEVQFLEFGVRLDLFSPSWVNCSLLGLNSCTVGTYKFIPAAPWKGIIMIWRTNFEESCNPVRIGSMAAPSHGQVDGAQKVRALHG

SEQ ID NO: 164356 - protein, 112 aa, Glycine max
  Coding DNA Sequence Number=SeqID_47578
MDKEKLWPKVTSIHKASIVTLSEPGLSLRLFVINDDNEVVTKEIMSPFAYCRRNSIITPMALPEASVSKVNDIAKFVGTNTRASVVAFFRLVEHGIDLGWIWGNTIGRDDMT

SEQ ID NO: 164357 - protein, 720 aa, Glycine max
  Coding DNA Sequence Number=SeqID_47579
  Gene Ontology: Mol. function=inorganic anion exchanger activity; Cellular component=integral to membrane; Biological process=anion transport
  Homolog annotation: Hit_ID=Q7X9F3; Match level="QueryCoverage=95%, HitCoverage=96%, E-value=0.0, Identity=71%"; Hit description=Boron transporter
  Pfam annotation: Domain name=HCO3_cotransp; Domain location=7-553; Score=-86.2; E_value=2.9e-13; Accession=PF00955.11; Description=HCO3- transporter family
MEETFVPLRGIKNDLKARIPCYRQDWTSGFQAGIRILAPTTYIFFASAIPVISFGEQLERNTDGSLTAVQTLASTALCGIIHSIIGGQPLLILGVAEPTVLMYTFMYNFAKDRQDLGHKLFLPWTGWVCVWTALLLFLLAVLGACSIINRFTRLAGELFGLLIAMLFMQQAIKGLVEEFGAPKNQREGTNQIALQSSWLFGNGMFALVLSFGLLFTGLQSRKARSWRYGSGWLRGFIADYGVPLMVLIWTAVSYIPVNEVPRGIPRRLFSPNPWSPGAYSNWTVVKEMLNVPPLYIVGAFIPATMIAVLYYFDHSVASQLAQQKEFNLRKPSSYHYDLLLLGFLTILCGLIGIPPSNGVIPQSPMHTKSLATLKHQLLRNKLVSTARKSMRRNVNLSQLYQNMKEAYDEIQTPLVPQMPTTLGLKELKESTIELASSQGYIDAPVDEVVFDVNKDVDDLLPVEVKEQRLSNLLQALMVAACVAAMPVLKKIPTSVLWGYFAFMAIESLPGNQFWERILYLFTAPSRRYILLEEYHATFVETVPFKTIAMFTVFQTVYLLLCFGITWIPIAGVLFPLLIMLLVPVRQYFLPKFFKGAHLQELDAAAYEEAPAIAFNMSFEGPSSQAPTINISGGEILDEVITRSRGEFRRTQSPKTTSSTPTSTGDIRPANSPQLARRIPSPRVTELRGESSLRPTGKEIKLMQTPSPRSPGLGKVTKDLP

SEQ ID NO: 164358 - protein, 380 aa, Glycine max
  Coding DNA Sequence Number=SeqID_47580
  Subcellular localization annotation: CTP_CleavageSite=25; ConfidenceScore=5.25e-01
MPVSAATPSSGSFIGVSAGVSLGVSSASASTSGHMSHEGLHAHDRPLLSQIVNTLHHQAKAVGSAGAKGAGGAGARAEVEASEGALALALWAPGNIIVGSFGDNSSGYARCSDQCKKAKPRGVGLGHLRDLSRNDRAYVHVHLHHELVNQPHLVHIKIEGVRGSVPLAPPPGGTHHTVRRPTPHSFMGGCLEVEARLFLETICTKTQQMSQVRQDKYGPSDGGPSKRQRLKPMPDSNPKALIQASMLSQSDRDMLRKVGPSASMDPIARFAALKIKLTTVDNSVKALQEEVELLKKEFALSKVAAEKMKEKMKIDLNEVEVKILKTHEVGFNKAIRQVKYFFKDADMFLFNVDNNITCQGDLVNEVEMSDIPSSWNCFAG

SEQ ID NO: 164359 - protein, 187 aa, Glycine max
  Coding DNA Sequence Number=SeqID_47581
AGESGRAATSLSESSGMSIKGGAGGASGGGRISTFGEAGGSTIGGCSSAGAGSILVGMGLGAQPREIFLTAAELQARPLYLKIAPWILLAYYEPTAAGGGLDNEGMSLALALFLEAIYLAKPKTCRNDVRLALPEPRLALSLHSTLVIVMKLHLTNAFSTLPLSKRFAKQESHLVLQGQPLSGARSK

SEQ ID NO: 164360 - protein, 138 aa, Glycine max
  Coding DNA Sequence Number=SeqID_47582
MEELTEDHYHEKVLPNLVRIFGTHREMRSEKPPQGKAFAILGTPVMGTLGNGSPASVVDLLCQNVERRNVLGYTIRYKTANTGSRMHPFIDGIMKVHLPPRWKTLNIDRYDGLSDPDEHVGAFMMQMNLFTNEDALMC

SEQ ID NO: 164361 - protein, 88 aa, Glycine max
  Coding DNA Sequence Number=SeqID_47583
MMFFLSYTKAKAENAQVRNGIGQGNVTHTPDVFSKIPTIYISGCYTLSARRDNVLAGRAGCVLGAQISELSSSRVSHPLSELDASLNG

SEQ ID NO: 164362 - protein, 476 aa, Glycine max
  Coding DNA Sequence Number=SeqID_47584
  Pfam annotation: Domain name=zf-CCHC; Domain location=67-84; Score =21.7; E_value=0.00026; Accession=PF00098.13; Description=Zinc knuckle
MVIDVLNEVPKENGGKAIQTLLFNECGIYKESSSLVMYSTSSDRALQWHLPSKGSLGKLLKDKGLQSMCFRCGQVGHKKDNCTQFIGADAVKQTVSQTEEASKSVNILETQTAVNNLSNIHGGSNANINPKHNLQVTKSHNHVINDTDSIHGEWLIAKRNYRKMKLNVAKKEGVIMGKNNKGVAENNSNNGKKSGSISVDIGSRFGVLSVRDNGELVIGAEGDATKNSNVDGAANNNDEVNKSRVGPTKVNGNHVRVVHVPELNKSIVLSMSSQKLTYASSSKEPVKQAHVRNMVGRVLRKNKTQVNKELAKQIAKNVLVGVKKRDAMYEESLNLLKMSQFTNPNIQLPSFMVKSHVDKEAIEFVNSQRQLEVASKVHNSVQESVMDYSGVAAMEEERTQETPSIGYDMRQFDSSFLVLMETRTSSGDCARSIIHRIGLNFFVQDVIGHVGGIWFMWNPKDWQVDVLNNSSQFVKK

SEQ ID NO: 164363 - protein, 151 aa, Glycine max
  Coding DNA Sequence Number=SeqID_47585
  Gene Ontology: Mol. function=RNA-directed DNA polymerase activity; Biological process=RNA-dependent DNA replication
MNKRGGKAKNATGPEKPLKHAKGTHLKLDSKATKSMPPITFMDEDFRDIDRCHNDPMVVKIEASNFLDKKGSKSIMIKYLTVSVRTSYNALIGRPSLNELGVIISTPHLTMKFPSKNGRIIVVWADQITTRECYATSLRVGKEKKGIKPKA

SEQ ID NO: 164364 - protein, 176 aa, Glycine max
  Coding DNA Sequence Number=SeqID_47586
  Gene Ontology: Mol. function=RNA-directed DNA polymerase activity; Biological process=RNA-dependent DNA replication
MDVEKVVNRVLEANADLFAWSMSDMPEIDPEFHWHKLALFPEARPFVQRKRKLDPERGKVVDEEARKLLSVGLYVNGLSNEKGSGAGVIRESLDKVILEQSLRFKFETTNNQAEYEALLAKLRFAKEHIAQENNEQADLLSKLASTKKKGQHRMVIKETILEQSLVVASMTPSNQE

SEQ ID NO: 164365 - protein, 110 aa, Glycine max
  Coding DNA Sequence Number=SeqID_47587
MENNDRKSNENSQSKSTSEVLEKGDPPSATQRGSDTNIKRDHDTINDGVTHTNVIGLGTSNIKTTMKNDVSSISSLRLGTMYIYDKDLKLLHLALELGGLMSYLDSGSLY

SEQ ID NO: 164366 - protein, 44 aa, Glycine max
  Coding DNA Sequence Number=SeqID_47588
MGMFDYQSIRKAQDEKVEKAKAEKCFNGSWTSQHPKARSASMSH

SEQ ID NO: 164367 - protein, 308 aa, Glycine max
  Coding DNA Sequence Number=SeqID_47589
  Gene Ontology: Mol. function=DNA binding; Cellular component=nucleus; Biological process=regulation of transcription, DNA-dependent
  Homolog annotation: Hit_ID=Q9S7L2; Match level="QueryCoverage=86%, HitCoverage=77%, E-value=3e-56, Identity=42%"; Hit description =Transcription factor MYB98
  Pfam annotation: Domain name=Myb_DNA-binding; Domain location=205 -250; Score=54.7; E_value=3e-13; Accession=PF00249.21; Description =Myb-like DNA-binding domain
MDLETMFKETYVSQPTHLQESCLQPSLKDVLLSSYGFFKDFHHIDQFHHVNISSSNTIQTPNFDAFDNFTNTGSSPDFDFMILEPPSKSQRNQLDMMVANQRFLPFNPQEIKPSNFVVPYEVSCTSPVYYYKRVGVNKNNKSYPTTRRTFKVRKKSNIVKGKWTIDDGFTISNSIQPHIAKILPGRIGKQRRERWHNHLRPDIKKDTWTDEEDKVLIEVHDEVGNKWAEIATRLPGRTENSIKNHWNATKRRQHSKRKCRSKYLRGTLLQEYIKSLNLDKNPPRYYRRKCSSNYGSAIMSDDNKISTS

SEQ ID NO: 164368 - protein, 64 aa, Glycine max
  Coding DNA Sequence Number=SeqID_47590
MSWWRNEWSGGTYWDMIAGRGGTGRDEDGVVGAGGLKCEVGGLGTCEVMLGERELGFLKGKMVS

SEQ ID NO: 164369 - protein, 446 aa, Glycine max
  Coding DNA Sequence Number=SeqID_47591
  Gene Ontology: Mol. function=transmembrane receptor activity; Cellular component=membrane; Biological process=defense response
  Homolog annotation: Hit_ID=Q1SLQ9; Match level="QueryCoverage=56%, HitCoverage=99%, E-value=2e-34, Identity=37%"; Hit description=TIR
  Pfam annotation: Domain name=TIR; Domain location=19-152; Score=45.1; E_value=2.4e-10; Accession=PF01582.10; Description=TIR domain
MACNSIQSSSSLCTRNFDVFLSFRGTDTHNGFIDHLFASLPRKGVAAFRDDQTIKKGNSWSLGILQAIEGLRVYIVVFSKDYALSTWCMKELAKIVDWVEETGLKTEWRVQKSFWREALKAITNSCGGDFGSLLYFGVSGHNMKKLKKLLKRDVSEWRSALTRLKENPSKDMMDEDVTELLAYCRFYPNIAMKVLIEKSLISCTETRMIQIHDLLKELDKSIVREKSPKESRKWSRIWDYKDFQNATIENMEAEILEAIVVKQYPKESMEKVLNVDAISKMNHHKLLILENDSLQPSSSLGKMDIIIPGTQIPKWFNKQNSSSSISMDPFPVMDDPNLIGVACCVLFVTHDDPSNLGDRWHPCDCPSFGYGVRNKQLECETYFTVPILFKKDLVTVEFHHLLVMFFTQDLFIPLVSECSNEMQDLDTMEFAPLIYPPPGLHLEVNN

SEQ ID NO: 164370 - protein, 71 aa, Glycine max
  Coding DNA Sequence Number=SeqID_47592
MNHMQEFDMQIYSLRCNICWPWNTVPSRNLGSFKDALLATNFLWDYTNVVMNFHYESSEENERSPSIDGTR

SEQ ID NO: 164371 - protein, 183 aa, Glycine max
  Coding DNA Sequence Number=SeqID_47593
MNYKDVIEMIIVPKSYTEALLGGKGVSLHGKDVEEDEDEFCGLRIEERKLGEYECLTLILSESEEKRIQRPWSTSVIVKLLDRKIRFKALETRLKQMWGGKDSGVGQHIPEGPWTIVKKMRHPRRGKERDNGDPNLMHNQGSRFRVLSGHQDEDNQAGVGKQPMVPRVNEMRENLVTMEIKDG

SEQ ID NO: 164372 - protein, 220 aa, Glycine max
  Coding DNA Sequence Number=SeqID_47594
  Gene Ontology: Mol. function=RNA-directed DNA polymerase activity; Cellular component=chromatin; Biological process=chromatin assembly or disassembly
MYKVMCTTLVNEDDNLMTLDASNDAQCCLYRVAGQSGRVVFPQGKQEVPSSRAHRPRKQRGERIWHDNGSSNCNTHHNYNISRARDARPSQPGRARATAWTRDKSCKARTSRCMFGERPEMMQLRRKGGTPRVIVQGWSKAQLQSLKEGRSGGQLIIMIHPLKPTQCSSVEVGALVSSNRGTSRFMRGGEGGSRLLLSGTRSGNRCYRPWEGSMKAPIDG

SEQ ID NO: 164373 - protein, 365 aa, Glycine max
  Coding DNA Sequence Number=SeqID_47595
  Gene Ontology: Mol. function=RNA-directed DNA polymerase activity; Cellular component=nucleus; Biological process=RNA-dependent DNA replication
MAIPKSILLEIEKVQRAFIWGDTQDKCRVHVIDWRTMSLPKVNGGAAMCNLRKTNTACLMKLGKERWAIGSGSTAHAWKDKWIDDCTRVEDVVRDIPYQFQNLTMSELTDDVGQWSLSLLNQFLPIGRFLYFKHLYEVKLFFINWSRRIIEDSYGILNLFKDHCQVVDEKILHVMRDCPLASMVWMHLLRVDHRADFFGLQLDRWILWNLNMRAHSMYGISWLELWANACHLIWFWRNKDLHDANFVRPIRPWIPPDPGWICLNTDGPLKRDLGFAVVELWGVFKGLNLARAKNFSHVVLHVDSLVVVQVSHVYKEGNMCADALANLAYQMQESDSVVFELAPSSICSLVSSTARGDSLPQDVLL

SEQ ID NO: 164374 - protein, 494 aa, Glycine max
  Coding DNA Sequence Number=SeqID_47596
  Gene Ontology: Mol. function=RNA-directed DNA polymerase activity; Cellular component=chromatin; Biological process=chromatin assembly or disassembly
  Pfam annotation: Domain name=zf-H2C2; Domain location=320-361; Score =7.4; E_value=0.037; Accession=PF09337.1; Description=His(2)-Cys(2) zinc finger
MVGNDIEIACDKVCRDVAVLIQGHKFDLDLYVMALGGVDLVLGVARLKLLGPITIDYSHLTMSFVYHGQPITIQGGITPGPSEITHGQVKYLMSTQRVATLFHIQLQESGPVTSDTLILPPPLHRLLDKYSHFFQTPTLLPPSRPTDHTIHLEPNLKPVNVRPYRYPYYQKQEIERQVEDMPWCQLIRPIRSPYSSPVLLVKKKDVTWRFYWSFVKNYAHIVDPVTHLLRKDQFVWSPEAQLAFDNLKQAMTTTLVLSLSDSSVPFIVKTDESRSGMGVVLMQRGHQIAFFSKDNLLLHQGHIWINRENSFIPLLLEEYHKSLLDGHMGLAKTLNHIQQSFFWEGMRRDTQQFIKQCTDCLQTKYVPQKPTGLLQPTPPPSRPWEDLALDFVTGLPNYQGATVIMTVVDRFSKGAHFGTLPTHFTAHTVALTEWCYNTTCHSSTNWFPYEVTYGKPPPGVPDYLPGLSTVEVVDFLLSSRQDMFEALCRKLERT

SEQ ID NO: 164375 - protein, 53 aa, Glycine max
  Coding DNA Sequence Number=SeqID_47597
SIFTARTLNFAFMPEYDPGEFYASFEMQPGTPIEVTEKQARKGTRGLHDSCAS

SEQ ID NO: 164376 - protein, 133 aa, Glycine max
  Coding DNA Sequence Number=SeqID_47598
MNCVFVHVYEFGARLSDCLLQFSILTLFQSPMNCVFVHVSSTFEFGAMRSDCLVQFSILILFRSPMNCVFVHVSSTFEFGAMRSDCLVQFPIHNLFRSPMNCIFVHVSSTFEFGAMRSDCLVKFSILNLFGAP

SEQ ID NO: 164377 - protein, 145 aa, Glycine max
  Coding DNA Sequence Number=SeqID_47599
MLGMKQIKEKNAATAAAVSSAAESRPDSLGSHAPASLKHKDAGHIASPVHEKEPPQQPDEVHKDPQDYARRDVEFYPPIPEGPAPGTLPQPNIAASPIVLSMEGPPPATEERRKLDLLEERLRAVEGFGDYPFADMTDLCLVPDV

SEQ ID NO: 164378 - protein, 131 aa, Glycine max
  Coding DNA Sequence Number=SeqID_47600
  Gene Ontology: Mol. function=RNA-directed DNA polymerase activity; Cellular component=intracellular; Biological process=RNA-dependent DNA replication
  Homolog annotation: Hit_ID=Q1SYR3; Match level="QueryCoverage=81%, HitCoverage=4%, E-value=2e-31, Identity=54%"; Hit description=RNase H, putative
MSANVRDELVTLFQDYQDIFAWSYQDMPGLSSDIVQHKLPLNPECSPVKQKLRRMKLEMSLKIKEVKKQFDVGFLAVAQYPEWVTSIVPVLKKDGKIKMALEDMEKTTFITLWGYGKDNLHHKSSFKEIES

SEQ ID NO: 164379 - protein, 261 aa, Glycine max
  Coding DNA Sequence Number=SeqID_47601
  Pfam annotation: Domain name=zf-C2HC_plant; Domain location=37-84; Score=14.3; E_value=0.00083; Accession=PF07567.3; Description =Protein of unknown function, DUF1544
MSFKGRRKKKGYGHMGVGIWDNVGMGWEGGNLREKRTPRPDKSRNSILSRCGKVISCGITRLKDHLARIPGEVTGCGDEHDEVQDFMDEDAYIIQAAQERIMSHKQWEDKQRFRQQTRGNSYAAKAWNNPKLTRESRKPKKFGKAVSKLIIYERLSINLANSPRLYNLINADAELGLGVKAPPPYEFLEVYLEEEHKVMQSWIEGLKPTCAHCLDLYSEDIGKKYLKATDIIKVFESIVKVVMEVMKNKQEQQQEMQQNRN

SEQ ID NO: 164380 - protein, 85 aa, Glycine max
  Coding DNA Sequence Number=SeqID_47602
MGSNQAPSFEKRFYHVKVKNLELASLRELGQWMDQVRRQAFSKAYGKIWDLAMIEVSIEGYQGSTWRRRQKLWQIKESGPRSLTY

SEQ ID NO: 164381 - protein, 205 aa, Glycine max
  Coding DNA Sequence Number=SeqID_47603
MKLNMRQTMRISQEEIQDSFNPINLNYIFQEEDTLSPWLEERERPLTEGAHNFDLLPMEFDDDNEEAIGGNDSDLSQTPSDGGGDGGLSPPNNNNNSCSGDGGDNISQKGEVEGKGMKMVYWMILPHLEYHNPLVILVLLHQLKHLRKTAAIRIAEFVILVTVKTLTRPQFEILSWTDASMATQEGEAYEGHEMGETAALSMENS

SEQ ID NO: 164382 - protein, 91 aa, Glycine max
  Coding DNA Sequence Number=SeqID_47604
  Homolog annotation: Hit_ID=Q1SH28; Match level="QueryCoverage=53%, HitCoverage=5%, E-value=5e-10, Identity=62%"; Hit description =Integrase, catalytic region
MVLVIKWVYKIKHRVDGTIERYKARLEAKGYNQVEGLDIDGYCYVPELEDRNFLQNERVAINPNGFANTKGTSHNRMDSGGQALTGKQQQY

SEQ ID NO: 164383 - protein, 273 aa, Glycine max
  Coding DNA Sequence Number=SeqID_47605
  Gene Ontology: Mol. function=nuclease activity; Biological process =response to DNA damage stimulus
  Homolog annotation: Hit_ID=Q00ZI2; Match level="QueryCoverage=63%, HitCoverage=68%, E-value=1e-24, Identity=35%"; Hit description=[P] KOG4408 Putative Mg2+ and Co2+ transporter CorD
  Pfam annotation: Domain name=DUF525; Domain location=142-265; Score =155.9; E_value=1.1e-43; Accession=PF04379.5; Description=Protein of unknown function (DUF525)
  Pfam annotation: Domain name=UVR; Domain location=104-134; Score =13.0; E_value=0.016; Accession=PF02151.9; Description=UvrBuvrC motif
  Pfam annotation: Domain name=UVR; Domain location=64-99; Score=10.2; E_value=0.035; Accession=PF02151.9; Description=UvrBuvrC motif
  Pfam module annotation: Pfam domain module=DUF525::UVR::UVR; Domain location=142-265::104-134::64-99
  Subcellular localization annotation: CTP_CleavageSite=42; ConfidenceScore=5.60e-01
MMQSLMSMKAYVGTRLPILTNSETSTRKQRVNCPNRRNVMVSCGSERNGNEGIGSNSGSFMSPSHNYAILKHRMEKAAKSEYYEEASRIRDSLKCFEDEIPVLRLRRLLKEAVADERFQDAARYRDELKEIAPHSLLKCSSDATTLGIRVQVKSAYIEGRSQPSEEVYSFEYRIKITNNTNRPVQLLRRHWIISDANGKTENIWGIGVVGEQPAIFPRSSFEFSSTCPLSTQNGRMEGDFEMIHVDRVGSRAFNVAIAPFSLSLLGDGDGETT

SEQ ID NO: 164384 - protein, 76 aa, Glycine max
  Coding DNA Sequence Number=SeqID_47606
MTEVEGRWRSMRGKIHKQSLKEGQNGLFMKVSDPKFSQANIHLAWAKDVTSGLSKQLVWASYSFPGRVDAFTIIRP

SEQ ID NO: 164385 - protein, 312 aa, Glycine max
  Coding DNA Sequence Number=SeqID_47607
  Gene Ontology: Mol. function=RNA-directed DNA polymerase activity; Cellular component=chromatin; Biological process=chromatin assembly or disassembly
MVMMKHFINFLFNLMFLEVKVAIQVLMGYRERHKAEGGKKQQHAIPLQNKIKIPKGHNIEVHGEIVLVDGNRHISAHLITTKFTPISHHDAKWLSGLGPKIQKVDHVILDEVVGTTPIDEDHDVMPINGTINVQSGGGRMIRVRSEGPMSTGLSLSFVIRRKNFTLHLWLSLGESEEGEVIVKGNGGEGNNIKLPWGRHRMRVRSASPKPGRKSFVIGSAIELEKLRNFKDPGHGIRTIKPQDIKFQMWRGVEVRNDLLNFGVEGALGSGEGTLVLGELSDSLFKVGDCLGTCVINHGREAMKAPKMIATKL

SEQ ID NO: 164386 - protein, 93 aa, Glycine max
  Coding DNA Sequence Number=SeqID_47608
MNADPTTFFFHMKIIINVVAEGVGVYGSLGGIVVVVKQHGCDEGGEHPLGTVDLAIIDGDLFEGRDGNLGEALKILDGITTEGVDIADLDDAV

SEQ ID NO: 164387 - protein, 778 aa, Glycine max
  Coding DNA Sequence Number=SeqID_47609
  Gene Ontology: Mol. function=oxidoreductase activity, acting on CH-OH group of donors; Biological process=electron transport
  Homolog annotation: Hit_ID=Q9LW56; Match level="QueryCoverage=96%, HitCoverage=96%, E-value=0.0, Identity=55%"; Hit description =Similarity to long chain fatty alcohol oxidase
  Pfam annotation: Domain name=DAO; Domain location=270-669; Score= -63.6; E_value=0.1; Accession=PF01266.14; Description=FAD dependent oxidoreductase
  Pfam annotation: Domain name=GMC_oxred_C; Domain location=604-771; Score=-35.0; E_value=0.00088; Accession=PF05199.4; Description=GMC oxidoreductase
  Pfam annotation: Domain name=GMC_oxred_N; Domain location=316-550; Score=396.7; E_value=3.3e-116; Accession=PF00732.10; Description=GMC oxidoreductase
  Pfam module annotation: Pfam domain module=DAO::GMC_oxred_C::GMC _oxred_N; Domain location=270-669::604-771::316-550
MTRKECHPLLRGGRGDSKYKHGFSAAEMESLASICEVVLPPLPMDALKIRKEDQIDDYDSSKSLKSFWDISASRYPIPHEVLLIEILLKEAETVKNFPTPFPASQIRNSLYYYVIPKVAEMLTKRSLIEAVILIRVVLWLLATRLGTLLLCGFLCLGEKWPYVNNFSNISLEKREMVMQKWLKHRFLTPIRLAFAYIKVDENGDNPAWKAIGYEVPADENLTNASKTRPLEKGIIETMNESDSALQQSLANKGLNVTLDSKSNILKVKCDALVVGSGCGGGVAAAVLSSAGYKVVVLEKGNYFSTQDYSSLEGPSMNQLYETGGILASVDSRVLVLAGSTVGGGSAVNWSACIKTPHKVLNEWSENHKLPFFSSQEYLSAMETVCERIGVTENCTQEGFQNQVLRKGCQNLGLKVDYVPRNSSGNHYCGSCGYGCPKGEKQGTQATWLVDAVERDAVIITGCKAERFLLESNRSGNGRKKKCLGVMAKALNSRVTMKLQIEAKVTISAGGALLTPPLLISSGLKNKNIGKNLHLHPVLMTWGYFPESNDSEFKGKVYEGGIITSVHKVPSTDSNSDSRAIIETPSLGPASFAALCPWESGLDFKERMLNYPRTSHLITIIRDMACGQVSTEGRISYKLNEIDKENMKAGLKQALKILIAAGAVEVGTHRSDGQRLKCDGIGENEVQEFLDSVCPMEGALSPGEYWNIYSSAHQMGSCRMGVNEKEGAVDENGETWEAEGLFVCDASVLPSAVGVNPMITVQSTAYCISNRIADYLRRD

SEQ ID NO: 164388 - protein, 300 aa, Glycine max
  Coding DNA Sequence Number=SeqID_47610
  Gene Ontology: Mol. function=2-C-methyl-D-erythritol 2,4 -cyclodiphosphate synthase activity; Biological process=terpenoid biosynthetic process
  Homolog annotation: Hit_ID=Q681X6; Match level="QueryCoverage=85%, HitCoverage=78%, E-value=2e-52, Identity=44%"; Hit description=MRNA, complete cds, clone: RAFL21-92-C23
MGFLTGSHKDSWKPIMTAKTNTQSYWLNWRVLLCAIWILVSVIFSTLLLWKYERLRKPARNGSRVTQQETSATLYEDETWRPCLKGIHPAWLMAFRVVAFIMLLVLLIINATVDGGSIFYYYTQWTFTSITIYFGLGSLLSIYGCYQHHKKATGDKVDNVDGDAEQGMYDASALPQSSNPSDQEKSLGAPEEVLVRQHAGFWGYIFQIIFQINAGSVMLTDCVFWFIIVPFLTIKDYNLNFLIVIMHSINAVFLIGDTALNCLVLCGGITAYSMLWNFRFVNEAETPCIVNAVPGLISMR

SEQ ID NO: 164389 - protein, 64 aa, Glycine max
  Coding DNA Sequence Number=SeqID_47611
MGGDIIVLHKLTGTTTNRREGGVNQSEARFCMSLGLPMAMTVNYTNNTRAKNIYMVLVKGINDR

SEQ ID NO: 164390 - protein, 486 aa, Glycine max
  Coding DNA Sequence Number=SeqID_47612
  Gene Ontology: Mol. function=protein serine/threonine kinase activity; Cellular component=integral to membrane; Biological process=protein amino acid phosphorylation
  Homolog annotation: Hit_ID=Q19VG4; Match level="QueryCoverage=43%, HitCoverage=68%, E-value=2e-74, Identity=61%"; Hit description =Serine/threonine kinase protein
  Pfam annotation: Domain name=Pkinase; Domain location=289-483; Score=- 4.1; E_value=2.6e-08; Accession=PF00069.15; Description=Protein kinase domain
  Pfam annotation: Domain name=Pkinase_Tyr; Domain location=289-484; Score=-43.5; E_value=8.4e-10; Accession=PF07714.7; Description =Protein tyrosine kinase
  Pfam module annotation: Pfam domain module=Pkinase::Pkinase_Tyr; Domain location=289-483::289-484
MKFQGKSSLLLLLLVLIALHLASSRTSVYNCVLDIQFSPSLISSNCELYNWGGFTHGCCGPYFDDYLYALGLRANQTGKIFLNSSEQENCIASMQAFDKNFTCYGIEKLTSGVGGCSDYTITDVINHHGDNFRRLNEDCMPFRRNGRPNETCTKCLKAWEDISAKSDSTRGSESANINVYLCRFAVLVSITSTRIYDRESIQEVYKYLGEHTLSAVNQEVKVKASANANINSAGLWIAFGITGVTAVVFLAALALFITRIKSAPTVQDESDSTSPKITLKDVYVATNNLSASNFIGQGIAGKVYKGVLSNNQSVAVKHITNEGYMETFVREVRSLSHVRHQNLVALLGYCESEAECFLVYELCHNGNLSEWLFGNGKVLSWIQRLEIVIDSARGLEFLHTYPNGCIVHRDIKVMDLGQSYVSSEVRGTFGYIDPEYRTNHQVKASGDVYSFGIVLLQLLSGQRVLNIDFQRPMSLGKMVRNYILRA

SEQ ID NO: 164391 - protein, 192 aa, Glycine max
  Coding DNA Sequence Number=SeqID_47613
  Homolog annotation: Hit_ID=Q1SGW7; Match level="QueryCoverage=27%, HitCoverage=8%, E-value=2e-11, Identity=64%"; Hit description =Protein kinase
  Subcellular localization annotation: CTP_CleavageSite=85; ConfidenceScore=5.93e-01
MTKLFISLSLSLSPFSFSSHPSTSKISTSSRNSMTSLPLLTTLIFQIPISSTMTSTTSTTRRRRRSRSPRWTTRISSFKAPKHVAASTELKPNDIVLTNVDATVENELVNSYDVQGFLTIILGFLNSLVIKEKEGGGVMVNDEKGMFGLSDLMRETTKVLGNGSFGSFYKVVMANGVVVVEKRTREMNVQEM

SEQ ID NO: 164392 - protein, 156 aa, Glycine max
  Coding DNA Sequence Number=SeqID_47614
  Subcellular localization annotation: CTP_CleavageSite=72; ConfidenceScore=5.12e-01
MQNFWYVPKQTRPQNIQFVESSSIFLVFKTKKQKQLFHVLLFGFSSLTENCPFQNPNNTFRKELSHGKGRMRSYLKVEAMHDVDLVADGGVTATVRPDVVCAVVGCCRAAARASGAGGSRWRSVDLGERERRATEEELRGDVARGGERKVGGSARR

SEQ ID NO: 164393 - protein, 203 aa, Glycine max
  Coding DNA Sequence Number=SeqID_47615
  Gene Ontology: Mol. function=translation release factor activity, codon specific; Cellular component=cytoplasm; Biological process =translational termination
  Homolog annotation: Hit_ID=Q1S684; Match level="QueryCoverage=36%, HitCoverage=15%, E-value=7e-17, Identity=62%"; Hit description =Peptide chain release factor 2
MEAKSKTYQDTVDTADMRIGAKSALVPMATRKATSADTTDTVDTKQENLPERSEEVGFATRARPGWLCDQSTTRVALRDSAWWVKDNGSTEGGFARWVRSNGSDEGKFARMSTSSDEGKFARMKMGSEKDFYSLRKDVEIMSQCVEEIRESSGLQLLEQELANLEEQALDSSFWDNRAKAQETLSTMDDVKDNIKLLNDFKTQ

SEQ ID NO: 164394 - protein, 144 aa, Glycine max
  Coding DNA Sequence Number=SeqID_47616
MQLLLDGINPLLAYWVEQGKNSCLYGSENLVWIQQFNDKIIEIKQPGLQLETIYVGNSQSSENVKQIMAKGGEKSLNDPLSFINVQHFWVQLETMRMSKLILGNTPSSDHVLAKLSTLLDMDDREEGWAVIGCRGSSSTNILRL

SEQ ID NO: 164395 - protein, 148 aa, Glycine max
  Coding DNA Sequence Number=SeqID_47617
  Gene Ontology: Mol. function=nucleoside-triphosphatase activity; Cellular component=integral to membrane; Biological process=protein catabolic process
  Homolog annotation: Hit_ID=Q2HUS2; Match level="QueryCoverage=84%, HitCoverage=19%, E-value=1e-30, Identity=56%"; Hit description =Peptidase S26A, signal peptidase I; AAA ATPase; Peptidase M, neutral zinc ...
  Homolog annotation: Hit description=metallopeptidases, zinc-binding site; Peptidase M41, FtsH extracellular
  Pfam annotation: Domain name=Peptidase_M41; Domain location=1-147; Score=-36.7; E_value=2.4e-08; Accession=PF01434.8; Description =Peptidase family M41
MEEVDDSQNSGALTWFIPSEDPSLISKNQLLARIVGGLGERAEEEVIFGETEITTRVAVDLQQITQIARQMVTRFGMSEIGPWVLTDPTVQGHHALVAHSLAPPGIRTIPPSPKWLSTSQGCIEAHLTNNSEPVGFIITKIDEFWQLK

SEQ ID NO: 164396 - protein, 36 aa, Glycine max
  Coding DNA Sequence Number=SeqID_47618
MWEVGTCGYVILGKMGSQSSLACFLGAHARDLKSIY

SEQ ID NO: 164397 - protein, 828 aa, Glycine max
  Coding DNA Sequence Number=SeqID_47619
  Gene Ontology: Mol. function=phosphoinositide binding; Biological process=cell communication
  Homolog annotation: Hit_ID=Q1T3A0; Match level="QueryCoverage=98%, HitCoverage=76%, E-value=0.0, Identity=55%"; Hit description=Phox -like
  Pfam annotation: Domain name=PX; Domain location=582-692; Score=47.3; E_value=5e-11; Accession=PF00787.14; Description=PX domain
MNARGEVGSPDPLDSFPPLRVRGSDGASDDSEFERYCSANSVMGTPSTSMSLCSAVTLFHEFSDCDFASAGGEGFENFSLGKGAAEVNRGGGGDRRRSLRYGSSGLEMYGDCSEELSMTALDSSEFIGLNHRIEESKGNGEVSGGNGFELEIEKREEEEVEEEKEEEEEKEEEEEEELSEGDDSMYDYGSDGDGGNEMYLWKNKGYFEEPEVRNENSLFMNSSVAFGSRDLDDFLLQSGDISVMPDLFQNQRKKNDGVNMGSGRNEEGKDEKYVVRGNEVEETKDVGYFDSVEEVRDSEISADCDHVRDSDMLANIVESSPSIDCRNHVEPQVQGSDDLVSCPETSSIVKVDEVDLDMLAKEAPPRNMGLDVNDGGSMEKGNINSEEAIAACDAHGLKSELDDSKFNLDCLSASRFDRSSSIPSNHLGNVNAKSFESLEQIEPVLDYGMRKTLEKSSTSTNLLEKSPVVSKFCCGHSCTMAVVGQNVAQLWCDVVVTEDFELNEFYDEVVQEMEEILLESVDSPGTRLSMRDRFAEPQFSMPSRDGGLTASTSSKDDAYLLVQCPRKIDRIEVVGARQKKGDVSFSERLVGVKEYTVYKIKVWSGKDQWEVERRYRDFLTLYRYMKTLFYEQGWKLPLPWSSVEKETQIFRSASPDIIVKRSVLIQECLQSIIRSRFSLSPPRALIWFISHQDSYPISPVSNAPVSQSSFTRGENTRSISNLGKTISLIVEIPPNKSVKQLLEAQHHTCAGCHKHFDDGKTLIRDFVQTFGWGKPRLCEYTGQLFCSSCHTNETAVLPARVLHHWDFTHYPVSQLAKSYLDSIYEQQR

SEQ ID NO: 164398 - protein, 84 aa, Glycine max
  Coding DNA Sequence Number=SeqID_47620
MDGVVFALSTPKLNVANKASQLQQWVQANKVCRHSLLSALSNDLFDVCCSDKEVRIVDGGNNTIVVDTESGTQRLWWPWSACRT

SEQ ID NO: 164399 - protein, 82 aa, Glycine max
  Coding DNA Sequence Number=SeqID_47621
MVSLGPKLSMYLLSVYVSDEDMTYNGVNASSEPSEAEYDDIEDDVDLIKGEVHSDYDINEIYVEKGILGKHLRGNQMARSSL

SEQ ID NO: 164400 - protein, 96 aa, Glycine max
  Coding DNA Sequence Number=SeqID_47622
MKQDRGLLMSWTKRSWLVWLPLGCTQRSSNLKINHGASFWLLGEVVEQVFDIMSESGATSSSSLCANAVKVKKSYELLKMDFEDLKTEVDKMKANL

SEQ ID NO: 164401 - protein, 113 aa, Glycine max
  Coding DNA Sequence Number=SeqID_47623
MHILKNEIPMDFCKAWDPNIEAIGIKTQGKSTPNLALNTCIPNAKVIQNFFNSTIASEPLILSLLRAIQNKKQKTSYLDEQLQVATPLKGARLRQRGGGGTNMTFGGRQTRQC

SEQ ID NO: 164402 - protein, 118 aa, Glycine max
  Coding DNA Sequence Number=SeqID_47624
MHDATQRRKMCNEGFREFTAETNRGEGTVKQTVKKKQRSEEGEDSVKCNFFIKRYLMYTAPPPNDEELMQAASRSVITSQLEFALCRKQVDDPFRLHLVDNHRRVAVALAGHGGAHSG

SEQ ID NO: 164403 - protein, 74 aa, Glycine max
  Coding DNA Sequence Number=SeqID_47625
MSHYREGYERSDGGRILSPEVRSIGESYKDGPSHHHNGSEATNGQVSGVPVGGATLVGGVIATKRGLFPNSDIC

SEQ ID NO: 164404 - protein, 148 aa, Glycine max
  Coding DNA Sequence Number=SeqID_47626
MDLAATDVQVIMPHPFIPPLPPPEKPSKTKKVFPPAVLSGYTRVHGEVGSYSTSFLTYKSITKFLEIVEFFHDDHPDMVIIDSCSEEKCVSWALLQVLMMPKQKQHKFYFKSKSRPRKERSRKKLSLSLSLLKESLSDCKSLASQHNF

SEQ ID NO: 164405 - protein, 110 aa, Glycine max
  Coding DNA Sequence Number=SeqID_47627
MTFMIFVTPRSSLDTIHLVATHDSMPGGDGGGRVDRFDVGVKALRATRYWVVAVVIKHESNVVVKALCETTMVVGSRAIEVLVLGGCATDGGGHMGDGGSQQWVVMGHDG

SEQ ID NO: 164406 - protein, 304 aa, Glycine max
  Coding DNA Sequence Number=SeqID_47628
  Gene Ontology: Mol. function=protein serine/threonine kinase activity; Cellular component=cytoplasm; Biological process=protein amino acid phosphorylation
  Homolog annotation: Hit_ID=O23304; Match level="QueryCoverage=68%, HitCoverage=43%, E-value=2e-76, Identity=68%"; Hit description =Kinase like protein
  Pfam annotation: Domain name=Pkinase; Domain location=1-254; Score =97.9; E_value=3e-26; Accession=PF00069.15; Description=Protein kinase domain
  Pfam annotation: Domain name=Pkinase_Tyr; Domain location=1-235; Score=-29.8; E_value=1.2e-10; Accession=PF07714.7; Description =Protein tyrosine kinase
  Pfam module annotation: Pfam domain module=Pkinase::Pkinase_Tyr; Domain location=1-254::1-235
MNSAAVAIKSIKLNRSRPDLDDVRCEAKTPSLLSYPNILKAHCSFTVDRCLWVVMSFMAAGSLQSIIYHSHPNGLMEPYITVVLRDTLNALSYLHCQHLHRDIKVGNILIYTNGQVKLADFGVSASIYESTTTTTTSSSSSLKFTNVVGTPYWMAPEVIHSHTGYSFEADIWSFGITALELAHGRPPLSHLPPSKFMMLKITKRFPFSDDFDDNMPQGKYDNTIKECTEALELNLVCVKALVRRGEAHEKLEHFEEAIAGEFKFYNRVEGNYTKVVHRLAFIAFPVSSLEQSHNNSKQERGGLK

SEQ ID NO: 164407 - protein, 119 aa, Glycine max
  Coding DNA Sequence Number=SeqID_47629
  Gene Ontology: Mol. function=transcription factor activity; Cellular component=transcription factor complex; Biological process =regulation of progression through cell cycle
  Homolog annotation: Hit_ID=Q9LEL4; Match level="QueryCoverage=81%, HitCoverage=20%, E-value=6e-12, Identity=56%"; Hit description =Transcription factor E2F
MLLTHKQKHFLKVPLSQSVWKKLQTKIEKLSLEEQGLDDQIREMQERLRNLSENENNPKFFFLLILVHFCKQNETLIAIKAPHETTLEVPDLEEMHDGELLLLYASGCRLSTEKIENHS

SEQ ID NO: 164408 - protein, 99 aa, Glycine max
  Coding DNA Sequence Number=SeqID_47630
MTIFGDDDGHCSPVKKRRKVPQGHLETKGEKISVTLATSSPEARPKWRLHMLPCAGNVSSAKGVWHIFEMCLGERQRFAHDVVNIALYISERCFKWRGC

SEQ ID NO: 164409 - protein, 107 aa, Glycine max
  Coding DNA Sequence Number=SeqID_47631
MTSLDASCGGNLMLKPRVDAIRIIEDMCSNPYRNSRDMRIMKRGINQVEKNDSQTELGKQITPTISIKDKASDRIKECIGLNLCKIRGPDKRRRLPTLQETMLQYMT

SEQ ID NO: 164410 - protein, 77 aa, Glycine max
  Coding DNA Sequence Number=SeqID_47632
  Gene Ontology: Mol. function=oxidoreductase activity; Cellular component=peroxisome; Biological process=electron transport
  Homolog annotation: Hit_ID=Q76FR9; Match level="QueryCoverage=83%, HitCoverage=17%, E-value=4e-22, Identity=76%"; Hit description =Hypothetical protein PsOPR5
MVEQKNQVIPLLTPYKMGNLNLSHRIVLAPLFRARSYNNFAQPHAILYYSQRATKGGLLITEATTISPTSKLYVICI

SEQ ID NO: 164411 - protein, 32 aa, Glycine max
  Coding DNA Sequence Number=SeqID_47633
MAATLPDDKGGTMRMAATLRVSAAAREILILR

SEQ ID NO: 164412 - protein, 100 aa, Glycine max
  Coding DNA Sequence Number=SeqID_47634
  Gene Ontology: Mol. function=transferase activity, transferring glycosyl groups; Cellular component=chloroplast; Biological process =aromatic amino acid family biosynthetic process
  Homolog annotation: Hit_ID=Q02166; Match level="QueryCoverage=87%, HitCoverage=18%, E-value=1e-12, Identity=79%"; Hit description =Anthranilate phosphoribosyltransferase, chloroplast precursor
MVKVEVTWVHGCRVGEGNAETRDKGRERVWTMWLTSWEPEGTVPTTRSTFRLVLRFSLRLVVAELQRSVCRGKRLSSSACGSADVVLEALGVVMDLGPQE

SEQ ID NO: 164413 - protein, 46 aa, Glycine max
  Coding DNA Sequence Number=SeqID_47635
MPEEFVGWAVCSPLGMKASYNQEVRASGNILVKRIGERTESGSKSI

SEQ ID NO: 164414 - protein, 67 aa, Glycine max
  Coding DNA Sequence Number=SeqID_47636
MQIAGGNDAFPVNATTGHGVAINDGVLLELGLASQTGELMLGHFGSSQWHWRFEVDVAIPNGDFSSL

SEQ ID NO: 164415 - protein, 58 aa, Glycine max
  Coding DNA Sequence Number=SeqID_47637
MSNLNLDEDDDHDDDDYLESNSYVEESLDEDDSVDGISDTDDEVTDIPQPVRIVHPAE

SEQ ID NO: 164416 - protein, 273 aa, Glycine max
  Coding DNA Sequence Number=SeqID_47638
  Gene Ontology: Mol. function=structural constituent of ribosome; Cellular component=ribonucleoprotein complex; Biological process =translation
  Homolog annotation: Hit_ID=P31165; Match level="QueryCoverage=98%, HitCoverage=99%, E-value=2e-85, Identity=66%"; Hit description=50S ribosomal protein L15, chloroplast precursor
  Pfam annotation: Domain name=L15; Domain location=201-232; Score =44.6; E_value=3.3e-10; Accession=PF00256.13; Description=Ribosomal protein L15
  Pfam annotation: Domain name=Ribosomal_L15; Domain location=65-172; Score=204.1; E_value=3.3e-58; Accession=PF01305.8; Description =Ribosomal protein L15 amino terminal region
  Pfam module annotation: Pfam domain module=L15::Ribosomal_L15; Domain location=201-232::65-172
  Subcellular localization annotation: CTP_CleavageSite=24; ConfidenceScore=5.41e-01
MGSASLIPVSWLPWRPLSPFKGTVKTLVAKPWLKKIQQARPLISVVNKAASLSSPVTAPSVGVRFRLDNLGPQPGSRKRAKRKGRGISAGQGASCGFGMRGQKSRSGPGVRKGFEGGQMPLYRRIPKLRGIAGGMHAGLPKYVHVNLRDIEDAKFKEGEEVSLESLKAKGVINPSGRERRLPLKLLSLNLASPRSFSGSVEILGEGELSKKLTLKARAFSTSAKEKLENAGCSLTVLPGRKKWVKPSVAKNLARADEYFAKKRAMAASEPASA

SEQ ID NO: 164417 - protein, 150 aa, Glycine max
  Coding DNA Sequence Number=SeqID_47639
  Subcellular localization annotation: CTP_CleavageSite=66; ConfidenceScore=5.40e-01
CCQTIGTGGYHPSGDPTVPLRFPRYFSGSSSTHMPPSPPPPPPPQRPYLYPSPTRPVSFGSSHFPLQHAVNDYYVGHVMSGGSHGHYVGGESTRSYTCIGAPVGQGGGFAGGKEGSAVQEEGLSTWGRGYSGAQDRLDPPSAINRFQDGF

SEQ ID NO: 164418 - protein, 45 aa, Glycine max
  Coding DNA Sequence Number=SeqID_47640
MALFFRGCRASMGIAKIFLDTQLCSLMRFPPHNRLMIGGCTRIII

SEQ ID NO: 164419 - protein, 103 aa, Glycine max
  Coding DNA Sequence Number=SeqID_47641
MRIEVGHGHVHFRNSTSLHNPVEMPMEPVSEPEPITDNKQGSVRDRRDDPLRKRTIIIGFAGWIRGGLNASVASTNIKTFTTSTGGAAYGETLFVVGSMTGTL

SEQ ID NO: 164420 - protein, 185 aa, Glycine max
  Coding DNA Sequence Number=SeqID_47642
ACRPRLTKVAEDDISLCVFSGFSSYRHQKVYTDNHSGISARQRDSKVSMTDLVSAEDDVAEDDVSLCVLSSFSSYRQQKVYTDNHSGISARQRDSKVSMTDLQKVYTDNHSGISARQRDSKVSMTDLVSAEDDQKVYTDNHSGIYARKRDSKVSMTDLVSAEDNVYLHVSTGLSAATDEGRRRRH

SEQ ID NO: 164421 - protein, 66 aa, Glycine max
  Coding DNA Sequence Number=SeqID_47643
  Subcellular localization annotation: CTP_CleavageSite=18; ConfidenceScore=5.05e-01
MMRNPRRGSTRDVLAQCAASSPSESFVFSHAQRAQLAKPKFTNSRLAIRIFSIGKCFKALELDRAS

SEQ ID NO: 164422 - protein, 69 aa, Glycine max
  Coding DNA Sequence Number=SeqID_47644
  Subcellular localization annotation: CTP_CleavageSite=62; ConfidenceScore=5.12e-01
MSASLYSCTSSSLPITLAPAQDMGLNQFRFFNMVHDILVKRKMQGSRMSKHENKRYAVCRTKSMLNAYA

SEQ ID NO: 164423 - protein, 237 aa, Glycine max
  Coding DNA Sequence Number=SeqID_47645
MTPKKSENVRILAINNIEETIRRPKGGLIHSFLFNIVMPRLGSRDYVSDKDICCMYKVIVNGKTPQHSPKPSSPPKSKKEVFALAKVTKKSFAKSRKKAKIDKTLERKDAIKEENDIIVLWKLYLWKNIRKSKLKMQGWVPWQERFLKKFQKMFFFGVSKGIAYLGGSEEATEKAIMVDVDGELVPEEQAKREELKRIQFFVEHGAELIDVDVATRQVKVKVAIIPEDSDPKEKKVL

SEQ ID NO: 164424 - protein, 207 aa, Glycine max
  Coding DNA Sequence Number=SeqID_47646
MEGMRESGLFLGSDTNLGVVKTDQPGCSTWHCCQRRKMGLPGIPSLSLALSFPFFSYISHPFPTFCDLMERDKHVTSRLARNSVVARQVSVTVRGVLKAIVRVQRPFASGYSRFHPVCMRDVGFLVAVVARLAVTGLVALAPPRRGGSRSHKVVPSRASRAIWLGFSRLLVSSIMSLCRVSLSPVPWRPCAAIPYAPWRQGSCLPLW

SEQ ID NO: 164425 - protein, 270 aa, Glycine max
  Coding DNA Sequence Number=SeqID_47647
  Homolog annotation: Hit_ID=Q1T393; Match level="QueryCoverage=99%, HitCoverage=37%, E-value=1e-94, Identity=66%"; Hit description=IMP dehydrogenase/GMP reductase
GNPPSQRDCIIASDDETEDAEAPFIQKLFGILRIYYVFLESIRRVSLGILAGLFVLTQPSKSPVIIVLSMTSFQLFFMLLKKPFIKKRVQLVEIISLACEVTLFATCLVLLKKDISVSAETKYGIFMLVLFLIGYCAQITNEWYALYIQAKMLDPEEKSLLTGLKNASIGFLLYFVPQKCIKDLEKRLPQNDNVNEEPRDTASGADRSRRSSSRSSGTPDGAWLKQLRGFAKSSFGRERSGTRNDPSTSGTTGWSGLWGNKRSGSSSSEF

SEQ ID NO: 164426 - protein, 317 aa, Glycine max
  Coding DNA Sequence Number=SeqID_47648
  Gene Ontology: Mol. function=hydrolase activity, acting on ester bonds; Cellular component=cellulose and pectin-containing cell wall; Biological process=lipid metabolic process
  Homolog annotation: Hit_ID=Q1RU40; Match level="QueryCoverage=91%, HitCoverage=79%, E-value=8e-87, Identity=53%"; Hit description =Lipolytic enzyme, G-D-S-L
  Pfam annotation: Domain name=Lipase_GDSL; Domain location=2-300; Score=140.4; E_value=5e-39; Accession=PF00657.12; Description=GDSL -like LipaseAcylhydrolase
MSHFHNFLVDLPQDKFMINCITKAEELKLPYLSAYLDSIGSNYNYGANFAAGGSSIRPTGFSPVFFGLQISQFTQFKSRTMALYNQSSHNREDAPFKSRLPKSMDFSNALYTIDIGQNDLSFGFMSSDPQSVRSTIPDILSQFSQGLQKLYNEGARFFWIHNTGPIGCLPRASVENKPRPEDLDSTGCRKMENEIAQEFNKQLKDIVFELRKKLPTAKFTNVDVYSAKYELIKNARNQGFINPKKFCCGTTNVIHVDCGKKKINKNGKEEYYKCKHPSKYISWDGVHYSEAANRWLATLILNGSFSDPPIAIGMIGN

SEQ ID NO: 164427 - protein, 254 aa, Glycine max
  Coding DNA Sequence Number=SeqID_47649
  Homolog annotation: Hit_ID=Q1T393; Match level="QueryCoverage=99%, HitCoverage=34%, E-value=1e-112, Identity=76%"; Hit description=IMP dehydrogenase/GMP reductase
MQRILSHIQVFALSRWLTVKLPVEFYEFARHLQWTVPYFPVPWEAEPMNLFMVGSNPFGSSNFITKAPATIPKKFLDKSLNLAASVYGSPLTSSEYLQYFESENMKPEAEYLLDSQHSAGWTEFYRSMFWLAVICGGLMVLHAFLLIVLKFGKRNSEKDKIHGALTFPRFEMFLIFLALPNVCKSSGVLLQGGSPSGLAVGILLLVFVGTVLLALFMFLSIGITFGKLLQYKEVHQEGETFHWYQELVRVTLGP

SEQ ID NO: 164428 - protein, 127 aa, Glycine max
  Coding DNA Sequence Number=SeqID_47650
  Homolog annotation: Hit_ID=Q9FMG8; Match level="QueryCoverage=60%, HitCoverage=83%, E-value=7e-15, Identity=45%"; Hit description =Arabidopsis thaliana genomic DNA, chromosome 5, P1 clone:MMG4
MELERDTWHTHDGAVGCNKSLRVYEDTTSLEMKVSRRVEWWQNMMFPVRRVWFVVAKRLGIRKTGLLKLSNDVRACEYEDIQVMWEILNRNESEFGRSSSTRKGNNKKGHCWKLLRWARCAPCMCRT

SEQ ID NO: 164429 - protein, 409 aa, Glycine max
  Coding DNA Sequence Number=SeqID_47651
  Gene Ontology: Mol. function=transporter activity; Cellular component= membrane; Biological process=oligopeptide transport
  Homolog annotation: Hit_ID=Q1SJN9; Match level="QueryCoverage=95%, HitCoverage=73%, E-value=0.0, Identity=82%"; Hit description=TGF -beta receptor, type I/II extracellular region
  Pfam annotation: Domain name=PTR2; Domain location=1-358; Score =120.8; E_value=4e-33; Accession=PF00854.12; Description=POT family
MSFSFLSLSLYLISLGQGGYNPSLQAFGADQLGEEEELPCSKEDKSCNTKTLFFQWWYFGVCSGSLLGVTVMSYIQDTFGWVLGFAIPAISMILSILIFSGGSPIYLYKEHDVLQAKKPIMNIFQAIRASALRCFHCEITLPNDKSEVVELELQEKPLCPEKLETVKDLNKDPKSGMYLLANAKVMVRLLPIWTMLLMFAVIFQQPATFFTKQGMTMKRNIGADFKIPPATLQSAITLSIILLMPLYDKIFIPMTQVITRQDKGISVMQRMGIGMVLSIIAMIIAALVEMRRLDIGRQMRSAGSQSETVPLSIFWLLPQYILLGISDIFTVVGMQEFFYGEVPRNMRTMGIALYTSVFGVGSFVSALLITLVEVYTSSKGIPSWFCDDMVEAHLDSYYWLLAWLSTILP

SEQ ID NO: 164430 - protein, 114 aa, Glycine max
  Coding DNA Sequence Number=SeqID_47652
  Subcellular localization annotation: CTP_CleavageSite=74; ConfidenceScore=5.46e-01
MGAPEMSPPPSSAPPVPSTTVLTVKSPSSSFHPHVSLDHIYSSNNAYSLWGMRYKPEQKTLIGFVLAFDKNLIRSAGVQHAMNSAKKEKKDLVGQVEGMEVEKGELAKVVENLM

SEQ ID NO: 164431 - protein, 334 aa, Glycine max
  Coding DNA Sequence Number=SeqID_47653
MSWWTSLRWALRLRTLAGQEVLVDKGCYGLGVHAPMPGLPWRVDVCLGVPRSMARVFGGPWTVYKPPSFENACRQKRLSNVEGDYPALREGNLDRCENCRSGRLAKPPSLDKRGLTCQACAMNAQYSCIRVTRGLGLDSVTLDRPRGHFRCGGTRFKSFDEDLLTHVERVDKAILEQLPASLDAQAILSLPLASDPLLALDGEHFFLVGPTSGIVPLSVVAPTAGEGGQLVVEVGHVVATAEVTLNAPSFILAKRKRDNDVGVSGRKKSRAPLSLRALRHVVGLTHPQLIEICAPTVTAPVIPSIAFAFSPLVASISAPLPPSAAPAKEVVPIA

SEQ ID NO: 164432 - protein, 70 aa, Glycine max
  Coding DNA Sequence Number=SeqID_47654
  Gene Ontology: Mol. function=nucleic acid binding
  Homolog annotation: Hit_ID=Q1T6D0; Match level="QueryCoverage=98%, HitCoverage=19%, E-value=9e-13, Identity=57%"; Hit description=Zinc finger, CCHC-type; Lipocalin
MEDFQPLFGGLPLVPGVCCFKSIGTPIRVYTNTVNMDGGRFACVYVEIDLSVPVVGKFFLNGAWYHVEYE

SEQ ID NO: 164433 - protein, 331 aa, Glycine max
  Coding DNA Sequence Number=SeqID_47655
DMESESNKSKQKQKLEVSDILWESVVIYFRNLNFIIFTFLTSIPLFCIMVYFEIFLQELLVETSNIVNLPHESHDDSIVFTDYDFIDYRNSYRPDLIIDRFNKDYVLKLILTGFIYMVPLYVLEFVSAIVTIALASKLHSKEKKMTLKEMVQKPFDLSKLRGSFVTSVYVLFLTTTHQLGLLFIVLNYHVYLKDSSFYLLFAVICSAAFAKVLRMYLEWSAMWNMSLVMSVLEGIYGVDALAVSAYFSRGCHRRGLFLMLIFFAWGHLLRLSCYHIGGYEQGNAIFVQVGLYCMVNPLKWVACMIYVHDCKERKLEKKADEESGKDVKNGS

SEQ ID NO: 164434 - protein, 393 aa, Glycine max
  Coding DNA Sequence Number=SeqID_47656
  Gene Ontology: Mol. function=catalytic activity; Cellular component =cytosol; Biological process=spermidine biosynthetic process
  Homolog annotation: Hit_ID=A0EVX4; Match level="QueryCoverage=81%, HitCoverage=93%, E-value=1e-152, Identity=84%"; Hit description =Spermidine synthase
  Pfam annotation: Domain name=Spermine_synth; Domain location=46-301; Score=486.3; E_value=3.5e-143; Accession=PF01564.7; Description =Sperminespermidine synthase
MADESVVESPVKRQRDDDEENEVSVSMDVEGGKDPLSNGLSSVIPGWFSEISSMWPVVSFPCVLVAGEAHSLKVEKILFQGKSEYQNVMVFQSSTYGKVLVLDGVIQLTERDECAYQEMITHLPLCSIPNPKKVLVIGGGDGGVIREVAHHSSVEKIDICEIDKMVVDVSKQYFPDVAVGYDDPRVTLHIGDGVAFLKEVPEGTYDAVIVDSSDPIGPAQELFEKPFFSSVAKALRPGGVVCTQAESIWLHMDIIEDIVANCRQIFKGSVNYAWTTVPTYPSGMIGFMLCSTEGPPVDFKHPVNPIDENESQKSVRPLKFYNSEPLSSLIKGNIINLGSTDKHCSIDKNYEVPILQKWKHMGVIPVSDTDMGVIPLKMTRHNSDTAQAVSDTA

SEQ ID NO: 164435 - protein, 61 aa, Glycine max
  Coding DNA Sequence Number=SeqID_47657
MYVGVEVYKVDDVRGMKDFTTSRIWMVAKVSVAMSSLRVYTVTREHAAMAIVNESEEELST

SEQ ID NO: 164436 - protein, 908 aa, Glycine max
  Coding DNA Sequence Number=SeqID_47658
  Gene Ontology: Mol. function=alpha-mannosidase activity; Cellular component=Golgi apparatus; Biological process=carbohydrate metabolic process
  Homolog annotation: Hit_ID=Q1SJM4; Match level="QueryCoverage=99%, HitCoverage=79%, E-value=0.0, Identity=82%"; Hit description =Glycoside hydrolase, family 38; Galactose mutarotase-like
  Pfam annotation: Domain name=Alpha-mann_mid; Domain location=243-328; Score=111.5; E_value=2.5e-30; Accession=PF09261.1; Description=Alpha mannosidase, middle domain
  Pfam annotation: Domain name=Glyco_hydro_38; Domain location=1-239; Score=179.5; E_value=8e-51; Accession=PF01074.12; Description =Glycosyl hydrolases family 38
  Pfam annotation: Domain name=Glyco_hydro_38C; Domain location=387 -900; Score=354.2; E_value=2.1e-103; Accession=PF07748.3; Description= Glycosyl hydrolases family 38 C-termi
  Pfam module annotation: Pfam domain module=Alpha-mann_mid::Glyco _hydro_38::Glyco_hydro_38C; Domain location=243-328::1-239::387-900
EGNMWLNDTIGFVPKNSWAIDPFGYSSTMAYLLRRMGFDNMLIQRTHYELKKELAWHKNLEYIWRQSWDAEETTDIFVHMMPFYSYDIPHTCGPEPAICCQFDFARMSGFAYEQCPWGQYPVETTQENVQERALKLLDQYKKKSTLYRTNTLLVPLGDDFRYINVEEAEAQFRNYQMLFDYINSNPSLNAEAKFGTLEDYFVTLREEAERINYSSPGEIGSGLVEGFPSLSGDFFTYADRQQDYWSGYYVSRPFFKAVDRVLEQTLRATEMMVALILGTCRRSYCEKFAMGFSYKLTAARRNLALFQHHDGVTGTAKDHVVMDYGMRMHTSLLDLQIFMSKAVEALLGIRYDKLDHSPAQFEPAIVRSKYDAQPLHKVISVHEGSYESVAFFNPLEQTREEVVMVVVDSPYVTVVDSNWTCVQSQILPELQYHSSKIFTGKHRLYWKVSVPAMGLETYYISTSFGECEKARPAKLKMFSKSSSVACPTPYSCVEVEADVTEIENQHQKLTFDVKYGLLQKIISSSPNTINEEIGMYSSSGGAYLFMPHGDAQPIIEEGGQLLVSEGPLMQEVYSYPRTAWDKSPISHSTRIYSGESTVQGFAIEKEYHVELLGRDFNDRELIVRYKTDIDNKKIFYSDLNGFQMSRRETYDKIPLQGNYYPMPYLAFIQGSNGQRFSVHSRQSLGVASLKNGWLEIMLDRRLVRDDGRGLGQGVMDNRVMNVVFHLTMEANVSATSNLVPTPFPYSPSLLSHRVGSHLNYPIHAFVSKKPQDMSVKPPPRSFSPLATPLPCDLHIVNFKVPKPLKFLQQPPEGPRFGLILHRRHWDSSYCRKGRSQCTNLADNTVNLFSMFKELTVSKAKATSLNLLHEDPEVMGFSEQFGDLAKEGNVAISPMEIQAYRLELRPQPQ

SEQ ID NO: 164437 - protein, 65 aa, Glycine max
  Coding DNA Sequence Number=SeqID_47659
MGHLGRMLLEILHMFVEGFWVEKVYKERKDGGLEVGVLVSNGGEERKVIMCNKMYVGNEGFEALE

SEQ ID NO: 164438 - protein, 165 aa, Glycine max
  Coding DNA Sequence Number=SeqID_47660
  Gene Ontology: Mol. function=DNA binding; Cellular component=nucleus; Biological process=regulation of transcription, DNA-dependent
  Homolog annotation: Hit_ID=Q20CE8; Match level="QueryCoverage=81%, HitCoverage=62%, E-value=1e-28, Identity=49%"; Hit description =Fgenesh protein 18
  Pfam annotation: Domain name=KNOX1; Domain location=39-83; Score =66.7; E_value=7.6e-17; Accession=PF03790.4; Description=KNOX1 domain
  Pfam annotation: Domain name=KNOX2; Domain location=91-142; Score =89.0; E_value=1.5e-23; Accession=PF03791.4; Description=KNOX2 domain
  Pfam module annotation: Pfam domain module=KNOX1::KNOX2; Domain location=39-83::91-142
MESSLYDFYYSATYSDESTMAPFAPSNKPVFGKEEDVSKVLRAKVASHPLFPHLLHAYMDCHKVGAPQDVAHLLEGIKGEHTSGVCQISESEGFLGTDPELDDFMGTFCDLLVKYKSDLLKPFNEATMFLNLMETQLHSICNNTPPQPGLSLSLFQISLDTCWLI

SEQ ID NO: 164439 - protein, 185 aa, Glycine max
  Coding DNA Sequence Number=SeqID_47661
  Gene Ontology: Mol. function=nucleic acid binding; Cellular component= nuclear speck; Biological process=nuclear mRNA splicing, via spliceosome
  Homolog annotation: Hit_ID=O81127; Match level="QueryCoverage=54%, HitCoverage=55%, E-value=1e-37, Identity=72%"; Hit description=SRZ21
  Pfam annotation: Domain name=RRM_1; Domain location=4-68; Score=62.0; E_value=2e-15; Accession=PF00076.12; Description=RNA recognition motif. (a.k.a. RRM, R
  Pfam annotation: Domain name=zf-CCHC; Domain location=87-104; Score =32.8; E_value=1.2e-06; Accession=PF00098.13; Description=Zinc knuckle
  Pfam module annotation: Pfam domain module=RRM_1::zf-CCHC; Domain location=4-68::87-104
MSRVYVGNLDPRVSERDLEDEFRIYGVLMSVWVARRPPGYAFIEFDDRRDALDAIQALDGKNGWRVELSHNSKGGGRGGRGRGGEDTKCYECGEPGHFARECRLRIGSRGLGSGRRRSPSPYRRRRSPSYGYDRRSYSPRGRRSPRRRSISLPRGRSYSRSPPYRPSCHDSPYANAYVYVQLSCS

SEQ ID NO: 164440 - protein, 62 aa, Glycine max
  Coding DNA Sequence Number=SeqID_47662
  Gene Ontology: Mol. function=alpha-mannosidase activity; Biological process=carbohydrate metabolic process
  Homolog annotation: Hit_ID=Q1SJM4; Match level="QueryCoverage=98%, HitCoverage=5%, E-value=3e-27, Identity=90%"; Hit description =Glycoside hydrolase, family 38; Galactose mutarotase-like
MDSRRKFIWEEMSYLERWWRDASDEMKESFINLVKNGQLEIVGGGWVMNDEANSHYFAIIEQ

SEQ ID NO: 164441 - protein, 182 aa, Glycine max
  Coding DNA Sequence Number=SeqID_47663
MTPSQQHDASMATPNAPFAPQWNVPGAIPDMGDLLGVDLRQEFSAEAEQAEAGRQRGGRRNPDRQARRWDQPWIGFMDYGKGLGLGLEVPGLRVRVELFVLGLRDMVELVGLGVGLGVGLEVWGLRDRVEGLGLGLDVRGLGFKGLGFGLGVRVKGYRLELDVRGWGFKGLGFGLGVRVKGY

SEQ ID NO: 164442 - protein, 41 aa, Glycine max
  Coding DNA Sequence Number=SeqID_47664
MASYGSAFAYSNSLRRCFPFVQSWARDDLSVVTLASTRVHP

SEQ ID NO: 164443 - protein, 79 aa, Glycine max
  Coding DNA Sequence Number=SeqID_47665
MVAWPEIQPSLHKEDKGPTAQVPNHMEDESSEATIPEPFDIGEEAEETQIPEDPTTPVLAMDTSPPTTPVLQLTDEEDG

SEQ ID NO: 164444 - protein, 101 aa, Glycine max
  Coding DNA Sequence Number=SeqID_47666
MDEDHWMLDNIMSEEVDMNVENEDEPGVKLEHVDCSDVFKSYKVFATYDNILNRARVVAYEIAFVAVIMRSDTNTNMRERTLFVLIGCERSGQYRVRKKDL

SEQ ID NO: 164445 - protein, 169 aa, Glycine max
  Coding DNA Sequence Number=SeqID_47667
MPMLDQFHPCIHDSIENIVDVKVDGKCGYCAIAALLGMGEDSWSLVHNHLLKELAKWSDEYINLLGDIDKFEKLKRLLLSSVIVYAYVPSVTILRLINRSNLQLLVGKPHMTLTTMEKAQHISDPSVQGIQKTEYIYHQYLICITLKQQGVEEWSAYTQIVTQPSLVGV

SEQ ID NO: 164446 - protein, 145 aa, Glycine max
  Coding DNA Sequence Number=SeqID_47668
  Homolog annotation: Hit_ID=Q9FVD4; Match level="QueryCoverage=49%, HitCoverage=19%, E-value=5e-10, Identity=57%"; Hit description =Ser/Thr specific protein phosphatase 2A B regulatory subunit beta isoform
MVRFCGAVWTGAYPLSAVVWRAQRTCNCKWMNDRNDNDTSKTHFLFSSSSFRKPSGIANSAKKENEIACDDVVLAPPPMTTNSDSSSAPLHWKFSQVLGQRLPNEPLQNGMTEENWSSGISRLRGIPNFVSKRNFRATSPRHVRN

SEQ ID NO: 164447 - protein, 171 aa, Glycine max
  Coding DNA Sequence Number=SeqID_47669
  Gene Ontology: Mol. function=sequence-specific DNA binding; Cellular component=nucleus; Biological process=regulation of transcription, DNA-dependent
  Homolog annotation: Hit_ID=Q9M3Y7; Match level="QueryCoverage=67%, HitCoverage=41%, E-value=8e-33, Identity=55%"; Hit description =Knotted1-like homeobox protein
  Pfam annotation: Domain name=ELK; Domain location=28-49; Score=32.3; E_value=1.7e-06; Accession=PF03789.4; Description=ELK domain
  Pfam annotation: Domain name=Homeobox; Domain location=51-110; Score =1.8; E_value=0.0032; Accession=PF00046.19; Description=Homeobox domain
  Pfam module annotation: Pfam domain module=ELK::Homeobox; Domain location=28-49::51-110
EVTHGSPGKDLSRVKKEAIEGKRMEVQELKDNLLRRYSGYITNLRHEFSKKKKKEKLPKEAKQILLSWWNVHFKWPYPTDADKVALAEWTGLDQKQVNNWFINQRKRHWKPTEEMHAEILDGLYGSLDESGKFKIVGGRRRFDDDDQEKEVANGVKLRVRMAIVDEEAEAA

SEQ ID NO: 164448 - protein, 134 aa, Glycine max
  Coding DNA Sequence Number=SeqID_47670
  Gene Ontology: Mol. function=RNA-directed DNA polymerase activity; Biological process=RNA-dependent DNA replication
MRKNRFPAQRKCKLALRGEGPFQVLERISGDAYKIDFPSEYNISSTFNFVNLSPYEAREDSRMNTLEERCDDENQVLEQKHSSNLWDPFQIASGPIIKAITKRFKEALNGVVQDLWANHNSVQSEFELKHAYTN

SEQ ID NO: 164449 - protein, 148 aa, Glycine max
  Coding DNA Sequence Number=SeqID_47671
  Gene Ontology: Mol. function=DNA binding
MEKRGMGHVSVKRRSVKYIGIGTALITKVHTKKRNCLQQKTMNDVVFVMTNSRLNKKKDVRKAKDFNIDDAASNDEWIVENEENSDLNALDEDILVELGEDARGEGVGGAPMDDLEVPPIDDDGDGGDAINEEEDYLHLTLNDLLGLT

SEQ ID NO: 164450 - protein, 73 aa, Glycine max
  Coding DNA Sequence Number=SeqID_47672
MHRRSKRGDSFVCEHLAIQHGGRGSNVHNNGRREHEEDQNEDLGGSRTKNLKPWVKVVTLATTTFADCEDRRK

SEQ ID NO: 164451 - protein, 180 aa, Glycine max
  Coding DNA Sequence Number=SeqID_47673
  Gene Ontology: Mol. function=protein phosphatase type 2A regulator activity; Cellular component=protein phosphatase type 2A complex; Biological process=signal transduction
  Homolog annotation: Hit_ID=Q6KAI1; Match level="QueryCoverage=61%, HitCoverage=66%, E-value=2e-20, Identity=46%"; Hit description =Ser/Thr specific protein phosphatase 2A B regulatory subunit beta isoform-like
MAPPLCSENMLLAERSFVPGLETTANGYHLEWIEKTPKNHLLPQDIDGEIGGMEDPIRAKCQKVYAYAHSFNINSISNNSDYETFISADDLRINLWNLEVSDQCFNIIDMKPSNMEDLTAFENFSIGKISFTAGSLLSGGLESGKEVFILGILYLPRFHTTLENQVLDQMVFKCKLISIG

SEQ ID NO: 164452 - protein, 79 aa, Glycine max
  Coding DNA Sequence Number=SeqID_47674
MRYIKSEEVGIGWMEKSREDQTEQEETEEKPMSPFEKMMLAKMDELMRIHKEDYVELKECFKSILERLNAMGASHVDDI

SEQ ID NO: 164453 - protein, 110 aa, Glycine max
  Coding DNA Sequence Number=SeqID_47675
MWDLIQVTHEGTSEIRRARKNSLIQEYKTFSMKFNKFLKKKKDYENITFQPKKNLKKGEPSSSNGYTCFEYGKKCYFKVDNPIYQKKQQGDKKNKDSFKKKKAYIAWDDD

SEQ ID NO: 164454 - protein, 429 aa, Glycine max
  Coding DNA Sequence Number=SeqID_47676
  Gene Ontology: Mol. function=DNA binding; Cellular component=beta -galactosidase complex; Biological process=DNA integration
  Homolog annotation: Hit_ID=O24587; Match level="QueryCoverage=63%, HitCoverage=27%, E-value=3e-79, Identity=51%"; Hit description=Pol
MQREFEIQMKGELKYFHGLQVKQMNHRTFLHQTKYCKELLKKFDMDKSKEAATPTATNCYISAYEKGKLINQTKYRELACACMCARYQSCPKEPHFSIVKTVMKYLRGTLDVGLWYPKGVEISLVEYLDSDFVGCILDRKRTSGTCHLLGHSLVSWNSKKQACVALSTVEADYIVARSYCAQILWLKQHLFDFGLRLEHIPLRCNNTSSISLTKNPIMHSRTKHIEIRHHFIKDHIHKGDYDIEFVDIDSQLADIFTKPLARDTFFHLHNEHGILRDDSTEVCQFGVAQKWRLCFEYHKLKKLVEMKGTYYIDLVKFFYTTAHIHGDIGFLCAEVKGQQIVMTPEVWFDIVGLLLEGVMANQLGLKKAGFAFNKVDKYKSMRKNPSTYVVVVTKSKGKERFGNGPLMLEHRLLAYVTTQTITPRGSNHA

SEQ ID NO: 164455 - protein, 163 aa, Glycine max
  Coding DNA Sequence Number=SeqID_47677
  Homolog annotation: Hit_ID=Q941I4; Match level="QueryCoverage=41%, HitCoverage=9%, E-value=2e-16, Identity=60%"; Hit description =Vacuolar acid invertase
MEANPSHTTTPHLDHALQTPLLNHPSRVNNISHRPSRGIFVILLSIVFLVSLVALIMIQGQNYMENLENSNIEITLFSNISKQELPRGAAQGVSAKSNPPLFHKVSYNWTNAMFSWQRTAFHFQPQNNWMNEANQQCLVDPLVFLFRADDVWLNWLQILMKKK

SEQ ID NO: 164456 - protein, 514 aa, Glycine max
  Coding DNA Sequence Number=SeqID_47678
  Gene Ontology: Mol. function=hydrolase activity, hydrolyzing O -glycosyl compounds; Cellular component=vacuole; Biological process =carbohydrate metabolic process
  Homolog annotation: Hit_ID=A0A7Y9; Match level="QueryCoverage=98%, HitCoverage=78%, E-value=0.0, Identity=71%"; Hit description=Soluble acid invertase
  Pfam annotation: Domain name=Glyco_hydro_32C; Domain location=349 -460; Score=144.3; E_value=3.3e-40; Accession=PF08244.2; Description =Glycosyl hydrolases family 32 C termi
  Pfam annotation: Domain name=Glyco_hydro_32N; Domain location=4-308; Score=588.4; E_value=6.5e-174; Accession=PF00251.10; Description =Glycosyl hydrolases family 32 N termi
  Pfam module annotation: Pfam domain module=Glyco_hydro_32C::Glyco _hydro_32N; Domain location=349-460::4-308
MTCPLFHMGWYHLFYQYNPDSAIWGNISWGHAVSRDMIHWFYLPIAMGPDTWYDINGVWTGSATILPGGKIIILYTGDTNEYVQVQNLAYPANLSDPLLLDWVKYAGNPVLVPPPGIGPKDFRDPTTGWIGPDGKWRVAIGSKKGKKGISLVYTTTDFVNFESNDHYLHAVPGTGMWECVDFYPVSISGSRGLDTSENEPNVKHVLKASMDETRVDHYALGTYFIENDTWVPDNPLEDVGIGLVLDYGRYYASKTFYDPEKERRILWGWINETDTESDDLRKGWASLQTIPRTVLFDSKTGTNLLLWPVEEVESLRLSSDEFEGVVVKPGSVVPLNISLATQLDMFAEFEIETLESKSIGKNNIGCGSGGATNRSAFGPFGLLAIADDTLSEQTPIYFRLSNTTLGSSTTFFCVDETRSSKAADVAKPIYGSKVPVLSDEKLSMRVLVDHSIIESFAQGGRTVITSRVYPTEAIYGAARLFLFNNATGINIKATLKIWQLSSAFIRPFPFDQSQ

SEQ ID NO: 164457 - protein, 418 aa, Glycine max
  Coding DNA Sequence Number=SeqID_47679
  Gene Ontology: Mol. function=protein binding; Cellular component =membrane; Biological process=defense response
  Homolog annotation: Hit_ID=Q6SQJ2; Match level="QueryCoverage=99%, HitCoverage=34%, E-value=1e-127, Identity=59%"; Hit description=NBS -LRR type disease resistance protein RPG1-B
  Pfam annotation: Domain name=NACHT; Domain location=205-356; Score= -22.6; E_value=0.0033; Accession=PF05729.3; Description=NACHT domain
  Pfam annotation: Domain name=NB-ARC; Domain location=164-418; Score =140.5; E_value=4.4e-39; Accession=PF00931.13; Description=NB-ARC domain
  Pfam module annotation: Pfam domain module=NACHT::NB-ARC; Domain location=205-356::164-418
MALEFVGGALLSAFLQVEFDRLTSYQVLDSFHRRKLDETLSSKLKIKLLSIDALAHHAEQKQFRDQHVKSWLVAVKVAVLDAEDLLDDIDYELSKCKVDAESESQTYTCKVLNFFKSHVRSFDKDIKSRMEQLLDSLEFLSNQKGDLGLKNASGVGVGSGLGGELSHKSPSTSFLSESVFYGRDDDKEIILNRMISDTHNCNQLSILSIVGLGGLGKTMLAQHVYHHSGIEGIFDIKAWVCVSDEFDDFKVSRAILDTITNSADDSRELEMVHARLKEKLPGKRFLLVLDDVWNECQSKWEEVQKALDFGAQGSKILITTRSKKVASTMRSKEHHLKQLQEDYCRQLLAEHAFRDDNSQPDPDCKEIGMKIVEKCKGLPLALKTMGSLLHRKSVSEWKSVLQSEMWELEDSDIVPALH

SEQ ID NO: 164458 - protein, 151 aa, Glycine max
  Coding DNA Sequence Number=SeqID_47680
  Gene Ontology: Mol. function=drug transporter activity; Cellular component=membrane; Biological process=multidrug transport
  Homolog annotation: Hit_ID=Q1SHJ6; Match level="QueryCoverage=99%, HitCoverage=31%, E-value=5e-63, Identity=75%"; Hit description=Multi antimicrobial extrusion protein MatE
MFLAVTEGLIVSATLFGCRHILGYAYSDDRMVVHYVAVMTPLLCLSIFTDSLQGVLSGVARGSGWQHLGAYVNLGAFYLVGIPVGIVLGFVAHLRAKGLWIGIVTGSIVQSILLSLVTALTNWKKQAMMARERIFDVKPPDENESNHMTSA

SEQ ID NO: 164459 - protein, 546 aa, Glycine max
  Coding DNA Sequence Number=SeqID_47681
  Gene Ontology: Mol. function=protein binding; Cellular component =membrane; Biological process=defense response
  Homolog annotation: Hit_ID=Q6SQJ2; Match level="QueryCoverage=98%, HitCoverage=50%, E-value=1e-165, Identity=54%"; Hit description=NBS -LRR type disease resistance protein RPG1-B
  Pfam annotation: Domain name=LRR_1; Domain location=201-222; Score =3.6; E_value=60; Accession=PF00560.23; Description=Leucine Rich Repeat
  Pfam annotation: Domain name=LRR_1; Domain location=359-378; Score =4.3; E_value=45; Accession=PF00560.23; Description=Leucine Rich Repeat
  Pfam annotation: Domain name=LRR_1; Domain location=36-57; Score =11.7; E_value=1.8; Accession=PF00560.23; Description=Leucine Rich Repeat
  Pfam annotation: Domain name=LRR_1; Domain location=382-401; Score =9.6; E_value=4.6; Accession=PF00560.23; Description=Leucine Rich Repeat
  Pfam annotation: Domain name=LRR_1; Domain location=407-430; Score =10.9; E_value=2.7; Accession=PF00560.23; Description=Leucine Rich Repeat
  Pfam annotation: Domain name=LRR_1; Domain location=455-477; Score =8.2; E_value=8.2; Accession=PF00560.23; Description=Leucine Rich Repeat
  Pfam annotation: Domain name=LRR_1; Domain location=487-510; Score =9.0; E_value=5.8; Accession=PF00560.23; Description=Leucine Rich Repeat
  Pfam annotation: Domain name=LRR_1; Domain location=59-81; Score =15.2; E_value=0.24; Accession=PF00560.23; Description=Leucine Rich Repeat
  Pfam annotation: Domain name=LRR_1; Domain location=83-104; Score =0.1; E_value=2.7e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=201-222::359 -378::36-57::382-401::407-430::455-477::487-510::59-81::83-104
MSIDELFSKFQFLWVLSLYCYSNLTEVPDSVANLKHLCSLDLSHTNIEKLPESTCSLYNLQILKLNHCAHLKELPSNLHKLNNLRCLEFINTGVRKVSAHLGKPKNLQVLMSSFDVGKSKELNIQHPSDASAVDLKNKAHLVELKLKWDGIGDQNTDDSTKERDVIVIENLQPSKHLEKLSIKNYGGMQFPSWLSDNSLWNVVSLSLKNCQSCQCLPSLGLLPSLKELTIERFDRIMGIDADFYGSSSSSFTSLETLKFSDMKEWEKWECQVVTGAFPPLQHLSIKGNCQCIFENSTEAWFLELIRQMISLTSSLERLYVISCPNMNIPMSGCHDFFISLMIIDGCDSLTIFPLDFFPTLSKLHLSGCLSLQRISHRHTHNNLKELEIWECPQLESLPERMHILLPSLDELLIADCPKLESFPHGGLPSNLKEMYLHNCFKLITSLKGALRDNSSLETLNIGKLDVESFPDEDLKKLDYKGLCHLSSLERLLLEDCPSLQCLPEEGLPISISYLEIWNCLLLKQSCQKPEGIDRGKIAHIEKVIIG

SEQ ID NO: 164460 - protein, 79 aa, Glycine max
  Coding DNA Sequence Number=SeqID_47682
  Gene Ontology: Mol. function=drug transporter activity; Cellular component=membrane; Biological process=multidrug transport
  Homolog annotation: Hit_ID=Q1SHJ6; Match level="QueryCoverage=97%, HitCoverage=15%, E-value=2e-13, Identity=57%"; Hit description=Multi antimicrobial extrusion protein MatE
AVMEEGSETGKWGWMKRRRAMREELKKVGTIAAPMVVASVLQYLLQVVSLVMVGHLNQLSLSTVAIATSLTNVSGFSVL

SEQ ID NO: 164461 - protein, 268 aa, Glycine max
  Coding DNA Sequence Number=SeqID_47683
  Gene Ontology: Mol. function=ATP binding
  Homolog annotation: Hit_ID=Q1T390; Match level="QueryCoverage=89%, HitCoverage=32%, E-value=2e-87, Identity=70%"; Hit description=ATP -binding region, ATPase-like
MGPTEVVYLSSDDESEKEVAFKAVKLEEDFVLDAKQYNETNKGQLAKHKRSQSHTTGQDSEENLSSNGPSTGHSNSSVLEQGPSPVDDTGISYASSIGVAPLCRQFWKAGNYDDGLGSKVTVQNAKNYLHVHPMFLHSNATSHKWAFGAIAELLDNAVDEHTKLLPMPVNNKTSNPRDGNPALLIQDDGGGMDPDAMRRCMSFGFSDKKSQFAIGRYGNGFKTSSMRLGADVIVFSCHLNNRYGSTNEHNITLKLVSATGLLLYWQSP

SEQ ID NO: 164462 - protein, 162 aa, Glycine max
  Coding DNA Sequence Number=SeqID_47684
MGGGRAAKRLHKVDMTSLAQFWTAFMLDNIIPNSHKKLSQKDNWSSARLSVACYELKQAKTKSIEGDIDWPRLSTTIDVQGQRVEQAAVEEPSVATSTSAEKEALESTHTDPIPSTEATNEAEVDERINVDDDVEIGYDDSNNITGGVLQENKNGEELAIAK

SEQ ID NO: 164463 - protein, 279 aa, Glycine max
  Coding DNA Sequence Number=SeqID_47685
  Gene Ontology: Mol. function=chromatin binding; Cellular component =chromatin; Biological process=chromatin assembly or disassembly
  Homolog annotation: Hit_ID=Q1SAV4; Match level="QueryCoverage=93%, HitCoverage=71%, E-value=4e-78, Identity=51%"; Hit description =Integrase, catalytic region
  Pfam annotation: Domain name=rve; Domain location=1-129; Score=23.6; E_value=6.4e-05; Accession=PF00665.16; Description=Integrase core domain
MDFITGLPAYRGNTCIFVVVDPFSKGLHLGMLPTQHTAHTMALLFLDMVGHLYGMPKSIVSDRDPLFISKFWRELFTMSEVANRIIEQYLRAFVHEKPSTWGRYLPWVEWSYNTSCHSTPSMTPFEITYGRKPPTCPHYISGTSNIEVVDSILNQREAIFEMLRRKLLKAQSRMKANADRHRRDQEFKVGDWVLVELRPQRQILVTGTTYSKLSKRYYGHFQVTECMGKVAYRLQLPENSCIHPIFHVSLLKPYTATSIAATAMDLPPIDAILPRKGIG

SEQ ID NO: 164464 - protein, 156 aa, Glycine max
  Coding DNA Sequence Number=SeqID_47686
  Gene Ontology: Mol. function=nucleic acid binding; Cellular component= oxygen evolving complex; Biological process=DNA integration
  Homolog annotation: Hit_ID=Q1SHW0; Match level="QueryCoverage=63%, HitCoverage=12%, E-value=1e-19, Identity=48%"; Hit description =Integrase core domain, putative
MTWIFMMKQKFEAFKFFKHSTILMKNQAGKIVKCLRTNNDLKLFSIKFNEFYRDEGIATQCIVCYPPQQNKVAERMNMTSLERARCKLSNLGLNRSSWVESMLKVFGCPIYYHISEGKTKDVTKQVEFKNSPIRNISDQKQFEAPDAIDQDLQMHP

SEQ ID NO: 164465 - protein, 81 aa, Glycine max
  Coding DNA Sequence Number=SeqID_47687
MCGSHHQCLFEEKVRKTKKKGVALAPMYPQKKKSSMIDGGNEYAQKQQGGPLREMTALGGLAARPGELMLHSEVTLLAQAS

SEQ ID NO: 164466 - protein, 586 aa, Glycine max
  Coding DNA Sequence Number=SeqID_47688
  Gene Ontology: Mol. function=RNA-directed DNA polymerase activity; Cellular component=chromatin; Biological process=chromatin assembly or disassembly
MWGMVYIQQHSFTTDFHVLPLCGADVVLGVQWLKTLRPILTDYDTLTMKFIIRGKLIELHGDREKGMEQVSSSQLRRFVHTNPTNTFFHIRVESATKHTPSTNHPLPEIKTLIAKNIFLFQPPTTLPPSRPIDHTINLLPNSAPVNVRPYRYPYFQKKEIEEQVATMLAKGFIQPSSSPLSSPVLLVKKKDGSWRFCVDYRALNAITVRDCFPVPTVDGLLDELGGARWFSKLDLMQGYHQILMNTTNISKTSFRTHQGHYEFRVMPFGLCNAPFSFQATMNQLFQPYLRKYIIVLFDDILIYSRTMHDHLLHLETAFQVLMAGQFPLKLSKCTFAQQQLEYLGHMVSANGVKPVPEKVQAIQQWPTPCTSQALRGFLGLAGFYRRFIRGYAALAAPLTKLLRHGQFDWSQEADTAFQNLKNALTVVPVLALPDFSTPFMVETDTSGSGMGAVLTLGGHPLAYYNKQFFPKLLNSSTYVRELAAITATVKKWRQYLLGHHFIILTDHRSLRKLMNQTIQRLEQHRYLARLLGFDYTIQYRAGRSNVVADALSRAMEGQAASLYFLSMSQFVFLDDLRKELAFLGTF

SEQ ID NO: 164467 - protein, 355 aa, Glycine max
  Coding DNA Sequence Number=SeqID_47689
  Gene Ontology: Mol. function=oxidoreductase activity; Cellular component=anchored to membrane; Biological process=lignin catabolic process
  Homolog annotation: Hit_ID=Q9FHN6; Match level="QueryCoverage=90%, HitCoverage=54%, E-value=1e-130, Identity=67%"; Hit description =Monocopper oxidase-like protein SKS2 precursor
  Pfam annotation: Domain name=Cu-oxidase; Domain location=159-314; Score=211.1; E_value=2.5e-60; Accession=PF00394.12; Description =Multicopper oxidase
  Pfam annotation: Domain name=Cu-oxidase_3; Domain location=33-149; Score=192.9; E_value=7.6e-55; Accession=PF07732.5; Description =Multicopper oxidase
  Pfam module annotation: Pfam domain module=Cu-oxidase::Cu-oxidase_3; Domain location=159-314::33-149
MKMVLSGFSLLLHIALLARLCFGGDPTVFTELRVSYTTVTPLGVPQQVIAINKKFPGPVINVTTNNHVIVNVFNELDEDLLISWSGVQMRRNSWQDGVLGTNCPIPPNWNWTYQFQVKDQIGSFFYFPSLGFQRASGGFGPFVINNREIIPIPFARPDGEIFIMVGDWYTQNHTALRATLDGGKDLGIPDGVLINGKGPFQYNTTLVPGGINYETITVDPGKTYRIRVHNVGISTSLNFRIQDHNLLLVETEGHYTTQTNFTSFDIHAGQSYSFLLSTDQNASTDYYIVASARFVNESLWEKVTGVAILHYSNSKGPAIGPLPPPPSDFYDKTASMNQARSVRFVPQNFVSERIL

SEQ ID NO: 164468 - protein, 225 aa, Glycine max
  Coding DNA Sequence Number=SeqID_47690
  Gene Ontology: Mol. function=potassium ion transporter activity; Cellular component=integral to membrane; Biological process =potassium ion transport
  Homolog annotation: Hit_ID=Q8W4I4; Match level="QueryCoverage=88%, HitCoverage=25%, E-value=8e-71, Identity=66%"; Hit description =Potassium transporter 6
  Pfam annotation: Domain name=K_trans; Domain location=26-225; Score= -336.0; E_value=5.9e-09; Accession=PF02705.7; Description=K+ potassium transporter
MDLDRGIVQNSDKVNWRKESWKTVLTLAYQSLGVVYGEISTSPLYVYRNTFAEDIGHSETNEEIYGVLSLVFWTLTLVPLVKYVFIVLKADDNGEGGTFALYSLLCRHAKVGLLPNCQLADEELSEYKKHSCGMAPERSLAFRLKSLLERHKVLQRILLVLALLGTCMVIGVGVLKPTISVFSAVSGLELSMSKEHHRFLKFGRFVMKVIKGYARALSGRPLFVP

SEQ ID NO: 164469 - protein, 253 aa, Glycine max
  Coding DNA Sequence Number=SeqID_47691
  Gene Ontology: Mol. function=oxidoreductase activity; Cellular component=anchored to membrane; Biological process=lignin catabolic process
  Homolog annotation: Hit_ID=Q8VXX5; Match level="QueryCoverage=88%, HitCoverage=38%, E-value=2e-93, Identity=68%"; Hit description =Monocopper oxidase-like protein SKS1 precursor
  Pfam annotation: Domain name=Cu-oxidase_2; Domain location=59-198; Score=135.4; E_value=1.5e-37; Accession=PF07731.4; Description =Multicopper oxidase
  Subcellular localization annotation: CTP_CleavageSite=35; ConfidenceScore=5.21e-01
MPLSRQNTSASGARPNPQGSFHYGSINVTDTYVLKVMSLAPINGTNRATINGISFLKPEVPFRLADKHQLRGTYKLDFPSKPMNRTPVIDRSMINATYKGFIEIILQNNDSSIQNFHLDGYSFFVVGMDYGDWSENSRGSYNKWDAISRSTTQVFPGGWTAILISLDNVGSWNLRAENLDRWYLGQETYLKIVNPEENGDTEMAAPDNVLYCGPLKSLQKSNSTFSAASTLGHSLNLFSLLLGLFAIILFLAR

SEQ ID NO: 164470 - protein, 739 aa, Glycine max
  Coding DNA Sequence Number=SeqID_47692
  Gene Ontology: Mol. function=protein binding; Cellular component =integral to membrane; Biological process=protein amino acid phosphorylation
  Homolog annotation: Hit_ID=Q9SN91; Match level="QueryCoverage=85%, HitCoverage=68%, E-value=1e-171, Identity=38%"; Hit description =Leucine rich repeat-like protein
  Pfam annotation: Domain name=LRR_1; Domain location=112-134; Score =10.6; E_value=3; Accession=PF00560.23; Description=Leucine Rich Repeat
  Pfam annotation: Domain name=LRR_1; Domain location=136-158; Score =15.1; E_value=0.26; Accession=PF00560.23; Description=Leucine Rich Repeat
  Pfam annotation: Domain name=LRR_1; Domain location=15-37; Score =16.6; E_value=0.091; Accession=PF00560.23; Description=Leucine Rich Repeat
  Pfam annotation: Domain name=LRR_1; Domain location=160-182; Score =14.9; E_value=0.29; Accession=PF00560.23; Description=Leucine Rich Repeat
  Pfam annotation: Domain name=LRR_1; Domain location=184-206; Score =12.8; E_value=1.2; Accession=PF00560.23; Description=Leucine Rich Repeat
  Pfam annotation: Domain name=LRR_1; Domain location=208-230; Score =10.9; E_value=2.6; Accession=PF00560.23; Description=Leucine Rich Repeat
  Pfam annotation: Domain name=LRR_1; Domain location=232-254; Score =12.1; E_value=1.5; Accession=PF00560.23; Description=Leucine Rich Repeat
  Pfam annotation: Domain name=LRR_1; Domain location=256-278; Score =11.0; E_value=2.5; Accession=PF00560.23; Description=Leucine Rich Repeat
  Pfam annotation: Domain name=LRR_1; Domain location=280-302; Score =12.7; E_value=1.2; Accession=PF00560.23; Description=Leucine Rich Repeat
  Pfam annotation: Domain name=LRR_1; Domain location=304-326; Score =12.7; E_value=1.2; Accession=PF00560.23; Description=Leucine Rich Repeat
  Pfam annotation: Domain name=LRR_1; Domain location=328-349; Score =11.0; E_value=2.5; Accession=PF00560.23; Description=Leucine Rich Repeat
  Pfam annotation: Domain name=LRR_1; Domain location=351-373; Score =17.3; E_value=0.055; Accession=PF00560.23; Description=Leucine Rich Repeat
  Pfam annotation: Domain name=LRR_1; Domain location=375-397; Score =16.9; E_value=0.072; Accession=PF00560.23; Description=Leucine Rich Repeat
  Pfam annotation: Domain name=LRR_1; Domain location=39-61; Score =13.0; E_value=1.1; Accession=PF00560.23; Description=Leucine Rich Repeat
  Pfam annotation: Domain name=LRR_1; Domain location=399-421; Score =12.9; E_value=1.1; Accession=PF00560.23; Description=Leucine Rich Repeat
  Pfam annotation: Domain name=LRR_1; Domain location=423-445; Score =13.3; E_value=0.91; Accession=PF00560.23; Description=Leucine Rich Repeat
  Pfam annotation: Domain name=LRR_1; Domain location=447-469; Score =9.5; E_value=4.8; Accession=PF00560.23; Description=Leucine Rich Repeat
  Pfam annotation: Domain name=LRR_1; Domain location=471-493; Score =14.7; E_value=0.34; Accession=PF00560.23; Description=Leucine Rich Repeat
  Pfam annotation: Domain name=LRR_1; Domain location=495-517; Score =7.9; E_value=9.5; Accession=PF00560.23; Description=Leucine Rich Repeat
  Pfam annotation: Domain name=LRR_1; Domain location=519-541; Score =11.3; E_value=2.2; Accession=PF00560.23; Description=Leucine Rich Repeat
  Pfam annotation: Domain name=LRR_1; Domain location=544-566; Score =3.5; E_value=62; Accession=PF00560.23; Description=Leucine Rich Repeat
  Pfam annotation: Domain name=LRR_1; Domain location=568-590; Score =18.2; E_value=0.03; Accession=PF00560.23; Description=Leucine Rich Repeat
  Pfam annotation: Domain name=LRR_1; Domain location=592-614; Score =15.2; E_value=0.24; Accession=PF00560.23; Description=Leucine Rich Repeat
  Pfam annotation: Domain name=LRR_1; Domain location=63-86; Score =10.9; E_value=2.6; Accession=PF00560.23; Description=Leucine Rich Repeat
  Pfam annotation: Domain name=LRR_1; Domain location=87-106; Score =10.8; E_value=2.7; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1; ...
  Pfam module annotation: Pfam domain module=Domain location=112 -134::136-158::15-37::160-182::184-206::208-230::232-254::256 -278::280-302::304-326::328-349::351-373::375-397::39-61::399 -421::423-445::447-469::471-493::...
  Pfam module annotation: =495-517::519-541::544-566::568-590::592 -614::63-86::87-106
  Subcellular localization annotation: CTP_CleavageSite=33; ConfidenceScore=5.06e-01
MLEGEIPSSLGSLKSLRILNLANNTLSGSIPTSLSLLSNLTYLNLLGNMLNGEIPSELNSLSQLQKLDLSRNSLSGPLALLNVKLQNLETMVLSDNALTGSIPYNFCLRGSKLQQLFLARNKLSGRFPLELLNCSSIQQVDLSDNSFEGELPSSLDKLQNLTDLVLNNNSFSGSLPPGIGNISSLRSLFLFGNFFTGKLPVEIGRLKRLNTIYLYDNQMSGPIPRELTNCTRLTEIDFFGNHFSGPIPKTIGKLKDLTILHLRQNDLSGPIPPSMGYCKRLQLLALADNKLSGSIPPTFSYLSQIRTITLYNNSFEGPLPDSLSLLRNLKIINFSNNKFSGSIFPLTGSNSLTVLDLTNNSFSGSIPSILGNSRDLTRLRLGNNYLTGTIPSELGHLTELNFLDLSFNNLTGHVLPQLSNCKKIEHLLLNNNRLSGEMSPWLGSLQELGELDLSFNNFHGRVPPELGGCSKLLKLFLHHNNLSGEIPQEIGNLTSLNVFNLQKNGLSGLIPSTIQQCTKLYEIRLSENFLSGTIPAELGGVTELQVILDLSRNHFSGEIPSSLGNLMKLERLDLSFNHLQGQVPPSLGQLTSLHMLNLSYNHLNGLIPSTFSGFPLSSFLNNDHLCGPPLTLCLEATGKERMQLSNAQVAAIIVAIVLTSTLICLVMLYIMLRIWCNWIKVAVSSEDGGMVEQQKTRNGEYWNMNSPELFPSPDKQISPTICICSLKIDAEAQENTLVR

SEQ ID NO: 164471 - protein, 363 aa, Glycine max
  Coding DNA Sequence Number=SeqID_47693
  Gene Ontology: Mol. function=DNA binding; Cellular component=nucleus; Biological process=regulation of transcription
  Homolog annotation: Hit_ID=UPI00001631DC; Match level="QueryCoverage =96%, HitCoverage=100%, E-value=1e-83, Identity=46%"; Hit description= ANAC026; transcription factor
  Pfam annotation: Domain name=NAM; Domain location=9-138; Score=313.6; E_value=3.6e-91; Accession=PF02365.6; Description=No apical meristem (NAM) protein
ENMNNFSHVPPGFRFHPTDEELVDYYLRKKVTSRGIDLDVIKDVDLYKIEPWDLQELCRIGAQEQNEWYFFSHKDKKYPTGTRTNRATAAGFWKATGRDKAIYSKHDLIGMRKTLVFYKGRAPNGQKSDWIMHEYRLETDENGAPQASLKTYIYNQEEGWVVCRVFKKRLTTMRKLSEHDSPCWYDDQVSFMQDLDSPKQSSQPNLPYQQFQYSCKKELDLSYHLPVQLPLENQKLLQSASNSMTPYGIEENPNAMQPASSMMQQVQQQNFQAVVFGNNANDQQVTDWRSLDKYVASQLSQEDASKDHNRYSNTGNIFQVKNNSNIEQLRDLDKDEMMPENASTSNSSCPINITCEFSGFTSS

SEQ ID NO: 164472 - protein, 56 aa, Glycine max
  Coding DNA Sequence Number=SeqID_47694
MERAVIFGDIRRIRRIQRENKASQGNILFRSFLPNDASSVPNTPLDARGSSSASNP

SEQ ID NO: 164473 - protein, 187 aa, Glycine max
  Coding DNA Sequence Number=SeqID_47695
  Gene Ontology: Mol. function=protein binding; Cellular component =integral to membrane; Biological process=protein amino acid phosphorylation
  Homolog annotation: Hit_ID=Q6L3I5; Match level="QueryCoverage=84%, HitCoverage=64%, E-value=1e-21, Identity=42%"; Hit description =Leucine Rich Repeat family protein
  Pfam annotation: Domain name=LRRNT_2; Domain location=27-67; Score =34.6; E_value=3.4e-07; Accession=PF08263.3; Description=Leucine rich repeat N-terminal domain
  Pfam annotation: Domain name=LRR_1; Domain location=120-142; Score =15.3; E_value=0.22; Accession=PF00560.23; Description=Leucine Rich Repeat
  Pfam annotation: Domain name=LRR_1; Domain location=144-166; Score =15.2; E_value=0.23; Accession=PF00560.23; Description=Leucine Rich Repeat
  Pfam annotation: Domain name=LRR_1; Domain location=168-187; Score =1.0; E_value=1.9e+02; Accession=PF00560.23; Description=Leucine Rich Repeat
  Pfam annotation: Domain name=LRR_1; Domain location=72-94; Score=9.4; E_value=5; Accession=PF00560.23; Description=Leucine Rich Repeat
  Pfam annotation: Domain name=LRR_1; Domain location=96-118; Score =21.6; E_value=0.0029; Accession=PF00560.23; Description=Leucine Rich Repeat
  Pfam module annotation: Pfam domain module=LRRNT_2::LRR_1::LRR_1::LRR_ 1::LRR_1::LRR_1; Domain location=27-67::120-142::144-166::168-187::72- 94::96-118
MDSIYICHFILLLTIVCTVVVATLGDNTTESYWLLRIKSELVDPLGALRNWSPTTTQICSWNGLTCALDQARVVGLNLSGSGLSGSISGEFSHLISLQSLDLSSNSLTGSIPSELGKLQNLRTLLLYSNYLSGAIPKEIGNLSKLQVLRLGDNMLEGEITPSIGNLSELTVFGVANCNLNGSIPVEV

SEQ ID NO: 164474 - protein, 79 aa, Glycine max
  Coding DNA Sequence Number=SeqID_47696
MEPNGRRRGAYHSMTQPNNIKGRGKWSPLITNTNLKLLEFGSLLEKEKEREREPLANANLNCKSQRMIYDPYNSPFRTQ

SEQ ID NO: 164475 - protein, 90 aa, Glycine max
  Coding DNA Sequence Number=SeqID_47697
EAPKKEKSLALSSQKVKQALLSKEQVSISLSKSLEAETPLMKILSKSLMKMNSPSSHEIFSRCGRTKGDPNRRTSQKCCSRKRKTKTKAP

SEQ ID NO: 164476 - protein, 213 aa, Glycine max
  Coding DNA Sequence Number=SeqID_47698
  Gene Ontology: Mol. function=nucleic acid binding; Biological process= DNA integration
  Homolog annotation: Hit_ID=Q1SNY3; Match level="QueryCoverage=99%, HitCoverage=15%, E-value=6e-40, Identity=40%"; Hit description =Integrase, catalytic region; Zinc finger, CCHC-type; Peptidase aspartic, catalytic
MLLSKIRPKHIDDAMFDEYCVKAMPEELDQFQKNDVRKLVELPNGKSTVRAKWVLKKKLDEPGKIYVYDIIFGATNDSLCEDSSKLMYAKFKMSMIGESKFFFGLQIMQADEGIYIHQTKYVNELLKKFKMDDAKYMKTPMHLTSVLGLDEKSKKVGKKSKKVEEKTYREMIRSILYLTTSRLDIMFSVCFCAIFQKELGKFIYLLSNTYLGI

SEQ ID NO: 164477 - protein, 256 aa, Glycine max
  Coding DNA Sequence Number=SeqID_47699
  Subcellular localization annotation: CTP_CleavageSite=50; ConfidenceScore=5.36e-01
MDAPSSQDTLAPPHPLPTLVASKATGAMAQVPKKVAPKKQQPSSTTKCLRALNETKSDEDGLVFRKKKVAPPLDETTAPQMNKVKPNPQVIHFKKKKKTESTTGMDNEIQHQAPLSPIHLDRFQHQGQPTIEPNLTVEDTTRYFTMEAKKTVTLKLDTKFDQNDAMLFYFKDMYENSRLMSISNYEKEDTFNHMRMVQILRPTNIYRFNDWKMCPKSAMQRVVVIAWARHPILKEHPFSPYHKPWVPKQGMATELQ

SEQ ID NO: 164478 - protein, 99 aa, Glycine max
  Coding DNA Sequence Number=SeqID_47700
MSFIVAKVTLKDKEPKVHTEHFFDIESLENVGYVIKAHLMLGYFVDHVLGIIVKLSVETIAQATDYERRGTKFIKLEDQIGNSLWGPNWPTCQGNMAPC

SEQ ID NO: 164479 - protein, 115 aa, Glycine max
  Coding DNA Sequence Number=SeqID_47701
MILHEIRRPNTLKTVPSGVANCRDLPFDGRATRDSRERLPRKENVRSHHQRLFEKNVGKTRTCGLLTLSVKGSGVVFTYGEGVVDKSGVFAPTYPRFVVKNSDLRSSCEAVKFMC

SEQ ID NO: 164480 - protein, 52 aa, Glycine max
  Coding DNA Sequence Number=SeqID_47702
MVLEQPFSSLIPDLHGIDRTILNRALKLLEQKGKLVVFKGTSTDDEGVKFSI

SEQ ID NO: 164481 - protein, 291 aa, Glycine max
  Coding DNA Sequence Number=SeqID_47703
  Gene Ontology: Mol. function=triacylglycerol lipase activity; Biological process=lipid metabolic process
  Homolog annotation: Hit_ID=Q2R051; Match level="QueryCoverage=90%, HitCoverage=44%, E-value=8e-20, Identity=27%"; Hit description =Lipase family protein
MWKIIGHSLGGGTAALLTFMLREMKQFSSSACMTLELAGFGKPFITSIINGYDIVPTLSASSLHDFIYKGRIKDKNILTAVGSRLSFAKAITGHAVTRCTQVVKKHQQRTQSLLPCSQRENIETSDDLVKASQSWETSCETLLTEEHVIIESVSDDEEYNSSSEGSDGDDDDSDDDKDKLSNIHAKDKEATTTKNITEEESVCPVPTSVNLDRHPLYPPGKIMHIVPENNNSNRKYPDKKRIYLYETPTQFYGKLRFSRGIILDHLTKKYLKKLQQLINQLEKEQSKFGGL

SEQ ID NO: 164482 - protein, 605 aa, Glycine max
  Coding DNA Sequence Number=SeqID_47704
  Gene Ontology: Mol. function=metal ion binding; Cellular component =intracellular; Biological process=metabolic process
  Homolog annotation: Hit_ID=Q9C6T2; Match level="QueryCoverage=94%, HitCoverage=95%, E-value=0.0, Identity=59%"; Hit description=PPR -repeat protein, putative
  Pfam annotation: Domain name=PPR; Domain location=198-232; Score =18.0; E_value=0.033; Accession=PF01535.11; Description=PPR repeat
  Pfam annotation: Domain name=PPR; Domain location=300-334; Score =45.3; E_value=2.1e-10; Accession=PF01535.11; Description=PPR repeat
  Pfam annotation: Domain name=PPR; Domain location=335-369; Score =14.8; E_value=0.13; Accession=PF01535.11; Description=PPR repeat
  Pfam annotation: Domain name=PPR; Domain location=371-405; Score=9.4; E_value=0.57; Accession=PF01535.11; Description=PPR repeat
  Pfam annotation: Domain name=PPR; Domain location=437-471; Score=2.4; E_value=3.8; Accession=PF01535.11; Description=PPR repeat
  Pfam annotation: Domain name=PPR; Domain location=97-131; Score=34.0; E_value=5.2e-07; Accession=PF01535.11; Description=PPR repeat
  Pfam module annotation: Pfam domain module=PPR::PPR::PPR::PPR::PPR::PP R; Domain location=198-232::300-334::335-369::371-405::437-471::97-131
MSGTSVLCQSHLLSLPNSPLQSSELNAKFNEQGWLSLLKRCKSMEEFKKVHAHILKLGLFYDSFCGSNLVASCALSRWGSMEYACSIFRQIEEPGSFEYNTMIRGNVNSMDLEEALLLYVEMLERGIEPDNFTYPFVLKACSLLVALKEGVQIHAHVFNAGLEVDVFVQNGLISMYGKCGAIEHAGVVFEQMDEKSVASWSSIIGAHASVEMWHECLMLLGDMSREGRHRAEESILVSALSACTHLGSPNLGRCIHGILLRNISELNVVVKTSLIDMYVKCGSLEKGLCVFQNMAHKNRYSYTVMIAGLAIHGRGREALRVFSDMLEEGLTPDDVVYVGVLSACSHAGLVKEGFQCFNRMQFEHMIKPTIQHYGCMVDLMGRAGMLKEAYDLIKSMPIKPNDVVWRSLLSACKVHHNLEIGEIAADNIFKLNKHNPGDYLVLANMYARAQKWANVARIRTEMVEKNLVQTPGFSLVEANRNVYKFVSQDKSQPQCETIYDMIQQMEWQLKFEGYTPDMSQVLLDVDEDEKRQRLKHHSQKLAIAFALIQTSEGSPVRISRNLRMCNDCHTYTKFISVIYEREITVRDSNRFHHFKDGTCSCKDYW

SEQ ID NO: 164483 - protein, 80 aa, Glycine max
  Coding DNA Sequence Number=SeqID_47705
VLMMPRQKQHKFYFKSKSRPRRKQSVNHEDFDDVKKIKPWIMSVIIKKGENVNLAYLDDVEKKSLDYHHKKGGECECINT

SEQ ID NO: 164484 - protein, 59 aa, Glycine max
  Coding DNA Sequence Number=SeqID_47706
MEWKLESLLLLSNVWEPYRSSQRKNLKNLRKLLEMLLSLSEYTFEVPMRNYCEIDVFLC

SEQ ID NO: 164485 - protein, 361 aa, Glycine max
  Coding DNA Sequence Number=SeqID_47707
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=23%, E-value=4e-53, Identity=50%"; Hit description=Chromo
  Pfam annotation: Domain name=RVP; Domain location=231-332; Score= -14.5; E_value=0.1; Accession=PF00077.10; Description=Retroviral aspartyl protease
  Pfam module annotation: Pfam domain module=RVP::Retrotrans_gag; Domain location=231-332::3-74
MTRENSFKTWIAFTRALETEFGPSPCECPRSQLFKLTQIGSVQSYYVQFTALANRVQGITQEALLDCFVGGLKPNIRMDVIAQSPTSLLKTVSLAKLYEEKYTPKLKPFSSSFSSKTQTSNTNSNLNTNQNSPQSLKSTSLPPLLPTPYTKPINVKKMTSAEMQLRRERGLSFTCDDKFSPSHRCPNKQHFVLQWEEEDDPALQPDPPDEVETVGDPSFQIHHLSYNALKGSSGLGIMKCRLGVQILLDSGSSDNFLQPRLAQCLKLPVEPIPNLQVLVGNGNALTAEGLIQDLEVKIQGHTLKLPVYLLPVSGADLVLGAAWLATIGPDLSDYSTLTLKFYLGNQFITLHGERPSLPQQA

SEQ ID NO: 164486 - protein, 131 aa, Glycine max
  Coding DNA Sequence Number=SeqID_47708
MSWKRTHYFSMPHLENHDYERVQKGEKLKSVAASVSLSEALELSESHPLSETSAHLASKRNLEANLPCKHVLSTSSARPMSHLPLLALSASGSLRQRSLTCAKRENGAKHAFKDRKSFLKPEVKEKRELGR

SEQ ID NO: 164487 - protein, 53 aa, Glycine max
  Coding DNA Sequence Number=SeqID_47709
MWDRHKLKATLKPSVFTPKFQAKEEKVQAADDSLSEVDPLSERHLLSKTSSSL

SEQ ID NO: 164488 - protein, 90 aa, Glycine max
  Coding DNA Sequence Number=SeqID_47710
MHTSKNAVEEESMQLQSLYLSARYNLLEVFVIGPRGFGNKLQVSGGLGRMVLGKHFTNIAKAFIPKNSIIMLFFANLEGNIFLLSIIWNI

SEQ ID NO: 164489 - protein, 314 aa, Glycine max
  Coding DNA Sequence Number=SeqID_47711
  Homolog annotation: Hit_ID=Q1S066; Match level="QueryCoverage=92%, HitCoverage=97%, E-value=1e-73, Identity=52%"; Hit description =Arabidopsis conserved protein
  Pfam annotation: Domain name=DUF241; Domain location=56-290; Score =102.2; E_value=1.5e-27; Accession=PF03087.5; Description=Arabidopsis protein of unknown function
MAPVETSIKSSLHSRSNSLPNAPHPILSQVEVHLHRLKKDPEATTSLSSSSSSISHRLNDLQDLQESADKLLQLTISQQGLAQECRSKQIDELLDRSLRLLDICSTIKDCLLQSKDSMHELGSVIRRKRDAETGFTTEGGKYLACRKKMKRAIAKALRDLKAIQNKFTVSSSNKDEETSSMLSFLKEAEMVTMSSFESLLIFIIGPKGQLKQSRWSVISKLVQPKRISCDSEVSDTNKFKMVDKVLKLLIGSKPSSTENFQSHVQNLELCIQDIEVGVERLSRQLIRTRVTQHFEPLVNRTMFLTLLILVHKCD

SEQ ID NO: 164490 - protein, 343 aa, Glycine max
  Coding DNA Sequence Number=SeqID_47712
  Gene Ontology: Mol. function=signal transducer activity; Cellular component=membrane; Biological process=signal transduction
  Homolog annotation: Hit_ID=Q6D515; Match level="QueryCoverage=99%, HitCoverage=55%, E-value=1e-145, Identity=76%"; Hit description =Methyl-accepting chemotaxis protein
  Pfam annotation: Domain name=Cache_1; Domain location=49-131; Score =25.0; E_value=0.00015; Accession=PF02743.8; Description=Cache domain
  Pfam annotation: Domain name=HAMP; Domain location=190-262; Score =19.7; E_value=0.011; Accession=PF00672.15; Description=HAMP domain
  Pfam module annotation: Pfam domain module=Cache_1::HAMP; Domain location=49-131::190-262
AGAAPKGRYAYFIDRDQGGNFALHPLTSIFKPGQGDYYLLPQKSQTDTLIEPYSYAYNGVPTLLTSVAAPIISQGKLWGVVTSDISLASLQEKVNSIKPWEGSGYAMLLSSAGNVVSYPDKSQTSKAWKGDTHNFSSTVTEQHDAILGEDALVAWRPVVIGNSDQKWYLGVVAPVSKVMEAAHRQLINAVILMVISILVVCALLGLVFSRKVLKPIGGEPLTAATIALAVADGKLDNAIPLKARDSSSLFFALHTMQNQLREIVGQIQDASASVRQGAGEIASGNLNLASRTEEQAAALEQTAASMEQITATVKHNAANAHQATKLTDNATHIASRGESLVGQ

SEQ ID NO: 164491 - protein, 54 aa, Glycine max
  Coding DNA Sequence Number=SeqID_47713
MDAFTAKMGRKSAGGGLSGGGEAVQMDDGIDVILFDRLILAYYDRAEKRIIRID

SEQ ID NO: 164492 - protein, 233 aa, Glycine max
  Coding DNA Sequence Number=SeqID_47714
  Homolog annotation: Hit_ID=Q1S065; Match level="QueryCoverage=55%, HitCoverage=47%, E-value=7e-35, Identity=60%"; Hit description =Arabidopsis conserved protein
MNEICQRWGCLRYVSSIFSGGKAALFINSIKQNIFNCIWLENWEAGEGIPSSLDIKDYSYLDGDVYAKTQCSQRIWQLQKQAQRALSTIDETACPPHLTHSYHNESMHELHSVIRKRKGDKTIFTIEGGKYLASRNKLKKKIRKALRNLKAMKSEFHNFSMLSILTEAEEVTLRSLESLLLFICDPKGQPKQSRWSAISKLMHPKRMVYDSQESRTNEFDKVDAALYSLITAK

SEQ ID NO: 164493 - protein, 85 aa, Glycine max
  Coding DNA Sequence Number=SeqID_47715
  Homolog annotation: Hit_ID=Q1S060; Match level="QueryCoverage=100%, HitCoverage=29%, E-value=3e-13, Identity=46%"; Hit description =Arabidopsis conserved protein
  Subcellular localization annotation: CTP_CleavageSite=38; ConfidenceScore=5.11e-01
MASSPLNPKYSSHGRSNSLPSRPHPLILKCNEHLESLRASKATSSSSTLLRHKVEGLQDLIECVGKLIQLPLTQDVLLHERQENW

SEQ ID NO: 164494 - protein, 182 aa, Glycine max
  Coding DNA Sequence Number=SeqID_47716
  Gene Ontology: Mol. function=two-component sensor activity; Cellular component=membrane; Biological process=two-component signal transduction system (phosphorelay)
  Homolog annotation: Hit_ID=Q1FSZ5; Match level="QueryCoverage=93%, HitCoverage=24%, E-value=6e-31, Identity=38%"; Hit description=GGDEF domain
  Pfam annotation: Domain name=EAL; Domain location=1-168; Score=83.3; E_value=7.5e-22; Accession=PF00563.11; Description=EAL domain
MLQQIVEWDRVLRLPPLVFSINISPLQLMHRDFTHDTLLTLSHYKIRPERLKFEITETTFIYDQQRIGDVINHFSQLGIKWAIDDFGVGYSSLKSLSDFAIDDIKIDKSLIMHIFENESAAIVVQKTIELSRAMGLNVLAEGIESEEYFEHLRNKGCHLFQGYHFARPLPAAEALQWIKKAG

SEQ ID NO: 164495 - protein, 100 aa, Glycine max
  Coding DNA Sequence Number=SeqID_47717
  Homolog annotation: Hit_ID=Q1S065; Match level="QueryCoverage=96%, HitCoverage=32%, E-value=2e-19, Identity=47%"; Hit description =Arabidopsis conserved protein
MALVETNMKSSLHNRSNSMPTAPRPTVSQVEEHLHRLKDTEATTSSLSSSISHRLNDLQDLQESTDELLQLRISQQALAQECSSKQIDELLDGSVRLGYL

SEQ ID NO: 164496 - protein, 294 aa, Glycine max
  Coding DNA Sequence Number=SeqID_47718
  Homolog annotation: Hit_ID=Q1S060; Match level="QueryCoverage=99%, HitCoverage=100%, E-value=7e-77, Identity=55%"; Hit description =Arabidopsis conserved protein
  Pfam annotation: Domain name=DUF241; Domain location=52-291; Score =158.5; E_value=1.7e-44; Accession=PF03087.5; Description=Arabidopsis protein of unknown function
  Subcellular localization annotation: CTP_CleavageSite=38; ConfidenceScore=5.12e-01
MASSPLNPKSGSHGRSNSLPSRPHPLILKCNEHLESLRASKETSSSSTLLRHKVEGLQDLIECVEKLTQLPPYSRCPSPRVSRELGKRHGSLRLLDVCTAAKDALLRTKECTRELQSTIRRKRGGEVELTAEVKKFLTSRKVVKKAISKALANLNSTSKSSNISSNTNKDHRTVALISLLQDMEVATLSTFQTLLQFISGSTQSKSNSWLSISKLIQPKRVGCSLVADESEFAQVDAALQSFVFTKTCKFEDINNLQNQLEKMESCIQDFEEGLEFLFRRLIKIRVSLLNVFNH

SEQ ID NO: 164497 - protein, 169 aa, Glycine max
  Coding DNA Sequence Number=SeqID_47719
  Homolog annotation: Hit_ID=Q1S066; Match level="QueryCoverage=67%, HitCoverage=38%, E-value=4e-28, Identity=53%"; Hit description =Arabidopsis conserved protein
MAVTEANTKSSLHTRSNSLPSAPHPLISQHEEHLQKLRDSEATSSISSSSLSHKLNGLLDLQDCTDKLLQLPMKQQAVAQKFSDKCVDDILEGSLRLLDICSTAKECLQISKETLSSEGKEQVEEGNQKGLEKFESHKKNSYGGFEDKGHSYKIAETLPTIAGICGCFS

SEQ ID NO: 164498 - protein, 834 aa, Glycine max
  Coding DNA Sequence Number=SeqID_47720
  Homolog annotation: Hit_ID=UPI00006DAAC0; Match level="QueryCoverage =46%, HitCoverage=94%, E-value=1e-155, Identity=68%"; Hit description= COG2141: Coenzyme F420-dependent N5,N10-methylene tetrahydromethanopte rin ...
  Homolog annotation: Hit description=reductase and related flavin -dependent oxidoreductases
  Pfam annotation: Domain name=Acetyltransf_1; Domain location=719-798; Score=63.5; E_value=7e-16; Accession=PF00583.14; Description =Acetyltransferase (GNAT) family
  Pfam annotation: Domain name=SBP_bac_3; Domain location=437-667; Score=109.9; E_value=7.6e-30; Accession=PF00497.10; Description =Bacterial extracellular solute-binding proteins, family 3
  Pfam module annotation: Pfam domain module=Acetyltransf_1::SBP_bac_3; Domain location=719-798::437-667
RGWKLDFLFVADGLFINEKSIPHFLNRFEPLTLLSALAGVTEHLGLVGTVSTSYSEPFTVARQFASLDHLSGGRAGWNVVTSPLEGSAKNFSRQQHPEHALRYRIADEYLQVVKGLWDSWEEGAFVRNKASGQFYAPDKLHTLNHHGDFFQVQGPLNIERTPQGRPIIFQAGASEDGRKLAARHADAIFTHQPTREEAQAFYRDVKQQLVANGREPGDLHIFQGVSVIVGEDDADVERQYQTTAALVSIEDALNYLGRFFDHHDFSQYPLDQPFPDIGDIGQNSFRSTTDEIKRKAREHGHTLRQAALEAATPRPLFHGTPQQVADGLQLWFETEATDGFIIQGGTPDTFERFVDQVIPVLQARGLTRREYPGSTLRASFGLKQPLNHAALAEDVAVNGQQVSLAANKTPINTPENPAAVAQIPAGHKFAVPGSFTVAVAALNSPPLTVFSDDNKTLLGSEVDIARLVADSLGLKLNIVPTSWEDWPLGVASGKYDAAITNVTVTKDRKQRFDFATYRKDSLGFYVKTSSPITSLSKAEDIAGLRIIVGSGTNQEAILLAWDKENQAKGLKPFTPVYTKDDAAQTLALQAGRADAYFGPNVIGAWKAALTKKTRLVGSVDGGWPKAAHIAVTVKKDNGLVQPINTALNGVIKNGDYDKVLNRWGMSQQFFREVSPEAPELQPILDGLFGEYAARYGDFFRKHNEVELTEWYLPPRGLFIVLERDGEIIAMGAYKPWDATTAELKRIWTRRDLRRQGLALLILQELERRALRAGYQRVFLTTGFRQPEAVQLYIGHGYQPQFELREDMEIYGQPPHDGRLRFLKVIDVHNVAQAS

SEQ ID NO: 164499 - protein, 135 aa, Glycine max
  Coding DNA Sequence Number=SeqID_47721
  Gene Ontology: Mol. function=Rab GTPase activator activity; Cellular component=integral to membrane; Biological process=regulation of Rab GTPase activity
  Homolog annotation: Hit_ID=Q1S081; Match level="QueryCoverage=82%, HitCoverage=57%, E-value=8e-34, Identity=64%"; Hit description =Retrieval of early ER protein Rer1
  Pfam annotation: Domain name=Rer1; Domain location=2-133; Score =150.0; E_value=6.1e-42; Accession=PF03248.4; Description=Rer1 family
MEGSGGGGASPSAPLKQYLQEFSKLFQYYLDKSTPHPPYRWIGTFVIASIYVLRVVYVQGFYIVSYGLGIYLLNLLIGFLSPLVDPELDPSNAPMLPTKGSDEFKPFIRRLPEFKFCPLWINLFISVYRKRRYND

SEQ ID NO: 164500 - protein, 107 aa, Glycine max
  Coding DNA Sequence Number=SeqID_47722
  Gene Ontology: Mol. function=DNA binding; Cellular component=nucleus; Biological process=regulation of transcription
  Homolog annotation: Hit_ID=Q9FRL6; Match level="QueryCoverage=73%, HitCoverage=59%, E-value=1e-23, Identity=65%"; Hit description=Myb -related protein; 20671-21051
  Pfam annotation: Domain name=Myb_DNA-binding; Domain location=13-62; Score=32.2; E_value=1.8e-06; Accession=PF00249.21; Description=Myb -like DNA-binding domain
MASSTLSKQKPYDSCWTPKQNKVFEKALAKYDKDTPDRWHNVAKAIGGKSEDDVKRHYQILLEDLRHIESGHVPIPNYKSTPTTFPLSTTLLICLPQASEVSKAEMV

SEQ ID NO: 164501 - protein, 37 aa, Glycine max
  Coding DNA Sequence Number=SeqID_47723
MWPLAEENSDGGERSGDRSLQVRLTAFPTDANLQAPD

SEQ ID NO: 164502 - protein, 184 aa, Glycine max
  Coding DNA Sequence Number=SeqID_47724
  Gene Ontology: Mol. function=iron ion binding; Biological process =iron ion transport
  Homolog annotation: Hit_ID=O51900; Match level="QueryCoverage=61%, HitCoverage=26%, E-value=4e-40, Identity=66%"; Hit description =Enterochelin esterase
  Pfam annotation: Domain name=MbtH; Domain location=116-182; Score =111.9; E_value=1.8e-30; Accession=PF03621.4; Description=MbtH-like protein
SYGGLAALYAGVHWPERFGHVLSQSGSFWWPTVQFVTQFEKRHELEEGWLIRQVRQRDAAAPALNVIQQAGDREADIEFVNRQMHEALTAAGHRADYRVFSGGHDALCWRGGLEQQNPFDDESLRFSVLVNAQQQYSLWPQFADAPQGWRVLMGPASRGECIDYIETHWQDMRPAALKAADAAR

SEQ ID NO: 164503 - protein, 99 aa, Glycine max
  Coding DNA Sequence Number=SeqID_47725
  Homolog annotation: Hit_ID=Q8VUE5; Match level="QueryCoverage=84%, HitCoverage=2%, E-value=4e-19, Identity=60%"; Hit description =Synthetase CbsF
MSETLSLPDTRVEYRDYPLVAAQPGIWIADQIALRRNGFAVAHYTELHGAIDRSALERAIRQGLAEADTVQAQFFEAQDGQPVQRLPLNADPARVQAPE

SEQ ID NO: 164504 - protein, 139 aa, Glycine max
  Coding DNA Sequence Number=SeqID_47726
MDYFYVPSLVLFEQPSGCTLHLNWSRRDVPSLVLSYNNPSRCTLYLYHKGCTLQCVKTKFQAVSPLKLCEGETKDISGGEERHKRIQAVSPLFFWKREKRVTKRIQASKVWKPKNLESFWQRKKKKKKFKKMFKEIQRL

SEQ ID NO: 164505 - protein, 102 aa, Glycine max
  Coding DNA Sequence Number=SeqID_47727
AIMKRSSKLESGGHMNRAIHGAPKNGGEWRIALRAIMKHSSKLESGGHMNENAIHGAPKKRGRMEDCLEGGEWRIALRVRTWEIMKYNSKLESGGHMNSARQ

SEQ ID NO: 164506 - protein, 121 aa, Glycine max
  Coding DNA Sequence Number=SeqID_47728
MMHQIPMIGGMMNVLSGATLFCKITHAPNIFMICVHRDSLGRNNQHKNKEKGMFYSITFLNFLNSDQGIPMDPKRIKVISEWPTPSSVEERINEFQEPLDLRSNPFQGGGNDAILPPKGIG

SEQ ID NO: 164507 - protein, 129 aa, Glycine max
  Coding DNA Sequence Number=SeqID_47729
  Homolog annotation: Hit_ID=Q9ZTB2; Match level="QueryCoverage=40%, HitCoverage=10%, E-value=8e-21, Identity=94%"; Hit description =Nodulin
MYRVANASEYLVITGVGITDIKLAKKAWVLSGHSCTVFDLSPVNYTFEVQAMRLRCLRLWWQRPIPQQSRVLSMKPSQRLVFWTNGGIKEVAGVYKMLPLLFKAVHEQTVCPLDVAYFVKNAEGHGYKI

SEQ ID NO: 164508 - protein, 127 aa, Glycine max
  Coding DNA Sequence Number=SeqID_47730
MAGTPSRLEDCDHQDMAITHYCGCFRVFYARYESCREQQETLKVHRNWLQKKLKRVVKALSEILVWPKKSFSLQRLSTCISEVKDKKRKMQFQYDPKSYALNFDDGSIEEDDGVFLGFSARYALHVH

SEQ ID NO: 164509 - protein, 695 aa, Glycine max
  Coding DNA Sequence Number=SeqID_47731
  Gene Ontology: Mol. function=phosphoric diester hydrolase activity; Cellular component=nucleus; Biological process=DNA repair
  Homolog annotation: Hit_ID=Q1T567; Match level="QueryCoverage=90%, HitCoverage=99%, E-value=0.0, Identity=67%"; Hit description =Forkhead-associated; Tyrosyl-DNA phosphodiesterase
  Pfam annotation: Domain name=FHA; Domain location=91-158; Score=23.5; E_value=0.00077; Accession=PF00498.16; Description=FHA domain
  Pfam annotation: Domain name=Tyr-DNA_phospho; Domain location=233 -641; Score=547.6; E_value=1.3e-161; Accession=PF06087.3; Description= Tyrosyl-DNA phosphodiesterase
  Pfam module annotation: Pfam domain module=FHA::Tyr-DNA_phospho; Domain location=91-158::233-641
MRGRIEGRRDWTHWEEEDVRMGKEERSVEGVGKREKGRRKRFRVIVSVLARKKFDSSFMSLSPQVGYLVPLNRNFKEEASVPKFAVSDGINVIGRNNIPVPDKRLSRKHLTLTASPNGSASLLVEGTNPIVVNSGNKRRKLNPKEEATICNGDIIELIPGHHLFKYQVLGGDGKSSTCRNNEAQSSFKNKASGRSSQDKVETSSQKQGRNADARKSSGEDNSVEAIRNFHVPSDQIPSTFRLLHVQGLPPWANTSCVSIGDVIQGDIKVAILSNYMVDIDWLVPACPALSKVPHVLVIHGESDGRVDYIKRSKPANWILHKPSLPISFGTHHSKAMMLIYPQGVRVIVHTANLIYVDWNNKSQGLWMQDFPWKDQNSLSKGSGFENDLVEYLSVLKWPEFSVNLPFLGSVSICPSFFRKFDYSDARVRLIASVPGYHSGSSLKKWGHMKLRSLLQECTFDEEFKKSPLVYQFSSLGSLDEKWMTELASSMSAGLSEDKTPLGMGEPQIIWPTVEDVRCSLEGYAAGNAVPSPLKNVEKTFLKKYWAKWKADHTGRCWFLLTSANLSKAAWGALQKNNTQLMIRSYELKPKNWDKCPARESSEMKKTKLVTLTGIKKESMHSSSEVIIPLPLPYELPPLPYSSQGRDLSLTFFLVCLSGMTLVTCLLILFPSADIPWSWDRQYNKKDVYGHVWPRM

SEQ ID NO: 164510 - protein, 641 aa, Glycine max
  Coding DNA Sequence Number=SeqID_47732
  Gene Ontology: Mol. function=RNA-directed DNA polymerase activity; Biological process=RNA-dependent DNA replication
  Homolog annotation: Hit_ID=O04136; Match level="QueryCoverage=24%, HitCoverage=37%, E-value=2e-80, Identity=91%"; Hit description =Homeobox protein knotted-1-like 3
  Pfam annotation: Domain name=ELK; Domain location=64-85; Score=33.7; E_value=6.2e-07; Accession=PF03789.4; Description=ELK domain
  Pfam annotation: Domain name=Homeobox; Domain location=86-143; Score=- 11.0; E_value=0.07; Accession=PF00046.19; Description=Homeobox domain
  Pfam module annotation: Pfam domain module=ELK::Homeobox; Domain location=64-85::86-143
MVHDLTGVSPGEGTGATMSDEEDEQVDSDANLFDGALDGPDSMGFGPLIPTENERSLMERVRHELKHELKQGYKEKIVDIREEILRKRRAGKLPGDTTSVLKAWWQSHSKWPYPTEEDKARLVQETGLQLKQINNWFINQRKRNWHSNPSTSTALKSKRKSAWLIVGDFNEIISPFEEKHSTWGHCGKRLDRCLANSDWRLHFPNAVVELLQPHKFDHNPLLLAQEIAHFMHKRKTGKKGYILFKINFEKAYDNVNWDFMRLTLIKFGFPPPIVTLIMNCTTTTSLSFKWNALLIQEKVHEHKWLPIQLVKEVLDQFCLASGLKGRVTNANFSHILDRVNSRLAGLKSKLLCRTRRVTLAHKSSTHWVNLDTITRCRKLGGLGISAKYLPGESILNVESKDGASYTWQSIMKAVHELKSGFKWIMDSHLCAKDFYDNGEWCWDKSATYVPIAEDVVIWGENYSGSYTSEFAYWLLVDDYPTDIANLRTWPWVWRARVPENVKHFGWLLAHENLPTYSFLLLFDDLPTDFFNLNADDWIFHIISAPNAQNLLIACWFIWLSRNAEIFRDKVWPAWLVVNKYKSLMALVQYTQVSDTSSSSPRLGNPGASGFGDLIRDWVLLSLVSLATVGIRRAFMPSCPVP

SEQ ID NO: 164511 - protein, 55 aa, Glycine max
  Coding DNA Sequence Number=SeqID_47733
  Subcellular localization annotation: CTP_CleavageSite=46; ConfidenceScore=5.12e-01
MAAVCIWLVGGSVPSFGTVPLPVTPFTISVTFVQLLCVWCQVGRRRAAGLWNWEY

SEQ ID NO: 164512 - protein, 231 aa, Glycine max
  Coding DNA Sequence Number=SeqID_47734
  Homolog annotation: Hit_ID=Q8L8M8; Match level="QueryCoverage=54%, HitCoverage=57%, E-value=2e-39, Identity=63%"; Hit description =Serine-rich protein
  Subcellular localization annotation: CTP_CleavageSite=77; ConfidenceScore=5.90e-01
MASSSSRTKSSGPVLRSLSPSSRFCSYTTSKTPFSSPSSAFASSTSSGFSSSTFFNQPRQHHSQSHHSHHRAASPTRVNLYSPAPLSSGVRFSIDPRSISPNRSISNQIITTKNNRPISGQKKTCMCSPTMHPGSFRCSLHKNIGNNNHHSDSYPSNRLNMRRSAMKNSLVRIGGVEGEWVKRALTALIRPSSHQQRRRAGLFLILLVYIPYHPWRPDLPPELDSGEAVGR

SEQ ID NO: 164513 - protein, 334 aa, Glycine max
  Coding DNA Sequence Number=SeqID_47735
  Gene Ontology: Mol. function=calcium ion binding; Cellular component =intracellular; Biological process=defense response
  Homolog annotation: Hit_ID=Q1SH11; Match level="QueryCoverage=54%, HitCoverage=47%, E-value=2e-51, Identity=49%"; Hit description =Calcium-binding EF-hand
  Pfam annotation: Domain name=efhand; Domain location=273-301; Score =22.5; E_value=0.0015; Accession=PF00036.22; Description=EF hand
AIYMIIGKGDSVRVWQHSWIPNTADGRIHVDQHFQSDSNLLASDLINQFSSFKGLMVDTKCTRCGEKEENVVHALLLCEEVSRIWFASNLGGRIQVSEDDSFAIWLYDCMKIGDWDFWGGFVNCLGSHGLQGSNGLFTREIDKEEFKKVMQSMRSHTRQGVQHRDGRRTGLRANASVENGGLMEYLFGKDGNGRLTHDKFVRFIRDLHDEIVRLEFAHYDYKSRKTIPAKDFAHSIVASADLSHLGRLLERVDELSNDPRFRDVCGLSLSDNVVEIVFHLFDANEDGNLSTEEFVSVLQHRERDIAQPVETGIMGFLSCCWKCKDTSPSSRLLS

SEQ ID NO: 164514 - protein, 133 aa, Glycine max
  Coding DNA Sequence Number=SeqID_47736
MTLEVWLKIVGLFSKGVTANLLGLKEARIAFNKVKKYKSMMKNPSTYVVVTKAKGNEHFAIVPLMLKHRLLAYVVALIITPRYLITLKLIPKKRSLTKVLKQMGTSSLKKRELDGLRRAKRIKQNNKMQKRSL

SEQ ID NO: 164515 - protein, 561 aa, Glycine max
  Coding DNA Sequence Number=SeqID_47737
  Gene Ontology: Mol. function=protein binding; Cellular component =membrane; Biological process=primary shoot apical meristem specification
  Homolog annotation: Hit_ID=Q1S365; Match level="QueryCoverage=99%, HitCoverage=49%, E-value=1e-175, Identity=55%"; Hit description =Lissencephaly type-1-like homology motif; CTLH, C-terminal to LisH motif; WD40-like; ...
  Homolog annotation: Hit description=Quinonprotein alcohol dehydrogenase-like
  Pfam annotation: Domain name=WD40; Domain location=120-160; Score =21.4; E_value=0.0032; Accession=PF00400.22; Description=WD domain, G- beta repeat
  Pfam annotation: Domain name=WD40; Domain location=210-249; Score =0.7; E_value=30; Accession=PF00400.22; Description=WD domain, G-beta repeat
  Pfam annotation: Domain name=WD40; Domain location=31-68; Score=0.3; E_value=34; Accession=PF00400.22; Description=WD domain, G-beta repeat
  Pfam annotation: Domain name=WD40; Domain location=445-481; Score =5.6; E_value=8.2; Accession=PF00400.22; Description=WD domain, G -beta repeat
  Pfam annotation: Domain name=WD40; Domain location=485-524; Score =4.5; E_value=11; Accession=PF00400.22; Description=WD domain, G-beta repeat
  Pfam annotation: Domain name=WD40; Domain location=528-561; Score =0.5; E_value=32; Accession=PF00400.22; Description=WD domain, G-beta repeat
  Pfam annotation: Domain name=WD40; Domain location=76-116; Score =31.4; E_value=3.2e-06; Accession=PF00400.22; Description=WD domain, G-beta repeat
  Pfam module annotation: Pfam domain module=WD40::WD40::WD40::WD40::WD4 0::WD40::WD40; Domain location=120-160::210-249::31-68::445-481::485 -524::528-561::76-116
MSIGLWDVNSGEKLFSENYRIWGIGASSINFKEAQEKDFRVSVKKIKWSPDGSLFGVAFSKHFVQLYSYHHGNDIISQHLQIDAHDGSVNDLAFSSLNKQLLVITCGDDKKIKVWDAVSGVRCYTFEGHDAPVCSICPHVKQHVDFIFSTSTDGKIKAWLYDSLGARVDFDAPGYGYTTLAYSADDNRLFSCGTGKDGEPYLVEWDESEGYIKRTYKGLKKPCFSAIHFDSTQKGLLAAGDGHKVKFWNMDSVELWTSTDVDAELLENPCIRFNKKGTLLAVAAKGNKIKILAIDDILQKQNETHSIHVPNNQHEALKCTQSPILVDAGAGVAGEGIVMNGYQKGLEDGRYNSIEESHNNSKFWNVSEICEPSQCQFLQLPVHPKINKIVRLTYTNAGNGILALTSNGDHLLWKWPRDNLNLDGKATAQVSPHIWQSRSGLQLMSNKLTSSYSGVPVSCFSLSKNDSYLMSTSGGAISLFNMLTFKTVTTIMTPPPMATCLTFYPRDNNILAVGMDNYSIIIYNVRTNKIISKLEGHSKRVTALAFSSSFDLLVSGDINAQ

SEQ ID NO: 164516 - protein, 187 aa, Glycine max
  Coding DNA Sequence Number=SeqID_47738
  Gene Ontology: Mol. function=protein binding; Biological process =multicellular organismal development
  Homolog annotation: Hit_ID=Q10NY2; Match level="QueryCoverage=93%, HitCoverage=15%, E-value=5e-61, Identity=65%"; Hit description =Expressed protein
  Pfam annotation: Domain name=LisH; Domain location=8-34; Score=28.1; E_value=3.1e-05; Accession=PF08513.1; Description=LisH
MEKSILNKELVFLILQFLDEEGLKETAHKLERESGIYFDMKYFEDMLLAGKWDDSERYLSGFTRVDDNRHSTKVYFEIRKQKFLEALDMDDRAKALDILIKDLKVFSSGHEELFNEMTQLLIINNIREHASLSTYGDTNSVRKIVADDIKKVIEANPVFHGKLKCPVFKSQRLRYLLNQRFHSLFPI

SEQ ID NO: 164517 - protein, 241 aa, Glycine max
  Coding DNA Sequence Number=SeqID_47739
  Gene Ontology: Mol. function=catalytic activity; Cellular component =nucleus; Biological process=metabolic process
  Homolog annotation: Hit_ID=Q47NZ8; Match level="QueryCoverage=94%, HitCoverage=59%, E-value=5e-45, Identity=43%"; Hit description =Mandelate racemase/muconate lactonizing enzyme family
  Pfam annotation: Domain name=MR_MLE; Domain location=9-89; Score =34.1; E_value=5e-07; Accession=PF01188.11; Description=Mandelate racemase  muconate lactonizing enzyme, C-terminal domain
MVKVAPTEPVRFIDSEQTMRRLVTELEELRAAVGDAVDIAVDLHGRFSVPQSRRFLDRTEHLGLAFVEEPLRPEHSALIGDLVRGTSTPIATGERLYSRTEFEPVFRAGIAIAQPDVSHAGGISEVLRIGATAEVHDVQLAPHCPLGLVAFAACVQVDAALPNTAVQESMIDFSGLLDDDEHAYVRNRHEWMPVDGYLRVPTGPGLGLDIDEELVRARATEVAPSVALWWSDPRDGSYVEW

SEQ ID NO: 164518 - protein, 99 aa, Glycine max
  Coding DNA Sequence Number=SeqID_47740
  Gene Ontology: Mol. function=RNA-directed DNA polymerase activity; Cellular component=intracellular; Biological process=RNA-dependent DNA replication
MPGLSSDIVQHRLPLNPECSPVKQKLRRMKPETSLKIKEEVKKQFDAGFLAVAQYPEWVANIVPVPKKDGKVLRLQSDKNGTRGYGKDYLRQPVGNVLL

SEQ ID NO: 164519 - protein, 134 aa, Glycine max
  Coding DNA Sequence Number=SeqID_47741
  Homolog annotation: Hit_ID=Q8PH77; Match level="QueryCoverage=98%, HitCoverage=92%, E-value=1e-49, Identity=74%"; Hit description =Fimbrial assembly protein
  Pfam annotation: Domain name=PilP; Domain location=24-131; Score =56.6; E_value=8.4e-14; Accession=PF04351.3; Description=Pilus assembly protein, PilQ
MAAVVLMLAACGRDVTSTPGDAPNLEKWVEGERARPAQPLEPLPVMQQFETFEYSAQGLRDPFTDAWTNPQQGNGGLRPDPNRRKEPLEGFPLDALDMVERRAGHGGLRGPRGADRTGAGWRGRLAGTAGNALA

SEQ ID NO: 164520 - protein, 140 aa, Glycine max
  Coding DNA Sequence Number=SeqID_47742
MIMRSQDIYSSQDEATTSPSSSESEEAKGEESSEEIYPQEEGQPLMVKEECKEVSVSSKRLVKKESHFEIMTNIKETSPLRQPPHLGVPTDPKRIKVIPDWPTPPSVEGRSPEYEKPRDLRSNPFQGGGDDVILPPKGIG

SEQ ID NO: 164521 - protein, 137 aa, Glycine max
  Coding DNA Sequence Number=SeqID_47743
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSGRIKATRAESQWIVAARPLCHLQYPVAY

SEQ ID NO: 164522 - protein, 182 aa, Glycine max
  Coding DNA Sequence Number=SeqID_47744
  Gene Ontology: Mol. function=nucleic acid binding; Cellular component= membrane; Biological process=intracellular protein transport
  Homolog annotation: Hit_ID=Q7W4C3; Match level="QueryCoverage=98%, HitCoverage=19%, E-value=9e-78, Identity=78%"; Hit description =Preprotein translocase secA subunit
  Pfam annotation: Domain name=SEC-C; Domain location=162-182; Score =50.3; E_value=6.5e-12; Accession=PF02810.6; Description=SEC-C motif
  Pfam annotation: Domain name=SecA_SW; Domain location=2-109; Score =55.1; E_value=5.4e-14; Accession=PF07516.3; Description=SecA Wing and Scaffold domain
  Pfam module annotation: Pfam domain module=SEC-C::SecA_SW; Domain location=162-182::2-109
MLEKEAFLTDEDLRERVVAAARDVYQAKVDQVGTESWSQFERSIMLQAIDTHWREHLSALDYLRQGIHLRGYAQKNPKQEYKREAFELFSGMLDRIRDDVVRVLMTVRVQSSEQVEQAEAEAAQSHVQNVQYHHSDYDEALAQSADDTGAQPVRNALPKVGRNDPCPCGSGKKYKQCHGKLV

SEQ ID NO: 164523 - protein, 176 aa, Glycine max
  Coding DNA Sequence Number=SeqID_47745
  Homolog annotation: Hit_ID=Q6CQF2; Match level="QueryCoverage=41%, HitCoverage=91%, E-value=6e-18, Identity=63%"; Hit description =Kluyveromyces lactis strain NRRL Y-1140 chromosome D of strain NRRL Y- 1140 of Kluyveromyces lactis
MAHLELSNSMARLNRAAAPSYLFKSFAPIPKSDERFARQYRCGPPPEFPLASPRSGIVHHLSGPDRYALTRTLHRRSGSVGGATHRGIPPISFLAPYGPTPGARRCRGTPRARAAIHNRDDDVSTSISTARAWATIAIRVGQCPESIGGPALTVPHPTGTHRRPPSASLPTISSTL

SEQ ID NO: 164524 - protein, 93 aa, Glycine max
  Coding DNA Sequence Number=SeqID_47746
  Subcellular localization annotation: CTP_CleavageSite=41; ConfidenceScore=5.66e-01
MAESSKKRKGSFFTTTTTGHRRQGTSGNPPAPVPPSLSSLRSSTLFSLDDQRQSQGVPFEGTLVDDWKFDYSSHDARRIVCNDRHITYWVINF

SEQ ID NO: 164525 - protein, 164 aa, Glycine max
  Coding DNA Sequence Number=SeqID_47747
MPPTRHHLDPDKSNRALGFPALITGLCQSFGVPVTPSKVIRPPITRAFIEKYCTPRQAQGDAPQAADAPPPPCQTDPAESFGMEQYLQHLVHQQAANHRGQSQGFTLFACPTPDQFRAEVAWPGDWPEAQAGEALTEAPGDADEARMDEEMTDLLDFLGGSRAT

SEQ ID NO: 164526 - protein, 45 aa, Glycine max
  Coding DNA Sequence Number=SeqID_47748
MASMGQQTHRRHLQSPSAHLQRLERCLRPVADQQATKSKAKVGHT

SEQ ID NO: 164527 - protein, 114 aa, Glycine max
  Coding DNA Sequence Number=SeqID_47749
  Gene Ontology: Cellular component=fimbrium; Biological process=cell adhesion
  Homolog annotation: Hit_ID=Q474G4; Match level="QueryCoverage=45%, HitCoverage=29%, E-value=6e-11, Identity=64%"; Hit description =Fimbrial protein
VDGERGTARNGTGGGQGVLGHGRQVDGEVLAARGRDGAGLVGHLAVEGDGAVGGVGGQRSGGQHQSGDDIDLVHSLLPNPTEEMRSRGGSKEHCRAIKTHPCVSPVAGLGHTFP

SEQ ID NO: 164528 - protein, 55 aa, Glycine max
  Coding DNA Sequence Number=SeqID_47750
  Subcellular localization annotation: CTP_CleavageSite=32; ConfidenceScore=5.13e-01
MAFQTARERSANINPPRTAPGSNTPQPLPSALCSMVPPLTMELPKVINCAPVNNI

SEQ ID NO: 164529 - protein, 109 aa, Glycine max
  Coding DNA Sequence Number=SeqID_47751
  Gene Ontology: Mol. function=DNA binding; Biological process =regulation of transcription
  Homolog annotation: Hit_ID=Q8LFS2; Match level="QueryCoverage=71%, HitCoverage=21%, E-value=4e-22, Identity=62%"; Hit description =Regulatory protein
MNTIVIITVFSRMRNCSQSHRNTTDTDNMWLRDPFKIFYKDTDFQIACDVFNGNSSDLNNFPNGGFKYVKSNKRTIWFYKFWFKSRNVYPGLHEKSVLNNIKINAPLSF

SEQ ID NO: 164530 - protein, 92 aa, Glycine max
  Coding DNA Sequence Number=SeqID_47752
MIKGAEFVYARLPPNLLFPNDKGRRICICAFTTRLAKFECQRAQNLSLRVYHSTRCSRIIKGAEFVYARLSLIERADGRNLSPHVIEPAASG

SEQ ID NO: 164531 - protein, 148 aa, Glycine max
  Coding DNA Sequence Number=SeqID_47753
  Homolog annotation: Hit_ID=Q1S0F5; Match level="QueryCoverage=65%, HitCoverage=24%, E-value=5e-08, Identity=47%"; Hit description=IMP dehydrogenase/GMP reductase
MEGLVDLAVIDAFLAFHHGKESPVVAILAKYDTFNRRCEKSDTRIFFVVHWLSMCGWFHTLFSKKVGLSIRYKEGRIRILSSCEGCPNVPLMGTRGCINYNPVLAIRQLGYPMRGVPSDESITPFIARGFSDHNARVLQGVRKAWDAA

SEQ ID NO: 164532 - protein, 105 aa, Glycine max
  Coding DNA Sequence Number=SeqID_47754
MEQKETTGEIQQSDLIPIYLEINATCRRHNQERIKIFLQDLEAATIPEEEPQSSEASSSLPIARHSHLDHIEDHIMAEEPRRVTLEDYSSSNVPQFFTSIAQPEV

SEQ ID NO: 164533 - protein, 52 aa, Glycine max
  Coding DNA Sequence Number=SeqID_47755
MGLMAKDYESGEEANKDVFLIRLVSYPNFVRGPLLDDMRPFFGPCEVLGTHH

SEQ ID NO: 164534 - protein, 54 aa, Glycine max
  Coding DNA Sequence Number=SeqID_47756
MTGLPMILLSESDLTNPLCSVSCYVLLSAPGWFFTDMVDDYEEPHARGHRNTML

SEQ ID NO: 164535 - protein, 106 aa, Glycine max
  Coding DNA Sequence Number=SeqID_47757
MVQLSAHHCAKPNIFTISYTLSNGLNVDDALSATPSLCKFIKVALSVPSCAKPQIYSVVALSLNHSLLSAYCRKIFGVAESAKRRYRAKPQMLTGVYNFKLGLARG

SEQ ID NO: 164536 - protein, 105 aa, Glycine max
  Coding DNA Sequence Number=SeqID_47758
  Subcellular localization annotation: CTP_CleavageSite=35; ConfidenceScore=5.45e-01
MSLLSQYQPFSLPTTQSTTKLVAAHPIPNTTLNTNQNTNRGRNFPEKKPIEFTAILVSYADLLPYLLDNSMVAITPAVVPQPPFFRGYNSNATCAYHGGVLGHSI

SEQ ID NO: 164537 - protein, 150 aa, Glycine max
  Coding DNA Sequence Number=SeqID_47759
MVTMGLVWPWTGPAASATLAPYLVGIVVQFAFEQYARYRKSPSWSAIPLIFQQMLVVNMLVRGIQTHDLSLSLSSFNHQVYRLHQLNRAAQLVTALSFTVRGAEMTSHNMAINSSLGTLLNVLQFLGVICIWSLSSFLMRFIPYASTTKQ

SEQ ID NO: 164538 - protein, 61 aa, Glycine max
  Coding DNA Sequence Number=SeqID_47760
MPSSVPPFHVQRLLFLLLLSNAPELPRTVEVPLLNLKIRKLILLHLFKLLRENVFATIGLR

SEQ ID NO: 164539 - protein, 116 aa, Glycine max
  Coding DNA Sequence Number=SeqID_47761
MVSQKWLEILLPLITSISKCEIISNILLPLRPEPSHFIYLAQLATETLYEQLCKNHLWPLEIYVGIRLAFQGCGNISWKKKKNLGREGEQVKTAKFEYFTNKNITESKLEQYAIFS

SEQ ID NO: 164540 - protein, 76 aa, Glycine max
  Coding DNA Sequence Number=SeqID_47762
MAPTLKEGKVQNLWIKQNLKEKTKERKEGTVSKNDSAVWVREGIEMVEGWVGVKGDCKCRTLTQEDERIYDMILKD

SEQ ID NO: 164541 - protein, 135 aa, Glycine max
  Coding DNA Sequence Number=SeqID_47763
RCGDGDIVKDGVDYDVGKVLLLVEREAELVVVVVAEDFADLVVEGSGGGGDGGDTSFLACKPSNLPMDPNLKLNLHDGDILLDPSVYKRTRLIFPAHNSLKFTVFADADWASYVDTKRSASSLCAFREQPSLLEF

SEQ ID NO: 164542 - protein, 497 aa, Glycine max
  Coding DNA Sequence Number=SeqID_47764
  Gene Ontology: Mol. function=protein serine/threonine kinase activity; Biological process=multicellular organismal development
  Homolog annotation: Hit_ID=Q6T2Z9; Match level="QueryCoverage=39%, HitCoverage=73%, E-value=2e-90, Identity=74%"; Hit description=CDK -activating kinase
MKTKSYSFDTDKDTNIYNGNTSYLVTCTTSDIDDDLCKAAELLYGSTYYGLEIDLWSLGCVFAELLTSKPLFPGTSDVDQLSRAVSVLGNINEETWPGCSKLSDYGSISFGNVENPSGLEPCMPNCYPNEVSLVQKRPTTMELLQDKYFREEHLPVPISQLRVPLTRNGQDQDSPGGHNEMGSDYDLEEFSTLNITTTSVKGDKVFAKSDGHSDNHKSDGKNHKSTNMPSDLTSAGDHGLDKKKQEAAIAAGNGSDDFYDGIPWFNDSFPHKSRSVKSRHVMVKASIFETLGVTSLSGKFSPVPAFQKGSESGYLDKKNLDTCGPESESESHPVSKMKSSKDINPYCEVIRTHERNNFPVSKDNKNSLDQSKQYDVIDNCSDHHFFHEGEKIDMISYKERGVTLGATYAAGFAIGIWKEAYLFNTKDKFRHGYKTFIYPSMYDHPIIGYFISSEQVDEGGVGGEEGVDGVLKGATVGEELSCTLLWSCCKAESTARV

SEQ ID NO: 164543 - protein, 58 aa, Glycine max
  Coding DNA Sequence Number=SeqID_47765
MQGHRFKEWGFDKGWGNIAGRVVYILDQVRALEEELLHKIELQVLHVKPQILVCRERL

SEQ ID NO: 164544 - protein, 324 aa, Glycine max
  Coding DNA Sequence Number=SeqID_47766
  Homolog annotation: Hit_ID=Q93X76; Match level="QueryCoverage=74%, HitCoverage=54%, E-value=1e-70, Identity=55%"; Hit description =Putative carboxyl-terminal proteinase
  Pfam annotation: Domain name=DUF239; Domain location=216-324; Score= -10.2; E_value=6.7e-08; Accession=PF03080.5; Description=Arabidopsis proteins of unknown function
  Subcellular localization annotation: CTP_CleavageSite=86; ConfidenceScore=5.04e-01
MMMIQQPNNDDDVVPEHTCAQQQQQEQQNQSPKLAASSTSQNATPVLPAFVALLLLVTSIAPAALCHPLQGSNHTFRPNHELLKLRRSPDGDLIDCVLSHQQHAFDHPKLRGHIVLDPPERPKGNHTNGEAERVIESFQLWSDSGEACPEGTVPIRRTTEEDILRASSIQRFGRKPRPVRRDSTGSGHEFEFQKQQGTDSERTSLHAVVFVNGDQYYGAKASINVWAPRVTDEFEFSLSQMWVIAGSFGKDLNTIEAGKSTTIWRQLSKVLHLLDCFIQINNRIAIGAAISPRSAFNRRQFDIGLMIWKVLRSSKITCSHFSIM

SEQ ID NO: 164545 - protein, 54 aa, Glycine max
  Coding DNA Sequence Number=SeqID_47767
MTGLPMILLSESDLTNPWCGVSCYVLLSAPGWFFTDMVDDYEEPHARGHGNTTL

SEQ ID NO: 164546 - protein, 135 aa, Glycine max
  Coding DNA Sequence Number=SeqID_47768
MAEMGKLDYLEERLRAIEGGKDYAFANLEALFLVPNIITPPKFKVPDFDKYKGTTCPKNHLEMYCWKMGAYTKDEKLLIHLFQESLTGVAVTCISTILIWLWIGCNYRTCAKRGMNLSKNTPKGGETWQLKWHLQ

SEQ ID NO: 164547 - protein, 522 aa, Glycine max
  Coding DNA Sequence Number=SeqID_47769
  Gene Ontology: Mol. function=receptor activity; Cellular component =nucleus; Biological process=multicellular organismal development
  Homolog annotation: Hit_ID=Q1SKE4; Match level="QueryCoverage=93%, HitCoverage=98%, E-value=0.0, Identity=71%"; Hit description =Transcription factor jumonji, jmjC
  Pfam annotation: Domain name=JmjC; Domain location=212-318; Score =63.6; E_value=6.5e-16; Accession=PF02373.13; Description=JmjC domain
MFSSSSSFFVVFSGQNQKQKQVVKCERGMSMGPINIKGEIERVNGKELSYSEFVKRYMEKNQPVVLTGLMDPHYWRSSTDWVTLQGQPNFQYFSTHFGASKVQVADCDTREFTDQKREEMMVSDFIARCLQLEEASAVQCYNENSSSNGPSISVPYLKDWHFVKEYPEYVAYVTPMFFCDDWLNLYLDNFRIHIDSDTQQPDKEICCSDYRFVYMGVKGSWTPLHADVFRSYSWSGNVCGKKRWLFLDPSQCHLVFDRNMKNCVYNIFDEVSNSKFPGFSEAIWLECTQNAGEIIFVPSGWYHQVHNLEDTISINHNWFNAYNLSWVWNLLLRDYNEAKEYIEDIKDICDDFEGLCQRNLAANTGMNFYDFFTFISYFALANLVLLRYMNRRYGNGTGSSSTISQHFSMNLGCLRKIASEMKSMHALEGNHDYVVDMIEAFEDPRFSKLCMHVGRTYIMIQEQSYLSLDFECTSMCDLVDLNDMKSYTSQIYTPEDLIKFIDNGVAELGDCFIEEQPILHVA

SEQ ID NO: 164548 - protein, 184 aa, Glycine max
  Coding DNA Sequence Number=SeqID_47770
MAINFCNFKSVDLLFGDSKNDIEENYGVVEDDAQNFDFSNGDNYSEEDGDNDFEDGCDDLEDEIVWENKDPDNLNSADDIDIGNLMHDVIDKLDYVDLETAYMFCTWYSRIVNFSIQKIHVEKIIEVRLQVVESAKQEMALGVSVVRQHRNSLKRDNREIKLEVLENYLKELTDLYKSIMDKIG

SEQ ID NO: 164549 - protein, 171 aa, Glycine max
  Coding DNA Sequence Number=SeqID_47771
MNFVAKKPIDFTLISVSYADLLPYPLGNSTVAITPTKFSQLPFFPGYDLNATCAYHEGVPGHSIEHCRALKHKDSTHDSIERLTSSSAPFANRGQQARLHAEIYIIFRADNLCQALTSEVRGQAEISKWTQHMIACRDKHRLLRPLSIAANKAVDTRGFTTSSMQTTSVKH

SEQ ID NO: 164550 - protein, 814 aa, Glycine max
  Coding DNA Sequence Number=SeqID_47772
  Gene Ontology: Mol. function=nucleoside-triphosphatase activity; Cellular component=nucleus; Biological process=protein transport
  Homolog annotation: Hit_ID=Q9LZF6; Match level="QueryCoverage=99%, HitCoverage=99%, E-value=0.0, Identity=84%"; Hit description=Cell division control protein 48 homolog E
  Pfam annotation: Domain name=AAA; Domain location=252-436; Score =330.9; E_value=2.2e-96; Accession=PF00004.19; Description=ATPase family associated with various cellular activities (AAA)
  Pfam annotation: Domain name=AAA; Domain location=525-712; Score =342.5; E_value=6.9e-100; Accession=PF00004.19; Description=ATPase family associated with various cellular activities (AAA)
  Pfam annotation: Domain name=AAA_2; Domain location=248-377; Score= -29.3; E_value=0.0015; Accession=PF07724.4; Description=ATPase family associated with various
  Pfam annotation: Domain name=AAA_5; Domain location=252-384; Score =12.5; E_value=0.0002; Accession=PF07728.4; Description=ATPase family associated with various
  Pfam annotation: Domain name=Arch_ATPase; Domain location=229-394; Score=-91.8; E_value=0.029; Accession=PF01637.9; Description =Archaeal ATPase
  Pfam annotation: Domain name=CDC48_N; Domain location=35-121; Score =136.8; E_value=5.8e-38; Accession=PF02359.8; Description=Cell division protein 48 (CDC48), N-t
  Pfam annotation: Domain name=NACHT; Domain location=524-676; Score= -40.9; E_value=0.09; Accession=PF05729.3; Description=NACHT domain
  Pfam annotation: Domain name=ResIII; Domain location=233-364; Score= -34.3; E_value=0.035; Accession=PF04851.6; Description=Type III restriction enzyme, res subunit
  Pfam annotation: Domain name=Sigma54_activat; Domain location=218 -380; Score=-182.3; E_value=0.024; Accession=PF00158.16; Description =Sigma-54 interaction domain
  Pfam module annotation: Pfam domain module=AAA::AAA::AAA_2::AAA _5::Arch_ATPase::CDC48_N::NACHT::ResIII::Sigma54_activat; Domain location=252-436::525-712::248-377::252-384::229-394::35-121::524 -676::233-364::218-380
MADPTSSNPDKDQSSTEPKSEKKDYSTAILERKKSPNRLVVDEAINDENSVVTLHPETMEKLQFFRGDTVLIKGKKRRDTICVVLADEQCDEPKIRMNKVVRANLRVRLGDVVSVHQCPDVKYGKRVHILPIDDTIEGVTGNLFDAYLKPYFMESYRPVRKGDLFLVRGGMRSIEFKLIETDPGEYCVVAPDTEIFCEGEPIKREDEERLNDVGYDDVGGVRKQMAQIRELVELPLRHPQLFKSIGVKPPKGILLYGPPGSGKTLIARAVANETGAFFFLINGPEIMSKLAGESESNLRKAFEEAEKNSPSIIFIDELDSIAPKREKTHGEVERRIVSQLLTLMDGLKTRSHVIVIGATNRPNSIDPALRRFGRFDREIDIGVPDEVGRLEVLRIHTKNMKLSDNVDLEKVARDTHGYVGADLAALCTEAALQCIREKMDVIDLEDETIDAEVLNSMAVTNEHFQTALSSSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDESSRLQIFKACLRKSPISKDVDLSALARFTHGFSGADITEICQRACKYAIREDIEKGIEKERRKRENPEAMEEDDTDEVPEIKPAHFEESMKFARRSVSDADIRKYQLFAQTLQQSRGFGSEFRFPDQNENTAAGASDPFSSVTAEGDDDLYS

SEQ ID NO: 164551 - protein, 307 aa, Glycine max
  Coding DNA Sequence Number=SeqID_47773
  Homolog annotation: Hit_ID=Q10430; Match level="QueryCoverage=36%, HitCoverage=46%, E-value=2e-08, Identity=28%"; Hit description =Kinetochore protein spc25
  Pfam annotation: Domain name=Spindle_Spc25; Domain location=165-242; Score=88.9; E_value=1.6e-23; Accession=PF08234.2; Description =Kinetochore protein Spc25
MASICDKDIPLRLHNIDAFIASYRNSLHSLRATALEAARSQSELAEVKAKLREAEDELVKALAVKTRREAKRMALKEAIVSVKGRIEDLKTSIQKQRTQNEECATVVSHHRLGHLSMPLVLCPIVLGVLMFYHFYSAQKKYFDMHMKSNESSEHRDEVQEAISWYNRILGFQIEGGRGVKFSFKNINVDNPNEEFFFTIRHEDDVYTLLNCKPSVKDTDELIHELNNTNGLFKFVRTMRKKFQEVVAQELNQLVLVKLVNYFQFNMLKLVMLQSSRLYQGKGSNLSLIHGYKLLWLPLSVMAPMVVP

SEQ ID NO: 164552 - protein, 73 aa, Glycine max
  Coding DNA Sequence Number=SeqID_47774
MVEGQNSAIETCHCSLWHHYSRPPLTNCLWQLAKIQHAVPPWRHHLTTLSKTTPEITGYEMIVYEEISVRKRQ

SEQ ID NO: 164553 - protein, 49 aa, Glycine max
  Coding DNA Sequence Number=SeqID_47775
  Homolog annotation: Hit_ID=Q1SIP0; Match level="QueryCoverage=82%, HitCoverage=13%, E-value=5e-08, Identity=73%"; Hit description =Ribose-phosphate pyrophosphokinase
MAMVKSPKKQVNLFYSLDSEDLAQNVALQSPHIVLQNIKWRLAFSPNYV

SEQ ID NO: 164554 - protein, 97 aa, Glycine max
  Coding DNA Sequence Number=SeqID_47776
MEEVVPMLQVPGHWIEDSKKIGPEMQEKALGCFTQFGVLLSPIAHKVVGPLLLDSNSSRDDTNPPFQFPMWQLTNKETKRQTITKDQKYEMKVKPIE

SEQ ID NO: 164555 - protein, 56 aa, Glycine max
  Coding DNA Sequence Number=SeqID_47777
  Gene Ontology: Mol. function=DNA binding; Biological process=DNA integration
  Homolog annotation: Hit_ID=Q2HRM7; Match level="QueryCoverage=94%, HitCoverage=8%, E-value=9e-09, Identity=57%"; Hit description =Polynucleotidyl transferase, Ribonuclease H fold
MCSNFVNVVLFAKRPNQRKFDDANHVTNLFFKEGVKLHGLPKSIVSNRNFKFLSHF

SEQ ID NO: 164556 - protein, 188 aa, Glycine max
  Coding DNA Sequence Number=SeqID_47778
  Gene Ontology: Mol. function=serine-type endopeptidase activity; Biological process=proteolysis
  Homolog annotation: Hit_ID=Q8D097; Match level="QueryCoverage=100%, HitCoverage=27%, E-value=2e-85, Identity=78%"; Hit description =Protease II
  Pfam annotation: Domain name=Peptidase_S9_N; Domain location=4-188; Score=-134.3; E_value=0.0031; Accession=PF02897.5; Description =Prolyl oligopeptidase, N-terminal beta-propeller domain
MMTPPKAEKRPYPITIHGDTRVDDYYWLRDDERADRQVLDYLQAENAYTDAMLKPQQALRETLYEEMVARIPQQEHSVPYVRHGYRYQTRYEPGNEYAISVRQPQAESERWEVLIDGNQRAENHEFYTLGGLDVSPDNQRLGVAEDFLSRRQYDIRFKNLADGSWADEVLENTSGSFEWANDSSTVYY

SEQ ID NO: 164557 - protein, 155 aa, Glycine max
  Coding DNA Sequence Number=SeqID_47779
MSDLLLPSTTPEWKRVAEVEPEPMELSKEEKDAKQKKALELDADYILYLTNRVAVYLEMGNVCFILFIGIMVILNLHFDDLVSVGWNSNNVVDNDNEGARMVGTKMVMVEAKKVERGGGNVGDYGGMVVMEATTKTMAVARARAMAVAEALAVVR

SEQ ID NO: 164558 - protein, 202 aa, Glycine max
  Coding DNA Sequence Number=SeqID_47780
MVLLPKEYSHRGTKHTLIHSQGKGSVEATRGSTYPKWFEQCKVAAVLQWDNTMILSRGAVQWDGATTSRGTMVSALYKGGCGMWDVSLWGCHWDIFDSQDGDEDDTTRKRPFYDALSTKNRRGLRVIWSREPLSLTESTSCAQSVHTNPYVHYIVASLNSPSTSLTGHRRYILRCPATSSNIFGRRSITTVIIQGQSLISPV

SEQ ID NO: 164559 - protein, 255 aa, Glycine max
  Coding DNA Sequence Number=SeqID_47781
  Gene Ontology: Mol. function=metal ion transporter activity; Cellular component=integral to membrane; Biological process=metal ion transport
  Homolog annotation: Hit_ID=O65348; Match level="QueryCoverage=100%, HitCoverage=70%, E-value=1e-88, Identity=65%"; Hit description=Root iron transporter protein
  Pfam annotation: Domain name=Zip; Domain location=44-255; Score=94.7; E_value=2.7e-25; Accession=PF02535.12; Description=ZIP Zinc transporter
MATSLTLFKTIFVFLIIFTLLTPQATADCEAESRNSCNNKKKALPLKIIAIFTILASSIIGISLPLVTRSVPALSPENNLFIIVKCFAAGIILGTGFMHVLPDSFDMLWSDCLKEKPWHEFPFSGLAAMFSAIITMMVDSLSTSIYTKKYRTTEVVPGESNRAGGGDQLEMAAVNLGHFHGHHHAHETKIEGKEAQLLRYRVVAMVLELGIIVHSVVIGLGMGASNNTCAIRGLIAAMCFHQMFEGMGLGGCILQ

SEQ ID NO: 164560 - protein, 228 aa, Glycine max
  Coding DNA Sequence Number=SeqID_47782
  Gene Ontology: Mol. function=hydrolase activity; Biological process =nucleoside metabolic process
  Homolog annotation: Hit_ID=Q1XUQ3; Match level="QueryCoverage=99%, HitCoverage=100%, E-value=4e-69, Identity=56%"; Hit description =NUDIX hydrolase
  Pfam annotation: Domain name=NUDIX; Domain location=11-140; Score =43.0; E_value=1e-09; Accession=PF00293.18; Description=NUDIX domain
MTEDYSQYPKHLVAVDCIIFGFDGENLKILLVKRNFEPQMGEWSLMGGFIGSEETSDEAANRVLYTLTGLENIYLEQLKCYTEIKREPTARIMSISYYALINIEKDIQINEQYSAEWVELQKAPDLIFDHNDMVKDAVARLRRRASTGPIGFELLPEKFTMKDLQNLYEAIFDEKFDKRNFTSKINSMDILVNTNKKDMTSSRKGSFLYRFDEKKYTKKISRGFMFKM

SEQ ID NO: 164561 - protein, 45 aa, Glycine max
  Coding DNA Sequence Number=SeqID_47783
MGRRSLTRTHSRILGCLAAAFSACPEQGKDDDLSVVTLASICVCP

SEQ ID NO: 164562 - protein, 108 aa, Glycine max
  Coding DNA Sequence Number=SeqID_47784
MVGYTPSNFVDMVFAGKRIEVGLKRGKFDHPALIKTGANEEGKDEGETHAVTAIPIWPSFPPTQQCHYSANNNPSLYPPPSYPQRPCLNQPQNPPSTQPMLNTTLSTN

SEQ ID NO: 164563 - protein, 94 aa, Glycine max
  Coding DNA Sequence Number=SeqID_47785
MHRLQKFRVEISRISQQASCGFFVAIGRPEHRSHVGVVGVGLTIKKYFGLAPRTSRMSSSMAPEDLEQLMQQIRDQLEESITEKVTQRLMLSFS

SEQ ID NO: 164564 - protein, 81 aa, Glycine max
  Coding DNA Sequence Number=SeqID_47786
  Homolog annotation: Hit_ID=Q9FHG6; Match level="QueryCoverage=58%, HitCoverage=16%, E-value=2e-09, Identity=61%"; Hit description =Arabidopsis thaliana genomic DNA, chromosome 5, P1 clone:MRI1
MERSARMDDADFGSSPAWKSNNVMSWIWMQQAMHTELNDNSCFRKKWVCCHHHADAMEAAHTTEKCRNKIKMKRKADQRCM

SEQ ID NO: 164565 - protein, 93 aa, Glycine max
  Coding DNA Sequence Number=SeqID_47787
MASTSGDATPLSSEALSVRIENIERRREDKSSNSSHGEDEGYEKDEGGRRNERYRERRNHRRYGGRQKEEGIEGVKVKIPTFKGTYDLEVYLE

SEQ ID NO: 164566 - protein, 135 aa, Glycine max
  Coding DNA Sequence Number=SeqID_47788
  Subcellular localization annotation: CTP_CleavageSite=75; ConfidenceScore=5.28e-01
MRGYLVVTHTFLQPRANEPVDAQRLTSSSAPSVVLTRESGDMRGYLMVTRTFRQPGANRPVDTQRLTSSYAPFVVLTREVRCHAGLPYGYPQVTCGVTLWLPAPFAIQGQRVRNIQARRRARFFSAGQGRSSAMA

SEQ ID NO: 164567 - protein, 150 aa, Glycine max
  Coding DNA Sequence Number=SeqID_47789
  Gene Ontology: Mol. function=aminoacyl-tRNA ligase activity; Cellular component=membrane; Biological process=lipopolysaccharide biosynthetic process
  Homolog annotation: Hit_ID=Q3K9H3; Match level="QueryCoverage=96%, HitCoverage=19%, E-value=2e-25, Identity=41%"; Hit description =Lipopolysaccharide biosynthesis
  Pfam annotation: Domain name=Wzz; Domain location=13-145; Score=69.7; E_value=9.2e-18; Accession=PF02706.6; Description=Chain length determinant protein
MTKQMDSRAVKDDEIDLRELLGALIDRKWWIVGTTAAFFIAGVAYALLARPVYQAQAMVQVESKMPSIPGLADLASLGGSGSTAATTEVALLTSRTVIGAAVDKLNMEVAIEPKRLPVFGNFFVRRFKPETDEQVAPPKFGLARYGWGGD

SEQ ID NO: 164568 - protein, 60 aa, Glycine max
  Coding DNA Sequence Number=SeqID_47790
MPLMIDFSPSRTVRDFARGRGCDVLLPECRAASLPSSEYPKPPVVASPPPDRRGLAAPPP

SEQ ID NO: 164569 - protein, 256 aa, Glycine max
  Coding DNA Sequence Number=SeqID_47791
  Subcellular localization annotation: CTP_CleavageSite=27; ConfidenceScore=5.02e-01
MKSICSATRATRPPAFHRTATFVRDMRSAAEPALLSNLIDLRASFDQQRALMMRCQGPRNLVERVAFAGILKECFNAAHQCTRAVALQRRCGCRLFGGSAKCLDDVEVQAVGDLLHERTVAQQQPGCLGPDGFHGHVSAPHYMVDPKNMRDAAHVAQVWCVTQAVRDAEQFLQKVAAVSPEQASTRVHEGVYGIATARGQAGAGQQLWNVRFQGDQDGRNAADPVADPPIVLGKEEGPSSQNLGIQPREARAEQVQ

SEQ ID NO: 164570 - protein, 212 aa, Glycine max
  Coding DNA Sequence Number=SeqID_47792
  Homolog annotation: Hit_ID=Q8KWP3; Match level="QueryCoverage=66%, HitCoverage=29%, E-value=5e-07, Identity=23%"; Hit description =Putative CPS repeating unit transporter Cps9vK
MSRTKVAVLWNAGGRVARVALQMLFILLMGRVLGPTEFGIVTLALIPFQIATTLGTRTFTQALIQNQSWMDGLHRETARASVVSGLVVFILIAACGLAFGYVNQSWDYFIIIAAMGLSAPISSMAVVAQARLSKDMAFAKISLAETIASIAAVAAGLAYLYIWRDVYAVAVYALTQRSVETLLIYTTARRRSLPAPTENATLQSTPGDIKPV

SEQ ID NO: 164571 - protein, 783 aa, Glycine max
  Coding DNA Sequence Number=SeqID_47793
  Homolog annotation: Hit_ID=Q0EV71; Match level="QueryCoverage=33%, HitCoverage=70%, E-value=6e-39, Identity=35%"; Hit description =Glycosyl transferase, group 1
  Pfam annotation: Domain name=Glycos_transf_1; Domain location=310 -482; Score=115.9; E_value=1.1e-31; Accession=PF00534.10; Description= Glycosyl transferases group 1
TSTVVIRTEAARTARYLEWLPYGQDVDFAIRVERAGYRWHMINDPGAVWNDVKSGSRISARTDPAVRLRWAEEAEPLLTKKALRGFKGWRVAKAYAEHGQTLKGLTLWLEAAVTGTYAPKHAVIVFLQVALANGWYRKVADVGSETFIADHYDALEKSGVECTFACEEAVGGSIDRFRHLKNRGAHGGKFARLMQKTLFNLAPNWSRLAVEIRALAPDVIHAHFATDAAEILPIAEKLGIPLIVTLHGFDVTSKASYFAKKLPFKWPYVLRAGRLRQRAAAFLPVSDFLRDTAISKGYPAERTHTHYLGTDLDRAPAVSSEPRKNILFVGRLVEKKGCHYLIAAFRKMVANGFEGKLLIIGSGPQMEPLMRSSEDLQERIEFLGAQDRETVLKHMSSASAFCMPSMPAKSGDNEGLGMVYLEAQLTGCPVVAFDQGPVREAVWEGDWDLLAEQGDIHSLAEKLYLAIRDDKASHHLQVMRRDAVIRTHSRLSVPIIIFTIALVYLFIQDIPFQDRGTRIDLDEGGSGSIIRQIFFIAVAAYFFLKGIVSRKISRHFFPWSIVALLLWWSITVTWATSPEISFRRLAFNAIIFIWIYSATAVIGPKRSLQTLKNVSFALVFASLISGLLIPNAIHQAGEMDSGLVGAWRGFSFKSIRLRKIFLPLLGTLGGFALLILSNSKTSIGMLLPALLIGYVCTHIAMSRSRLLGYAALILTGTAAASAAIAIFFPQISSILTTPESFTGRAGMWAILVTMIIDRPISGFGFGSVFQAGAESAISGYANW

SEQ ID NO: 164572 - protein, 164 aa, Glycine max
  Coding DNA Sequence Number=SeqID_47794
  Homolog annotation: Hit_ID=Q67VB7; Match level="QueryCoverage=72%, HitCoverage=24%, E-value=8e-07, Identity=29%"; Hit description =Ankyrin repeat protein-like
  Pfam annotation: Domain name=Ank; Domain location=136-162; Score =14.0; E_value=0.3; Accession=PF00023.20; Description=Ankyrin repeat
  Pfam annotation: Domain name=Ank; Domain location=63-95; Score=13.3; E_value=0.37; Accession=PF00023.20; Description=Ankyrin repeat
  Pfam module annotation: Pfam domain module=Ank::Ank; Domain location =136-162::63-95
MKILKNTQCSSQQGAASQRRLQHKELVGENKAITSELNEAVENGDMDSLVNVLAKVFDQVTWTGDSLLHLAANLGKEKTVELICDHFPELLLRRNVKSNTVLDAAVRSKNSTIDQVHSLQLSHREDKEITKEKNEYGNTPLHEAVYSGDVGVIKEILLADNDVV

SEQ ID NO: 164573 - protein, 112 aa, Glycine max
  Coding DNA Sequence Number=SeqID_47795
  Gene Ontology: Mol. function=nucleic acid binding; Cellular component= cytoplasm; Biological process=DNA integration
  Homolog annotation: Hit_ID=Q1RXN8; Match level="QueryCoverage=98%, HitCoverage=8%, E-value=1e-37, Identity=64%"; Hit description =Peptidase S8 and S53, subtilisin, kexin, sedolisin; Integrase, catalytic region; Zinc finger, CCHC-type
  Subcellular localization annotation: CTP_CleavageSite=31; ConfidenceScore=5.19e-01
MGIARHKSVARTPQQNGLAKRFHRTILERVRCMLSSATAPKTFWAEAMTKPCFLINRCPSTTLNMKKSKEVWSGHPLTYNRLIVFAYVTYAHIRQDKLEPRALKCMFIGYPE

SEQ ID NO: 164574 - protein, 283 aa, Glycine max
  Coding DNA Sequence Number=SeqID_47796
  Gene Ontology: Cellular component=extracellular region; Biological process=sexual reproduction
  Homolog annotation: Hit_ID=Q9M0I2; Match level="QueryCoverage=95%, HitCoverage=96%, E-value=1e-106, Identity=67%"; Hit description =Expansin-B3 precursor
  Pfam annotation: Domain name=DPBB_1; Domain location=78-158; Score =112.0; E_value=1.8e-30; Accession=PF03330.8; Description=Rare lipoprotein A (RlpA)-like double
  Pfam annotation: Domain name=Pollen_allerg_1; Domain location=186 -266; Score=118.1; E_value=2.4e-32; Accession=PF01357.11; Description= Pollen allergen
  Pfam module annotation: Pfam domain module=DPBB_1::Pollen_allerg_1; Domain location=78-158::186-266
MQLHRVSAASKLSLTCFSFALKFVLLYAAEAQLQHRGPDLHWYPGTATWYGDPEGDGSTGGACGYGTMVDVKPFRARVGAVGPLLFMKGEGCGACYKVKCLDKSICSRRAVTVIITDECPGCPSDQTHFDLSGAAFGRMAIAGENGPLRDRGQIPVIYRRIPHDLHLSLPLLLSPGTLCKYPGRKIAFHVNEGSTPFWLSLLVEFEDAEGDIGSMHIREAGSTEWLQMNHLWGANWCIIGGPLRGPFSVKLSSSTGRSLSARDVIPTNWVPKATYTSRLNFYP

SEQ ID NO: 164575 - protein, 45 aa, Glycine max
  Coding DNA Sequence Number=SeqID_47797
MGGAPSRLERNVGVADSVVAADATGRVGFYLVLHWFCGYLRKGAI

SEQ ID NO: 164576 - protein, 209 aa, Glycine max
  Coding DNA Sequence Number=SeqID_47798
  Gene Ontology: Cellular component=extracellular region; Biological process=cellulose and pectin-containing cell wall organization and biogenesis
  Homolog annotation: Hit_ID=Q9SZM1; Match level="QueryCoverage=92%, HitCoverage=81%, E-value=3e-69, Identity=61%"; Hit description =Expansin-A20 precursor
  Pfam annotation: Domain name=DPBB_1; Domain location=62-137; Score =116.1; E_value=9.9e-32; Accession=PF03330.8; Description=Rare lipoprotein A (RlpA)-like double
  Pfam annotation: Domain name=Pollen_allerg_1; Domain location=148 -209; Score=64.2; E_value=4.3e-16; Accession=PF01357.11; Description =Pollen allergen
  Pfam module annotation: Pfam domain module=DPBB_1::Pollen_allerg_1; Domain location=62-137::148-209
MGVLQYTLLYLILLQSCKIIAYKDQEWKKATATHANDTEGSLITEGACGYGDLHRASYGKHSAGLSTILFNRGSTCGACYEISPSVVVTVTDFCAPNYGLSVDYGGWCNFPREHFEMSRAAFAEIAKNKADIVPVQYRRVKCERSGGMRFTMSGSSHFYQVLISNVGLDGEVFAVKVKGSRSGWIPMARNWGQNWHCNFNFQNQPLSFE

SEQ ID NO: 164577 - protein, 50 aa, Glycine max
  Coding DNA Sequence Number=SeqID_47799
MTNANSPQESLHSVSNGNLRVSVCVIRKGVRGCVSVTRGLSVCLWVSHQG

SEQ ID NO: 164578 - protein, 100 aa, Glycine max
  Coding DNA Sequence Number=SeqID_47800
  Gene Ontology: Mol. function=[ribulose-bisphosphate carboxylase] -lysine N-methyltransferase activity; Cellular component=chloroplast
  Homolog annotation: Hit_ID=Q43088; Match level="QueryCoverage=71%, HitCoverage=14%, E-value=9e-28, Identity=80%"; Hit description =Ribulose-1,5 bisphosphate carboxylase/oxygenase large subunit N- methyltransferase, chloroplast precursor
TEVSVSPAIDTFWKWLKEEGVVSAKTPVKPSVVPEGLGLVALKDISRNEVVLQVPKRLWINPDVVAASKIGKRLFAMRRYGGGMLYAALPLHMQRGCFRI

SEQ ID NO: 164579 - protein, 210 aa, Glycine max
  Coding DNA Sequence Number=SeqID_47801
ISVLQTAKKNVYTDNHSGISARQRDSKVSMTDLVSAEDDTAKKNVYTDNHSGISARQRDSKVSMTDLVSAEDNVNLRVSTGLSAAIHEGRRRRLESLRALRLFVLQIAKKNVYTDNHSGISARQRDSKETTLVSAGYQAFRITDSKKVYTDNHSGICARQRDSKVSMKDPVSAKDDIANKNVYTDNHSGKSGCQRDSEVSMTDLVRTEDD

SEQ ID NO: 164580 - protein, 264 aa, Glycine max
  Coding DNA Sequence Number=SeqID_47802
  Gene Ontology: Mol. function=receptor activity
  Homolog annotation: Hit_ID=A0EJF3; Match level="QueryCoverage=69%, HitCoverage=27%, E-value=1e-70, Identity=70%"; Hit description=Beta -glucan-binding protein 4
  Pfam annotation: Domain name=Glyco_hydro_81; Domain location=1-264; Score=-374.6; E_value=0.068; Accession=PF03639.4; Description =Glycosyl hydrolase family 81
MNKSIDFIHESSNDKGKRLREPEKKDDFKAIGMRCGRMPALAAAANEDGDLAMLRLIVGACICMATFPLLFLIGSPYITASDSKYVETLDKFSSCYPVSGDAALKKPFSVEYKWQKKCSGDLLMLAHPLHAKLLSYDHDVTVLNDFKYRSIDGDLVGVVGDSWVLETNPIPVTWNSNKGVEKESYGEIVMALVKHVQALNSSAIGTNSSYFYGKQVGRAVRLALIAEEVSYPKVIPKVKKFLKETIEPWLDGTFKGNAFLYERK

SEQ ID NO: 164581 - protein, 343 aa, Glycine max
  Coding DNA Sequence Number=SeqID_47803
  Homolog annotation: Hit_ID=UPI000044A8F0; Match level="QueryCoverage =38%, HitCoverage=100%, E-value=3e-18, Identity=29%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTGPLNESIFCILIRVDPWVLVPSPSEGNMPSPSEDYTSSPSEGYTLSPSENYTSSPSEGCTPSPSKDYMSSPLEDCTSSPSEDYTSSPSEGYTLSPLEDYTSSPSEGYTPSPSEDYTSSPLEGCTPSPSEDYTPSPLEEREAIAQLLCISGQDFTQPLQGDECGSCIPPQLRSPPAEVLVGLCRHDIGIAPTRHPVDPEKSNRALGFPALVLSLCQSYRVPVPPARSCHRDIRIVPIRNSVGPEKSNRVLGFPVLITNLCQFYGVPVATNKVIRPLTNRAFIRKYCVPRQAQGKTPQQLGDGRQWAIDAPPPPPESLSSSTKAEALPTTRGRPASDQVQSQR

SEQ ID NO: 164582 - protein, 171 aa, Glycine max
  Coding DNA Sequence Number=SeqID_47804
MHLLHATSKFVMVAFSDQHEIMEKKDKTIDDLMTLRRVKKFIAHCSGVEPKDKPLTDGYHEKIERNYNYLYCWHQAFIRPSDKNAFTPWKTRFYYQSNKQSSYFVCFPYSTFFFIVVEPAIIKIQEKFYKSMNISPLVMTMKLLWMSYGLLMMLIQSYSHKKKGLEIFFFI

SEQ ID NO: 164583 - protein, 75 aa, Glycine max
  Coding DNA Sequence Number=SeqID_47805
MVSKNRNNSTTEVSFHQQTNLAMHTKCKFHHDICCPADLNDEEELHDSKAFNDSHGIRRYGGSRQQGGVARFEGV

SEQ ID NO: 164584 - protein, 167 aa, Glycine max
  Coding DNA Sequence Number=SeqID_47806
  Gene Ontology: Mol. function=DNA-directed RNA polymerase activity; Cellular component=nucleus; Biological process=transcription
  Homolog annotation: Hit_ID=Q9C8S4; Match level="QueryCoverage=71%, HitCoverage=10%, E-value=4e-33, Identity=58%"; Hit description=DNA -directed RNA polymerase subunit, putative; 8546-1198
  Pfam annotation: Domain name=RNA_pol_Rpb2_6; Domain location=2-167; Score=-121.9; E_value=7.1e-07; Accession=PF00562.18; Description=RNA polymerase Rpb2, domain 6
  Subcellular localization annotation: CTP_CleavageSite=25; ConfidenceScore=5.11e-01
MLLRSPKSPQTQKQFPLQKSTNVTRNQQIGKELVSTEPRLTLTLQALDNTLQQKSIIYIKSQHFILTGSKCVTEQAAVNIRFRHPRNPVIGDKFSSRHGQKGVCSQLWPDVDMPFSGNTGMRPDLIINPHAFPSRMTIAMLLESVAAKLSGVAPGLLWDSKSGDSDH

SEQ ID NO: 164585 - protein, 64 aa, Glycine max
  Coding DNA Sequence Number=SeqID_47807
  Gene Ontology: Mol. function=NADH dehydrogenase (ubiquinone) activity; Cellular component=integral to membrane; Biological process=ATP synthesis coupled electron transport
  Homolog annotation: Hit_ID=A0A380; Match level="QueryCoverage=60%, HitCoverage=7%, E-value=7e-15, Identity=94%"; Hit description=NADH -plastoquinone oxidoreductase subunit 2
MYNSPGILIALLFITVGIGFKLSPAPSHQWTPDVYEGVRCYIVGSHPSETTSINRSIPSTKGSP

SEQ ID NO: 164586 - protein, 93 aa, Glycine max
  Coding DNA Sequence Number=SeqID_47808
  Homolog annotation: Hit_ID=Q9C8S4; Match level="QueryCoverage=72%, HitCoverage=6%, E-value=2e-11, Identity=48%"; Hit description=DNA -directed RNA polymerase subunit, putative; 8546-1198
EKLEDWLQKGKRLLLDEIDKKSKKFDFSDIVQVKKVMDKNSPKQVSTAVENMLKTGRLVTQTGLDLQQLTYKEMHLISYSSVFIKLPGHNRKG

SEQ ID NO: 164587 - protein, 172 aa, Glycine max
  Coding DNA Sequence Number=SeqID_47809
  Gene Ontology: Mol. function=DNA-directed RNA polymerase activity; Cellular component=nucleus; Biological process=transcription
  Homolog annotation: Hit_ID=Q9C8S4; Match level="QueryCoverage=68%, HitCoverage=10%, E-value=2e-38, Identity=61%"; Hit description=DNA -directed RNA polymerase subunit, putative; 8546-1198
  Pfam annotation: Domain name=RNA_pol_Rpb2_1; Domain location=2-165; Score=-5.9; E_value=1.1e-06; Accession=PF04563.6; Description=RNA polymerase beta subunit
MELVFVHLTWFLLWLDNPVLYPPQKERISRTMREALLPFECRQAKISYAGKITIDVCFQYNDGPIIRENINFGQFPIMLQSKLCNLRGADPQKLVSYREEASEMGGYFILNGLERVIRLLILPKRNHQPMSMVRNSFSDRREGYTDKAIIVQKIVHDEGYCLAYGDRLQDSF

SEQ ID NO: 164588 - protein, 231 aa, Glycine max
  Coding DNA Sequence Number=SeqID_47810
  Gene Ontology: Mol. function=chitin binding; Cellular component =extracellular region; Biological process=chitin metabolic process
  Homolog annotation: Hit_ID=UPI000044A8F0; Match level="QueryCoverage =68%, HitCoverage=99%, E-value=7e-19, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MGETHEIPHHNLADFEPCLGYATKGQTVGGIPLQNTLEGPQYQPALLNVDFQNRSIRDYSSCTLVRVPQTTSKAEKGLHALTVRGLHVLAFRGLHVLAFRGLHAFAFVGLDVLKFRGLHVLAFKGLYALAIRGLHVLAFKGIYALAFRRLHALALRGLLALAFKGLHVLAVRGLCVLTFRGLHVLTFRGLHPLVFKGLHAVTFRGLHVLAFRGLHVLAIRGLHALTFIGLH

SEQ ID NO: 164589 - protein, 72 aa, Glycine max
  Coding DNA Sequence Number=SeqID_47811
MTLQLADRSITRPYGVIEDVLVRVKHFIFPVDFVICLLQNNMFAYSPFAKRKPRAECIFGHALSRESQALSA

SEQ ID NO: 164590 - protein, 118 aa, Glycine max
  Coding DNA Sequence Number=SeqID_47812
  Subcellular localization annotation: CTP_CleavageSite=50; ConfidenceScore=5.15e-01
VDSRGSHLQSNSTGGTTRPVKDRSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 164591 - protein, 94 aa, Glycine max
  Coding DNA Sequence Number=SeqID_47813
MKEREWKIFRPDKFSARLPFSTGDIPPHMNKEEKTETPRFLSKNTTLEKILLVEKPSGPFGPANLFFSEPHECHCLPLFMCPPPSSLELCFMIA

SEQ ID NO: 164592 - protein, 253 aa, Glycine max
  Coding DNA Sequence Number=SeqID_47814
  Gene Ontology: Mol. function=thiol-disulfide exchange intermediate activity; Cellular component=cytoplasm; Biological process=cell redox homeostasis
  Homolog annotation: Hit_ID=Q6F385; Match level="QueryCoverage=59%, HitCoverage=80%, E-value=1e-58, Identity=70%"; Hit description =Expressed protein
  Pfam annotation: Domain name=DUF1000; Domain location=47-161; Score =172.2; E_value=1.3e-48; Accession=PF06201.4; Description=Domain of Unknown Function (DUF1000)
MSGESASAIHKGQVDLLDFIDWSGVECLNQSSTHSLPNAIKQGYREDDGLHLESDADEQLLLYIPFTQVVKLYSFVIKGPEEEGPKTVKLFSNKEHMGFSNVNDFPPSDVANLSEENLKGKPVLLKYVKFQNVRSLTIFIEDNQSGSEITKVQKIVLHGTTYTNTHTAHTSKHDKLFIIPTVKLCNQNTANGIIPQVLQTARSKDIPTPNGRGSYLLVADVLSNTRSAEPIVSGEEYADCKINWSTTTVTDCK

SEQ ID NO: 164593 - protein, 75 aa, Glycine max
  Coding DNA Sequence Number=SeqID_47815
MAFMKHQALGGEGHEPICSFLTGHTNSPSMAALKFCPPFSPNHHIGQQHTMDTLMQQLLMIPTCLGLIYMLERQQ

SEQ ID NO: 164594 - protein, 101 aa, Glycine max
  Coding DNA Sequence Number=SeqID_47816
MTLLLNNILPNDRNADLPLWKYQLGSCPQDTQWTRRSPTGQGPGVSSSSYGPLGCPFPPARDRARKTPSGPGKVQQGPRVSSSDYEPLSVLLSACRPQQGH

SEQ ID NO: 164595 - protein, 119 aa, Glycine max
  Coding DNA Sequence Number=SeqID_47817
  Gene Ontology: Mol. function=nucleoside-triphosphatase activity; Cellular component=membrane; Biological process=defense response
  Homolog annotation: Hit_ID=Q1SI25; Match level="QueryCoverage=98%, HitCoverage=12%, E-value=8e-48, Identity=80%"; Hit description=NB -ARC domain, putative
  Pfam annotation: Domain name=LRR_1; Domain location=27-49; Score=9.6; E_value=4.6; Accession=PF00560.23; Description=Leucine Rich Repeat
  Pfam annotation: Domain name=LRR_1; Domain location=4-25; Score=12.2; E_value=1.5; Accession=PF00560.23; Description=Leucine Rich Repeat
  Pfam annotation: Domain name=LRR_1; Domain location=51-73; Score=2.2; E_value=1.1e+02; Accession=PF00560.23; Description=Leucine Rich Repeat
  Pfam annotation: Domain name=LRR_1; Domain location=75-97; Score=9.7; E_value=4.3; Accession=PF00560.23; Description=Leucine Rich Repeat
  Pfam module annotation: Pfam domain module=LRR_1::LRR_1::LRR_1::LRR _1; Domain location=27-49::4-25::51-73::75-97
VMEKLKILNLSHSHYLTETPDFSNLPNLEKLLLVDCPRLSAISYTIEHLNKVLLINFQDCISLCNLPRSIYKLKSLKALILSGCLKIDKLEEDLEQMESLTTLIADKTAITRVPFSIVR

SEQ ID NO: 164596 - protein, 74 aa, Glycine max
  Coding DNA Sequence Number=SeqID_47818
MWVQAIERSELSRIGVISLNPSTEKILQLFLVLEKFFLRESNRLFHSSLLQGFENKTTMDTSEPYTGAMKRHQA

SEQ ID NO: 164597 - protein, 98 aa, Glycine max
  Coding DNA Sequence Number=SeqID_47819
  Pfam annotation: Domain name=zf-C2HC_plant; Domain location=36-90; Score=45.7; E_value=1.5e-10; Accession=PF07567.3; Description =Protein of unknown function, DUF1544
ISGIESGNGIDSSNSNIGTSTGAASRSKNAPGNRTDIGWKHETDVLGNGKKVKYNYCSKINNGGIFIFKHHLAGTRWDSEPCASVLEEVKMLMMNVVG

SEQ ID NO: 164598 - protein, 147 aa, Glycine max
  Coding DNA Sequence Number=SeqID_47820
MVRYRMHKALRANAPLPYPHLITLFLRHFQIPVDDEPFVQVKRSFAIGAGAVTSFGYRKDRNGQWLKKDALPPQDERTPSPPPQREDSALMNEVLTELRGLRSYDGERFDSLDTCFAGMDIRLTQVEEDVSFIRTCFDPPPLPPSSS

SEQ ID NO: 164599 - protein, 154 aa, Glycine max
  Coding DNA Sequence Number=SeqID_47821
MTLLLSSILPNDRNVDLPLRKYQLGSRPQDTQWTRRSPTGLWGFQLWLRAFVSPTGCPYPPARDRARRTPRGPKEVQQGSGASGSDYGPLPVLRSVCHPPARSSGLLLAELSSRSIAPPGRQRARHHNSLGMASNRQQMHRRHLQSPSAHPQKG

SEQ ID NO: 164600 - protein, 259 aa, Glycine max
  Coding DNA Sequence Number=SeqID_47822
  Gene Ontology: Mol. function=metalloendopeptidase activity; Cellular component=proteinaceous extracellular matrix; Biological process =pathogenesis
  Homolog annotation: Hit_ID=P23694; Match level="QueryCoverage=99%, HitCoverage=52%, E-value=5e-86, Identity=59%"; Hit description =Serralysin precursor
  Pfam annotation: Domain name=HemolysinCabind; Domain location=119 -136; Score=16.5; E_value=0.095; Accession=PF00353.9; Description =Hemolysin-type calcium-binding repeat
  Pfam annotation: Domain name=HemolysinCabind; Domain location=137 -154; Score=27.1; E_value=6.2e-05; Accession=PF00353.9; Description =Hemolysin-type calcium-binding repeat
  Pfam annotation: Domain name=Peptidase_M10_C; Domain location=35-259; Score=266.7; E_value=4.7e-77; Accession=PF08548.2; Description =Peptidase M10 serralysin C terminal
  Pfam module annotation: Pfam domain module=HemolysinCabind::HemolysinC abind::Peptidase_M10_C; Domain location=119-136::137-154::35-259
MRYFSEQNPGADYKGVWPSGPQLDDITAIQKLYGANTTTRTGDTTYGFNSNTDRDFLSVKASTDKIVAAIWDAGGNDTLDFSGYSQDQRININEGSFSDVGGLKANIAIAYGAQIENIIGGSGADILVGNALNNTLKGGAGNDIIYGADGADQLWGNAGADTFVFSTADDSQAAAPDWIRDFQTAVDKIDLSWLNQTVKAEGGELHFVDNLSGSLYEAALNYDSQQNVTDLAINLSGHNQPDFLVKIVGQVDASADILV

SEQ ID NO: 164601 - protein, 90 aa, Glycine max
  Coding DNA Sequence Number=SeqID_47823
  Homolog annotation: Hit_ID=Q0Z6J1; Match level="QueryCoverage=45%, HitCoverage=11%, E-value=8e-10, Identity=68%"; Hit description=2 -nitropropane dioxygenase, NPD
MISCTRCARKRRRSCPSGAERAHRRFPPGGGQGRARRVYVAVGRAGRGPGAADAGGGAGRHPGGGAGSGVTSSARFIALTVWGQCRKAQG

SEQ ID NO: 164602 - protein, 284 aa, Glycine max
  Coding DNA Sequence Number=SeqID_47824
  Gene Ontology: Mol. function=DNA binding; Cellular component=nucleus; Biological process=regulation of transcription, DNA-dependent
  Homolog annotation: Hit_ID=Q6H975; Match level="QueryCoverage=93%, HitCoverage=33%, E-value=3e-70, Identity=55%"; Hit description=STY-L protein
  Pfam annotation: Domain name=WD40; Domain location=190-228; Score =21.9; E_value=0.0023; Accession=PF00400.22; Description=WD domain, G- beta repeat
  Pfam annotation: Domain name=WD40; Domain location=232-270; Score =37.1; E_value=6.2e-08; Accession=PF00400.22; Description=WD domain, G-beta repeat
  Pfam module annotation: Pfam domain module=WD40::WD40; Domain location=190-228::232-270
MDPRRLFGLPRGSLSAKDGQSTRNDGSICSQMQSDSPKVALAFQKLKKMKMAQSQQSLSHSQQQEQLQQQSNRKRKSGAANSTGTGNTAAPSPTSSPSTHTPGDGLNTASSLQHVNSVQKSMMMYGTETTGGLASSSNLLDDMDRFGDVDALDDNVESFLSNDGGDGGNLYGTVKQSPAEQLKESSKGTFGEVGCIRTRSSKVTCSHFSSDGKWLASAGDDMKVDIWNMDTLQIESTPAEHKSIITDVRFRPNSSQLATASRDKSMRLWDTTNILASSGLVPCV

SEQ ID NO: 164603 - protein, 85 aa, Glycine max
  Coding DNA Sequence Number=SeqID_47825
MEKGYAASSEVGQVHLWMRKMLLVKVFDIAFPTSIGEMYGLLGPAVMQSYPARALDRKLQVDWARDAREGPRVLMSLRVDFGPMG

SEQ ID NO: 164604 - protein, 195 aa, Glycine max
  Coding DNA Sequence Number=SeqID_47826
  Gene Ontology: Mol. function=protein serine/threonine kinase activity; Cellular component=ubiquinol-cytochrome-c reductase complex; Biological process=protein amino acid phosphorylation
  Homolog annotation: Hit_ID=Q2RAY6; Match level="QueryCoverage=95%, HitCoverage=22%, E-value=1e-40, Identity=47%"; Hit description=D -mannose binding lectin family protein
  Pfam annotation: Domain name=Pkinase; Domain location=1-174; Score= -6.7; E_value=3.7e-08; Accession=PF00069.15; Description=Protein kinase domain
  Pfam annotation: Domain name=Pkinase_Tyr; Domain location=1-174; Score=-146.4; E_value=0.0017; Accession=PF07714.7; Description =Protein tyrosine kinase
  Pfam module annotation: Pfam domain module=Pkinase::Pkinase_Tyr; Domain location=1-174::1-174
MENGSLAQNLSSNTLDWSKRYNIALGTARVLAYLHEECLEWILHCDIKPQNILLDANYQPKVADFGLSKLLNRNNLNNNLRFSVIRGTRGYMAPEWVYNTPITSKVDVYCYEIVLLEMITGKNPTTGVHSNAGEESYNGRLVTWVREKRGDASWLEHIIDPAIKTNFDECKMDLLARVALDCVEETKEDGLNSNE

SEQ ID NO: 164605 - protein, 75 aa, Glycine max
  Coding DNA Sequence Number=SeqID_47827
MKIVISIPLINCDFAGGEHYRDSCYFYSINKSNWRQELAMYNYHEKGRANDLESVLTDFMTYQASFKDYQWESEW

SEQ ID NO: 164606 - protein, 141 aa, Glycine max
  Coding DNA Sequence Number=SeqID_47828
MVVKKMKKIRGGRKRELCWKFLEKEREDLAFKMQKGSTFTFDLTTYLAIKEEKNWTFWDAKILPQFVCRLSGFSSSRFSAPVGTRFQRKTSQGQCFARMLQPYGINIGLKEHSNRVTPKAYTPKRPSGLLPPDLGPTQKTF

SEQ ID NO: 164607 - protein, 71 aa, Glycine max
  Coding DNA Sequence Number=SeqID_47829
MTKYDPEIVIEFYTSAWPMGQHYRFSERRSQALGFDEEAIGQLLCILGQDFTRSMTGRWVRIMHTSMTTLT

SEQ ID NO: 164608 - protein, 81 aa, Glycine max
  Coding DNA Sequence Number=SeqID_47830
MPAGLRHLEPGIMPPRHPMDPEKSNKALGKVLHAKADIAAWAGPSVAAIRRCSTATSTTATIPRVHLCSHAMDETLYAACG

SEQ ID NO: 164609 - protein, 109 aa, Glycine max
  Coding DNA Sequence Number=SeqID_47831
MKEAFTTENGRGSLTQGHSKTGSDSVLRLIEYGAVFVLTNLRPTSTASKSPKQASKLVGKNFGDEGQEIVTDTLEEVPQCGGINEYCNRSTPIHPQHHINREHDERMRN

SEQ ID NO: 164610 - protein, 72 aa, Glycine max
  Coding DNA Sequence Number=SeqID_47832
  Pfam annotation: Domain name=SLR1-BP; Domain location=3-72; Score= -14.0; E_value=0.03; Accession=PF07333.3; Description=S locus-related glycoprotein 1 binding
MKFISSVLFFVLILSIGIENEGPLRVIEASICDVKLDDYCEEDCFSDCPKKYGKKAQGICNEASECICRWQC

SEQ ID NO: 164611 - protein, 74 aa, Glycine max
  Coding DNA Sequence Number=SeqID_47833
MIAIIPTKVPQPPFSRGYNSNATCAYHGGVPRHSIKHCMTLKHKPYTRAMRGIVHESQANLGADKKFSLGRSKT

SEQ ID NO: 164612 - protein, 101 aa, Glycine max
  Coding DNA Sequence Number=SeqID_47834
MLLLSNILPSDHDSDLRLPKWIAPTRHPVDPKKSNRVLGYTECPSPPARSSGPLLTGLSSRSIAPPGRHRARYHNSLGTASSGQQMHRHHLQSPPQLIYKG

SEQ ID NO: 164613 - protein, 48 aa, Glycine max
  Coding DNA Sequence Number=SeqID_47835
FFISLKGISVDEENVKAIREFLVLKNANEDSKPVAYFSDIAICGQGNS

SEQ ID NO: 164614 - protein, 139 aa, Glycine max
  Coding DNA Sequence Number=SeqID_47836
  Subcellular localization annotation: CTP_CleavageSite=52; ConfidenceScore=5.48e-01
MSEDCNSGAASLLLPSPSNSKVGLFHAVRSILSSVFESKNPSSHSRFVFQIVGEKRGSTHRGHSARKRVKMKDLDAVVHSVETNSRYSEFKNDKENTVQWSLGATDASQQVTTGRNAMPEEFNFVARPLILNTEACKGG

SEQ ID NO: 164615 - protein, 137 aa, Glycine max
  Coding DNA Sequence Number=SeqID_47837
  Subcellular localization annotation: CTP_CleavageSite=63; ConfidenceScore=5.48e-01
MTCRKLKGSVSAQFVKFCNILEGKKGMIIFSTVLRRSSFILRRSSVFNRPRLFRFFRHFPQINVGGDSARIPFLEDAPVSLARIPFLETLGDSARIPFLEDLPPKGRLRQYEYMILMMPKKNPTKLLQRINIASRLI

SEQ ID NO: 164616 - protein, 66 aa, Glycine max
  Coding DNA Sequence Number=SeqID_47838
  Gene Ontology: Mol. function=RNA-directed DNA polymerase activity; Biological process=RNA-dependent DNA replication
MVHEDIVLQHLVSSKALRYPLKKPDAKLRLIRWMLLLQDFDIEIREMSGAKNVVADHLSSIEGAIV

SEQ ID NO: 164617 - protein, 244 aa, Glycine max
  Coding DNA Sequence Number=SeqID_47839
  Gene Ontology: Mol. function=catalytic activity; Cellular component =nucleus; Biological process=metabolic process
  Homolog annotation: Hit_ID=Q9LSQ0; Match level="QueryCoverage=57%, HitCoverage=23%, E-value=2e-58, Identity=78%"; Hit description=AMP -binding protein
MEAFADGWFHSGDLAVKHPDGYIEIKDRSKDIIISGGENISSVEVENVLFSHPAVLEASVVARPDEKWGESPCAFVTLKPAGMDGAASTNEKILAEDIVKFCRSKMPAYWVPKSVVFGPLPKTATGKTQKQLLRTKAKEMGPALLMMDHVKQELPLEHALGTKSSIFSTASQSRTWPILAKSVDDGEVAPMPSLQPQDAELESQSSLSLPPSLPPKFVHRILNGNSNIVLVIAFTFRSIRVSAS

SEQ ID NO: 164618 - protein, 73 aa, Glycine max
  Coding DNA Sequence Number=SeqID_47840
MRPIALQCNLVIDYQRPPQHAAFISKPGNRLHPLVIDYQKPSELPDLVFKHGNRLHSLGNRLPETILASCLHF

SEQ ID NO: 164619 - protein, 121 aa, Glycine max
  Coding DNA Sequence Number=SeqID_47841
MATCNGAIKINYHCGGTYHLSWLSEVAKITPIIFSDILLQGSERPLSQPTLRREGDVRAHGCIFQEGKMCGVATNVYSRKTSEKPEKAWSMNFKCEKDQELYLRKGKVLALYASVTRDDNL

SEQ ID NO: 164620 - protein, 251 aa, Glycine max
  Coding DNA Sequence Number=SeqID_47842
  Gene Ontology: Mol. function=hydrolase activity, acting on glycosyl bonds; Cellular component=cellular_component; Biological process =carbohydrate metabolic process
  Homolog annotation: Hit_ID=Q68UW1; Match level="QueryCoverage=96%, HitCoverage=61%, E-value=1e-110, Identity=75%"; Hit description =Polygalacturonase
  Pfam annotation: Domain name=Glyco_hydro_28; Domain location=1-250; Score=181.6; E_value=2e-51; Accession=PF00295.8; Description =Glycosyl hydrolases family 28
MGNKFMNLGFTNSNNIVINGVTSLNSQMFHIVIDRCNNVKLQGIKVSAAGNSPNTDGIHVQLSSTVTILNSNIATGDDCISIGPGTTNLWIENIACGPGHGISVGSLGKEFQEPGVQNVTVKTMTFTGTENGVRIKSWGRPSNGFARNILFQHATMVNVQNPIVIDQNYCPHEKNCPGQVSGVEVSNVIYQDIYGTSATEIAVKINCSPKYPCIGISLEDVMLTYESKQAVASCNHAGGITSGVVQPNNCF

SEQ ID NO: 164621 - protein, 94 aa, Glycine max
  Coding DNA Sequence Number=SeqID_47843
MDHAIDEVHEQPEEATVDDEVADVEGFPGEPHDTSVLTSYVGHLKLSSHGKKVQKFGRLALEIEGLVATSRLSPLSACSLDIGDWGLILAIAER

SEQ ID NO: 164622 - protein, 289 aa, Glycine max
  Coding DNA Sequence Number=SeqID_47844
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=98%, E-value=2e-34, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VLAFRGLHFLAFRGLHPLDFRGLHVLTFTGLYLLAFRGLHVLTFRGLQVLAFRGLHVLAFRGLHVLDFRGLHVLAFIGGLHILAFRGLHFLSFKGLHVLAFRRLHVLAFRGMHVLTFRRLHVLAFRVLHVLTFRRLHVLAFRVLHALAFRGLHFLTFRRLHILAFRGLHVLAFRRLDVLAFTELYVLAIRGLHVLAFRGLHILAFRGLHVLAFRELHVLTFRGLHVLAFRGMHVLPFRGLHVLTFRGLYVLTFRGLHVLAFKGLYVFAFRGLDALAFRELHVLAFTGLH

SEQ ID NO: 164623 - protein, 759 aa, Glycine max
  Coding DNA Sequence Number=SeqID_47845
  Gene Ontology: Mol. function=metabotropic glutamate, GABA-B-like receptor activity; Cellular component=membrane; Biological process =ion transport
  Homolog annotation: Hit_ID=Q69L15; Match level="QueryCoverage=96%, HitCoverage=90%, E-value=4e-86, Identity=30%"; Hit description =Putative Avr9/Cf-9 rapidly elicited protein 141
  Pfam annotation: Domain name=ANF_receptor; Domain location=46-375; Score=169.2; E_value=1e-47; Accession=PF01094.18; Description =Receptor family ligand binding region
  Pfam annotation: Domain name=Lig_chan; Domain location=493-738; Score= 54.3; E_value=1.9e-14; Accession=PF00060.17; Description=Ligand-gated ion channel
  Pfam annotation: Domain name=SBP_bac_3; Domain location=439-696; Score=4.2; E_value=2.4e-08; Accession=PF00497.10; Description =Bacterial extracellular solute-binding proteins, family 3
  Pfam module annotation: Pfam domain module=ANF_receptor::Lig _chan::SBP_bac_3; Domain location=46-375::493-738::439-696
MHKFAFLLWFISMHVIIHGNIAANESSDDKGIIGAILDKSSRIGQEHAVAMKLALEDFYQKSIQSFSLHIRNSQGDPLLAAIAAKDLIDNQKVQAIIGPQTWAETSLVAEISSQKRIPFLSLAEATPEWAMKKWHFLLQSSPSQIMQMKAIAEIVKSWKLYNITMIYEDGDSSSTKILSQLSEALTEFGTELSNAIAIPPLVSSSLSQQLEKLREGQCRVIIVHLSFPLALNLFETAKRMNIMGEGNVWITTGSFTSLVHSLNASTISNMQGVIGVKSYIPKLFPQYADFYRRFRKKFSSENFEEFNYEPGIFAAEAYDAARIVVDAMRETNQIGGQLLLDKIMLSNFTGLSGKIQFTKHGRAPAHTFKIINLIGRSYREIGFWSDGLGFSKYLDEKASYSSSVKELGKVVNPTCAIRLRIGVPSMSNVKQYAEVIQDLSQNVPSFNFKGFSICLFDEIVKKLPYRLEYDYFAFNGTYDELVKQVYLKNYDAVVGDVSIVSTRYEYASFTQPYTETGLMMIVPIKSKTGDRLHSNLSRVAMVVWFLVALIISQIYTASLASMLTVERSEPTVDSIQQLKNNNAIVGCDRGSYLQRYLQDALGINANKIKPFNSMESLAYALRNKEIAAVFLDVPQAKIFLAKHCKGFVQAMPTYKIGGYGFVFPRGSPLLHSVNQALLNISESGTLRDLENRMLASEKCIDIIDPDAKYTSLSPTSFMVPFFLTGGTSTIALLIYIFSANYLCHGQRTMWGLMMAVIKR

SEQ ID NO: 164624 - protein, 67 aa, Glycine max
  Coding DNA Sequence Number=SeqID_47846
MVRFGDWLRRVKWRRWILSLGNPLYRKSSWWCVQAACPANGAAVQVMAILVDDFRSMGKLHVEETHT

SEQ ID NO: 164625 - protein, 387 aa, Glycine max
  Coding DNA Sequence Number=SeqID_47847
  Gene Ontology: Mol. function=transporter activity; Cellular component= integral to membrane; Biological process=transport
  Homolog annotation: Hit_ID=Q5PNA3; Match level="QueryCoverage=99%, HitCoverage=45%, E-value=1e-81, Identity=39%"; Hit description =Putative fimbrial usher protein
  Pfam annotation: Domain name=Usher; Domain location=1-372; Score= -144.1; E_value=4.8e-14; Accession=PF00577.10; Description=Fimbrial Usher protein
MAGYRYSTDGYYSMTEVMDTYRSTTYSPLNERQRNRAEISLNQNLGPQFGSLSLNLISQDYWNSDKRMQSIGMGYGSSWENISYGLNYSYNRNSRSGNSSGERRVYDKDQIVAFNINIPWGKSSSSVYANYGLNSSKSGGTSHSISLSGNALADKNLSWAVQQNYASNARGRSGSLNSNYRSTFGEISAGYGYASASQRFNYGGHGGVIVHEDGITLGQSLGETVGLVKAPGAGGVEVYNQTGVKTDRRGYAVVPYLTPYRSNDITLNTSTLDNNIEIPQASLAVVPTRGALIRAEYVTQVGRRVLMTLKKADGNPVPFGATVTVLNAPEVQQGIIGDGGVVFLAGLEEVGQLQIKWGDAQHTQCRASYQLPAKSTTSGVLMSDTQC

SEQ ID NO: 164626 - protein, 246 aa, Glycine max
  Coding DNA Sequence Number=SeqID_47848
  Pfam annotation: Domain name=Fimbrial; Domain location=122-245; Score= -28.4; E_value=0.0039; Accession=PF00419.10; Description=Fimbrial protein
MVYAARPVCTPEGQRTPNHTVTISEKITVPRDLPVGSKIGNEVSLAINENFKCTISGGVTTGLYMRTTTSDSGIKDGALGIYKTNVDGIGFAMGITSSCVSYKLWVAGNLRLVDLVSTSPVEVQQCTVKTKNVTTKMGNIFDSDLVTVGSTSENKTVNIELECDAGANVWGIISATQETQGSQPGAIKLSGAGTDGVAAGIALQLLDNNNKVVTVNEKKKLVTAANKGDVKINWKARYIRTGEIKP

SEQ ID NO: 164627 - protein, 99 aa, Glycine max
  Coding DNA Sequence Number=SeqID_47849
  Gene Ontology: Mol. function=RNA-directed DNA polymerase activity; Biological process=RNA-dependent DNA replication
  Homolog annotation: Hit_ID=Q1SYR3; Match level="QueryCoverage=97%, HitCoverage=4%, E-value=9e-23, Identity=51%"; Hit description=RNase H, putative
MEIVNLGVGEEKKEVKVGTGMTAPVQDKLVVLLQNYQYIFAWSYQDMPGLYPNIVQHRLSLNPGCSPVKQKLRRMEPEMSLKIKEEVKKQFDTGFLVMA

SEQ ID NO: 164628 - protein, 303 aa, Glycine max
  Coding DNA Sequence Number=SeqID_47850
  Pfam annotation: Domain name=zf-CCHC; Domain location=89-106; Score =22.8; E_value=0.00017; Accession=PF00098.13; Description=Zinc knuckle
KRKPQEANINLSYFHGKENVEANLDWEIRVEQQLKKKSTSKSYGSHSYPKKDQGQGMLGVTPSKPKDDKGKTIEKQAPKASIQEKTSFIKCFKCLGRGHITSQCPTTKTMIMRGQDIYSSQDEPTTSPSSSESEEAKGEESSEEIYPEEDGQPLVTLASIATPLGLEFIPQLKKLLDEGLVRKSLNPCALLVPKIGVPTNPKRIKVIPDWPTPPTPLIELVRNHVPSWEDSQEMGVEGRSPEFQEPLDLRSMGVATYPSAGGRRETRGMRVPRKEYARSRHQRLFGENVGKTGKDEIYELFSE

SEQ ID NO: 164629 - protein, 184 aa, Glycine max
  Coding DNA Sequence Number=SeqID_47851
  Gene Ontology: Mol. function=calcium ion binding
  Pfam annotation: Domain name=efhand; Domain location=91-119; Score =18.6; E_value=0.023; Accession=PF00036.22; Description=EF hand
MDFVMHNWYFNKLTSLMVENILPEYEVTGFNGKEWRKRQIRKITDRVFDRVKNPAQNNLRFGDLYIAILLVYNDINKYIPGPHFDPPSKDRIKQVITFCDDNEDGQINRDEFFGFFEQMAPETFNVVRRKLVATLVATPTVAAVTKKATERVPVVGKLVQWLPKAVYAFLMTIAAVLYQEDSAH

SEQ ID NO: 164630 - protein, 56 aa, Glycine max
  Coding DNA Sequence Number=SeqID_47852
MTIHTVPLCSDQVKVGVEEVRDADACVPILTKEGLEGPPKPVDRSDPLYLMTLTIP

SEQ ID NO: 164631 - protein, 198 aa, Glycine max
  Coding DNA Sequence Number=SeqID_47853
  Subcellular localization annotation: CTP_CleavageSite=52; ConfidenceScore=5.72e-01
MVPRLPVWRASGASPSPPTREVWTPGQTTRSKKALRVMTSSVGIGGGGSRPTCTTRDECSTTKGRSGLVKWRRKKIMMALWVPEKVIDGSVRSTQGNAAPPKELQGFPGRNSVCEEPMPVAALKLMEKLVIVRVGQLNVPLWARGNNKKGNEEAKEEQGCLKILRRDMKEKKEMRVKGRVRQKKGAVVETACSYGLCA

SEQ ID NO: 164632 - protein, 211 aa, Glycine max
  Coding DNA Sequence Number=SeqID_47854
  Subcellular localization annotation: CTP_CleavageSite=47; ConfidenceScore=5.10e-01
MKNDIYLRRLLPTHMNYCRGGVSLLDRPSNNSSSVLVKISRSSIVTRSKEAAGDAAFVAKKLLRSTGKATFAVRIPEAEIPNLIKTLRGFNDTKIEFKLANVQKIWQRFLYRDSVLLEAERRKTAIGHVDDWAVEFLKLTEDDAFATLIQYSTPTGAPRPSQQLRSLNGEWDAPCSGALSAAGVVVTRSVTATLASADVRRCFCRYAPPRQ

SEQ ID NO: 164633 - protein, 303 aa, Glycine max
  Coding DNA Sequence Number=SeqID_47855
  Gene Ontology: Mol. function=protein-tyrosine kinase activity; Cellular component=integral to membrane; Biological process=protein amino acid phosphorylation
  Homolog annotation: Hit_ID=O22938; Match level="QueryCoverage=86%, HitCoverage=53%, E-value=4e-53, Identity=33%"; Hit description =Putative receptor-like protein kinase
  Pfam annotation: Domain name=LRR_1; Domain location=113-135; Score =19.3; E_value=0.014; Accession=PF00560.23; Description=Leucine Rich Repeat
  Pfam annotation: Domain name=LRR_1; Domain location=137-159; Score =6.9; E_value=14; Accession=PF00560.23; Description=Leucine Rich Repeat
  Pfam annotation: Domain name=LRR_1; Domain location=185-207; Score =11.3; E_value=2.2; Accession=PF00560.23; Description=Leucine Rich Repeat
  Pfam annotation: Domain name=LRR_1; Domain location=209-231; Score =11.6; E_value=1.9; Accession=PF00560.23; Description=Leucine Rich Repeat
  Pfam annotation: Domain name=LRR_1; Domain location=233-262; Score =1.8; E_value=1.3e+02; Accession=PF00560.23; Description=Leucine Rich Repeat
  Pfam annotation: Domain name=LRR_1; Domain location=65-87; Score =12.6; E_value=1.3; Accession=PF00560.23; Description=Leucine Rich Repeat
  Pfam annotation: Domain name=LRR_1; Domain location=89-111; Score =18.7; E_value=0.021; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=113-135::137-159::185 -207::209-231::233-262::65-87::89-111
MKHESLFEGLLQIWGEYLPSSKSLEFLDEIPATQNIAPGKVPPVAIIISHQNLRGDVSSISRLKALKWLDLSNTDFHGLIPPTFGNLFYLEYLDLSSNKFEGSIPPKLGALRSLKTLNLSNNLLVGEIPKELQGLESLQDFQIFNNHLSGLIPSWVGNWTNLRVFAAYENNFDGRVPSKLGFIYELKTLNLHSNHLEGPIPGRIFTSGKLEVLILTQNNLSCDLPVEIGNCQTLFSVRIGNNNLEALLIHHQYLPDEHWLNFFMNLQCYLEFSLTGLLDYHNDKSKVQSPIGFESSMYIHTCA

SEQ ID NO: 164634 - protein, 219 aa, Glycine max
  Coding DNA Sequence Number=SeqID_47856
MVNELGMRTLLRLGGVDGDPVLRGTRRRATGQETLGTLGGVLSPKTKLGQSRPNPGIVSQLQCAMAVVICFWALIAMAAQLIHDRVVMECLEGVWETLEGNERCRFRGIVQLTTTSLVHPEKPARTLQQPVEWILPTPTPYRLVEPVQLIEVSPSEEDLEEDPEELPPEPAMDAPDLPEDDEDSLPDVDSPEDITSASEADSTEESGPGGTANSDDPSS

SEQ ID NO: 164635 - protein, 174 aa, Glycine max
  Coding DNA Sequence Number=SeqID_47857
DISFVVQVEGTSTWVVVTENKRGYISFGSVQVEGTSTWLFKENKGGYIPCRSLLVKVFTRLKRNLKDRRLLDPTLAARDLIENQKVQATIGPQTWAEASLVAEVCTQKSILFLVSFFSRHRIHSSFHILTPSSTSEQGFATTISYKVAVEQNRMLPWSKTATPMNVHNNNSNGW

SEQ ID NO: 164636 - protein, 155 aa, Glycine max
  Coding DNA Sequence Number=SeqID_47858
  Gene Ontology: Mol. function=two-component response regulator activity; Cellular component=intracellular; Biological process=two -component signal transduction system (phosphorelay)
  Homolog annotation: Hit_ID=Q5PN70; Match level="QueryCoverage=53%, HitCoverage=25%, E-value=3e-30, Identity=79%"; Hit description =Putative receptor/regulator protein
MAECAINCAATPRAVISGITWQEYQSTVRLSAASHERNICAIRHAIMIHCGWDICIIPSHKPDNRGKRLALLLQHAINHAGKLVDFKLSDVTVSAHFAHVIFVGAAGQRRVNHHRNLPQRVVALDVARQGKAVHLRHFEVGQHQRDFVVNRLAVS

SEQ ID NO: 164637 - protein, 65 aa, Glycine max
  Coding DNA Sequence Number=SeqID_47859
MARFLAQISLSCDAADNRTSGSGAIYCAFRRGAGIEMRDESRRYGLCDRIMQIFLPCDAADNRTG

SEQ ID NO: 164638 - protein, 230 aa, Glycine max
  Coding DNA Sequence Number=SeqID_47860
  Gene Ontology: Mol. function=nucleic acid binding; Biological process= transport
  Homolog annotation: Hit_ID=Q8H6Q8; Match level="QueryCoverage=73%, HitCoverage=5%, E-value=1e-29, Identity=38%"; Hit description=CTV.20
MGIDATVLMCLRDIRHNKFEDSLIGTVETSLGQAPVYFNCYPNKTVSLMDKNILDSLFLNINFHGLDMKEGSIPAALIYRIQYKVMNTCASRVLLQPQKGETTLFITDITKANVSLKRIIKQDDVTLPEKWDMEKATPSDPRPTPIIEKIKQDNSGKVEITFNRRNSHEWNIDAQMEYNIVNAHQHMIMVATAYQTSHECSKETIIGILVEGFSGQLKGWWDNYLTNEEK

SEQ ID NO: 164639 - protein, 252 aa, Glycine max
  Coding DNA Sequence Number=SeqID_47861
MGKVEEVQEQMKADMEAMKEQMATMMEAMMSMKKIMEANAVAVVATSAVAKVNPMPPSGLKQVNHPTSDMDVNNSAPILIESQQPQSDHAHVSQPMGETHEMPHHNLADFEPCLGYATEGITHNHTPLHSTPGKNPHAMAEMGKLDHLKERLRAIEGGEDYAFANLEELFLVPNIITPPKFKVPDFDKYKGTTCPKNHLKMCCRKMGAYAKDEELLIHFFQESLTGVAATWYTNLEPSRVHSWKDLMVAFVR

SEQ ID NO: 164640 - protein, 52 aa, Glycine max
  Coding DNA Sequence Number=SeqID_47862
MAEVFGYGGKEHVVTRTELQGQGVTQCCSGAVVARPRGRTCRSKVKNNMRRC

SEQ ID NO: 164641 - protein, 208 aa, Glycine max
  Coding DNA Sequence Number=SeqID_47863
  Gene Ontology: Mol. function=phosphatidylinositol phosphate kinase activity; Cellular component=proteinaceous extracellular matrix; Biological process=phosphatidylinositol metabolic process
  Homolog annotation: Hit_ID=Q1S1T3; Match level="QueryCoverage=85%, HitCoverage=32%, E-value=1e-37, Identity=43%"; Hit description =Phosphatidylinositol-4-phosphate 5-kinase
  Pfam annotation: Domain name=MORN; Domain location=112-134; Score =1.4; E_value=5.6; Accession=PF02493.10; Description=MORN repeat
  Pfam annotation: Domain name=MORN; Domain location=43-65; Score=0.6; E_value=7.3; Accession=PF02493.10; Description=MORN repeat
  Pfam annotation: Domain name=MORN; Domain location=66-88; Score=19.8; E_value=0.01; Accession=PF02493.10; Description=MORN repeat
  Pfam annotation: Domain name=MORN; Domain location=89-111; Score=3.8; E_value=2.5; Accession=PF02493.10; Description=MORN repeat
  Pfam module annotation: Pfam domain module=MORN::MORN::MORN::MORN; Domain location=112-134::43-65::66-88::89-111
MLVEKAERKRVARGAAVCCSPQTERRVSHGTVVKALPANDDIYSGSLSGNAPHKSDKYLWSDECMYEGEWTKGKVCDKGQFSCPSGTIYVSEFASGRMHDHDTFVGIDGDTYRGGWVSNKKNGFDEKHKGNDDEGEMRYTWCNENEYVGEWKVVLFLGRACWFGRIEREPLRGVFGRTGFRRGNGWVFTWRDGSLMVKLGTLLVIYGG

SEQ ID NO: 164642 - protein, 89 aa, Glycine max
  Coding DNA Sequence Number=SeqID_47864
MRSKKETLRERKEEGSTHGGDGADPRTGSERRGGMEAVAPPRNGAEEGTSGGGEGRSAGSERSEVSRRRGKEEFRRNGGRCYIKYWPEN

SEQ ID NO: 164643 - protein, 66 aa, Glycine max
  Coding DNA Sequence Number=SeqID_47865
MKDFPSIVVSGDNFSSMNCDNNIKIRSNNDGAVDDTEVWAIENGLGFTRWGYGEIIDCGSIMCCFV

SEQ ID NO: 164644 - protein, 131 aa, Glycine max
  Coding DNA Sequence Number=SeqID_47866
  Homolog annotation: Hit_ID=P93390; Match level="QueryCoverage=31%, HitCoverage=9%, E-value=5e-09, Identity=65%"; Hit description =Phosphate/phosphoenolpyruvate translocator
MSFGYVWTLNLHPTPSITGSQFVAILPLVVAHTMGNLLTNISLGKLWEIEDFERKNGCSCVCLNYCGYITQRFIVNTSQSSIIISNTLNDVNIRKTFPNLDAFSAFVFVLNPHTTKKCTGSSSMARETQEI

SEQ ID NO: 164645 - protein, 264 aa, Glycine max
  Coding DNA Sequence Number=SeqID_47867
  Gene Ontology: Mol. function=hydrolase activity, acting on ester bonds; Biological process=metabolic process
  Homolog annotation: Hit_ID=Q9S816; Match level="QueryCoverage=74%, HitCoverage=38%, E-value=8e-68, Identity=61%"; Hit description =Putative phospholipase
  Pfam annotation: Domain name=Phosphoesterase; Domain location=28-259; Score=162.7; E_value=9.4e-46; Accession=PF04185.5; Description =Phosphoesterase family
MEMLKVREQESDSSQQIEEDWRRHRSDTKNIFYNSETTTGFQNGAAVPVPTSTQPNRFYVHSATSHGAMNNVRKDLIHDFPQKTIFDFFNENDLSFDVYYQNMLATLFFKCLHKLKNAVKLHDYALKFKKHALKGKLLNYVVVEQRYFDVEVFPTNDDHPSQDVAVEQMFVKEVYEVLRKSLQWEEMAVLITYDEHGGFYDHVTTSVEGVPNADGIIGPRPYYFRFDRLGVRVPTFIISPWIDKGTGMCSKVSCFFMLCWLTEI

SEQ ID NO: 164646 - protein, 74 aa, Glycine max
  Coding DNA Sequence Number=SeqID_47868
MGTGKVKSGMVKTSRKLRIEMANFSSTVVMLSCNFCKIAEKNKICKRKDNFYKKIVLDGLLTLGYDASICKSCL

SEQ ID NO: 164647 - protein, 80 aa, Glycine max
  Coding DNA Sequence Number=SeqID_47869
MVSDTETFRTLQTSLKDPNGQIVDKCLVKLQTQFREETMVNEGCTAFLPRQLHVASSRSFIKRLPHGFFEKFSQEASLRS

SEQ ID NO: 164648 - protein, 147 aa, Glycine max
  Coding DNA Sequence Number=SeqID_47870
  Homolog annotation: Hit_ID=Q1RVK8; Match level="QueryCoverage=74%, HitCoverage=20%, E-value=2e-08, Identity=27%"; Hit description =Ribonuclease H
MEYFALFGHSLGASYDGEIHEGESILSNPLKPYSSYNWRSILKARDALGDEFKAQLGDGKIWRAHLPEKLHYFMWQICQTAFPTNNKRVSCKLAQSIACPRCFLVDETTLHVLRDCPHRRELWNLLGILIPPIIIITYVKEWVANIM

SEQ ID NO: 164649 - protein, 220 aa, Glycine max
  Coding DNA Sequence Number=SeqID_47871
MTITTAAVVASDSGDNNSGDHVGGNDDSYGSGSDNNSDSGGDNNGHDGDNDGGESNNNDGHGSLLNQSQTYQGNPCGVYPDLSSLSGSGIIQNSVTYIKRSAPTNRRDKTGNRYGFVRFMGVQDAKAIEKQLDICIGNVKMNVNRPNDTCATQHELGWGKVAMHKWWQCLAMNQFECGRRKIEVSIRKRVNELFISDVARNVKLKYAGDDIVLIEGIMED

SEQ ID NO: 164650 - protein, 82 aa, Glycine max
  Coding DNA Sequence Number=SeqID_47872
  Gene Ontology: Mol. function=transition metal ion binding
MELCHLVSLNDLKLVDLKSHDCHFLIQQLLPIAIHGILHEKVRVAITRLCFVFNAICSNVIDPRQLDDLEIESAIVLLSIGD

SEQ ID NO: 164651 - protein, 50 aa, Glycine max
  Coding DNA Sequence Number=SeqID_47873
MTTSGHHEQPLITTEPPLGEEHFNQIGILKIHLKDSVENKLSILSFIASL

SEQ ID NO: 164652 - protein, 155 aa, Glycine max
  Coding DNA Sequence Number=SeqID_47874
MMCVREEEKRNRSRITLKLRFTLRESAAENTPKQREEEEKNTHPSSEPEFVSLRIFKKDCLFRDTDLEVGVKSFTLWYGDRREEPERVQGFGARVFLAVGEQEEAEMCEGEGPSDFSETQRWNQKETWFCTGSSSLWVHCARERNLSSPPPPSTT

SEQ ID NO: 164653 - protein, 182 aa, Glycine max
  Coding DNA Sequence Number=SeqID_47875
  Gene Ontology: Mol. function=zinc ion binding
  Homolog annotation: Hit_ID=Q1SL48; Match level="QueryCoverage=44%, HitCoverage=64%, E-value=1e-13, Identity=43%"; Hit description=Zinc finger, GRF-type
  Pfam annotation: Domain name=zf-GRF; Domain location=88-134; Score =37.0; E_value=6.5e-08; Accession=PF06839.3; Description=GRF zinc finger
MEGYYGHLGDERVRPSSMASPCSSCGVSLRQIANLHGCGNPNPQGCKPVWFSEVVVEKPRCPLKLVVGDVVPMKRSSLSYTLEPRSHIMCLCNVEAPLVTSWTEDNPGRRFYGCGLYKVIGRKWCNYYEWHDPLANSCEERIIVTLMKNVDELKFREKDLRTKINDMKMKGNFLGIRLVFSW

SEQ ID NO: 164654 - protein, 220 aa, Glycine max
  Coding DNA Sequence Number=SeqID_47876
  Homolog annotation: Hit_ID=Q1SYK7; Match level="QueryCoverage=26%, HitCoverage=45%, E-value=2e-09, Identity=48%"; Hit description =Probable Mutator-like transposase
MENLGFHFSQTHSHLVYERGEVWKVCYFVPVRITIEGAAFCLQVLVEGEARVEGGMEAKIQVDEQGLMEVQVQGQDEAGVVGEMEVVVEDVVENDVEAGCTMSLLMHTPDMKLKTLIAYAVEKWEIRLTMDQTYRAKLIYMVFKKDVGHLISTIIQFIHCYFQELVEGNWKKKYLGAHIKELMWMAARATTIPDWEKAMNQIKTYDVEGWKDLEKLNHVA

SEQ ID NO: 164655 - protein, 135 aa, Glycine max
  Coding DNA Sequence Number=SeqID_47877
MTVRLRDNSNCDILMTVWEDYAIQLHNAIDKNLLLQEPLVVMLTLGKIKDATDMIFSFRDMATTQIIKTTGNDKKKDKYGENRKHIQAGANSGNNTNIENLFVFAKNSDKQEQIRGTIPTSKTFIFRIKQQRTGK

SEQ ID NO: 164656 - protein, 106 aa, Glycine max
  Coding DNA Sequence Number=SeqID_47878
MKRNENTKEKAQTAGSKTKTHEQKPKPNKKASPKERKSERSEDDNRREEKMGKKPRRAGGTEWEWQNNDNMGKEEMEKKPNRIAVGTGKKMESGKAKKQKRAGHVG

SEQ ID NO: 164657 - protein, 214 aa, Glycine max
  Coding DNA Sequence Number=SeqID_47879
GLALPPEPEVGPSAARVSTKGSCVDPLLTDPETGDSDKCRLYIKANPSHLVALLRVYEGSTTVHNVPLLHGQVKIGVEEVKDAKARVPVPTDKPSDRPDPEVDDPLYLMTLTILQLFLKPLQVMWDVTVFGVFNLDFPLYIKHKDLSEIAHGDQCLSISASDRDKYASRDSDVYGFLEPQSIQRSGQSQFESESYMKSWMQSSKRDVYLGAYLN

SEQ ID NO: 164658 - protein, 78 aa, Glycine max
  Coding DNA Sequence Number=SeqID_47880
MARSVFASCPYLRDLQGRELTRLLAIIPKVVISLLMASRVPSGVANCRNLPFGGRATRDSRDACSMKGIRAESPPKFI

SEQ ID NO: 164659 - protein, 102 aa, Glycine max
  Coding DNA Sequence Number=SeqID_47881
  Subcellular localization annotation: CTP_CleavageSite=53; ConfidenceScore=5.00e-01
MYPPLFSLNNLVDVPSTRIDPQEMYPLLFSVTTTQVDVPSTCTTKDVPSNVLRQSSQEGRIKRILRPCRFEFFDKGEGRHKRIQAVSPLFFWKREKRDTKRI

SEQ ID NO: 164660 - protein, 84 aa, Glycine max
  Coding DNA Sequence Number=SeqID_47882
MAISRKQHIACLLRAPISGTYWEELKDCYLMIIPKVVAHKFQRFLEISSPLISNIVAVGTTSDNVSSKRKTLDEVSLSSSKSVT

SEQ ID NO: 164661 - protein, 234 aa, Glycine max
  Coding DNA Sequence Number=SeqID_47883
  Homolog annotation: Hit_ID=Q3V655; Match level="QueryCoverage=35%, HitCoverage=10%, E-value=1e-14, Identity=47%"; Hit description=MAP kinase phosphatase 1
MKRTVVKNHHGSGGHDLRHWLEGPTCCRQLQSYRREDSAEGFIDADLKIIHHCCPLLPPMNPTQRNTSFLFIFVALSRRLSNVALKYDHDHPAPLLFPFLSKLQSLLHFPLSRPLQPLAIHKHNVLEWPSVGCDDLGDWYLPPTPRGSSKTPDSGSGQVFQFKKEYYAFYDMECLRIMEHVYLGSDTVAKSVELLRRCRRPFSFSFSFSISLKNPFFIFCAWLFLKLIYTQMNN

SEQ ID NO: 164662 - protein, 175 aa, Glycine max
  Coding DNA Sequence Number=SeqID_47884
  Gene Ontology: Mol. function=helicase activity; Cellular component =membrane; Biological process=protein amino acid phosphorylation
  Homolog annotation: Hit_ID=Q9LTU4; Match level="QueryCoverage=95%, HitCoverage=11%, E-value=5e-54, Identity=61%"; Hit description =Helicase-like protein
  Pfam annotation: Domain name=DUF889; Domain location=1-91; Score= -41.9; E_value=1.2e-08; Accession=PF05970.5; Description=Eukaryotic protein of unknown function (DUF889)
MLNPAFTLLSPEFLYSLQTSGIPNHKLKLKVGTPIMLIRNLDQTDGLCNGTRLIITKLGSNVIEAEVVTGPNIGNRTYIPRINMSPSESPWPFKLIRRQFPFIVSYVMTINKSQGQSLHHIGLYLPHPVFSHGQLYVALSRVKSKDGLHILIHDNDRNPKNITTNVVNNEVFANL

SEQ ID NO: 164663 - protein, 808 aa, Glycine max
  Coding DNA Sequence Number=SeqID_47885
  Gene Ontology: Mol. function=protein binding; Cellular component =intracellular; Biological process=defense response
  Homolog annotation: Hit_ID=Q1S334; Match level="QueryCoverage=99%, HitCoverage=99%, E-value=0.0, Identity=59%"; Hit description=Disease resistance protein; AAA ATPase
  Pfam annotation: Domain name=LRR_1; Domain location=618-638; Score =1.4; E_value=1.5e+02; Accession=PF00560.23; Description=Leucine Rich Repeat
  Pfam annotation: Domain name=LRR_1; Domain location=646-668; Score =3.8; E_value=56; Accession=PF00560.23; Description=Leucine Rich Repeat
  Pfam annotation: Domain name=LRR_1; Domain location=670-692; Score =14.4; E_value=0.41; Accession=PF00560.23; Description=Leucine Rich Repeat
  Pfam annotation: Domain name=LRR_1; Domain location=694-716; Score =11.5; E_value=2; Accession=PF00560.23; Description=Leucine Rich Repeat
  Pfam annotation: Domain name=LRR_1; Domain location=718-740; Score =17.1; E_value=0.065; Accession=PF00560.23; Description=Leucine Rich Repeat
  Pfam annotation: Domain name=LRR_1; Domain location=742-763; Score =6.8; E_value=15; Accession=PF00560.23; Description=Leucine Rich Repeat
  Pfam annotation: Domain name=NB-ARC; Domain location=141-431; Score =26.5; E_value=5.6e-12; Accession=PF00931.13; Description=NB-ARC domain
  Pfam module annotation: Pfam domain module=LRR_1::LRR_1::LRR_1::LRR _1::LRR_1::LRR_1::NB-ARC; Domain location=618-638::646-668::670 -692::694-716::718-740::742-763::141-431
MEETKQRVALQERLRMVSSEIVEKGQSSESNKQILRSTLKDNAAVVQEIKQYNEHLNPPREEINTLFGEKENADEEFVCKWFSKWCLSLFLCRFGQKRDDSFAGGAEKQGLVAKDIEEKLYKMREILELLSKRSFEKNLGGFGTPLKFPFGVPENPKFTVGLDEPLSKLKIEVLRDGVSVVLLTGLGGMGKTTLATKLCWDEQVKDDVIMAHQSFITSSHLKIIVERLFEHCGCQVPDFQSDEDAANQLGLLLRQIGRSSMLLVVDDVWPGSEALVQKFKVQIPDYKILVTSRVAFPSFGTQCILKPLVHEDAVTLFRHCALLEESNSSIPDEELVQKVVRICKGLPLAIKVIGRSLSHQPSELWLRMVEELSQHSILDSNTELLTCLQKILNVLEDDPAIKECFMDLGLFPEDQRISVTTLIDMWAESCSLDDNGTEAMAIIKKLDSMNLANVLVARKNASDTDNYYYSNHFIILHDLLRELAIYQSTQEPAEERKRLIIEINQNKPHWWLGEKSKLLKPQQATAQTLSISTDENCCSDWPQIQLAQVEVLIFNLRTKQYSFPDFMEEMNKLKVLIVTNYSFYPSEINNFELLGSLSNLKRIRLERISVPSFVAMKNLKKLSLYLCNIKQAFENNDMLISYIFPNLEELNIDYSKDMVGLPKGLCDIISLKKLSITNCHKLSALPREFGKLENLELLRLNSCTDLEGLPDSIGRLSNLRLLDISNCISLPNLPEDFGNLFNLQNLYMTSCARCELPPSIANLENLKEVVCDEETAASWEDFKPMLPNLKIDVPQVDVNLNWLHTISS

SEQ ID NO: 164664 - protein, 150 aa, Glycine max
  Coding DNA Sequence Number=SeqID_47886
MPPTWHPLDPDKSNRALGFPALITGLCPSFGVPVTPSKVIRPPITRAFIEKYCTPRQAQGDAPQVADALPPPHQADPAGSFGMERYLQHLVRQQAANHMGQFRDEVAWLGDWPEAQAGEAPAEAPSDAEEARMDEEMTDLLGFLGGSGAT

SEQ ID NO: 164665 - protein, 109 aa, Glycine max
  Coding DNA Sequence Number=SeqID_47887
MAMRRSDEVDGGCRPHTDQGKEVWRCKDEEDELAWWWWKDKEDKLGEATRPGLDCERGGEEGGVVGDAIGGDDNGDCGREWRFLKKNWVATMVIQVGLTRGERRGSIEM

SEQ ID NO: 164666 - protein, 174 aa, Glycine max
  Coding DNA Sequence Number=SeqID_47888
  Gene Ontology: Mol. function=RNA-directed DNA polymerase activity; Biological process=RNA-dependent DNA replication
MVDDAYGWLLQQAQEQSWVHLGRTQWCGHGTILMFQIQAICNQVEYEALFVGLRLTKENLRGEIEEVQVTHISKEVSDKADELAWLATFAKPGQLKTFIIHAVPKPSVSRKECLQVEETPLRWRKEILDYLKHEILPADKSHARKIRTLAARYTLVIEKLYIRGFSSPLLKCLD

SEQ ID NO: 164667 - protein, 66 aa, Glycine max
  Coding DNA Sequence Number=SeqID_47889
MRLKGVFGLDVPSVSSAKPYSYSLSGYKLLLPPSDSYIMNVMRLKLEAKAVLRACDELVSDCEILE

SEQ ID NO: 164668 - protein, 76 aa, Glycine max
  Coding DNA Sequence Number=SeqID_47890
  Gene Ontology: Mol. function=protein binding; Biological process =defense response
  Homolog annotation: Hit_ID=Q1S334; Match level="QueryCoverage=90%, HitCoverage=17%, E-value=6e-11, Identity=33%"; Hit description =Disease resistance protein; AAA ATPase
MVLFPSEVCDITMLKKLSVTNCHKLLAIPQEIGKLVVICDEEITASWEGFEAMLPNLQIEVPQVDVNLIWFCSVSS

SEQ ID NO: 164669 - protein, 389 aa, Glycine max
  Coding DNA Sequence Number=SeqID_47891
MAEKTNKILEEAAQSGSTEGIIDPPSPIRRHVKWKLARTKKTGQMTILWMSRRHRDRSSPHGCQDVLTAAIGQPEHPGRVRAAGAGVTIKQYFGSAPRMSCSSSSMLPEDLQQLTQEIRDLLDESITKNGLALPSEPEVGPSGARVNTKESCVAPSGNDPETGDSDKCELYIEENPSRLVALGRLYEGSIVVHNIPLLHGQVKVGVEEVKDVEALVPIPTDEAAVSPVKPPKSPDHEVDDPLYLMTLIIPQLFLKPLQVIWDATMFGVFNQNFLLYIKHEDLSEIAHGGQCLSISVIQLWVLHLTETSLRAGNSDMYGFLEPQSIQRSGQLQFESESYIKSWMQSSKRDVYLGAYLNGPDNYLKGIINSVIDKKKALSAAITSCIGCPR

SEQ ID NO: 164670 - protein, 161 aa, Glycine max
  Coding DNA Sequence Number=SeqID_47892
  Homolog annotation: Hit_ID=Q96326; Match level="QueryCoverage=23%, HitCoverage=14%, E-value=4e-07, Identity=65%"; Hit description=G1p
MDEDQQNWKEIANIMMKINKKAEEMFNIVHVMDQDVPSTMYSFMKAARFTHLNMEGTTNLGTHHSIQIPSPLHRLPIPFLPSSPPSHLLAVALLPPPPPLHDEPHLAALEQICRHRRTRASSRQGASRPTRSASAASPALLSLFSTNSKTRSCSTSPQPKP

SEQ ID NO: 164671 - protein, 103 aa, Glycine max
  Coding DNA Sequence Number=SeqID_47893
MNTVRERFSSGAELRIAVQAEVANRKSPQRGIVNKTTQLDNSATTDHLSKDTSNNKGHGNANHATESTQKSASQTRIDVNVVDFLFNKLCFLNQILTEVQHFD

SEQ ID NO: 164672 - protein, 86 aa, Glycine max
  Coding DNA Sequence Number=SeqID_47894
MLISLSLGCRQRSEVEHPPLESDINTRFCKPFSPNCFVSTPPFVGGTMTGIQLRFHKPFSVECSWPVSLPLTANLALGGHSRKKHR

SEQ ID NO: 164673 - protein, 167 aa, Glycine max
  Coding DNA Sequence Number=SeqID_47895
  Subcellular localization annotation: CTP_CleavageSite=30; ConfidenceScore=5.35e-01
MACHVRGILIATLTLILTPKTLSFCSTPTYAGSRPSKVGSPSTSTPEGFHRLLIDVTSGVEGSTQCDLDESKLRIVTILDLTFLIHVIFVVLIMFLTYALVYWSVGGRRLKSYEVLPAYRINERRLESLSATTADSSASSPTTVATASECMDFLLHFSFEGAFVDFC

SEQ ID NO: 164674 - protein, 489 aa, Glycine max
  Coding DNA Sequence Number=SeqID_47896
  Gene Ontology: Mol. function=protein binding; Cellular component =intracellular; Biological process=defense response
  Homolog annotation: Hit_ID=Q1S351; Match level="QueryCoverage=98%, HitCoverage=62%, E-value=0.0, Identity=70%"; Hit description=Disease resistance protein; AAA ATPase
  Pfam annotation: Domain name=LRR_1; Domain location=327-349; Score =0.8; E_value=2e+02; Accession=PF00560.23; Description=Leucine Rich Repeat
  Pfam annotation: Domain name=LRR_1; Domain location=351-373; Score =6.4; E_value=18; Accession=PF00560.23; Description=Leucine Rich Repeat
  Pfam annotation: Domain name=LRR_1; Domain location=375-397; Score =12.2; E_value=1.5; Accession=PF00560.23; Description=Leucine Rich Repeat
  Pfam annotation: Domain name=LRR_1; Domain location=399-421; Score =17.1; E_value=0.062; Accession=PF00560.23; Description=Leucine Rich Repeat
  Pfam annotation: Domain name=LRR_1; Domain location=423-444; Score =4.2; E_value=48; Accession=PF00560.23; Description=Leucine Rich Repeat
  Pfam module annotation: Pfam domain module=LRR_1::LRR_1::LRR_1::LRR _1::LRR_1; Domain location=327-349::351-373::375-397::399-421::423-444
MQVVKSCKGLPLAIKVIGRSLSHQPFELWQKMVEELSHGHSILDSNSTELLTYLQKILDVLEDNTMIKECFMDLSLFPEDQRISITALIDMWAELYGLDNDGIEAMAIINKLESMNLVNVLIARQNTSDTDNCFYNNHFMVIHDLLRELAIHQSNQEPIEERKRLIIETNENKSEWGLCEKQQGMMTRILSFCFRYCAKQKYQQIPAHTLSISIDETCNSYWSHMQPNQAKVLIFNLRTNQYSLPESMEKMSKLKVLIVTNYNFHLTELTNFELLGTLSNLRRIRLERISVHSFVTLKTLKKLSLYMCNLNHAFQNGIFLISDAFPNLVDLSIDYCKDMVLLPSGVCDITTLKKLSVTNCHKLFALPQEIGKWVNLELLRLSSCTDLEGLPDSIGMLSNLRHLDISNCISLLNLPEDFGNLCNLRNLYMTSCARCELPSSAVNLVNLKVVICDEETAASWEGFESMLPNLQIEVPQVDVNLNWLYSVCS

SEQ ID NO: 164675 - protein, 212 aa, Glycine max
  Coding DNA Sequence Number=SeqID_47897
  Gene Ontology: Mol. function=protein binding; Cellular component =intracellular; Biological process=defense response
  Homolog annotation: Hit_ID=Q6YIA0; Match level="QueryCoverage=92%, HitCoverage=28%, E-value=2e-72, Identity=64%"; Hit description =Disease resistance protein-like protein MsR1
  Pfam annotation: Domain name=NB-ARC; Domain location=8-212; Score= -122.8; E_value=0.019; Accession=PF00931.13; Description=NB-ARC domain
MEETAQLVVFPMKSAFGVPETPEFSVGLDVPLSQLKIELLKEGVSIIVLSGFGGLGKTTLATKLCWDEQVMGKFRKNIFFVTFSKTPKLKIIAERLFEHFGFQVPKFQSNEDALSQLGLLLRKFEGIPMLLILDDVWPGSEALVEKFKFHLSDYKILVTSRVAFHRFGIQCVLKPLVYEDAMTLFHHYALLDCNSLNTPDEDVVQKVLVLTF

SEQ ID NO: 164676 - protein, 101 aa, Glycine max
  Coding DNA Sequence Number=SeqID_47898
MDFYKDSEKSQVGCLRTGRRSNEYRFYCPSHSTRIVELRNAKFLENDLIGGSGQFQDIAFEKDHYEAQPSGSSGRFIAIHTPHAQIKFLMRNTKFLKKITK

SEQ ID NO: 164677 - protein, 155 aa, Glycine max
  Coding DNA Sequence Number=SeqID_47899
MMREKKEFPKGEFSGFSGVGLAYSHLACSARLAQVPVFVLSACQIWHDVIPSSDLSSLSDLRGLTPLSVEGWSLGQATYWMKASGVVSGGSIFRWTKASEYAGPSGLRWMAAGSVRQVVEEAVLEAKLITGLSDLKGHGGGGGGSRGEAERWINK

SEQ ID NO: 164678 - protein, 143 aa, Glycine max
  Coding DNA Sequence Number=SeqID_47900
  Gene Ontology: Mol. function=zinc ion binding
  Homolog annotation: Hit_ID=Q1RSK3; Match level="QueryCoverage=95%, HitCoverage=15%, E-value=8e-64, Identity=81%"; Hit description=Zinc finger, RING-type; Transcription factor jumonji, jmjC
MVIWRGILEATDEKAKDENRMDSEIDIELAQFMKGYFKGLILENGWPQLLKLKDWPSPSMAEEFLLYQRPEFINKLPLLQYIHSKWGLLNVAAKLPHYSLQNDVGPKIYICYGISDELGRGDSVTNLHFNMRDMVYYLTLINP

SEQ ID NO: 164679 - protein, 95 aa, Glycine max
  Coding DNA Sequence Number=SeqID_47901
  Homolog annotation: Hit_ID=O63067; Match level="QueryCoverage=37%, HitCoverage=4%, E-value=4e-07, Identity=85%"; Hit description =Aspartokinase-homoserine dehydrogenase
MGALFRARQVTIWTDVDGVYSADLRKDTVLSRSVGNGTASAIFGVVKDVGANVIMISQANINVRAAAQGSFQIFSLKNHNNNDHYCAWFNWKRTA

SEQ ID NO: 164680 - protein, 79 aa, Glycine max
  Coding DNA Sequence Number=SeqID_47902
MVSLLLILGKWNKNHPQTTLQPIMEIKLAIFPSSPSPLAIEPTSGAPVAAIWLEEMVKKRKEKGAPRTVKKRKKKTSHM

SEQ ID NO: 164681 - protein, 82 aa, Glycine max
  Coding DNA Sequence Number=SeqID_47903
MAKFDPEIVLEFYDNAWPTKEGARDMHSWANNVSSARGGIGPTGLTRRPLPNCYAHEAGFRPDHYREVGVDHAYQHDHFDPD

SEQ ID NO: 164682 - protein, 56 aa, Glycine max
  Coding DNA Sequence Number=SeqID_47904
MGIADSILRHFFLCGTMPQAELETSWPAPKKKPFFDLSRCSSYFVTSPSRIEARSR

SEQ ID NO: 164683 - protein, 71 aa, Glycine max
  Coding DNA Sequence Number=SeqID_47905
  Subcellular localization annotation: CTP_CleavageSite=36; ConfidenceScore=5.17e-01
MESNQASSKTSPLTPQTDDSTIRVTPFLRSPTAAASATAEDGGKKTKVCEFGCIRRHCDSPCCSHSLKFYN

SEQ ID NO: 164684 - protein, 134 aa, Glycine max
  Coding DNA Sequence Number=SeqID_47906
MEAIKEQMATMMEAMMSVKKIMEANAVATAATSTVAKVNPMPPSGLNQMNHPTSAMVGKDLGSTGGPHYVQSQNKHAFPPHGFPPNCTPPNVAYTPGENVNNSTPILIESRQPGLIMHMSLNPWVRHMKCPTTI

SEQ ID NO: 164685 - protein, 107 aa, Glycine max
  Coding DNA Sequence Number=SeqID_47907
MIVHVSQGPGVSGVDHGPLLVIQGSRHPYKVIRPLITRAFIEKYCTPRQAQGDAHQAADALSPPQQADPAGSLGIERYLQHLVRQQAANHHGQVQIHECLYRFSLSQ

SEQ ID NO: 164686 - protein, 114 aa, Glycine max
  Coding DNA Sequence Number=SeqID_47908
DPDVDFEKLVNQAKEEENEDWGLPLNLRRMAKQEEREVKPHREETEVVNLGIAEREKRSRSALDMPGLSSDIMQHKLPLNPEYSPVSYPNFVRGPLLDDVRPFFGPREVLGTHH

SEQ ID NO: 164687 - protein, 365 aa, Glycine max
  Coding DNA Sequence Number=SeqID_47909
  Gene Ontology: Mol. function=hydrolase activity, acting on ester bonds; Cellular component=cellulose and pectin-containing cell wall; Biological process=lipid metabolic process
  Homolog annotation: Hit_ID=Q1S3U7; Match level="QueryCoverage=97%, HitCoverage=100%, E-value=1e-119, Identity=60%"; Hit description =Lipolytic enzyme, G-D-S-L
  Pfam annotation: Domain name=Lipase_GDSL; Domain location=43-356; Score=191.4; E_value=2.1e-54; Accession=PF00657.12; Description=GDSL- like LipaseAcylhydrolase
MKFLFVKLVSQLSLVILWSFATVITSQHVSVVSLPNNESVPAVIVFGDSIVDTGNNNYINTIAKVNFLPYGKDFGGGNQPTGRFSNGLTPSDIIAAKLGVKKLLPPYLDPKLQPQDLLTGVSFASGGSGYDPLTSKIASVLSLSDQLDKFREYKNKIKETVGGNRTTTIISKSIYILCTGSNDIANTYSLSPFRRLQYDIQSYIDFMIKQATNFLKELYGLGARRIGVIGLPVLGCVPFQRTIQGGIHRECSDFENHAATLFNNKLSSQIDALKKQFPETKFVYLEIYNPLLNMIQNATKYGFEVTDKGCCGTGDFEVGFLCNRLTPHICSNTSSYIFWDSFHPTEEGYKVLCSQVLDKNIKDFF

SEQ ID NO: 164688 - protein, 122 aa, Glycine max
  Coding DNA Sequence Number=SeqID_47910
  Gene Ontology: Mol. function=hydrolase activity; Biological process =aromatic compound metabolic process
  Homolog annotation: Hit_ID=Q9ZP87; Match level="QueryCoverage=96%, HitCoverage=38%, E-value=5e-41, Identity=64%"; Hit description =Epoxide hydrolase
MDLFDPSTPLPPWFSEEDLSTYASLYEKSGFRYALQVPYRSAKVETGLSDVKVTVPALLIVGEQDYFLKFPGMENYIRKGVVKNFVPNLETVYIPEGSHFMHEQIPEKVNQLIIEFLDKQSI

SEQ ID NO: 164689 - protein, 55 aa, Glycine max
  Coding DNA Sequence Number=SeqID_47911
MWDQHKLKVALKPGVFTPKAYTPKSPSGSLPPDLDTAHELYNTHDLPPVFYTRST

SEQ ID NO: 164690 - protein, 327 aa, Glycine max
  Coding DNA Sequence Number=SeqID_47912
  Gene Ontology: Mol. function=hydrolase activity; Cellular component =peroxisome; Biological process=aromatic compound metabolic process
  Homolog annotation: Hit_ID=Q9ZP87; Match level="QueryCoverage=98%, HitCoverage=99%, E-value=1e-116, Identity=62%"; Hit description =Epoxide hydrolase
  Pfam annotation: Domain name=Abhydrolase_1; Domain location=67-320; Score=51.1; E_value=3.6e-12; Accession=PF00561.10; Description =alphabeta hydrolase fold
MEKIQHSEVEVKGLKLHVAEIGSGHSLKTPYYNTVLICSKAVVFLHGFPEIWYTWRHQMISVANAGYRAIAFDFRGYGLSEQPVEPEKETMFDLVPEVVGLLDAINISKAFLVGKDFGAIPGYLTAAVHPERVAAVITLGIPFILPGPSAVQNHHLPKGFYITRWQEPGRAEADFGRFPVKSVIRNIYTLFSKSEIPIAADDQEIMDLFDPSTPLPPWFSEEDLSTYASLYEKSGFRYALQVPYRSAKVETGLSDVKVTVPALLIVGEQDYFLKFPGMEDYIRKGVVKNFVPNLETVYIPEGSHFMHEQVPEKVNQLIIEFLDKQSI

SEQ ID NO: 164691 - protein, 65 aa, Glycine max
  Coding DNA Sequence Number=SeqID_47913
MAKRPKVCLLMKKMREVVTNVYSMKMLEKPKDEGLRILKMRVRELFTHREVNKGVAHAPTYPQVR

SEQ ID NO: 164692 - protein, 401 aa, Glycine max
  Coding DNA Sequence Number=SeqID_47914
  Gene Ontology: Mol. function=transcription factor activity; Cellular component=cytoplasm; Biological process=regulation of transcription, DNA-dependent
  Homolog annotation: Hit_ID=Q9SKT1; Match level="QueryCoverage=84%, HitCoverage=89%, E-value=5e-50, Identity=38%"; Hit description=AP2 domain transcription factor
  Pfam annotation: Domain name=AP2; Domain location=205-269; Score =145.5; E_value=1.4e-40; Accession=PF00847.10; Description=AP2 domain
MANNREKSTKEGVEETHHHKVIGESEGQDWEIEKGKGLDLSSGRRQWKPVFDDASLSHRPLKKIRSPERENPNQQQQQPPSSMLSLQPPSSRIVFPFAFEGSQHPMPFPHPFGTTNLPLFRPNLHPTQQMISFGSQQNMGYPPFLAPESTMPHQHQQHLQQHHQQLLHYWSDAINLSPRGRMMMMMNRTEGRQMLRPQAQPLNATKLYRGVRQRHWGKWVAEIRLPRNRTRLWLGTFDTAEDAAMAYDREAFKLRGENAKLNFPELFLNKDKAEQSTTVAPASSSNEGSTSTSSQNTKQPEPIPEEINTESEDIPPTETIAEENAETGKGISQPQELVWGEWFNAIPAGWGPGSPVWDDLDPNNNLLLHSQLPFVNPNQQEFHDDAGASSQIQQEDNSTEP

SEQ ID NO: 164693 - protein, 124 aa, Glycine max
  Coding DNA Sequence Number=SeqID_47915
  Gene Ontology: Cellular component=integral to membrane
MVRVLRSCIQSILKLVNSVIGMAGLAMILYSAWMIRVWQRKMGELPFGHDSDYPPPWFIYMFLGLGVAFCVITCLGHVAAETANGCCLYLVSFSLVYRYISIYDARIQALVSDMSDAKQGYNIS

SEQ ID NO: 164694 - protein, 133 aa, Glycine max
  Coding DNA Sequence Number=SeqID_47916
MHEAYTKTYPSSPHMLYCYTHQRAKGISQMALAEPTLGNPANGTSETSLHQYLTGENKHMDDVALMDGCMELMVGMGYLANGSGGTPCMKNLLVLLARYLKKKTPYKNYFQRNPYVKKLVKPPLTSFCPKMTN

SEQ ID NO: 164695 - protein, 464 aa, Glycine max
  Coding DNA Sequence Number=SeqID_47917
  Gene Ontology: Mol. function=transporter activity; Cellular component= integral to membrane; Biological process=transport
  Homolog annotation: Hit_ID=UPI000034F0CE; Match level="QueryCoverage =48%, HitCoverage=34%, E-value=9e-28, Identity=34%"; Hit description =protein binding
  Pfam annotation: Domain name=Ank; Domain location=127-163; Score=8.9; E_value=1.6; Accession=PF00023.20; Description=Ankyrin repeat
  Pfam annotation: Domain name=Ank; Domain location=165-198; Score =20.7; E_value=0.0051; Accession=PF00023.20; Description=Ankyrin repeat
  Pfam annotation: Domain name=Ank; Domain location=202-235; Score =25.3; E_value=0.00022; Accession=PF00023.20; Description=Ankyrin repeat
  Pfam annotation: Domain name=Ank; Domain location=4-36; Score=22.2; E_ value=0.0019; Accession=PF00023.20; Description=Ankyrin repeat
  Pfam annotation: Domain name=Ank; Domain location=50-82; Score=19.5; E_value=0.012; Accession=PF00023.20; Description=Ankyrin repeat
  Pfam annotation: Domain name=Ank; Domain location=84-118; Score=8.8; E_value=1.7; Accession=PF00023.20; Description=Ankyrin repeat
  Pfam module annotation: Pfam domain module=Ank::Ank::Ank::Ank::Ank::An k; Domain location=127-163::165-198::202-235::4-36::50-82::84-118
RNVRGDTPLHVAARSKKYETVKLILSQYATKKSTYDEMKDKKIARETNECGNTPLHEAVYSGDVDVVKEIFDQDKAVAYCLNKSKRSPLCLAVVNGNEQILELLLQIPLPADQPLSQCRRSSPLHTAGRLPVHLACKRGCVEMVKEFFEPGSGWPINPYVLLNQKGQNILHIAAKNGRDNVVEYLLGNCNTDDLHINQKDYDGNTSLHLASKNLFPQVIKLITEDNRTDLNLTNEDGLTAGDISKTFKHPMLRRREPEKDTSDFQLQSQPEKDTRQAFLIVAALLMTVSFAAAFTVPGGVYSSDDPNPKIRGTAVLARKPLFVIFTIFNIITMCSSAMACALLSVGMVLQSELTPTIQFSLVCLLYAFFAAPVAFIAAVVIVVANNYLLTIATSGIGCVLAFYTVTLILPSVLSYLQEKANTDAIIVHSPILRPLYCCSILFSTIGGKPKILLHSQKANKDKDN

SEQ ID NO: 164696 - protein, 112 aa, Glycine max
  Coding DNA Sequence Number=SeqID_47918
MDWFFRISHPFMTPSHALDPLPDGHAPQPRVVPQAPQADIPHVPEPGAPSTSARPAVEKPRHAEVFHGIAERLERHLSLGVITLGSSTHEVIEECLRMAMSVRQDLLVYVRS

SEQ ID NO: 164697 - protein, 177 aa, Glycine max
  Coding DNA Sequence Number=SeqID_47919
MYVENVLFVQQRRATETHSRKSVKSNESKTAKSNAEGKKNIEVSVNSATDENGEKSELRSRDPRDRECRRERSHKAENAKLLSIGRGGAKRHRCSGRRSSRRSCRRSSFAIIAQRKKRTNPERDCIADLGRSCFRFCEKKQKPRGKVKYWKVPHTQVNSNVFATALLGFVSQITLYL

SEQ ID NO: 164698 - protein, 63 aa, Glycine max
  Coding DNA Sequence Number=SeqID_47920
MGSSKLLGIMAMLFIVLLPMAAKGDNITDFFGLQSGSKLVYYNFKCDIGYEILQIRFVKKWNV

SEQ ID NO: 164699 - protein, 634 aa, Glycine max
  Coding DNA Sequence Number=SeqID_47921
  Gene Ontology: Mol. function=protein serine/threonine kinase activity; Cellular component=cellular bud neck; Biological process =protein amino acid phosphorylation
  Homolog annotation: Hit_ID=Q8SA64; Match level="QueryCoverage=99%, HitCoverage=99%, E-value=0.0, Identity=65%"; Hit description=NIMA -related protein kinase
  Pfam annotation: Domain name=Pkinase; Domain location=4-261; Score =198.4; E_value=1.7e-56; Accession=PF00069.15; Description=Protein kinase domain
  Pfam annotation: Domain name=Pkinase_Tyr; Domain location=4-261; Score=-15.2; E_value=1.5e-11; Accession=PF07714.7; Description =Protein tyrosine kinase
  Pfam module annotation: Pfam domain module=Pkinase::Pkinase_Tyr; Domain location=4-261::4-261
MEQYEILEQIGKGAFGSALLVRHKHEKKKYVLKKIRLARQTERSRRSAHLEMELISKFRNPFIVEYKDSWVEKGCYVCIIIGYCEGGDMAEAIKKANGILFPEEKLCKWLVQLLMALEYLHMNHILHRDVKAWNRRLKFCLQVINDEAGDFGLAKMLTSDDLASSVVGTPSYMCPELLADIPYGSKSDIWSLGCCIYEMTAHKPAFKAFDIQALINKINKSIVAPLPTKYSSSFRGLVKSMLRKNPELSPSASELLGHPHLQPYVLKVHLKLNSPRQSTLPVHWPESNCMKKTRFLVPEDYPVSIYRDKRHSFTNDRTLNPSVSGADQDSVCSTLEIDCTPDHLNQRLAELRIGNSHQVKSIQKPVVSRTSSIIVKTPKFTSSKVSATNKKSMESSKNHKMEELLDIWSSLKLPLSQNTTKSANTNRRASFPLPTRGGIRQPPCRSVSLLSHVSSPDISVNSPRIDKMAEFPLTSYEDSLFPIKRASSSARGSSGFPSYSNHSTVIDKCTVEVYDTASNKPGCMDAWQGIKQSMLKEIDEDKSGSSDQNATAGASSHTSSDLRRRQFDPSSFQQRAEALEGLLEFSARLLQQARYDELGVLLKPFGPGKVSPRETAIWLSKSFKENTFNPEESM

SEQ ID NO: 164700 - protein, 420 aa, Glycine max
  Coding DNA Sequence Number=SeqID_47922
PDVHAPVAELTCMVDTCLWVLRRIFGSWKLNVPLSSEPGDEFVKPSNVDECCPMSGCFCQVVRDGLVFGVSGELPPIIEKSFSPINGLEFDFGSLFIVLPPTSEGTSIHHNAVPRLRILIEVPLIASHPRQKVRTSCQTGGGTSRPRGRVRPSAAIREPVSVIMILPPSASGGAMRAGGDVRSSPCIQPSVGAGSPSSTLAVVGYEWVRDDVLKYRSTLTSSASFVVFQRQEKLANAKDSCKLAVQTCGSDDFPFLRCALLEHLNVALSQLHPNSWATVKAFEILSPFFNIRPSVLVFLFFFQMKLSGKIGWVLATDGMPLVFNRDAEPRSSFYRQSNPTRFKSYDEDLLTLVERFDKVIFEQLPVSLDARAMLSLLLASDPLTALDGIIGDFAWRPLVKQVRLVGGTVPPSAAAPSVGE

SEQ ID NO: 164701 - protein, 81 aa, Glycine max
  Coding DNA Sequence Number=SeqID_47923
MARIKEKAVKLQAARRYNTKMIKGDTRARGRRRRRQAAKTTAGRATGVDEGSYIMEAPVVFTPALNKEVATAEGKITTEPT

SEQ ID NO: 164702 - protein, 348 aa, Glycine max
  Coding DNA Sequence Number=SeqID_47924
  Gene Ontology: Mol. function=ATP-dependent peptidase activity; Cellular component=integral to membrane; Biological process=ATP -dependent proteolysis
  Homolog annotation: Hit_ID=Q75GI8; Match level="QueryCoverage=98%, HitCoverage=86%, E-value=1e-98, Identity=50%"; Hit description =Expressed protein
  Pfam annotation: Domain name=DUF81; Domain location=9-322; Score=0.4; E_value=1.3e-05; Accession=PF01925.9; Description=Domain of unknown function DUF81
DLEPSWRLVLATVIGFLGSACGTVGGVGGGGIFVPMLNLLLGFDTKSAAALSKCMIMGASASSVWYNVRVPHPTKEVPILDYDLALLFQPMLMLGITVGVALSVVFPYWLITVLIIILFIGTSSRSFFKGIEMWREETIFKREKTKQRATLVDSHGEDKTGMYTFTINDVEACSPWYWVLFGLQFPIALLVFGYEAVKLYKEHKRRMSTRNLECIWGIVGGLLGSGGGFVLGPLLLEIGVIPQVASATATFVMMFSSSLSVVEFYLLKRFPIPYALYLTSVSVLAGFWGQFFVRRLIACLGRASIIVFILSGVIFASALTMGVVGIENSIQMINNHEFMGFLGFCSSQ

SEQ ID NO: 164703 - protein, 59 aa, Glycine max
  Coding DNA Sequence Number=SeqID_47925
MTGAKLESFWRWRDWREPSLKRKLSCEALDEILSDCEYFMLVCFCLDHVDACLARVTQH

SEQ ID NO: 164704 - protein, 356 aa, Glycine max
  Coding DNA Sequence Number=SeqID_47926
  Gene Ontology: Mol. function=protein serine/threonine kinase activity; Cellular component=spindle pole body; Biological process =protein amino acid phosphorylation
  Homolog annotation: Hit_ID=Q1SN39; Match level="QueryCoverage=89%, HitCoverage=93%, E-value=1e-160, Identity=86%"; Hit description =Protein kinase
  Pfam annotation: Domain name=Pkinase; Domain location=4-352; Score =35.2; E_value=1.2e-10; Accession=PF00069.15; Description=Protein kinase domain
  Pfam annotation: Domain name=Pkinase_Tyr; Domain location=2-342; Score=-136.3; E_value=0.00041; Accession=PF07714.7; Description =Protein tyrosine kinase
  Pfam module annotation: Pfam domain module=Pkinase::Pkinase_Tyr; Domain location=4-352::2-342
MRYVALKVQKSAQHYTEAAMDEITILQQIAEGDPDDKKCVVKLLDHFKHSGPNGQHVCMVFEYLGDNLLTLIKYSDYRGLPIAMVKEICFHILAGLDYLHQQLSIIHTDLKPENILLLSTIDPSKDPRKSGAPLILPNSKDKMAMESAGMKDTKMLNGDLVKNHKKKIKRKAKQAAHGCVEKEASEGVEGNAETSGAVESSPNASSAREQTSSSAGTSQLSDADGTKLKEQGNKRGSRSMRQKLLASVDLKCKLVDFGNACWTYKQFTNDIQTRQYRCPEVILGSKYSTSADLWSFACICFELATGDVLFDPHSGDNFDRDERSKLPVFWKGLPMKVLTGKVKLSIAVCSHQNIGS

SEQ ID NO: 164705 - protein, 168 aa, Glycine max
  Coding DNA Sequence Number=SeqID_47927
MSHKENKNVIEFLDEQAFYYDEEDEQWFKEKDDQWAKNIPCYKEDAAKVPSPPRVHAPAPQRVYTFANLVSATSAPIARVPASQESPEETFNDIASSQVHAPISHQHHLLPQNMKSNRVMLAGDSSRSILLGGFFMFMVTSLSLAIGASCVSLAHTMPTLRLVYYMPY

SEQ ID NO: 164706 - protein, 113 aa, Glycine max
  Coding DNA Sequence Number=SeqID_47928
  Homolog annotation: Hit_ID=Q1S8N0; Match level="QueryCoverage=61%, HitCoverage=30%, E-value=7e-07, Identity=52%"; Hit description =Leucine zipper, homeobox-associated; Homeodomain-related
MMNVMSGMSSSLDVQKWDFYLMIDALVMKLKTMLREQASRTQQQVSTGYTEISGDQETVESTSEALRCSKRGTLHQQQQNNNNIGEGNCSFTLEDHYNTVPVPYWPGVPYYHP

SEQ ID NO: 164707 - protein, 581 aa, Glycine max
  Coding DNA Sequence Number=SeqID_47929
  Gene Ontology: Mol. function=DNA binding; Cellular component=nucleus; Biological process=porphyrin biosynthetic process
  Homolog annotation: Hit_ID=Q0WU91; Match level="QueryCoverage=89%, HitCoverage=90%, E-value=8e-80, Identity=36%"; Hit description=GTL1 -like protein
  Pfam annotation: Domain name=MAT1; Domain location=227-387; Score= -83.6; E_value=0.063; Accession=PF06391.3; Description=CDK-activating kinase assembly factor
  Subcellular localization annotation: CTP_CleavageSite=28; ConfidenceScore=5.21e-01
MFDGVPDQFHQFITPRTSQPLHLPFPLHASGTPNTTFPSNFDPYNNPSHQLPLQPNNLLHPLHHKDEEKEENTTTVPMNFEIQRDQRQQLPELIDPWTTDEVLTLLRIRSSMESWFPELTWEHVSRKLAELGYKRSAEKCKEKFEEESRYFNNNINYAKNNNNSTSNYRFLSELEQLYHQQGSSGDHLEKMTQPPLQKQGRMDHHALELEEEEGDSRNVIVDASVTKIQSDEALAVEKITKDRKRKRSDRFEMFKGFCESIVHKMMTQQEEMHNKLLEDMMKRDEEKFTREEAWKKQEMEKMNKELEMMAREQAVAGDRQAKIIQILNKFSATTSSPASHTLKKVNTHISQNPNPSQTENPTLSVAQDTLIPSTSSTSTPAPAPPQNPSSCSLNSQNNNHINNNIPVEKNSILNKGSSSNEKDDVGRRWPKDEVLALINLRCTSVNNNNNNEEKEGNNKVPLWERISQGMSELRYKRSAKRCKEKWENINKYFRKTKDITKKRSLDSRTCPYFHQLSSLYNQGKLVLQSESHLNNTPPDQNPEQVKPDQTTQAHESSSQVGSGSGFSVQQQQVPSLDFDQF

SEQ ID NO: 164708 - protein, 66 aa, Glycine max
  Coding DNA Sequence Number=SeqID_47930
MVRIHMRSSWEPQRTEEKWGFERKNIELGNGVVAIDGSGGTTWSVVVVSVGEGKNGRKGRRTMEIR

SEQ ID NO: 164709 - protein, 98 aa, Glycine max
  Coding DNA Sequence Number=SeqID_47931
MRVRARLWGLRRGFELREGRWLQGVDAGEVDDGKDYQVGMWGSKEKKVSYDSLHSLELSSRDWVNSSQWWGDIHCNNDFPVGSNGWFENCIQRKVRDG

SEQ ID NO: 164710 - protein, 46 aa, Glycine max
  Coding DNA Sequence Number=SeqID_47932
MCDKCAFGFNKYGALNELVPLCNKSGTGSLDAMFRVARTACARSYI

SEQ ID NO: 164711 - protein, 367 aa, Glycine max
  Coding DNA Sequence Number=SeqID_47933
  Gene Ontology: Mol. function=protein binding; Cellular component =nucleus; Biological process=cell differentiation
  Homolog annotation: Hit_ID=Q5SNH3; Match level="QueryCoverage=94%, HitCoverage=94%, E-value=1e-123, Identity=63%"; Hit description =Putative pollen specific protein SF21
  Pfam annotation: Domain name=Abhydrolase_1; Domain location=75-309; Score=16.4; E_value=0.00042; Accession=PF00561.10; Description =alphabeta hydrolase fold
  Pfam annotation: Domain name=Ndr; Domain location=21-318; Score =417.2; E_value=2.3e-122; Accession=PF03096.5; Description=Ndr family
  Pfam module annotation: Pfam domain module=Abhydrolase_1::Ndr; Domain location=75-309::21-318
MGESSDSVSIDIDLIPLGGKECTVKTSKGSVSVLVCGDQEKPALITYPDLALNYVSCFQGLLFCPEAASLLLHNFCIYHIDAPGHELGADVISSDEPLLCVDDLADQIAEVLDFFGLREVLCLGVTAGAYVLTLFAMKYKERVLGLILVSPICKSPSWTEWLYNKVLMNLIYFYGMCGVLKECLLQRYFSKVFFTFFPSSLIMKELRCSVQGAESDIILTCRRLLDERQSLNVMRFLQAINVRHDLTEGLKDLQCRTLIFAGESSPFHAESVYMSTKMNHKICALVEVQACGSLVTEEHPNSMISPLEGFLMGFGYHRQTHAASSSSNCSNPASPTSHYSCIAPELLSPESLGIKLKPIRTRVDVQF

SEQ ID NO: 164712 - protein, 279 aa, Glycine max
  Coding DNA Sequence Number=SeqID_47934
  Homolog annotation: Hit_ID=Q019E6; Match level="QueryCoverage=48%, HitCoverage=56%, E-value=1e-15, Identity=31%"; Hit description =Homology to unknown gene
  Subcellular localization annotation: CTP_CleavageSite=21; ConfidenceScore=5.16e-01
MAKICCWSGTPPLQPLQKQFRRNHGVQNCSNTNTLNRRKIYACLNREKESETPQILKIAVSGVTELLRLFSPSSHQTSLEKQRDQIEFPASSVDDVLRIIKSDYDNAYFVTGNFSSSIYAENCIFEDPTIKFRGRELYARNLKLLVPFFDSASIILQKIDKDVDSDTNFVLASWKLRTNLKLPWRPLISIDGSTVYELNEDYKIVRHVESWNISAVEAVLQIFSFKSKNPALPSSSRLPLPFTSVFIVQNEISPFKQANSPSPDLQYRFQGVQARMEVM

SEQ ID NO: 164713 - protein, 158 aa, Glycine max
  Coding DNA Sequence Number=SeqID_47935
  Gene Ontology: Mol. function=calcium ion binding
  Homolog annotation: Hit_ID=Q6ZFI7; Match level="QueryCoverage=77%, HitCoverage=97%, E-value=3e-12, Identity=36%"; Hit description =Calcium-binding EF-hand family protein-like
  Pfam annotation: Domain name=efhand; Domain location=52-80; Score =17.3; E_value=0.054; Accession=PF00036.22; Description=EF hand
  Pfam annotation: Domain name=efhand; Domain location=92-120; Score =29.0; E_value=1.7e-05; Accession=PF00036.22; Description=EF hand
  Pfam module annotation: Pfam domain module=efhand::efhand; Domain location=52-80::92-120
MHTCPEDNNITVFLRLRPYSSLLFQKRTMSVAVVNSFTITEFVNDKAKFDGFVNEWFARIDENGDGKLSRDKIRGRLGMLLPFGSESPPQQENEEIFKRFDEDGNGALDLNEFKALMTEIMNAAARSIGGSPVIVVLGKDSLLMKAVQHELATPSSHS

SEQ ID NO: 164714 - protein, 331 aa, Glycine max
  Coding DNA Sequence Number=SeqID_47936
  Homolog annotation: Hit_ID=Q9LUA7; Match level="QueryCoverage=70%, HitCoverage=76%, E-value=1e-17, Identity=26%"; Hit description =Arabidopsis thaliana genomic DNA, chromosome 5, P1 clone:MIF21
  Pfam annotation: Domain name=DUF868; Domain location=18-330; Score =55.7; E_value=1.7e-15; Accession=PF05910.3; Description=Plant protein of unknown function (DUF868)
  Subcellular localization annotation: CTP_CleavageSite=56; ConfidenceScore=5.52e-01
MIPACFSQPNTPSSSSITQVPQNLVTCIYQTQLCNSSTYLTLTWCRTLLSHSLTIYAPHTFSITIPLNPSTFSFFRTRPESKSIYLTRPHKRSQKIKLHWDFSETLFSTRNSAEPESCFYLAICCNGRVEFFLGDLVLGLPVQLSTHQPSDQTLVSRREHVFGSKSYVSRGEFMGSKHELEIELCSGEELRVKADGQVCLVVKRLAWKFRGNEKIFIDGVEVEFYWDVLNWVVNSEDGNGNNGHGVFVFQVGDGGAVWPEMVGPEKKLMKKRLVGPTMAPSIFRTSPSSSSVLQWAEESSDGGRSSCSSSTRSCGSSNGGFSLLLYAWWRD

SEQ ID NO: 164715 - protein, 110 aa, Glycine max
  Coding DNA Sequence Number=SeqID_47937
MGHDHLEIPIELDDASWKERCNKRMEELKITKLSGQDSTGSQAGLLHKELVGKKKTMISELYKAVENENVDNFIEVLKQECMERKLPLSDIIINQVTATRGGNRSGQTRL

SEQ ID NO: 164716 - protein, 202 aa, Glycine max
  Coding DNA Sequence Number=SeqID_47938
  Homolog annotation: Hit_ID=UPI0000162C35; Match level="QueryCoverage =83%, HitCoverage=27%, E-value=5e-13, Identity=31%"; Hit description =protein binding
  Pfam annotation: Domain name=Ank; Domain location=105-136; Score=8.8; E_value=1.7; Accession=PF00023.20; Description=Ankyrin repeat
  Pfam annotation: Domain name=Ank; Domain location=176-201; Score=2.4; E_value=14; Accession=PF00023.20; Description=Ankyrin repeat
  Pfam annotation: Domain name=Ank; Domain location=32-64; Score=15.7; E_value=0.17; Accession=PF00023.20; Description=Ankyrin repeat
  Pfam module annotation: Pfam domain module=Ank::Ank::Ank; Domain location=105-136::176-201::32-64
METWIALLTCWVRFVEKGTYLCLLFFYQVTWTGDSLLHLAANLGKEKIVELICDHFPELLLRRNVKSDTVLDAAVRSKNSTIDQVHSLQLSHREDKEITKEKNEYGDTPLHEAVYSDGDVGVIKEILLVDNDVVYYLNKSRQSPQYLAVLRGNKEILNRLLEILVPADKPLPQQFIGNSPLHAAVQKQDPDLIQHIIEKDPS

SEQ ID NO: 164717 - protein, 413 aa, Glycine max
  Coding DNA Sequence Number=SeqID_47939
  Gene Ontology: Mol. function=transferase activity, transferring hexosyl groups; Cellular component=integral to membrane; Biological process=carbohydrate biosynthetic process
  Homolog annotation: Hit_ID=UPI000034F0CE; Match level="QueryCoverage =82%, HitCoverage=59%, E-value=2e-23, Identity=24%"; Hit description =protein binding
  Pfam annotation: Domain name=Ank; Domain location=106-138; Score =25.1; E_value=0.00026; Accession=PF00023.20; Description=Ankyrin repeat
  Pfam annotation: Domain name=Ank; Domain location=152-184; Score =22.2; E_value=0.0018; Accession=PF00023.20; Description=Ankyrin repeat
  Pfam annotation: Domain name=Ank; Domain location=186-220; Score=9.4; E_value=1.4; Accession=PF00023.20; Description=Ankyrin repeat
  Pfam annotation: Domain name=Ank; Domain location=253-289; Score =15.6; E_value=0.17; Accession=PF00023.20; Description=Ankyrin repeat
  Pfam annotation: Domain name=Ank; Domain location=290-323; Score =25.3; E_value=0.00022; Accession=PF00023.20; Description=Ankyrin repeat
  Pfam annotation: Domain name=Ank; Domain location=72-105; Score=10.6; E_value=0.91; Accession=PF00023.20; Description=Ankyrin repeat
  Pfam module annotation: Pfam domain module=Ank::Ank::Ank::Ank::Ank::An k; Domain location=106-138::152-184::186-220::253-289::290-323::72-105
MDQLRIDVDFPSPDAASQVGLLHKEIVRKAMIYKLYQVDEEGDADKFGEELKQQCEENKLRLPDVFDKVTLTGDSLLHVAADLGQERMVEMICDLFPVLLTRRNVRGDTPLHIAVRSKNTSMVNLILSQYATKKSTHDEMKDKEITRETNECGDTPLHEAVYSGDVDVVKDIFDQDKDVVHCLNKSKRSPLCLAVVNGNEQILKLLLQIPLPADQPLSQCRRSSPLHTAIQHQKEEFLELEWPINPYIVLNQKGQNILHIAAKNGRGGVVEYLLRNCKTYDLSITQKDYDGNTPLHLASKNLFPEIIHLITEYYRTGLNLTNKDGLTARDISETFEHPMLRKRKSVSMELLKRAGVPVNHMLHSQRQPQPEKDTFDFQLQSHVQPGKDIREAFLIVAALLVTVSFAAAFTVPG

SEQ ID NO: 164718 - protein, 106 aa, Glycine max
  Coding DNA Sequence Number=SeqID_47940
  Subcellular localization annotation: CTP_CleavageSite=55; ConfidenceScore=5.39e-01
MACGFLSLGIFLQSELTLTIQPSFLYLSSAFFTAPVAFIAAVVLVVANNRLLTIVTSVIGCLLTFYTVLLMLLSLLVSPLDGTSTTKANKDKDKDNGLEEHVQQGN

SEQ ID NO: 164719 - protein, 105 aa, Glycine max
  Coding DNA Sequence Number=SeqID_47941
MLDPWEFKSIDGCTVKNIIQAWRFGMTTTKEVKIKQGVTDSHDSWGVKRKNVMKEGGLSFMKSYTQVAVEHKKPITLRWEKVQTQGEIIKEGRWNGEVINMEECN

SEQ ID NO: 164720 - protein, 621 aa, Glycine max
  Coding DNA Sequence Number=SeqID_47942
  Gene Ontology: Mol. function=protein kinase activity; Cellular component=integral to membrane; Biological process=protein amino acid phosphorylation
  Homolog annotation: Hit_ID=Q1S8N8; Match level="QueryCoverage=99%, HitCoverage=94%, E-value=0.0, Identity=66%"; Hit description=Protein kinase
  Pfam annotation: Domain name=LRR_1; Domain location=101-122; Score =9.7; E_value=4.3; Accession=PF00560.23; Description=Leucine Rich Repeat
  Pfam annotation: Domain name=LRR_1; Domain location=124-145; Score =11.5; E_value=2; Accession=PF00560.23; Description=Leucine Rich Repeat
  Pfam annotation: Domain name=LRR_1; Domain location=148-171; Score =11.2; E_value=2.3; Accession=PF00560.23; Description=Leucine Rich Repeat
  Pfam annotation: Domain name=LRR_1; Domain location=53-75; Score =12.0; E_value=1.6; Accession=PF00560.23; Description=Leucine Rich Repeat
  Pfam annotation: Domain name=LRR_1; Domain location=77-99; Score =17.0; E_value=0.066; Accession=PF00560.23; Description=Leucine Rich Repeat
  Pfam annotation: Domain name=Pkinase; Domain location=334-588; Score=- 15.7; E_value=1.3e-07; Accession=PF00069.15; Description=Protein kinase domain
  Pfam annotation: Domain name=Pkinase_Tyr; Domain location=333-588; Score=8.1; E_value=5.7e-13; Accession=PF07714.7; Description=Protein tyrosine kinase
  Pfam module annotation: Pfam domain module=LRR_1::LRR_1::LRR_1::LRR _1::LRR_1::Pkinase::Pkinase_Tyr; Domain location=101-122::124 -145::148-171::53-75::77-99::334-588::333-588
DLHGYLLSNWTGGDACIAAWRGVLCSPNGRVTALSLPSLNLRGALDPLTPLTHLRLLNLHDNRLNDTISLLFSNCTNLQLLYLSSNDFSGEIPPEISSLKSLLRLDLSDNNLRGKVDVISNLTQLITLKLQNNLLSGEIPDLSSSMKNLKELNMTNNEFYGHLPSPMLKKFSSTTFSGNEGLCGATPLPGCSFTTTPPKDNGNNNNNEKEPSSQTTVPSNPSSFPETSVIARPGKEQRHRGLSPGAIVAMVVANCVALLVVASFVVAHCCARGRGSSLVGSRESYGKRKSGSSYNGSEKKVYGGGESDGTSGTNRSRLVFFDRRSEFELEDLLRASAEMLGKGSLGTVYRVVLNDGCIVAVKRLKDANPCARHEFEQYMDVIGKLKHSNVVRLKAYYYAKEEKLLVYDYLSNGCLHALLHGNRGPGRIPLDWTTRISLVLGAARGLAKIHAEYNFGLSLLLNPVHAIARLGGYRAPEQEQNKRLSQQADVYSFGVLLLEVLTGRAPSLQYPSPARPRMEEEPEQATVDLPKWVRSVVREEWTAEVFDQELLRYKNIEEELVSMLHVGLACVAAQPEKRPTMEEVVKMIEEIRVEQSPLGEDYDESRHSLSPSIPTTEDGLA

SEQ ID NO: 164721 - protein, 359 aa, Glycine max
  Coding DNA Sequence Number=SeqID_47943
  Gene Ontology: Mol. function=kinase activity; Cellular component =nucleus; Biological process=amino acid biosynthetic process
  Homolog annotation: Hit_ID=Q1SN30; Match level="QueryCoverage=75%, HitCoverage=51%, E-value=1e-120, Identity=78%"; Hit description =Aspartate/glutamate/uridylate kinase; MADF; Homeodomain-related
MASCDDDDDFSLLRDDTHHHLHQPYAPHHHHFSPSAVSVASASSVPPKPAAAADDDAEDFSNPFDEDDDGEKRKERDEIGEGAASYGFNNKRSKTTAPSNGVGAVSGGAEYRKDREEWSDTAIVCLLEAYTEKFTQLNRGNLRGRDWEEVAAVVSERCENQSKSVEQCKNKVDNLKKRYKLERHRMSSGCISTSHWPWFKQLEQIVGNSLPAKFSDEDKAVISAGTSPRQSKRYGVATPSTGGPANSMKSKALSNSRWRRVVLKISGAALTGSDTCNIDPKVAMLVSREVAIASRLGVEVAIVVGGRNFFSGEAWVNVTGLERCTAYQWDRKYLGCSAGEGHSWGVNSDLTCISCKVYW

SEQ ID NO: 164722 - protein, 481 aa, Glycine max
  Coding DNA Sequence Number=SeqID_47944
  Gene Ontology: Mol. function=DNA binding; Cellular component=nucleus; Biological process=regulation of transcription
  Homolog annotation: Hit_ID=Q1S8N2; Match level="QueryCoverage=88%, HitCoverage=86%, E-value=1e-120, Identity=56%"; Hit description =Homeodomain-like
MEPIGLGCGMFSGLVGVESPLQQQQQEQNPHHLQHHPQMVPYATHHDTENPHHPHLHHSIKQGYPPFLSKTKQQQQQQQQQSSFSDDDEPGSADDDPKKKVSPWQRMKWTDTMVRLLIMAVYYIGDEAGSEGTDKKKASGLMQKKGKWKSVSGAMMEKGFYVSPQQCEDKFSDLNKRYKRVNDILGKGTACRVVENQNLLDSMDLSPKMKEEVKKLLNSRHLFFREMCAYHNSCGNGNNNAPQQGESGGEVSQPQSQSQAQPHHQQQQQPQQQRCFHSSEVANLGGSGVEGLRVLKVGNGEEGDDDEDEDDDESEDDSDEDEDDLGEGGSRGHVGHGHEDIEDENDGRTMRKRARKVGGGVSNSLSPQTMQQLSAEVTGMFQDVGKSAWDKKQWMRNRMKQLEEQRISYHTQAFELEKQRLKWARFSSKKEREMERAKLENERRKLENERMVLLIRQKELELMGLQPQQQQHQQQQQHSST

SEQ ID NO: 164723 - protein, 131 aa, Glycine max
  Coding DNA Sequence Number=SeqID_47945
MGAKHLTRTKERSHVTKQRSPDEIRLEKNKLVDEVESAIIEKDKIAKVVDDLKAQLIESESRLEVSKMRASRKREANKELEEELLVLKRAMEQHEKGFNKAARQAGFFTKDLDLGLFDPFNDVKDGVLLDE

SEQ ID NO: 164724 - protein, 68 aa, Glycine max
  Coding DNA Sequence Number=SeqID_47946
MPGKWSTGTVMHLSYPSVEATDGDQLNKANDSGIKMMPSMKMRRQSSYEQDVHVEVAVPSGTLVQQQQ

SEQ ID NO: 164725 - protein, 323 aa, Glycine max
  Coding DNA Sequence Number=SeqID_47947
  Gene Ontology: Mol. function=transferase activity; Cellular component= integral to membrane; Biological process=carbohydrate metabolic process
  Homolog annotation: Hit_ID=Q1S8P3; Match level="QueryCoverage=91%, HitCoverage=62%, E-value=1e-135, Identity=81%"; Hit description =Three-deoxy-D-manno-octulosonic-acid transferase, N-terminal
  Pfam annotation: Domain name=Glycos_transf_N; Domain location=37-222; Score=249.9; E_value=5.3e-72; Accession=PF04413.6; Description=3 -Deoxy-D-manno-octulosonic-acid transferase (kdotransferase)
MMKKGLVVYKLYRALTHGLSPLIRLHLRWRRFLGLEHPHRWLERLGLPSQPRHAGPLLWFHAVSLGEGMIAVPVIKHCIRRMPHLNVLMTITTMSSFEVLSKSLPSGIILQFSPVDTPTSIHSFLDYWKPNAIVLMESELWPNLIMDASRNGIKLALLNARMSEKSFKIWSRPVLLPLISLMLSKFSLIVPLSTEQGIRFQLLQAPPYIINFSGDLKYVIEDFGVNERGRIDIDNLRLELTQKKVWMASSIHSGEEEIILGVHNALMQQQPNTMTIIVPRHPQEGREIAKVSFIGGHPYLRQSLILLGNHFNKVYIRKRQRGN

SEQ ID NO: 164726 - protein, 162 aa, Glycine max
  Coding DNA Sequence Number=SeqID_47948
MYDTPVELKWDGSKFGLSNVDASFFLTFSDVNEIVAGYKCLNISILQLWMLFLDEWSSTLGHASVYGFLEPQSIHNAKDRRAECEHYLQAWLKESQREVYLGAYLNQGHWQLVVLCPATNVVAWFCSLHVDHAIIISSAMKSANTTADGTNNPATPKWVEVK

SEQ ID NO: 164727 - protein, 105 aa, Glycine max
  Coding DNA Sequence Number=SeqID_47949
  Gene Ontology: Mol. function=catalytic activity; Biological process =metabolic process
MAYTTIPDHNIQSTEQGMAQALRAGEHLHRVIVLYVPLCPYLIDAPRAQTVFLEEEDYRREGRVASSRTRFHELSFGREDKGYKGNTQTFWKVLLSTREFQFLTF

SEQ ID NO: 164728 - protein, 168 aa, Glycine max
  Coding DNA Sequence Number=SeqID_47950
  Homolog annotation: Hit_ID=Q47522; Match level="QueryCoverage=30%, HitCoverage=64%, E-value=5e-24, Identity=100%"; Hit description=LacZ protein
MGNLASLGVEIGQIAGGLAVALPGAMVSLGIAVGVAYAALSDFGKVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 164729 - protein, 94 aa, Glycine max
  Coding DNA Sequence Number=SeqID_47951
MNHKSGDPGHTTPPPPRKKFITSAGILALPIKALIQFVTTYPFMGERGEAHGCVFQRRKMRGVATNVYLWKTLEKPDENPEIGQMQAKGPSGEG

SEQ ID NO: 164730 - protein, 163 aa, Glycine max
  Coding DNA Sequence Number=SeqID_47952
MFIRLTTRVFPPGQCDSNVSMTDLVSAEDDVNLRVSTGLSVPIGEGRRRRPKKNVYTDNHSGISACQRDSNVSMTDLTAKKNVYTDNHSGISACQRDSNVSMTNLVSAEDDVNLRVSTGLSAAIDEGHRRRRQSLRAIRLFVLQTAKKNVYTDNHSGISARQR

SEQ ID NO: 164731 - protein, 269 aa, Glycine max
  Coding DNA Sequence Number=SeqID_47953
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=4e-35, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MHVLAIRGIPVLTFRGLHVLAFIGLHVLDFKGLHILAIKGQHILTFRRGLHLLIFRGQHALTFRGLHVLAFRGIQVLTFRGMHVFTFRGMHVLAFSGLHVLAFRRLHALTFRGLHALTFRGLHALTFRGVHVFAFRGLDVLAFRGLHTLAFRGLHILAGYTSSPLGDCTSSPLEGYMPSPLEDFTSSPSEESMSSPLEGYTPSPSKGFTPSPLEYCMSSPLVECTLSPLEGCTSSPSGGYTPSPSGGYTPSPSEGYMPSPSKDCTSSPS

SEQ ID NO: 164732 - protein, 66 aa, Glycine max
  Coding DNA Sequence Number=SeqID_47954
MVIRTFRQPGANEPVDAKRLTSSSAPFVIQGQRVRWQAKIPYGHSHLSSSKANKFDGIRMMLVVRF

SEQ ID NO: 164733 - protein, 108 aa, Glycine max
  Coding DNA Sequence Number=SeqID_47955
MARTKKTWEMTTEAAKEIAEKIGSFVPHGRQDVIAAAIGRPEHLGRVRAAGAGVTIKQYFGSAPWTSRNASSLPFEKLQQLTQQIRDQLKESITEKVTRQVMASFSHM

SEQ ID NO: 164734 - protein, 291 aa, Glycine max
  Coding DNA Sequence Number=SeqID_47956
  Gene Ontology: Mol. function=DNA binding
  Homolog annotation: Hit_ID=Q1S0F5; Match level="QueryCoverage=96%, HitCoverage=56%, E-value=3e-37, Identity=34%"; Hit description=IMP dehydrogenase/GMP reductase
MGPLQRQAFRKVYRKILDLTATEVFTEVVVSLAQYYDQPLRCFMFGDFQMVLTVEEFEEILGCPLGGRKPYLFSGFLPSLSKIAVVVGDSAKELDRMKQTRNDVVGLSRKYLEGKARDMASQEKWVPFADILALLIFWVVLFPNIDGLVDLAVIDAFLAYHHSKESPVVAILADLFDTFDRRCEKNSARIVCCLPVLCVWLISHLFQQDVRHPCPLQSYRSCVEKRRVDWDQHLAGIGGSAINWFPRWKEGKEGVLFSCGDYPNVPLIGTRGCINYNPALAIRQLGYPMRH

SEQ ID NO: 164735 - protein, 198 aa, Glycine max
  Coding DNA Sequence Number=SeqID_47957
  Homolog annotation: Hit_ID=Q1RUD8; Match level="QueryCoverage=64%, HitCoverage=40%, E-value=1e-09, Identity=26%"; Hit description=IMP dehydrogenase/GMP reductase
MGQLQRQAFRKAYGKIWDLARVEVSMEPISSLSQYYDQPLRCFTFEDFQLVPTVKEFEEILGCPLGGRKPYLFSGFYPSTTRVAKRLTLFLAFHHGKESPVVAILAMHDTFDQRCEKSGARIVCCTPALYVWLVLHLFLQEGRPVYPLQGHRSCVEKRKTNWDQLLASIEGRLLIGSLARREEESGFYLHAKDFQMFP

SEQ ID NO: 164736 - protein, 116 aa, Glycine max
  Coding DNA Sequence Number=SeqID_47958
MEEKKSKQLEEATKSGSIDTIIDPPSPIRRHVKWKMACTKKTCQMMSEAAKKIADKIVNSFVAHGRQDVLTAAIGQPEHPGRVCAAGAGVTIKQYFGQLQGPLAHLCPWFPKTWST

SEQ ID NO: 164737 - protein, 192 aa, Glycine max
  Coding DNA Sequence Number=SeqID_47959
MVKFDPEIVMEFYANAWPIKEGVRDMCSWVRGQWIPFDEHAINQFLGHPLVSSTRGGVWPPTFMRRISVSCYAFWGWRCCFATFSPVTITRTFPCRSFEGFMPLRQLVDPEKSNRALGFLALITSLCQFYGVAVVEAMPSKVILMMQKNQELSKVSSKDSRIKFQDSRFKNQVAKIKIQDSRFKNQEKPQSR

SEQ ID NO: 164738 - protein, 225 aa, Glycine max
  Coding DNA Sequence Number=SeqID_47960
  Gene Ontology: Mol. function=transporter activity; Cellular component= periplasmic space; Biological process=transport
  Homolog annotation: Hit_ID=Q28LE2; Match level="QueryCoverage=99%, HitCoverage=53%, E-value=2e-75, Identity=57%"; Hit description =Extracellular solute-binding protein, family 1 precursor
MAAMNGSPAFFDKDGNSTLTQPGAIKGAQLLVDLYQQGGAPKDSVNWGFNEIVSGFYSGKCAMLDQDPDALIAIKNSMAAEDFAVAPMPVGPSGKAFPTIGYTGWAMFKQGKQNDVAWPLITFLSNKTNNLAWAKFVGTLPIYKGAEQDPFYQTPQFAGWFKELNDPNYVPLTMPTHLKGWGYFNSVIVKESSQETLLGENDTKDMVQDWASYLSKEQKAWLASQ

SEQ ID NO: 164739 - protein, 126 aa, Glycine max
  Coding DNA Sequence Number=SeqID_47961
MAAGQLCILGGIWKLASGNRLPREVKLASGNRLPRIAMAAQLIHDRVVMECLEGVWETLEGNERCRFHGTIQLTATSLVSSSEEDPEEDLEELPPEPVVDDLDLPEDDEDPLPDVDSPEDIMSASE

SEQ ID NO: 164740 - protein, 134 aa, Glycine max
  Coding DNA Sequence Number=SeqID_47962
MATMMEAMMSMKKIMEANAVTIAATSTIAKVNPMPPSGLNQMNHPTLAMVGKDLGSTNGPMMCKFKMSTPSRHMACLPTYTSQCGAHKMPHHNLADFEPCLGYATEGQTVGDIPLKNTLEGPQYHPQPHPSHST

SEQ ID NO: 164741 - protein, 101 aa, Glycine max
  Coding DNA Sequence Number=SeqID_47963
  Homolog annotation: Hit_ID=Q6CQF2; Match level="QueryCoverage=43%, HitCoverage=53%, E-value=2e-10, Identity=72%"; Hit description =Kluyveromyces lactis strain NRRL Y-1140 chromosome D of strain NRRL Y- 1140 of Kluyveromyces lactis
MAARALGVPRHLRAPGVGLWAPHSARLETRTKESDMCASQRASKPVRRKEADWWDPPHTCRDPKDGELCLSGAKPEETLVEARSDTDVQIVRLTWAIGAKD

SEQ ID NO: 164742 - protein, 86 aa, Glycine max
  Coding DNA Sequence Number=SeqID_47964
MASTIFDDESCEGTNTEDPAVDFEREANRLEVEEDEGMEFPAELEMMVAQEGREMKPHQEETEVVNLDVDNEKKEVKVGTGMTTPI

SEQ ID NO: 164743 - protein, 95 aa, Glycine max
  Coding DNA Sequence Number=SeqID_47965
  Pfam annotation: Domain name=G-patch; Domain location=38-79; Score =20.0; E_value=0.0007; Accession=PF01585.13; Description=G-patch domain
MEVVEESLETSFQALEVVINAYVESPPVQPRAFGAPLMVARVMLGHGYEPRMGLGRNGDGVASSVEFKENRGRFGIGYKPTRVNPCPPKFELGNW

SEQ ID NO: 164744 - protein, 119 aa, Glycine max
  Coding DNA Sequence Number=SeqID_47966
MRYRSFDLHQLLSHFSKHGNKSNRQEVLPSQGQKPRYHQHQGIRAVDGTPPNASLPQDLRKDLRVDHSRGIRAVDWVPFKDVLALLIFGVVLFPNVDGLIDLAAIDAFLAYHHSKESPV

SEQ ID NO: 164745 - protein, 100 aa, Glycine max
  Coding DNA Sequence Number=SeqID_47967
IYVSSIFGQDVLDIVSDIVDPAQSVKDITDLCVQYFRAGCPGHCIRHRGSCSFNSSFDFYLALCIVQPDLRKMQGSCMSKHNMRTMKIECMQLAKQKHAK

SEQ ID NO: 164746 - protein, 166 aa, Glycine max
  Coding DNA Sequence Number=SeqID_47968
MVEEIHMLETKGATEAHQHQTSSKNDQLASASEGSNNQLKSDNQPAHEFGAHALHSHAIPEKQFQCLEMGSSSLAGNEEQHMGMEEDQWSQEKRSKLECQIASTPSMDGTVMGFMPYRRSGLEGLGSVSLTLGLRHGVEGVQQQHLQQEEELRRQFGGHMIHDFVG

SEQ ID NO: 164747 - protein, 595 aa, Glycine max
  Coding DNA Sequence Number=SeqID_47969
  Homolog annotation: Hit_ID=Q9SJJ3; Match level="QueryCoverage=6%, HitCoverage=6%, E-value=5e-07, Identity=65%"; Hit description =Putative homeodomain transcription factor
  Pfam annotation: Domain name=POX; Domain location=445-588; Score= -25.4; E_value=9.4e-05; Accession=PF07526.2; Description=Associated with HOX
  Subcellular localization annotation: CTP_CleavageSite=59; ConfidenceScore=5.63e-01
PIIAFAIIVALLSFIHPSSHFPFQTNTTFSTGIFTLPTKSHQNLFSIAPKEVVSGWNLEASTRSAGVGGVEQNLGFHLLLCFYVSRFTGWGELCEWVLHLQSYRHIDWEGVALFGFGGWNIVTNKVMMIVLDAGDIHSLVKGLLGLRPELHVAQQLRRDKLRIQNSSQQHLQEFSNNNLEHLSLHPGFNLDLLQVRNVRNGNMLDEAAAALYSSEMITFSNPLSAPRNPLECQELMMAQYGSTSFPHSSSTKEQQCEPRNLGASGMVNYNGSNPNNNNSTFYSSELNNNVSSEMGNSEIQIQKQFGEIHYPPSSSSSPPLYHNALQDMAYGVWGGNNNNHGESVLHYGNNELRFGGASLWTHNNSALGFKKINNEQLHDTNHPHQGLSLSLSSNSQQQSSKPCFEERSVVKPPSSPMKLNVLSNNNNNTVYRNVGPLGPFTGYATILKSSRFLRPCQQLLDEWCCQSGSKFAKRGVCDVPEWVSRDVSAASTSATALNVDESAAAKGGGNSGASSSMLYSSIENNNNNNSNNNNNSADGGAASSFCLSSRPECQKNKAKLLYMQEEHKEKRPNALKLLRATRSHFWCRLMWMQSS

SEQ ID NO: 164748 - protein, 95 aa, Glycine max
  Coding DNA Sequence Number=SeqID_47970
MLKKINPITVEENKACGDCTTSVVLMLASSSMAANRMKFTRKLDERELSNESDDIYHHSIPGMGGPGERTVGEEFSKHYWHHNPHNQGLRHTLIS

SEQ ID NO: 164749 - protein, 105 aa, Glycine max
  Coding DNA Sequence Number=SeqID_47971
MSSTVCKDHARKTPSGPEEFQQGPGVLALITGLYRFYGVSFTPNKVIRPPINRAFITKYCAPRQAQGEAPRQPGDSQQLAADSSPPPLESTSTHLQGLEHCLRYM

SEQ ID NO: 164750 - protein, 637 aa, Glycine max
  Coding DNA Sequence Number=SeqID_47972
  Gene Ontology: Mol. function=protein kinase activity; Cellular component=extracellular region; Biological process=protein amino acid phosphorylation
  Homolog annotation: Hit_ID=Q69TY8; Match level="QueryCoverage=92%, HitCoverage=89%, E-value=2e-49, Identity=27%"; Hit description =Receptor protein kinase-like
  Pfam annotation: Domain name=LysM; Domain location=190-233; Score =8.7; E_value=0.071; Accession=PF01476.10; Description=LysM domain
  Pfam annotation: Domain name=Pkinase; Domain location=363-633; Score =13.2; E_value=2.4e-09; Accession=PF00069.15; Description=Protein kinase domain
  Pfam annotation: Domain name=Pkinase_Tyr; Domain location=363-633; Score=3.9; E_value=1e-12; Accession=PF07714.7; Description=Protein tyrosine kinase
  Pfam module annotation: Pfam domain module=LysM::Pkinase::Pkinase _Tyr; Domain location=190-233::363-633::363-633
MGGRAYFPRQTTHKILNMIGACSAQLSYDQNNCTSNEIGQGTRYSCKSTKDSCRTFLVYRANKHLNTISEVSKLFNTNSDEVLLKNNLTPLSLFDELKQGKEVLIPVNCTCSGGYFQASLSYKVLNNTTYSEIACGVFEGLLKHLTLAEENISQGNKPEAGSELRVPLMCACPDSYNFTRSMKVKYLVTYPLILGDDPDKLSEKFGISTEEFYAVNSLNPFSTVYPDTVVFVPIKDGPIRIHDIPDSPSPPPGFLSTNPVVTTEESTQSSNLYIAGSVIGFFLFITLLASGLYMKRIRKSDDVHSISQTNSLTLWSPTRSSHISTQTGKNSTTWCLSPDLLVGIKYYLLNYSMEELQKATNNFSEENKIGHNRGREGDFVYKGSVNDHEVMIKRMRLEDTQQVIDLHSKINHINIVNLLGVCYVGKSNKDPWSYLVFELPKNGCLRDCLSDPCNPINWYKRTQIAFDIATCLYYLHCCSFPSYAHMNISSRNIFITANWRGKLADVGRALAASVTLTPTKRNSVEIPKGLVAPEYLLHGLVSEKVDIFAFGVVLLELISGRDNFDGKPIKDSLGFLLGEASEGGCFEGLRSFMDPNLKDYSLPEALCLSFLAKDCVADDPLHRPSMDDIMKVLAKMV

SEQ ID NO: 164751 - protein, 347 aa, Glycine max
  Coding DNA Sequence Number=SeqID_47973
MTAREYRALFVNLRESGYESSQISCSVILTGGVDCNDKTNGMDRSTEGDCPDKTNGMDRSTKEDYREKTNGMDRSTQEDCHERTNENDRSTLEDCHDKTNGIDWSTQEDCHEKSNEVDRSAQEGDDGGRDKIDGCLKENCFDSAKDYKDILPPEDANGKEMRAEPKLSGPLKELLDNNVTVNSIVSSNAATCEPPSGAPERVQSESCKEETLQKLGSRDSISNENLIMKCVENDKGEKSISSKRKRNMVDMHANASAMLVDNDNSNLIEDAHPSRICGNVVETSGSRSKRIRHISLSESDVKRDGRKTANNVDQPSSKSYGDNLSTRNKDVFLGKYGDLMRQGRFLG

SEQ ID NO: 164752 - protein, 584 aa, Glycine max
  Coding DNA Sequence Number=SeqID_47974
MLAKQNLNFDCKKEVVDEINSRLWTLKENFLKLTGNSNVVSYPKASESSNGVFSYIEETTEVELVKNDNSKNIKNFQKRKSQWNKLLLMQQEEKQKLKKDIENENDEFWRRYQIHRAAIQLCSPNDVTKEQKLKVFNTEYMKIIRELERQHEIRLKDLEAKQLKTRLTFPETLALDELLNPVASNEPGTKVDQTCDQAQHSNAPKALVSDHVAEGEGFNDMVEVITRIGTGIGLSEAPDANASVVVPCSSALELQTPLVKHADANNKCNNIAENEYDSQGNIFSKHSNSREQCSDGAISPPEEGVCVNYSCESHDFGQDAITRVLPSCNEEICDGKTLDVQCSDGAISSPEEGECVNYCFESHDFGQDAITRVLPSCNEEICDGKTLDVQCSDGAISSPEEGECVNYSCESHDFGQDAITRVLPSSNEDICDGKTLDVPSGEVAPTVCNTTSSNGDHVEISSRQGELDGTILSNPVCGSSIEVEANGSNDGAKNMAPVNSQSSEEDIPSVNTMSTSNCENAAQIHEADDNNGSKNAETLNSSLSDERISSLNSKSPQGHVRNENAMCMQNCENFAQSLEDDDSN

SEQ ID NO: 164753 - protein, 727 aa, Glycine max
  Coding DNA Sequence Number=SeqID_47975
  Gene Ontology: Mol. function=protein serine/threonine kinase activity; Biological process=one-carbon compound metabolic process
  Homolog annotation: Hit_ID=Q84JK0; Match level="QueryCoverage=42%, HitCoverage=46%, E-value=2e-12, Identity=25%"; Hit description =Putative hydroxyproline-rich glycoprotein
MDQISNGGPLLDGDLSPGPCTSSPSNGRTLPDEQIPVLEPENSNKVAECQLTDSVVVNKNAISDQLEGVCRTMTENSLSLETPVSRPVDDLMEPLEQVHSLSSVESPPDPDTAREMKNTLVSSPVDIVPANQSINDSLVMEPPEQEAQLPSAGFLSSNQDLSNLPLVTGTEDQPSNEDDLPNHIPEMPIEIQNQVVQHASNSDRQEGVCRTMTENSLSLETPVSRPVDDLMVPLEQVQPLSSVESPPDRDTAREMQNILVSSSVDIVPANQSMNDSLVMEPPEQEGQLPSAGILSSNQDLANLPLVTGTEDQPSNEDGLPNHIPETSIEIQNQAVVQCASNVELDSCSRQVVHPASNMDLDSLLPGGVRLQSSDTRNLSTLTEINNHPIQPASQSASRIIRHLCLDPLTNELERLRILTDQNMKEYENKKLQLKYDFEKELEELYRKYDIKRKEVEVEFQNIRKNLDTQHNIVLVNKILAEAFRAKSMDLKVSGASRMQQDASVPQQLFQLASQQNATRPCLVGPSSCGPPADSMQSSYATTTSQTMVSPIQATYSTPGTFSSVSPRVPHINSLSSPLGNAQTAGEIRAPAPHLQPYRPPTSIPASSPCTVPHGRPSQPAPGNIPVTSPPFSHRTPWSMPANFQSVPHRGHWLVSTGGLSTPNLSSVNSCADANSQPGINLPNVRPHMPDLPTLMNLYLSKFSGNSTPANSAHPATSPDVVCLSDDE

SEQ ID NO: 164754 - protein, 291 aa, Glycine max
  Coding DNA Sequence Number=SeqID_47976
  Homolog annotation: Hit_ID=Q84VH5; Match level="QueryCoverage=99%, HitCoverage=54%, E-value=1e-113, Identity=64%"; Hit description =Envelope-like protein
LATSPREVDTEMDKKIRSIVSSILKNASVPDADKDVPTSSTPNAEVLSSSSKEESTEEEDQATEETPAPRAPEPAPGDLIDLEEVESDEEPIANKLAPGIAERLQSRKGKTPITRSGRIKTMAQKKSTPITPTTSRWSKVAIPSKKRKEISSSDSDDDVELDVPDIKRVKKSGEKELGRDALDCKETMDLIKAAGLLKTVTKLGDCYEKSRKCVRFSPAVINKYLGRPTDGVVDITVSEHQIAKEITAKQIQHWPKKGKLSAGKLSVKYAILHRIGAANWVPTNHTSTVAT

SEQ ID NO: 164755 - protein, 96 aa, Glycine max
  Coding DNA Sequence Number=SeqID_47977
  Gene Ontology: Mol. function=transporter activity; Cellular component= integral to membrane; Biological process=transport
  Homolog annotation: Hit_ID=P93004; Match level="QueryCoverage=83%, HitCoverage=28%, E-value=7e-25, Identity=79%"; Hit description =Aquaporin PIP2.7
MAVTVGRFQLLSPQRATRNTGGVVDEDKDHAIEGPCEAEKVNAVAWSGLFFVANDDGDGDVEEEKCGDKLDNEGSVEGLYSLISTKLMRGAGGEST

SEQ ID NO: 164756 - protein, 103 aa, Glycine max
  Coding DNA Sequence Number=SeqID_47978
MACRTRVPSLLSSLTIGWCILVMWGSWRRLLVLEFWRKVRARKVCWLRSCKLGGSGKRKVSEVLLSGSPGGWSIGEGCEGGEGKGRVTFLVLVYKADGGEACA

SEQ ID NO: 164757 - protein, 163 aa, Glycine max
  Coding DNA Sequence Number=SeqID_47979
  Gene Ontology: Mol. function=RNA-directed DNA polymerase activity; Biological process=RNA-dependent DNA replication
  Homolog annotation: Hit_ID=Q1SQP0; Match level="QueryCoverage=98%, HitCoverage=46%, E-value=2e-12, Identity=26%"; Hit description=RNA -directed DNA polymerase
LAFSPGRCILDVVVVANEFLDLVKRSKRECFMFKIDFEKAYDSGDPLAPFLFLMVVKGLQGLVKKAREIGDFRSLRLSPTLEFSLLQYVDDSIIIREHCYVCRAKANEGLGVKNLAASNASPVWVAWWQDFMRIDVGDDWFSSKEVNVGEMSVETNDHGVVWS

SEQ ID NO: 164758 - protein, 225 aa, Glycine max
  Coding DNA Sequence Number=SeqID_47980
  Gene Ontology: Mol. function=sugar porter activity; Cellular component=membrane; Biological process=transport
  Homolog annotation: Hit_ID=Q75I89; Match level="QueryCoverage=99%, HitCoverage=52%, E-value=6e-90, Identity=75%"; Hit description =Expressed protein
MMINKTLFLTYVYLFIYILLSSGVILYNKKSKWYFTTIHTLCSMREQPTELDPLWVLSPKYFNFPLPITLTMIHMAFSGAVAFFLVRVFKIVTPVKMTFEIYATCVVPISAFFASSLWFGNTAYLHISVAFIQMLKALMPVATFIMAVFCGTDKARCDVFLNMLLVSVGVVISSYGEIHFNIVGTVYQVTGIFAEALRLGLNASLLQKKGLTLNPITSLYYIAPC

SEQ ID NO: 164759 - protein, 192 aa, Glycine max
  Coding DNA Sequence Number=SeqID_47981
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=53%, HitCoverage=6%, E-value=7e-24, Identity=50%"; Hit description=Chromo
MAENKHLKDLQKEIRTHSDDIRHLGQTMDMRYQEKNDKMLQIQNSMGQIQLAMNLLLRNASQPPESSPNNGSPMVQPINASLPVKEISLGFPHFNGTTPVMEWIFKAENFFTYHNTPDASRVDIAAMHFDKDVVAWFQMLQKLSLVSTWSELTHALESQFSPSPFDCLMVELFKFQQTGSVSAYYLKVYVSS

SEQ ID NO: 164760 - protein, 66 aa, Glycine max
  Coding DNA Sequence Number=SeqID_47982
MMIAAHSSVVCRQQNHLRERGKVRERNNREKDQALNREEVENRRRESPQNNPTMCNPPSLYSPSLT

SEQ ID NO: 164761 - protein, 177 aa, Glycine max
  Coding DNA Sequence Number=SeqID_47983
MDSEGLENGIEELKLKEEKGNAHAQPQGQLQITTFSELVNDVNLHFQIIRFPKQIYVWIGYNSAKLGHMYAAASTRPNNMVSVTSILGGVSDNTGSGIAHRLVLKTGLNIILACSIPKNSPILEHREVMLLPNDFLTAIRYTEVNFSKQKSDILREIYLRIYIVVQTFYLERGASEN

SEQ ID NO: 164762 - protein, 132 aa, Glycine max
  Coding DNA Sequence Number=SeqID_47984
LCQSFGVPVAPSKVIRPPITRAFIEKYCTQRQAQGDAPQDVDAPPPHQAAPAESFDTEQYLRHLVRQQAANHWALALLSLSNLLGKIVSVKKIYAEALPKRFRNIFREEFRKGFDRSSTFFVRSSSFFDLQR

SEQ ID NO: 164763 - protein, 211 aa, Glycine max
  Coding DNA Sequence Number=SeqID_47985
MMKKELKKSLKVELSHIASHQSAPIKAPEIQALLGRVSTKGSCAGPEGSGLLKELLSGGDDLMGLFVVVGENTVFAGLGKVFENSSTIHNVHYENDVVKVQVVRTYMPHAEVPIPTSEVHYLEQTVGTFVAWPTHLVREVTNEVVVGLDKPPSKSVGEPNRLTSVATDDPLGELVKKSYVVYTKPMELAWDGAKFGLPNASNGFFITHVYE

SEQ ID NO: 164764 - protein, 71 aa, Glycine max
  Coding DNA Sequence Number=SeqID_47986
MGAYAKDEELLIHFFQESLTGVAVTCISAILIWLRIGCNYRKKNGGVRAFKLCKFGLRQRKDRSGSEKRQT

SEQ ID NO: 164765 - protein, 86 aa, Glycine max
  Coding DNA Sequence Number=SeqID_47987
  Subcellular localization annotation: CTP_CleavageSite=54; ConfidenceScore=5.05e-01
MSCTCSLSALLYLSKRTASVHPLSEKGALSQKSLTCVKRSIRSLDWDSELCMSRVSRERKVQVPRSFERFCCVKICRDQSLKQEPI

SEQ ID NO: 164766 - protein, 79 aa, Glycine max
  Coding DNA Sequence Number=SeqID_47988
MVDFGLVASVRSILGLNVGVGLFSGLNVGVESTPPSPNGVGLDYWCRALTAGAGSIMGFDYWCRVDFELGCWCWVDSGL

SEQ ID NO: 164767 - protein, 358 aa, Glycine max
  Coding DNA Sequence Number=SeqID_47989
  Gene Ontology: Mol. function=RNA-directed DNA polymerase activity; Cellular component=intracellular; Biological process=RNA-dependent DNA replication
  Homolog annotation: Hit_ID=Q1SYR3; Match level="QueryCoverage=96%, HitCoverage=23%, E-value=2e-63, Identity=45%"; Hit description=RNase H, putative
MVTLFHDMMHKEVEVYVDDMIAKSKKRLRKFKLRLNPAKCTFGVKFGKLLGFIVSQRGIEVDVGKAYAILELLPSHMEKEIRGFLGSMGKSLLKAVYAESHKLPALTGRIAHWQVLLSEYDIVYVTQKVVKDSALVDYLAHQPVEDYQSMQCEFLNEGIMVLFDNEDSSKERGWIMWFDGASNITGHGIGVILPSPEKKYIPITARLCFNGTNNIAKYEACTLGLQVAVESKIKKLEVYALATLSSMFALNKDEDMPLIKIQRHDQLAYFHLVEEEFDGKPWYFDIKDYIKIREYHPNASKNDKRTLRRLEMRFFLNVEVLYKKNHDMVLLRCVDVIEAQKIIREVCWTNGLSYLKKG

SEQ ID NO: 164768 - protein, 205 aa, Glycine max
  Coding DNA Sequence Number=SeqID_47990
MVYQLGLKEVGITFNKVDMYKSLMKNSSTYIVVVTKAKGSECFGIGHLMLEHKLLGYVVAWIITLKGSNHAQLIEEDLLLSCLMHGKLKINWVNIIIDNMMKTKMIRSFMCPYAMLISRILDYFGVDTQEEVFAFVEVEFKKNKEDQTTQQDLEEKPMSPLEQMMLAKRDKLLRMHKEDYIELKECFETIYGRLDVIGAPYVDDI

SEQ ID NO: 164769 - protein, 531 aa, Glycine max
  Coding DNA Sequence Number=SeqID_47991
  Gene Ontology: Mol. function=RNA-directed DNA polymerase activity; Cellular component=intracellular; Biological process=RNA-dependent DNA replication
MRGITYTLKKAKTSNRSYRTLWICYRCKLFEHPKPLVIHHTKCTTSSASSVPKPITVQVLKGFPYKDNKVVPWRYEVKVCVDGSDEKQSKNDSSEATNVTNIAGIGSMIRSCRIYSPSESRTEPSKETNGKEVVRSLDEERKEISDEEACKFLKLIKQSEYTMMDQLNRTLAKISLLSLMLNSEPHRKVLLKILNEAYVVHDISDEKFEGIVGNVTVSNYLTFTDEEMPTKGARHNKALHIFEKCMDHVLVRVLVDNGSSLNVMPKTTLAKLPSNESYMKPSTMVVRAFDWSHREVIGKISLPIQISLITFEVVFHVMDIAPSYSCLLGRPWIHCARAVPSTLHQKWKLIVDDKLVIIFVEEDLLVRVPIRDIQESFWSVGFEFPNSIAVVEEDISENKSFNLVHACPPNVKLNNWKIIELPVVVNLNLNFKNDTLEIDNATITSGGFDCLDNQSDEESEDEKGISSTLLREVKAGILISENECNKLIMLLHEYNNVFAWSYRDMPGLDVNIVEHKLPLKPKCLPVKQKLR

SEQ ID NO: 164770 - protein, 262 aa, Glycine max
  Coding DNA Sequence Number=SeqID_47992
  Homolog annotation: Hit_ID=Q9F3X3; Match level="QueryCoverage=84%, HitCoverage=47%, E-value=4e-35, Identity=37%"; Hit description=USG protein
MRRVQPGDSGSEDQASYDYNSRKQSLMINDLRRYGIQTLLVEDYRQITDLLYAIETQFKKSTVFISGSADNYHPYAREESIQFIHRLARLLIRKQYRIVNGFGWGVGTAVINGALEAIYASGGKISESQLVLRPFPQFASGGITLPALWHEYRQNMISLSGIAVFLFGNKRNAEGECVLADGLLKEFHIAAEQGCVCIPIGCTGGASAEIYRKIKEEMKDTLYHRHPVAMNLLDQLNEPGSLAEKKTCLLALIDIITKDNPR

SEQ ID NO: 164771 - protein, 199 aa, Glycine max
  Coding DNA Sequence Number=SeqID_47993
  Gene Ontology: Mol. function=transporter activity; Cellular component= integral to membrane; Biological process=transport
  Homolog annotation: Hit_ID=UPI00005FA528; Match level="QueryCoverage =94%, HitCoverage=25%, E-value=2e-29, Identity=41%"; Hit description =COG4590: ABC-type uncharacterized transport system, permease component
MTQTTANQHPRDRMRGRIDRGVQAAVTASGLMVLMTLMLIFVYLLFAVLPLFKPASLGQAQPLPIAASAPALALGMDVQQRVGYRIDAQGAGQFYRLTPTPNGQPQAPLAQQTLLAKPALLAQAAGERDLFALAQADGRLVVARADFATAETGRPQWLFPLGQQPLALDPQRKPLKLLSLADAHRGQYLLAGVTDDRRL

SEQ ID NO: 164772 - protein, 131 aa, Glycine max
  Coding DNA Sequence Number=SeqID_47994
RDSKVNMTDLVSAEDDTAKVYTDNHSGISARQRDSIESMTDLVGAEDDVYLRVSTGFSSYRQQKVYTDNHSGISARLRHSKVSMTDLVSAEDDGTEDDVSLCVLLAFSSYRQQNVYTDNHSGISARQRDSK

SEQ ID NO: 164773 - protein, 135 aa, Glycine max
  Coding DNA Sequence Number=SeqID_47995
MPCHHLIDEQGNTKKVSLTKPSVFVMPRGERLVVPFDSQLRVYGEAATLLSSACGRIAMDSKNIPNNFDSWSNVPKSYKDGCFNIVKWSSFVDYHLRPEYKEVNLGRAVGRGELYIATHKKKNGSYVNEEARSIG

SEQ ID NO: 164774 - protein, 405 aa, Glycine max
  Coding DNA Sequence Number=SeqID_47996
MSSQKSSSNGLFGHDVHGSSENRRDINIGRRSSSGWTIRVNEDATKLHPQRRLVLHEIGTIPLVNTNSRVRSQVDGAGIDMITNLELHEAPNSMYFVTFMLLGMLTPSKDCWDNLFAIDKGESGERFKSHFELYSSPTHYNESVNYYGKQEEELSLEELTTVNSIVKLVNEIRDDIPSIGKSMKKPMLLATLFAASGGDKKKSSRRKPLPSKKGKSSTTEICSRAFHDMPYPPLKRKKEIDRLILFENWDIVLKNNHTSLDSTISILVGVKEYLTHVSQLTEKLVEAELVRDEWHENFKKLVKDSFNNSLRQIEYIHPKVDIKTSLCNPRCEVVDGQFYVWVDGKLCLSHLGGLGIVNDDFVGLQIVVLESPDEEMADRFIKTLKTNADDRGVRASNIETDLEGS

SEQ ID NO: 164775 - protein, 430 aa, Glycine max
  Coding DNA Sequence Number=SeqID_47997
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=56%, HitCoverage=28%, E-value=4e-93, Identity=69%"; Hit description =Protein kinase; EGF-like, subtype 2; S-locus glycoprotein; Curculin- like ...
  Homolog annotation: Hit description=(Mannose-binding) lectin; N/apple PAN; Type I EGF
  Pfam annotation: Domain name=Pkinase; Domain location=126-382; Score =95.4; E_value=1.7e-25; Accession=PF00069.15; Description=Protein kinase domain
  Pfam annotation: Domain name=Pkinase_Tyr; Domain location=126-355; Score=54.5; E_value=8.2e-16; Accession=PF07714.7; Description =Protein tyrosine kinase
  Pfam module annotation: Pfam domain module=Pkinase::Pkinase_Tyr; Domain location=126-382::126-355
MAEWRCRILEKRHQIEVALRVAYGSAMARHDQQQSPARRTTARASATHTTIADDVLERDGSRPADDARERPTTKARDMRPPHDARHTSTATTVLWMSIEQKDQGGQEDLELPFFDLATIITATNNFSINNKLGEGGFGPVYKGLLVDEQEIAIKRLSRSSGQGLKEFRNEVILCAKLQHRNLVKVLGYCIEGEEKIKERLINLYWIILTDSVESKFLDWPMRFNILNAIARGLLYLHHDSRLRIIHRDLKASNILLDNDMNPKISDFGLARLCGSDQVEGSTSIIAGTHGYMAPEYAIDGLFSIKSDVFSFGVLLLEIVSGKKNKGLTYQDHDHNLIGHVFNVKDHSFNLCNNFLSAYHYQAANNIHDDFLVRAPRQVKYLVVAANYFTKWEEAKTLATITSKNIENFVFSQVDSKLDYPARPKEKGKIG

SEQ ID NO: 164776 - protein, 47 aa, Glycine max
  Coding DNA Sequence Number=SeqID_47998
MSKCPNCGVSRYKVKDDDCSNDESTKKDPSNKDLLISMLSQTSTPKL

SEQ ID NO: 164777 - protein, 489 aa, Glycine max
  Coding DNA Sequence Number=SeqID_47999
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=92%, HitCoverage=52%, E-value=1e-152, Identity=56%"; Hit description =Protein kinase; EGF-like, subtype 2; S-locus glycoprotein; Curculin- like ...
  Homolog annotation: Hit description=(Mannose-binding) lectin; N/apple PAN; Type I EGF
  Pfam annotation: Domain name=B_lectin; Domain location=72-187; Score =149.5; E_value=9e-42; Accession=PF01453.15; Description=D-mannose binding lectin
  Pfam annotation: Domain name=PAN_1; Domain location=351-425; Score =2.8; E_value=0.082; Accession=PF00024.16; Description=PAN domain
  Pfam annotation: Domain name=PAN_2; Domain location=344-412; Score =116.9; E_value=5.9e-32; Accession=PF08276.2; Description=PAN-like domain
  Pfam annotation: Domain name=S_locus_glycop; Domain location=201-327; Score=158.9; E_value=1.4e-44; Accession=PF00954.11; Description=S -locus glycoprotein family
  Pfam module annotation: Pfam domain module=B_lectin::PAN_1::PAN_2::S _locus_glycop; Domain location=72-187::351-425::344-412::201-327
MAIPLVILLICKLLSLFSQICYATTDTITKGQPLPDDGNTLLSKDGTFELGFFNPGSSNNRYVGIWYKNIVVKTVVWIANRDNPIRNNSSKLVISQDGNLVLLSQNESLIWTTNASSSEVSSSSPIVQLLDTGNLVIKDGNDKESVFLWQSFDYPCDTLLPGMKFGWDLRTGLNRRLTSWKSWDDPSSGDFTWGVEIGSNPDIVMWKGNVEYFRTGPYTGNMFSGVYGPRNNPLYDYKFVNNKDEVYYQYTLKNSSVITMIVMNQTLYLRHRLTWIPEAKSWTVYQSLPRDSCDVYNTCGPNGNCIIAGSPICQCLDGFEPKSPQQWNVMDWRQGCVRSEEWSCGVKNKDGFRRFASMKLPNTTFSWVNESMTLEECRAKCLENCSCKAYSNLDTRGGGNGCSIWVGDLVDLRVIESGQDLYVRMATSDMDGKHEHRRKVVLVVSTIASLVLVMLVAFCIYMIKKIYKGKFLGQNTFLLHKDYKHLQTQ

SEQ ID NO: 164778 - protein, 166 aa, Glycine max
  Coding DNA Sequence Number=SeqID_48000
MDMKLGYIISSQISMIAQHDSSRLGFPTLITALCKARGVTSDSLSFESLNPAINLAYVKKNCWNLDDLSRLQSSSLQPMMSVEEFLSQVAWPGVQPSPSGGGEASAAQELVPEKDEPTPPEPFIYEPIAEIAQEEVASPELVPQSHPSPAPVLEDPESSTPAPVPD

SEQ ID NO: 164779 - protein, 333 aa, Glycine max
  Coding DNA Sequence Number=SeqID_48001
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=98%, HitCoverage=39%, E-value=1e-125, Identity=66%"; Hit description =Protein kinase; EGF-like, subtype 2; S-locus glycoprotein; Curculin- like ...
  Homolog annotation: Hit description=(Mannose-binding) lectin; N/apple PAN; Type I EGF
  Pfam annotation: Domain name=Pkinase; Domain location=31-288; Score =81.0; E_value=3.8e-21; Accession=PF00069.15; Description=Protein kinase domain
  Pfam annotation: Domain name=Pkinase_Tyr; Domain location=31-288; Score=73.3; E_value=7.8e-19; Accession=PF07714.7; Description =Protein tyrosine kinase
  Pfam module annotation: Pfam domain module=Pkinase::Pkinase_Tyr; Domain location=31-288::31-288
MSREDKDEGRQEDLELPFFDLATIVNATNNFSIENKLGEGGFGPVYKGTLVNGQEIAIKRLSRSSGQGLKEFRNEVILCAKLQHRNLVKVLGYCIQGEEKMLLYEYMPNKSLDLFLFDSEQSKFLNWPVRFNILNAIARGLLYLHQDSRLRIIHRDLKANFGLARMCGSDQVEGSTSIIVGTHGYMAPEYAIDGLFSTKSDVFSFGVLLLEIISGKKNRAFTYQDNDHNLIDHAWRLWKEGTPERLTDAHLANSCNISEVIRCIQISLLCLQHHPDDRPNMTSVVVMLTSENALHEPKEPGFLIRRVSNEGEQSSNRQTSSFNEVSISLLNAR

SEQ ID NO: 164780 - protein, 275 aa, Glycine max
  Coding DNA Sequence Number=SeqID_48002
  Gene Ontology: Mol. function=electron-transferring-flavoprotein dehydrogenase activity; Cellular component=integral to membrane; Biological process=electron transport
  Homolog annotation: Hit_ID=Q1H3E4; Match level="QueryCoverage=82%, HitCoverage=41%, E-value=5e-79, Identity=61%"; Hit description =Electron-transferring-flavoprotein dehydrogenase
  Pfam annotation: Domain name=ETF_QO; Domain location=80-191; Score =224.7; E_value=2.1e-64; Accession=PF05187.3; Description=Electron transfer flavoprotein-ubiquinone ox
  Pfam annotation: Domain name=Fer4; Domain location=196-219; Score =5.0; E_value=0.06; Accession=PF00037.17; Description=4Fe-4S binding domain
  Pfam module annotation: Pfam domain module=ETF_QO::Fer4; Domain location=80-191::196-219
MAFPGGALLGCSAGLVNVPKIKGTHYAMKSGMLAAESVFEAVQQGAPELLTSYPQKMRTSWIWQDLTAVRNVKPYLSRWGTWVGTVLGGIEMWLSGWGITMPWTLKHTTADHATLAEAKQSRQPSYAKPDGVLTFDKLSSVSLCNIGHDDQQPCHLKLSVADIPERVNLPKYAGPEQRYCPAGVYEFVEQAGKEVLQINAQNCIHCKTCDIKDPTQNITWVPPEGSRWPRTPANPALLGASEGDPEHHASATVICFNNRIRVLNRPYFCDVSLAR

SEQ ID NO: 164781 - protein, 162 aa, Glycine max
  Coding DNA Sequence Number=SeqID_48003
  Gene Ontology: Mol. function=protein binding; Cellular component =molybdopterin synthase complex; Biological process=Mo-molybdopterin cofactor biosynthetic process
  Homolog annotation: Hit_ID=UPI00003CD5F5; Match level="QueryCoverage =96%, HitCoverage=91%, E-value=2e-59, Identity=73%"; Hit description =COG0315: Molybdenum cofactor biosynthesis enzyme
  Pfam annotation: Domain name=MoaC; Domain location=19-154; Score =268.5; E_value=1.4e-77; Accession=PF01967.11; Description=MoaC family
MTKQTSGLTHFNAQGHAHMVDIGDKAHTKRVAIAEGRIEMQAATLQTILQGNAKKGDVLGIARIAAIQASKKTSDLIPLCHPLSLSRVDVSFMADETQHSITCRVQCETTGQTGVEMEALTAVQVGLLTIYDMCKAIDRGMTIQGVRVLEKHGGKSGDWVAD

SEQ ID NO: 164782 - protein, 109 aa, Glycine max
  Coding DNA Sequence Number=SeqID_48004
MIFTPFSLYNFTQTLETPPPQPMTTGDRHEPSRLVAGPPHGEENFSQSKIFKTQLKDSIENGASNPPFAVSSSDLLDIPGEGRGSLRILTIHGHCIDGAYVSYFIIAWK

SEQ ID NO: 164783 - protein, 100 aa, Glycine max
  Coding DNA Sequence Number=SeqID_48005
SMMIGCGITWMLGKLGRIDGDPVLRETRIWATWEYVSSVGGGQQGMEVLKGETSCFYSLTTEWYLKICRGGQETLGTSGGVLLPKTKLDQSRPNPGIVSQ

SEQ ID NO: 164784 - protein, 72 aa, Glycine max
  Coding DNA Sequence Number=SeqID_48006
MVQKKDKELRGSSNEPIGGYHRWLKAYAQAVRIRKENAELRDVNLDTTKALEQETKRARKEEHGWNMFRGAL

SEQ ID NO: 164785 - protein, 397 aa, Glycine max
  Coding DNA Sequence Number=SeqID_48007
  Gene Ontology: Mol. function=transporter activity; Cellular component= integral to membrane; Biological process=transport
  Homolog annotation: Hit_ID=Q4ITM4; Match level="QueryCoverage=98%, HitCoverage=93%, E-value=4e-95, Identity=44%"; Hit description =Fucose permease
  Pfam annotation: Domain name=MFS_1; Domain location=27-381; Score =117.1; E_value=5e-32; Accession=PF07690.6; Description=Major Facilitator Superfamily
  Pfam annotation: Domain name=Sugar_tr; Domain location=22-397; Score=- 136.6; E_value=0.014; Accession=PF00083.14; Description=Sugar (and other) transporter
  Pfam module annotation: Pfam domain module=MFS_1::Sugar_tr; Domain location=27-381::22-397
MLAEKSAASAQPGVAVTANLRWAFILVTSLFFMWGLSYGLLDVLNKHFQETLHVTKAQSGLLQAAYFGAYFLVALPAGYFMDRKGYKAGILVGLCLYALGALLFVPAASANSFGVFLFALFVIASGLGCLETAANPYATVLGDAQGAERRLNLAQSFNGLGQFIGPLIGGTLFFSASQSAGGGDQSAVKMTYVAIAVLVLLIALLFSRTRLPAIREEEKPVHGVIAQGLWQHPHFVGGVITQFFYVAAQVGVGAFFINYATEHWRDVSNQSASYLLSIAMICFMVGRFFSTWLMGRVKPATLLAAYALINIALCGVVMLSVDGVSVVALIAVFFFMSIMFPTIFALGVKKLGKHTKRASSFMIMAIVGGAIMPYFMGALADRYSTALSYLLPLLCFA

SEQ ID NO: 164786 - protein, 88 aa, Glycine max
  Coding DNA Sequence Number=SeqID_48008
MTNANCPQESLHSVSNGNLRFDTAQTLVSRFLQVSSFFKDEDESPVESDETKVQSWSFYSAYLWSFCRVVGKTMAVVVVCSYLLDMEA

SEQ ID NO: 164787 - protein, 90 aa, Glycine max
  Coding DNA Sequence Number=SeqID_48009
MGSLAKDLAFSSQGRRRSRCLATSEKSLEATLEPPTPAAYTTSPQQAVDPSTPEDQTTLVQSPNASPVATPVLHLSKEEEVQTQDTQDQS

SEQ ID NO: 164788 - protein, 117 aa, Glycine max
  Coding DNA Sequence Number=SeqID_48010
  Gene Ontology: Mol. function=transition metal ion binding
MQQLLLVAIHGILPIKVRVAITRLCFLFNVICSKVIEPRQLDDLQNEASIVLCQLEMYFPPSFFDIMVHLIVHLVREIQLCGLVVKGYTNQKLPLLKVKLVGLLETHHDRTREGKGT

SEQ ID NO: 164789 - protein, 113 aa, Glycine max
  Coding DNA Sequence Number=SeqID_48011
MRTCFSKETKLPTDQSNICFLDEKQCVYRGRRHFVFKRPFRGNTGSNKDRRELLKVYQSHTGLTFSPWVKVYDKLGFWLKACRTAGHDICQGLANGSGIKGMSYIISMIHMQQ

SEQ ID NO: 164790 - protein, 381 aa, Glycine max
  Coding DNA Sequence Number=SeqID_48012
  Gene Ontology: Mol. function=GTP binding; Cellular component =monolayer-surrounded lipid storage body; Biological process=lipid metabolic process
  Homolog annotation: Hit_ID=Q1RUV0; Match level="QueryCoverage=94%, HitCoverage=42%, E-value=1e-132, Identity=70%"; Hit description =Phospholipase, patatin family, putative
MWFSTLQLAHLAEMEVKHRCNQVLELGFPLGGLAKLFAQDWEGDVTVVMPATPAQNPSYVELQKAANQGRRCTWEKLSAMKANCGIELALDESVAILNHMRRLKRNAERTAAASHGLPSTGKFSGSRRIPSWNIIARENSTGSLEDLHAAAAATSSLHQGVISPSGATGKNWKSHRSFHDASDSESESAHDLNSWTRSGGPLMRTTSADMFIDFFQNIEVDTELNRGKVTNTTTSPRDFQHHISRHTTPDHNRWCSKRTEIDQKENGNRMIAMNGSNIMVTEGDLLQPERIHNGIVFNVVKKQDFLTPSNRNNDYNSCCNNEVAECVQIEFPGKEVDALSSASENGDDGSTMARSLTEKPDYNSTNHFSKDFGEDQSIADN

SEQ ID NO: 164791 - protein, 474 aa, Glycine max
  Coding DNA Sequence Number=SeqID_48013
  Gene Ontology: Mol. function=GTP binding; Cellular component =monolayer-surrounded lipid storage body; Biological process=lipid metabolic process
  Homolog annotation: Hit_ID=Q1RUV0; Match level="QueryCoverage=100%, HitCoverage=57%, E-value=0.0, Identity=83%"; Hit description =Phospholipase, patatin family, putative
  Pfam annotation: Domain name=Patatin; Domain location=234-437; Score =90.9; E_value=3.9e-24; Accession=PF01734.12; Description=Patatin -like phospholipase
MDHINNEASVDPFAIGPSSILGRTIAFRVLFCKSISQLRHHIHFVLLDILKRFWGFWGPIVSWLHPRNPQGILAMMTIIAVLLKRYSSVKVRAEIAYRQNFWRNMMRAALTYEEWAHAAKMIDRETPKMNESKDLYDVELVSNKLQELRHRRQEGSLRDIIFCMRADLVRNLGNMCNPELHKGRLQMPRLIKEYIDEVSTQLRMVCNSDSEELALEEKLSFMHETRHAFGRTALLLSGGASLGAFHVGVVKTLVEHKLLPRIIAGSSVGSIMCSIVATRSWPELQSFFEDSLHSLQFFDQMGGIFTVVKRVTTYGAVHEIRQLQMLLRNLTSNLTFQEAYDMTGRILGITVCSPRKHEPPRCLNYLTSPHVVIWSAVTASCAFPGLFEAQELMAKDRSGEIVPYHPPFNLGPEKGSTSVRRWRDGSLEMDLPMMQLKELFNVNHFIVSQANPHIAPLLRFKEIIRAYGGNFAAK

SEQ ID NO: 164792 - protein, 282 aa, Glycine max
  Coding DNA Sequence Number=SeqID_48014
MKRIPPRIPLSSFQRQHGTGIKRTFIFETSFRRGTWSLLPSNVYDSEDGSPKMCIVRGMTIRFDAETLNEFLGTPITIAKGEQLTMYAQYLHSYQDYEAIMAKLCTPGGAPSSHTSDINVNWARLIYALVMKMNIDMGSIISQQITQIAQPKELLESSRFFYHFSRSEVSSSLHYSGCTTATTVASHPASSCAFFCRPFFLLLSPVGASHLDDAMYLSWPAPNHREHASVVSPPHHRSSIDDARGLHPMSVVGDAADVRDDIEYVVDLTTAQGEWDPWPTQD

SEQ ID NO: 164793 - protein, 159 aa, Glycine max
  Coding DNA Sequence Number=SeqID_48015
  Gene Ontology: Mol. function=RNA-directed DNA polymerase activity; Cellular component=chromatin; Biological process=RNA-dependent DNA replication
MKIFSRLALPLTKLTRKGQEFVWNEAYKTSFQELNKRLAFAPILILPDPEKKFEVYCDASGQGLGCVLMTSHNYDTIWVIVDRLTKSSHFIPINMKYKFEKLTKLYIKEVVKLHGVPSSIVSDKDLHFTSRFWKSLQKAMGMKLKLSSTYHLQADGQME

SEQ ID NO: 164794 - protein, 198 aa, Glycine max
  Coding DNA Sequence Number=SeqID_48016
  Gene Ontology: Mol. function=RNA-directed DNA polymerase activity; Biological process=RNA-dependent DNA replication
  Homolog annotation: Hit_ID=Q1SKC8; Match level="QueryCoverage=47%, HitCoverage=23%, E-value=1e-15, Identity=42%"; Hit description =Integrase, catalytic region
MRIPLAMPPPLEVGAITGVILIACRRQGACHRGNRVRLCCHNCGCRTENHHRKFNVFNRAWVGYVFGGDEILRDEAVARLYELGKVSDASGYLERTFLSPASMRAINLIRKWMEDAVGGTKWEMYMAFHLPVELKHRAYWAFRRLNFYESSSGEKRRLQLLKLEDMTLNAYESARIYKQKIKAYHYMKLQKKNFQPGQ

SEQ ID NO: 164795 - protein, 74 aa, Glycine max
  Coding DNA Sequence Number=SeqID_48017
MRGFGTLAARPSELLLLPEVTLLTQGAGYFTPKSFGGPSEPEASLGEPGFKKMPKMTFLPLPLGIFAFLIKTFE

SEQ ID NO: 164796 - protein, 156 aa, Glycine max
  Coding DNA Sequence Number=SeqID_48018
  Homolog annotation: Hit_ID=Q1SME3; Match level="QueryCoverage=49%, HitCoverage=81%, E-value=1e-16, Identity=52%"; Hit description =Retrovirus capsid, C-terminal
MAEFCLVPDVVIPPKFKVPNFDKYKGTSCPKNHLKMMQLQSMCKKENESFKEYAQRWRDLAAQVAPPTTEKEMITMIVDMLPVFYYQKMVGYTPSSFADLVFTGERIEVGRRRGKIDYPALMNGKPGENGENKKEGGTHAIIAIPTQPNFPPAQQC

SEQ ID NO: 164797 - protein, 61 aa, Glycine max
  Coding DNA Sequence Number=SeqID_48019
MHHQKRKTLDEASLLSSESETQHDHRSTSTPYGSHRPRQFVKFCDMPELKRKHRCTIREVT

SEQ ID NO: 164798 - protein, 48 aa, Glycine max
  Coding DNA Sequence Number=SeqID_48020
MSQNFTDYATIPSLTSGMLRDFTDYAIMLAFDSRHVVELHGLPNDGCQ

SEQ ID NO: 164799 - protein, 64 aa, Glycine max
  Coding DNA Sequence Number=SeqID_48021
MVSEASEALNIFEAGLLPLEARGSNPALLGELGGNLLPLFPINRRKGLFQIFLTPVAMHFSCFG

SEQ ID NO: 164800 - protein, 132 aa, Glycine max
  Coding DNA Sequence Number=SeqID_48022
  Gene Ontology: Mol. function=chitin binding; Cellular component =extracellular region; Biological process=chitin metabolic process
  Homolog annotation: Hit_ID=UPI0000612705; Match level="QueryCoverage =93%, HitCoverage=93%, E-value=9e-20, Identity=27%"; Hit description =UPI0000612705 related cluster
  Subcellular localization annotation: CTP_CleavageSite=56; ConfidenceScore=5.49e-01
MRNPLKARVCIPLKSKICRPLKSRACSPLKVRTCSPLKARACSPQKERTCSPLKVRACSPMKASTCSPMKERTCSPLKVRACSPLKVRTCSLLNARTCSPLKVRTCCPLKTKACSPVKVRPCVEVSFMMNQD

SEQ ID NO: 164801 - protein, 147 aa, Glycine max
  Coding DNA Sequence Number=SeqID_48023
MAQLISDAIHYLPGSCPQDTHKVIRPPANQAFIKKYCAPRQAHGETQQQPGNGQQRATDAPSPPPEPLSPSTKAGALPTTRGRLAGDQVQSQSSLRSGLGRAPLKRILVCPHKLTQALTNTNSGAWNINSISRPSKDTHSSDRDRGS

SEQ ID NO: 164802 - protein, 262 aa, Glycine max
  Coding DNA Sequence Number=SeqID_48024
  Gene Ontology: Mol. function=nucleoside-triphosphatase activity; Biological process=defense response
  Homolog annotation: Hit_ID=Q1SI90; Match level="QueryCoverage=87%, HitCoverage=17%, E-value=5e-26, Identity=30%"; Hit description =Disease resistance protein; AAA ATPase
  Pfam annotation: Domain name=LRR_1; Domain location=105-126; Score =4.1; E_value=48; Accession=PF00560.23; Description=Leucine Rich Repeat
  Pfam annotation: Domain name=LRR_1; Domain location=128-151; Score =12.8; E_value=1.2; Accession=PF00560.23; Description=Leucine Rich Repeat
  Pfam annotation: Domain name=LRR_1; Domain location=153-186; Score =6.4; E_value=18; Accession=PF00560.23; Description=Leucine Rich Repeat
  Pfam module annotation: Pfam domain module=LRR_1::LRR_1::LRR_1; Domain location=105-126::128-151::153-186
MKNQDLNAWKDALEQDCTTRDSLVSGWCLGLHKHVDTLANGRNRLYILIDNLRATSLLVDEGQRDLVVALDVCFIREIPEILECPKLKILQLNSQDIAIIGEITSLDILNLEKSELRELLVEIGGLSNLRLLDLTYCSTLGVIPHNLISSLTSLEELYMGNNNVQEKVKRSKSQSMGSCLSELRHLNQLTTLNMQIEDTSDFLRDYLGYGRLESYKILIGDGWKWSGVESGNYVTSRLLKLNLGADLGIVMDYGIKMLMAKA

SEQ ID NO: 164803 - protein, 850 aa, Glycine max
  Coding DNA Sequence Number=SeqID_48025
  Gene Ontology: Mol. function=protein serine/threonine kinase activity; Cellular component=membrane; Biological process=protein amino acid phosphorylation
  Homolog annotation: Hit_ID=Q5ZAV5; Match level="QueryCoverage=92%, HitCoverage=94%, E-value=1e-144, Identity=40%"; Hit description =Putative serine/threonine kinase
  Pfam annotation: Domain name=B_lectin; Domain location=77-186; Score =91.9; E_value=2e-24; Accession=PF01453.15; Description=D-mannose binding lectin
  Pfam annotation: Domain name=PAN_1; Domain location=332-408; Score =2.6; E_value=0.087; Accession=PF00024.16; Description=PAN domain
  Pfam annotation: Domain name=PAN_2; Domain location=327-394; Score =44.6; E_value=3.3e-10; Accession=PF08276.2; Description=PAN-like domain
  Pfam annotation: Domain name=Pkinase; Domain location=524-798; Score =157.0; E_value=5e-44; Accession=PF00069.15; Description=Protein kinase domain
  Pfam annotation: Domain name=Pkinase_Tyr; Domain location=524-798; Score=144.4; E_value=3e-40; Accession=PF07714.7; Description=Protein tyrosine kinase
  Pfam annotation: Domain name=S_locus_glycop; Domain location=199-310; Score=6.7; E_value=1.2e-05; Accession=PF00954.11; Description=S-locus glycoprotein family
  Pfam module annotation: Pfam domain module=B_lectin::PAN_1::PAN _2::Pkinase::Pkinase_Tyr::S_locus_glycop; Domain location=77-186::332- 408::327-394::524-798::524-798::199-310
MTLTFRLTSLTTLLFLCMFCVNATTYKEYLWMDQSLGTSDTILSRSGNFELGFFPAVRENSTNYYIGIWNKKGGSDKNKIMWVANRDYAVQASSAALTIQETEGNIIIIDRQMTYHVSQISNNSITYAKLLDSGNLLLLNNFTQEILWQSFDYPTDTLLPGMNLGYDTDSGYTWSLSSWKSADDPAPGAFSLKYDFGRATLIINNGSNVFWIDDRSNDTIDNVISRSGVHKERYRRYFTWPVDYNSMLVLEVSGELNQKYWSEEEKGWISIQSSKCGTNNLCGAFSICNPQALDPCDCLHGFKPFDANSWSKGIKSAGCVRKKELSCRNGVHSNDVFMPLNKTQLPSTLKGDSKIKIDTERGCESACSRKCSCVAYAYNLNGYCHLWLGQILNLKNISTYVDNSDNTNPIFNLRLDASELVPADSNTANAKEPANDFRKHENWLRILLIVILITLLTFLIFGLFVYWIRKQRRKGEDLLHFNVSMSMKAEDSELTEARRAKVKKKEVKLPLFSFVSVAAATNNFSDDNKLGEGGFGPVYKGILLNGDEVAVKRLSRRSGQGWEELRNEALLIAKLQHNNLVRLLGCCIDQEEKMLIYEFMPNRSLDVFLFDATKRRMLDWGSRVRIIDGIAQGVLYLHQYSRFRIIHRDLKASNILLDTNMNPKISDFGMARIFGENELQASTKRIVGTYGYMSPEYAMEGVFSIKSDVFSFGVLLLEIISGKKNTSFYQTNSLCLLGYAWDLWTNNSVMDLMDPTLDDSDSTSSRNHTVPRYVNIGLLCVQESPADRPTMSDAVSMIGNDNVALPSPKPPAFLNVRVFTSRGIRTHDLSLSPFSFYYQTNLITPDSMHC

SEQ ID NO: 164804 - protein, 101 aa, Glycine max
  Coding DNA Sequence Number=SeqID_48026
MRVYIEENPPHLVSLGRLYEGSTTIHNMPLHHDQLKVGVDEVKDANAPVPIPTDEEVVGPAKPADRPDYEVDDPLYLMTLTIPQLFLKSLQCTLANGHHFA

SEQ ID NO: 164805 - protein, 272 aa, Glycine max
  Coding DNA Sequence Number=SeqID_48027
  Subcellular localization annotation: CTP_CleavageSite=39; ConfidenceScore=5.50e-01
MVEPSKKRKGASTSTAATGTQRHGASGAQPASIPPSISSSMLFSSKEQHIRHDARRMVCTNQVDMTGRLLVGSLAFEYRIMHYLIVQILLPRSSNLAQVSKEDLIVIWFFLIGRQIEWAHLVRYRMHKALRSNAPLPYPHLITLFLRHFNVPLDSEPFVQVKRSFSIGAGVVSSFRYRKERDGSWVKKDAQPQTADDRSPSPPPQRDDSSSLMKNVLDKLDGLHTFVGERFDSLDSRIDAIDAWFAGMDTRITQLEEDVSFIRQCFDLPPPP

SEQ ID NO: 164806 - protein, 45 aa, Glycine max
  Coding DNA Sequence Number=SeqID_48028
MGIFVQSMLHAEVLSFLLAVDRPLMKSMEMSLQLWIRIGNGYKRL

SEQ ID NO: 164807 - protein, 68 aa, Glycine max
  Coding DNA Sequence Number=SeqID_48029
MKVAVSNGGNALAMAWNESETKQCKLKLYGYARKSKVGLFRFLSLGCFSALWANNLSHWRHSGPNAPD

SEQ ID NO: 164808 - protein, 54 aa, Glycine max
  Coding DNA Sequence Number=SeqID_48030
MATARWALKHPVYGIVILRLGIYTDRPNVSKKTFLNEKFYAIPEFQQTLLTTTK

SEQ ID NO: 164809 - protein, 70 aa, Glycine max
  Coding DNA Sequence Number=SeqID_48031
MACFGGSNSPNTLAFHCYCTLLPLHLLLIAPYIFYAALCASDNRRWRTPKASIDVSASKGSVVAQRTSII

SEQ ID NO: 164810 - protein, 71 aa, Glycine max
  Coding DNA Sequence Number=SeqID_48032
  Subcellular localization annotation: CTP_CleavageSite=32; ConfidenceScore=5.60e-01
MASKSSADLTNTSSSFDSSTATSKALFRACTVCFAGTVVSTWICQILVGYKRITDSTTNLAHPQFKRKRVQ

SEQ ID NO: 164811 - protein, 61 aa, Glycine max
  Coding DNA Sequence Number=SeqID_48033
MNRGTEKTTYEIILEMKKEDAYPMSVSLSIFDSYPKKFKSTSIGHCRNKLGTRDISGPNGP

SEQ ID NO: 164812 - protein, 267 aa, Glycine max
  Coding DNA Sequence Number=SeqID_48034
  Gene Ontology: Mol. function=transcription regulator activity; Cellular component=intracellular; Biological process=regulation of transcription, DNA-dependent
  Homolog annotation: Hit_ID=Q7CIP2; Match level="QueryCoverage=98%, HitCoverage=83%, E-value=4e-77, Identity=53%"; Hit description =Putative transcriptional regulator
  Pfam annotation: Domain name=Sugar-bind; Domain location=10-266; Score=267.1; E_value=3.5e-77; Accession=PF04198.3; Description =Putative sugar-binding domain
MGMVSVKIDHPVTHCLHLAREIEQKFGLTLCRVVPSAGLDDEAIQQMLAVEGAAVMAQFINEETPQVFGIGSGKTLRSMIDALPWVERPQHQCVSMIGAIARDDSGTRYDVPLKMAEKMQGKYFFIPAPLYADTPQDKTMWVQHQVYQRVTQRALQANVAFVGIGEVMPGCPLNAEGFITDAQVEALNARGVVGEMLGHFFNQQGERVYGETDELLTSVLLESQTQRNIIGFAGSARKYAAIHAALHGGWISGLVTDEDTALKLLHD

SEQ ID NO: 164813 - protein, 218 aa, Glycine max
  Coding DNA Sequence Number=SeqID_48035
  Gene Ontology: Mol. function=D-arabinitol 4-dehydrogenase activity; Biological process=metabolic process
  Homolog annotation: Hit_ID=P58709; Match level="QueryCoverage=98%, HitCoverage=46%, E-value=2e-81, Identity=66%"; Hit description=D -arabinitol 4-dehydrogenase
  Pfam annotation: Domain name=Mannitol_dh; Domain location=5-166; Score=163.8; E_value=4.5e-46; Accession=PF01232.13; Description =Mannitol dehydrogenase
MTTKSVWMHIGAGSFHRAHQAWYLHQLRQQGDDSWSIALGNIRGDAVALLNQLQAQNGEYVLETVTPEGERAYETITSLRTILPWDAEISALVAQGASAETKVIGFTVTEAGYYLTPAHELDLSQADIQADLRGEARTIYGALTRILRQRVASGGAPVTLLNCDNMRHNGERFRHGMLAFLAAQGDRALASWVRDNTTSPNTMVDRITPRPTPDVAER

SEQ ID NO: 164814 - protein, 180 aa, Glycine max
  Coding DNA Sequence Number=SeqID_48036
  Subcellular localization annotation: CTP_CleavageSite=32; ConfidenceScore=5.54e-01
MATPPSSPPPLPPTGVASQLPSTLKRTRNVTRLKSLATRPIGAERSLVHVDPATGKVGNPHNKKLRTYLGIAARDKVDVTYENWKQVPAAQKDLIWEDIQDVRKKTQAIQKQNTAPHVLSHRGYEYLQKKLMDEKTKKKLEEAAQSGSTDTLIDPLSPIRRHVKWKMARTKKTGQMTSKA

SEQ ID NO: 164815 - protein, 89 aa, Glycine max
  Coding DNA Sequence Number=SeqID_48037
MKTPNVQQDHIFLKAFPHSLEGVAKDWLYYSAPSCPHRQISEQLLLQYFYEGLSNMERSMIDAASGGVLGDMTPTEARNLTEKMASNSQ

SEQ ID NO: 164816 - protein, 58 aa, Glycine max
  Coding DNA Sequence Number=SeqID_48038
MPQPHGINMGLKEHSNRVSLPPRPRLRRIRLGLTFLIQPIQLSNNPYTYEFHDKKSPM

SEQ ID NO: 164817 - protein, 64 aa, Glycine max
  Coding DNA Sequence Number=SeqID_48039
MVWKENQGLIRMCKKETTTHPWTKKKVEKGTTIPCVMLMLPRNPRGIPIPPSLVIGGHTLQMIY

SEQ ID NO: 164818 - protein, 169 aa, Glycine max
  Coding DNA Sequence Number=SeqID_48040
MSKNEEFGNCTTEPDDIEFANVFTFLALLFNDLICSASDVQILKNNGINKDELGMSNHEVVDFFGSIANGVDRDHVDSGFRNIVDALNTYSATIFFTRFPIIACHDLSRITEWIYGLERFLRRGYNFAAALITLVTVVQTCYAILSYHYPHEDGNNNQFNSTQIHAKIN

SEQ ID NO: 164819 - protein, 81 aa, Glycine max
  Coding DNA Sequence Number=SeqID_48041
KGERGEAVDKVEKVVSVIKDVAFGAGVPHRTNTCNSLAWETRRIALANQGSSRRYSSRDGGARRHGGFGPCLASLTECCSQ

SEQ ID NO: 164820 - protein, 226 aa, Glycine max
  Coding DNA Sequence Number=SeqID_48042
  Gene Ontology: Mol. function=transcription factor activity; Cellular component=nucleus; Biological process=regulation of transcription, DNA-dependent
  Homolog annotation: Hit_ID=Q52QU2; Match level="QueryCoverage=100%, HitCoverage=56%, E-value=2e-34, Identity=34%"; Hit description =AP2/EREBP transcription factor
  Pfam annotation: Domain name=AP2; Domain location=170-226; Score =59.2; E_value=1.3e-14; Accession=PF00847.10; Description=AP2 domain
MAGATKNWLTFSLTPMETQFGPYDITTPSHCFNDNNFYGWANSKGVMDSQSETQQLAVPKMEDFYFGDHQQDLKAIVPGFKALSGTNSVDDSAPNKTTTRVAPAELTGAHSGESCKGSALSLCDVAANGSDDSNDNKAIVAVGFDTRKKVAVQLSFIEIEVMVVMNFGQHRWTGRYEAHLWDNSCRREGQARKGRQGGYDKEDKAARAYDLAALKYWGPKATTNFP

SEQ ID NO: 164821 - protein, 108 aa, Glycine max
  Coding DNA Sequence Number=SeqID_48043
MGWNKTGQECMQDQNLLRIGNEKRFQLRERKKKRKRKNKRRSEDELSGEQGVELQGVGLAVSAANRQQNCLKRKKVAKDAGWRKIEEFGMAHCNYQNDLTLVSGKIIN

SEQ ID NO: 164822 - protein, 185 aa, Glycine max
  Coding DNA Sequence Number=SeqID_48044
MLSPNSSDPYGCNLCSPHEIFFLPIPFTFHPPPVYTVYSPFLFSIVIITATTTLVSWQPPPSPITSFTESASPPWTFFVRSKPLGTQSRRMRILCVLDFDGGRALCQRLSYLVGVVCLHGNRLVAPPEAFYREVLSAMRLRIVPRIQRRTSLVAFGSAEGKLTAATTVSSGTRFSSAVDDDDETI

SEQ ID NO: 164823 - protein, 337 aa, Glycine max
  Coding DNA Sequence Number=SeqID_48045
  Gene Ontology: Mol. function=protein serine/threonine kinase activity; Cellular component=cytoplasm; Biological process=protein amino acid phosphorylation
  Homolog annotation: Hit_ID=Q9LSM2; Match level="QueryCoverage=94%, HitCoverage=75%, E-value=1e-114, Identity=63%"; Hit description =Similarity to lectin-like protein kinase
  Pfam annotation: Domain name=Pkinase; Domain location=23-290; Score =126.2; E_value=9.4e-35; Accession=PF00069.15; Description=Protein kinase domain
  Pfam annotation: Domain name=Pkinase_Tyr; Domain location=23-290; Score=98.5; E_value=2e-26; Accession=PF07714.7; Description=Protein tyrosine kinase
  Pfam module annotation: Pfam domain module=Pkinase::Pkinase_Tyr; Domain location=23-290::23-290
MQGELPYVHNILRYCFYKFTISVSVENLLGKGGHAEVYKGYLADGQVVAVKRIMRNEKEAEDRAGDFLTELGIIAHINHPNATRLIGFGIDNGLYFVLQLAPHGSLSSLLFGSECLEWKIRFKVAVGVAKGLQYLHHDCPRRIIHRDIKASNILLNENNEAEISDFGLAKWLADKCDHHVVFPIEGTFGYLAPEYFMHGIVDEKTDVFAFGVLLLELITGRRAVDSNSRESLVKWAKPLLDAKLIEEIVDPRLEDKYDLAEMKCVMATASLCIHHMSSKRPYMNQVVQLLKGEKVPNELNQNSSAPRSLLIDACDLEDYTCSNYLNDLNRHKQLLME

SEQ ID NO: 164824 - protein, 196 aa, Glycine max
  Coding DNA Sequence Number=SeqID_48046
MVLFPSVRRYGCVEEVDDGQRYTRVLWAERFEEPRGNNEWGRCTIYPYVVIAPDCHSHDFYDNQDLGGLVAVIGSYGVENSPLQPLISGGGHGASMEDAPCSTNHHRGKCFISLPRFFGHDVNEKATRSTFCQDTAIECYEDVGDFSDVEDLAPFKIAYSRDVIGEEILEGEMLSSDKKHDSLGDESDPSEDMTLP

SEQ ID NO: 164825 - protein, 197 aa, Glycine max
  Coding DNA Sequence Number=SeqID_48047
  Homolog annotation: Hit_ID=Q9LXA4; Match level="QueryCoverage=40%, HitCoverage=16%, E-value=4e-12, Identity=48%"; Hit description=Pto kinase interactor-like protein
MERIERRSKREEMKEKKWSRKIELTLMTMGGQNQKKEVVACDDDVLASPRDVFGVPISGTDSDSTGSSNYGGGPGSPGLGQNQAAQAQSQQWRAMIDVLRFKSVRRFSTIPLLAASYEISRKSLRNKLARIRPANEDDDFDGGINIDGISTKPSWRNFSYADLAVATDDFSPGMRPNYVSLATENDSKLILRPTIKL

SEQ ID NO: 164826 - protein, 136 aa, Glycine max
  Coding DNA Sequence Number=SeqID_48048
  Pfam annotation: Domain name=zf-CCHC; Domain location=56-73; Score =25.9; E_value=5.2e-05; Accession=PF00098.13; Description=Zinc knuckle
MKVNSSKEDCKESSRDDEDVENLSLMVKKFGKFLKRSKDRKFSKPSKIIESNNNTFTCFKCGKQGHIKFKCPIYLRKQLVEKKGKKDRKQKKAYIAWEDNASTSSDSSSEEIVANICLMGDSMNNSSTIEETEWLL

SEQ ID NO: 164827 - protein, 540 aa, Glycine max
  Coding DNA Sequence Number=SeqID_48049
  Gene Ontology: Mol. function=microtubule binding; Cellular component =cortical microtubule, transverse to long axis; Biological process =cytoskeleton organization and biogenesis
  Homolog annotation: Hit_ID=O23565; Match level="QueryCoverage=91%, HitCoverage=82%, E-value=1e-112, Identity=49%"; Hit description =Myosin II heavy chain like protein
  Pfam annotation: Domain name=DUF662; Domain location=3-187; Score= -51.9; E_value=0.053; Accession=PF04949.3; Description=Family of unknown function (DUF662)
  Pfam annotation: Domain name=Myosin_HC-like; Domain location=140-518; Score=442.4; E_value=6.2e-130; Accession=PF07058.2; Description =Myosin II heavy chain-like
  Pfam module annotation: Pfam domain module=DUF662::Myosin_HC-like; Domain location=3-187::140-518
MGKPQVHNLQEKVKELATCQSEIKALRATEAKKDKAIEELRNEVGKLDDKLRLTEDHLKHKKLEIKKLTEEKKDALAAQYAAEATLRRLHADQKEDDFVPLESVITPLEAEIKMYRNEIASLQEDKKALERLTKSKEAALLEAEKILRSALERVLIVEEEENKILEKTHRQKILEVEKLSQTIHELEEVILSSGVNANAVRDYQRQISELQEEKRTLERELARVKVSANRVATVVANEWKDENDKVMPVKQWLEERRIMQAEMQRLKDKLAISERTAKAESQLKVTYLSSYHDKLKMRLKTLEEGLKHFSNNPVSSNSGSAKSEKYKILSFLTTNGGLRNRCTSQPRGSTNGSSLFQKSNAKSNTESVTESLIPGSIMKKKYGTAENVLKKGIWASRHKVADSDEKENEMQVNAGMNLNKCNDKKEAAEIKTSVDVDDDSKSNSCNDLGSNDVVSGFLYDRLQKEVINLRKSCEIKESNLYTKDEEIKMLTKKVDALTKAMEIEWKKMKREAAAREKEAASTKSDDNRKLRRSNSSRRMI

SEQ ID NO: 164828 - protein, 691 aa, Glycine max
  Coding DNA Sequence Number=SeqID_48050
  Gene Ontology: Mol. function=nucleic acid binding; Cellular component= plastid chromosome; Biological process=transport
  Homolog annotation: Hit_ID=Q9FSB6; Match level="QueryCoverage=93%, HitCoverage=93%, E-value=0.0, Identity=54%"; Hit description=67kD chloroplastic RNA-binding protein, P67.1
  Pfam annotation: Domain name=PPR; Domain location=167-201; Score =29.5; E_value=1.2e-05; Accession=PF01535.11; Description=PPR repeat
  Pfam annotation: Domain name=PPR; Domain location=202-236; Score =32.7; E_value=1.3e-06; Accession=PF01535.11; Description=PPR repeat
  Pfam annotation: Domain name=PPR; Domain location=237-271; Score =18.4; E_value=0.026; Accession=PF01535.11; Description=PPR repeat
  Pfam annotation: Domain name=PPR; Domain location=272-306; Score =22.3; E_value=0.0017; Accession=PF01535.11; Description=PPR repeat
  Pfam annotation: Domain name=PPR; Domain location=307-341; Score =35.2; E_value=2.3e-07; Accession=PF01535.11; Description=PPR repeat
  Pfam annotation: Domain name=PPR; Domain location=342-376; Score =28.6; E_value=2.2e-05; Accession=PF01535.11; Description=PPR repeat
  Pfam annotation: Domain name=PPR; Domain location=377-411; Score =30.2; E_value=7.3e-06; Accession=PF01535.11; Description=PPR repeat
  Pfam annotation: Domain name=PPR; Domain location=413-447; Score =39.6; E_value=1.1e-08; Accession=PF01535.11; Description=PPR repeat
  Pfam annotation: Domain name=PPR; Domain location=448-482; Score =29.5; E_value=1.2e-05; Accession=PF01535.11; Description=PPR repeat
  Pfam annotation: Domain name=PPR; Domain location=549-583; Score =11.8; E_value=0.3; Accession=PF01535.11; Description=PPR repeat
  Pfam module annotation: Pfam domain module=PPR::PPR::PPR::PPR::PPR::PP R::PPR::PPR::PPR::PPR; Domain location=167-201::202-236::237-271::272- 306::307-341::342-376::377-411::413-447::448-482::549-583
  Subcellular localization annotation: CTP_CleavageSite=50; ConfidenceScore=5.74e-01
MAQSFLLCCSSSSFPPHPPSSSSFHYRQKITNASSVPSYSSRHFKLPNFSSSHQPKTLLQDAKLDDPNAKSSPLSKTSIWVNPKSPRAKHLWKNSYHARSSSLTKLAKSLDSCNPTQEHVSEILKVLGDSVLEPDAVFILNSMVNPYTALLAVEYFKQKVKSVRHVILYNVTLKLFRKVKDFEGAEKLFDEMLHRGVNPNLITFSTMISCASVCSLPHKAVKWFEMMPSFGCEPDNNVCSSMIYAYTRTGNTDMALRLYDRAKAGKWHVDTAVFSGLIKMYGVSGNYVGCLNVYNDMKVLGAKPNLTTYNALLYAMGRAKRARDAKAIYGEMISNGLSPNWPTYAALLQAYCRARFNRDALNVYKEMKEKGKDLDILLYNMLFDMCANVGCVDEAVKIFEHMKSSGTCPPDSFTYASLINMYSSIGKILEMEAMFNEMMESGFEPNIIVLTSLVHCYGKAKRTDDVVKIFNQLMDLGISPDGRFCDCLLYAMTQVPKEELGKLSGCVEKANPKLGSVLRYIMEKQEGGGDFRTEASELFNSTEADVKKSMCNCLIDLCVSLDVPDRARDLLDLGLTLEIYPDIQSRSQAKWSLHLKRLSVGAALTALSVWISDLSKALELGEELPPLLGINTGGGKHRFSDKVLPTVFESYLKELKAPFHKDANKAGWFLATSEAATSWLQSRGSTVALPQ

SEQ ID NO: 164829 - protein, 1016 aa, Glycine max
  Coding DNA Sequence Number=SeqID_48051
  Gene Ontology: Mol. function=transferase activity; Cellular component= mitochondrion; Biological process=transport
  Homolog annotation: Hit_ID=Q9FSB6; Match level="QueryCoverage=95%, HitCoverage=93%, E-value=0.0, Identity=51%"; Hit description=67kD chloroplastic RNA-binding protein, P67.1
  Pfam annotation: Domain name=PPR; Domain location=157-191; Score =32.1; E_value=1.9e-06; Accession=PF01535.11; Description=PPR repeat
  Pfam annotation: Domain name=PPR; Domain location=192-226; Score =31.1; E_value=3.8e-06; Accession=PF01535.11; Description=PPR repeat
  Pfam annotation: Domain name=PPR; Domain location=227-261; Score =15.3; E_value=0.12; Accession=PF01535.11; Description=PPR repeat
  Pfam annotation: Domain name=PPR; Domain location=262-296; Score =26.4; E_value=1e-04; Accession=PF01535.11; Description=PPR repeat
  Pfam annotation: Domain name=PPR; Domain location=297-331; Score =39.4; E_value=1.3e-08; Accession=PF01535.11; Description=PPR repeat
  Pfam annotation: Domain name=PPR; Domain location=332-366; Score =32.4; E_value=1.5e-06; Accession=PF01535.11; Description=PPR repeat
  Pfam annotation: Domain name=PPR; Domain location=367-401; Score =28.7; E_value=2e-05; Accession=PF01535.11; Description=PPR repeat
  Pfam annotation: Domain name=PPR; Domain location=481-515; Score =44.1; E_value=4.6e-10; Accession=PF01535.11; Description=PPR repeat
  Pfam annotation: Domain name=PPR; Domain location=516-550; Score =36.6; E_value=8.3e-08; Accession=PF01535.11; Description=PPR repeat
  Pfam annotation: Domain name=PPR; Domain location=551-585; Score =20.5; E_value=0.0061; Accession=PF01535.11; Description=PPR repeat
  Pfam annotation: Domain name=PPR; Domain location=586-620; Score =48.6; E_value=2.1e-11; Accession=PF01535.11; Description=PPR repeat
  Pfam annotation: Domain name=PPR; Domain location=621-655; Score =34.6; E_value=3.5e-07; Accession=PF01535.11; Description=PPR repeat
  Pfam annotation: Domain name=PPR; Domain location=656-690; Score =24.3; E_value=0.00043; Accession=PF01535.11; Description=PPR repeat
  Pfam annotation: Domain name=PPR; Domain location=691-725; Score =20.1; E_value=0.0078; Accession=PF01535.11; Description=PPR repeat
  Pfam annotation: Domain name=PPR; Domain location=727-761; Score =38.9; E_value=1.8e-08; Accession=PF01535.11; Description=PPR repeat
  Pfam annotation: Domain name=PPR; Domain location=762-796; Score =34.3; E_value=4.4e-07; Accession=PF01535.11; Description=PPR repeat
  Pfam annotation: Domain name=PPR; Domain location=863-897; Score=2.1; E_value=4.3; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR; Domain location=157-191::192-226::227-261::262-296::297-331::332-366::367 -401::481-515::...
  Pfam module annotation: Domain location=516-550::551-585::586 -620::621-655::656-690::691-725::727-761::762-796::863-897
  Subcellular localization annotation: CTP_CleavageSite=28; ConfidenceScore=5.43e-01
MAQPYPLCPSPSASSFSFHSRIPFFTIVPSHSKTLLHAPRFSLQPVNTLQDAKLDDPDAKSPSLSKNSIWVNPRSPRAKHLQKNSPHARSSSLTKLAKSLDSCNPTEQHVSEILNVLRDNVSERDAVFILNTMVNPNTALLALKYFQPKINPAKHVVLYNVTLKVLREVKDFEGAEKLFDEMLQRGVEPNLITFSTIISSASVCSLPDKAIKWFEKMPSFGVEPDASVGSFMIHAYAHSGKADMALELYDRAKAEKWRVDTVAFSVLIKMCGMLENFDGCLSVYNDMKVLGAKPNMVTYNTLLYAMGRAKRALDAKAIYEEMISNGFSPNWPTHAALLQAYCKARFCEDALGVYKEMKKKGMDVNLFLYNLLFDMCADVGCMDEAVEIFEDMKSSGTCQPDNFTYSCLINMYSSHLKRTDSLESSNPWEQQVSTILKGLGDNVSEGDVIFILNRMVDPNTASFVLRYFQNMVNFTRDKEVILYNVVINLFRKSRDFEGAEKLFDEMLQRGVKPDNITFSTLVNCASVSGLPNKAVELFEKMSGFGCEPDGITCSGMVYAYARTNNVDKAVNLYDRAKAENWSLDAVTFSTLIKMYSMAGNYDKCLEVYQEMKVLGVKPNVATYNTLLGAMLRSKKHRQAKAIHKEMKSNGVSPDFITYASLLEVYTRAQCSEDALGVYKEMKGNGMDMTADLYNKLLAMCADVGYTDRAVEIFYEMKSSGTCQPDSWTFSSLITIYSRSGKVSEVEGMLNEMIQSGFQPTIFVMTSLIRCYGKAKRTDDVVKIFKQLLDLGIVPNDHFCCCLLNVLTQTPKEELGKLTDCIEKANTKLGTVVRYLVEEQESDEGFRKETLELLNSIDAEVKKPLCNCLIDLCVKLNVPERACGLLDLGLMLEIYKNIQSKSQTQWSLHLKELSVGAAMTALHVWINDLSEALESGEDLPPLLGINTGQGKHKYSDKGLASVFESRLKELNAPFHEAKAGWFLVTKAAAKLWLESRDSTESIAGLNFLVLDVPTMAL

SEQ ID NO: 164830 - protein, 477 aa, Glycine max
  Coding DNA Sequence Number=SeqID_48052
  Gene Ontology: Mol. function=nucleic acid binding; Cellular component= endoplasmic reticulum membrane; Biological process=DNA integration
  Homolog annotation: Hit_ID=Q1T010; Match level="QueryCoverage=66%, HitCoverage=25%, E-value=2e-85, Identity=48%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MNTESRSETLSRRPLRIVDTCCALGVHEFNDSVSLARCWARGLWGLTQTQFFDKDEEFASGSGLWEEEAFGNLKLRRENEEEEEEIEVETYWSEEWEAQMREAILLGSSHTDTVMCCVLLCALRIDAFVARIETIRLVVAIAIIRGWSMHQLDVKSAFLNEPLDKEVYVIQPPGFEILDQEEILRLRKSLYDLKQAPRVWNKRIDNFLSQTSFVKCTSEHGVYLKVLKVVIGANLLIVCLYVDNLLVIRSNEREIEEFKKKMMKEFEMSDPRLLSYFLEIEFKTTENGIVMYQTRCVADMLKKFNMFKCNSTVTLAKTGLVLEKKRIEEFMNPTYFRKIIGSLRYLCNTMLDLGFSVGFISRFMETPRVSHLLAAKKIMHYVKRTLDYGILFPKVSDNLEVEMLGYSNSDWCGDKFDSKSVAAEYITLSMNNCQDVWLDTLMQEIKGVSLFYSATERRDPVKLNGNVRYLPFVRAAP

SEQ ID NO: 164831 - protein, 1032 aa, Glycine max
  Coding DNA Sequence Number=SeqID_48053
  Gene Ontology: Mol. function=binding; Cellular component =mitochondrion; Biological process=transport
  Homolog annotation: Hit_ID=Q9FSB6; Match level="QueryCoverage=93%, HitCoverage=94%, E-value=0.0, Identity=54%"; Hit description=67kD chloroplastic RNA-binding protein, P67.1
  Pfam annotation: Domain name=PPR; Domain location=177-211; Score =20.3; E_value=0.0072; Accession=PF01535.11; Description=PPR repeat
  Pfam annotation: Domain name=PPR; Domain location=212-246; Score =30.0; E_value=8.1e-06; Accession=PF01535.11; Description=PPR repeat
  Pfam annotation: Domain name=PPR; Domain location=247-281; Score =11.0; E_value=0.37; Accession=PF01535.11; Description=PPR repeat
  Pfam annotation: Domain name=PPR; Domain location=282-316; Score =20.7; E_value=0.0054; Accession=PF01535.11; Description=PPR repeat
  Pfam annotation: Domain name=PPR; Domain location=317-351; Score =29.1; E_value=1.6e-05; Accession=PF01535.11; Description=PPR repeat
  Pfam annotation: Domain name=PPR; Domain location=352-385; Score =26.7; E_value=8.3e-05; Accession=PF01535.11; Description=PPR repeat
  Pfam annotation: Domain name=PPR; Domain location=388-422; Score =25.4; E_value=0.0002; Accession=PF01535.11; Description=PPR repeat
  Pfam annotation: Domain name=PPR; Domain location=502-536; Score =36.7; E_value=8.2e-08; Accession=PF01535.11; Description=PPR repeat
  Pfam annotation: Domain name=PPR; Domain location=566-600; Score =20.1; E_value=0.0082; Accession=PF01535.11; Description=PPR repeat
  Pfam annotation: Domain name=PPR; Domain location=601-635; Score =39.6; E_value=1.1e-08; Accession=PF01535.11; Description=PPR repeat
  Pfam annotation: Domain name=PPR; Domain location=636-670; Score =39.1; E_value=1.6e-08; Accession=PF01535.11; Description=PPR repeat
  Pfam annotation: Domain name=PPR; Domain location=671-705; Score =19.5; E_value=0.012; Accession=PF01535.11; Description=PPR repeat
  Pfam annotation: Domain name=PPR; Domain location=706-740; Score =19.2; E_value=0.015; Accession=PF01535.11; Description=PPR repeat
  Pfam annotation: Domain name=PPR; Domain location=742-776; Score =37.9; E_value=3.6e-08; Accession=PF01535.11; Description=PPR repeat
  Pfam annotation: Domain name=PPR; Domain location=777-811; Score =33.7; E_value=6.4e-07; Accession=PF01535.11; Description=PPR repeat
  Pfam annotation: Domain name=PPR; Domain location=877-911; Score=3.4; E_value=2.9; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR; Domain location =177-211::212-246::247-281::282-316::317-351::352-385::388-422::502 -536::566-600::...
  Pfam module annotation: Domain location=601-635::636-670::671 -705::706-740::742-776::777-811::877-911
  Subcellular localization annotation: CTP_CleavageSite=69; ConfidenceScore=5.61e-01
MAQSYLPCNTSSSSSSSSSSSISPIPCSSAFYCRKPITTYNSFSYFSRHFKLPTFPLSHNKPKTLLQVQAANTPQDPDAKSSPLPQTSIWVNPKSPRAKHLWKNPYHARSSSLTKLAKSLDSCNPTQQHVSEILRVLGDNVFESDAVVILNSMVNPYTALLAVNYFNQKIKPSRHVVLYNVTLKLFRAVRDFEGEEKVFDEMLQRGVNPNLITFSTIISSASMFSLPHKAIEFFEKMPSFGVQPDAGLTSFMIHAYACSWNADMALELYDRAKAERWRVDTAAFLALIKMFGKFDNFDGCLRVYNDMKVLGTKPIKETYDTLLYVMGRAKRAGDAKAIYEEMISNGFSPNWPTYAALLEAYCKARCHEDALRVYKEMKKEKGMNVDVFLYNLLFDMCADVGCMDEAVEIFEDMKSSRTCQPDNFTYSCLINMYSSHLKQTESLESSNPWEQQVSTILKGIGDMVSEGDVIFILNKMVNPNTASFVLRYFLSKINFTTDKELILYNATLNLFRKSRDFEGAEKLFDEMLQRGVKPNNFTFSTMVNCANKPVELFEKMSGFGYEPDGITCSAMVYAYALSNNVDKAVSLYDRAIAEKWCLDAAAFSALIKMYSMAGNYDRCLKIYQEMKVLGVKPNVVTYNTLLGAMLKAEKHRQAKAIYKEMRSNGVSPDFITYACLLEVYTIAHYSEDALGVYKEMKGNGMDMTADLYNKLLAMYADMGYIDRAVEIFYEMNSSGTCQPDSWTFASLIAIYSRSGKVSEAEGMLNEMIQSGFQPTIFVLTSLVHCYGKAKRTDDVVKVFKQLLELGIVPNDHFCCSLLNVLTQAPKEELGKLTDCIEKANTKLGSVVKYLVEEEGDGDFRNEVSEFLNSIDAEVKMPLCNCLIDLCVKLNVPERACDLLDLGLMLEIYKNIQSKSQTQWSLHLKELSVGAAMTALHVWINDLSKALESGEDLPPLLGINTGKGKHKYSEKGLAGIFESHLKELNAPFHEAKAGWFLATKAPAKSWLESRGSIADLNFELYGFGCSNNDPKYR

SEQ ID NO: 164832 - protein, 210 aa, Glycine max
  Coding DNA Sequence Number=SeqID_48054
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q9FIU7; Match level="QueryCoverage=84%, HitCoverage=31%, E-value=2e-50, Identity=52%"; Hit description=Beta -glucosidase
  Pfam annotation: Domain name=Glyco_hydro_1; Domain location=2-208; Score=-218.4; E_value=9.7e-08; Accession=PF00232.9; Description =Glycosyl hydrolase family 1
MYQISYRPISMGKLPSSGIQPFVTLYHWDLPRMLEDKYEGWLSSQIIKTIEFHIQPLLDRKDYEHYAYTCFKAFGDRVKHWITFNEPHNFALHGYDLGIQAPGRCSLLVHLLCKKGKSSTDSYIVVHNILLSHAGAYRSYQIHFQGQQGGQIGIALDVIWYEPITELMKTKTQQQEVWTFHLDGNLSSSIMMIIIKCHCLVTTTKNSSST

SEQ ID NO: 164833 - protein, 82 aa, Glycine max
  Coding DNA Sequence Number=SeqID_48055
MAEISWQKFCGPKRNGGRFGLGFLKTSMVVGRREMLLQHGGVFRDSNGNLGACSVFMIQLSTILISLDLAYYREAPAVSILC

SEQ ID NO: 164834 - protein, 101 aa, Glycine max
  Coding DNA Sequence Number=SeqID_48056
PTIVSNMDVVHLGSFESPENVPLGVEEQVKLQEEYNEEVSEEGEYQEEAILCSTKTEGKESEAHITEEEEIEEEDEEGETKSEVEIAQDDELEEITSNNNK

SEQ ID NO: 164835 - protein, 124 aa, Glycine max
  Coding DNA Sequence Number=SeqID_48057
MRNREKKVKPIACHVIPWRSLGSGVGRMFRHQYLLVKQKIKRPEFSGSEGGGDCDDDMFGDVALVVGGHGGNELMRIGDGDGFLAGGGGLGNEVIGLGFEYEAEEGEVCYSPMGFRMCMSNLSN

SEQ ID NO: 164836 - protein, 85 aa, Glycine max
  Coding DNA Sequence Number=SeqID_48058
MWGEQRIAYLPQTRYLVAALSIATLKNFLFLMKLLRIQSMWLKILKLIPLLSALSQPSAWSHLIKTSFDYLLKKKVRNIKDFEVR

SEQ ID NO: 164837 - protein, 355 aa, Glycine max
  Coding DNA Sequence Number=SeqID_48059
  Gene Ontology: Cellular component=nucleus; Biological process =regulation of progression through cell cycle
  Homolog annotation: Hit_ID=Q2ABE7; Match level="QueryCoverage=83%, HitCoverage=80%, E-value=4e-80, Identity=54%"; Hit description =Cyclin D3-1
  Pfam annotation: Domain name=Cyclin_C; Domain location=195-311; Score= 20.1; E_value=0.001; Accession=PF02984.9; Description=Cyclin, C -terminal domain
  Pfam annotation: Domain name=Cyclin_N; Domain location=62-193; Score =102.8; E_value=1e-27; Accession=PF00134.13; Description=Cyclin, N -terminal domain
  Pfam module annotation: Pfam domain module=Cyclin_C::Cyclin_N; Domain location=195-311::62-193
MAHRYPKPLLDTLYCLKDHIHWEEEQVEDDEYSSSTTTTITNTNTDTSSVVFLEHDLFWDREELSSLLAKEHQNQLSNTLQKNLVLASSRQEAVEWILKVNAHYSFSTLTAVLAVNYLDRFLFSFRFQNDSNNNPWLTQLAAVACLSLAAKVEETHVPLFVDLQVEESKYLFEAKAVNRMEILVLSALGWQMNPVTPLSFLDYITRKLGLKGYLCLEFLRRLMGYLPYQAATATVMRVVNIVASRLGVEYQDQLLGILGIDKEKVEECYKLMMEVVSGYDEEGKRSKLKKRKFESIIPCSSQNCVKEESFSCDSSSNESWELGASSVSSSSKKTRSQDQLLLNHSNSSDFLSIPR

SEQ ID NO: 164838 - protein, 115 aa, Glycine max
  Coding DNA Sequence Number=SeqID_48060
  Subcellular localization annotation: CTP_CleavageSite=40; ConfidenceScore=5.31e-01
MQGYLMVTRTFRQPGAKETVDAQRLTSSPASSVVLTREVRANEPVETKRLTSSSAPTAIQEQRVRWQADIPYGHPHLSSMEGNEFDDIRMMLVLPSSSGNIQAQRRARFFSTGQG

SEQ ID NO: 164839 - protein, 391 aa, Glycine max
  Coding DNA Sequence Number=SeqID_48061
  Gene Ontology: Mol. function=RNA-directed DNA polymerase activity; Cellular component=chromatin; Biological process=chromatin assembly or disassembly
  Subcellular localization annotation: CTP_CleavageSite=86; ConfidenceScore=5.12e-01
MGRIEEALAKLLPSQPSFTSKLDDVLQKMATLETSQSSSPTSSANQHSVSFSPTAHHMKLEDPTGTLFKLNQKGSVNDYLSKFEVLANRIIGLPEEKLSDSRWFFRPRLHLSTSSSPLSTRQTTIPSSTSLLLAPPKPSYVPNKRFSSEEMTFNRGHKCSFKFFLLIAEEDDTMMGGADLGQLHSHPSEDVDQSPAQISFHALYGHLAPETLRLVGQITNHQVMILINGGSTHNFVGEFLDMVGNDNEIYCHQLCVGVAIHVQSFWPVLIDYNDLYMKCMRSGKVIELKLPSSQTSLSAIIHLTIAPLIQKFDHLFQAPTILPPQRDTNHAIHLLPYFSQSTFGHIVTHTSRSKSLKPSVITVKDRFPIPTIDEMLDELSGVGWFSKLDLL

SEQ ID NO: 164840 - protein, 134 aa, Glycine max
  Coding DNA Sequence Number=SeqID_48062
  Gene Ontology: Mol. function=chromatin binding; Cellular component =chromatin; Biological process=chromatin assembly or disassembly
  Homolog annotation: Hit_ID=Q1SAV4; Match level="QueryCoverage=54%, HitCoverage=21%, E-value=2e-09, Identity=40%"; Hit description =Integrase, catalytic region
MDSKHFHASTTARKKRNHICALEDDGRSIYDGFVGDHKHVVEKVAPKITQQENDRLIRWLRMAKQEGGLLLGWPDGMVSAWSSGKTDECVILLVAETYKLHVHPVQKFEMGHSSTLQALRKMIQQPIFDNEGAV

SEQ ID NO: 164841 - protein, 154 aa, Glycine max
  Coding DNA Sequence Number=SeqID_48063
  Homolog annotation: Hit_ID=Q1T4N4; Match level="QueryCoverage=98%, HitCoverage=33%, E-value=4e-08, Identity=30%"; Hit description =Polynucleotidyl transferase, Ribonuclease H fold
MESLQERAPNSCKLAYSSHILATCSQSIICWKTIGLDLILLRLFDQLKSEDQSRVSMLLWSLWRKRNKKVWDNKLLSESKVIQQAGDMFYQDWMSAKDLSVTRGHEQHNHYRVQWVPPPTVLVSETVLESFLWQGQNGGSLVCQCWKEKHGPYG

SEQ ID NO: 164842 - protein, 83 aa, Glycine max
  Coding DNA Sequence Number=SeqID_48064
MEKRVAILQEWFDRVDSEKSGSITAVQLKTALAVGNLEFPLSVVQQMIRGRGFLVPDDVFEALVKIGFMLDSPAFYSVCEEPV

SEQ ID NO: 164843 - protein, 371 aa, Glycine max
  Coding DNA Sequence Number=SeqID_48065
  Gene Ontology: Mol. function=transcriptional repressor activity; Cellular component=cyanelle; Biological process=regulation of nitrogen utilization
  Homolog annotation: Hit_ID=Q6Z3F9; Match level="QueryCoverage=57%, HitCoverage=64%, E-value=1e-102, Identity=79%"; Hit description =Putative NADPH-dependent reductase
  Pfam annotation: Domain name=NmrA; Domain location=145-335; Score= -45.7; E_value=1.7e-05; Accession=PF05368.3; Description=NmrA-like family
MLVYQRQNVNPRKLHRHKQSSPLGLPQIRWHRNHCVLYRNLRVKLRQTRRVTQHHGHQFLGRVYGVRDETHAASGIFLIRSRKRERAMNMMKVWDAAQGTHNHNDIWHCPTAMAVQCKCSNHHTGVSGGKRRMELEGEMQQGRRVLGLGRQIVRRALDEGYDVSKPETIPATLVGIHTVIDCATGRPEEPIKTEGKVALIQCAKAMGIQKYVFYSIHNCDKHPEVPLMEIKFCIEKFLRDSGLNHVIIRLCGFMQGLIGQYAVPILEEKSVWGTDAPTRIAYMDTQDIARLTFIAIRNDKLNGKLLTFAGPRAWTTQEVITLCERLAGQDANVTTVPVSILRLTFLSGQMMLLTDSHFQRYYPYLPSSLLN

SEQ ID NO: 164844 - protein, 242 aa, Glycine max
  Coding DNA Sequence Number=SeqID_48066
  Gene Ontology: Mol. function=protein binding; Cellular component =nucleus; Biological process=regulation of progression through cell cycle
  Homolog annotation: Hit_ID=Q40671; Match level="QueryCoverage=97%, HitCoverage=56%, E-value=3e-92, Identity=69%"; Hit description =G2/mitotic-specific cyclin-2
  Pfam annotation: Domain name=Cyclin_C; Domain location=119-240; Score= 169.3; E_value=1e-47; Accession=PF02984.9; Description=Cyclin, C -terminal domain
  Pfam annotation: Domain name=Cyclin_N; Domain location=1-117; Score =200.4; E_value=4.3e-57; Accession=PF00134.13; Description=Cyclin, N -terminal domain
  Pfam module annotation: Pfam domain module=Cyclin_C::Cyclin_N; Domain location=119-240::1-117
NSSRVSPNYMNSQFDINERMRAILIDWLVEVHYKFELLEETLFLTVNLIDRFLERQAVIRKKLQLVGVTAMLIACKYEEVSVPTVEDFILITDKAYTRNEVLDMEKLMMNILQFKLSVPTPYMFMRRFLKAAHSDKKLELLSFFLVELCLVECKMLKFSPSLLAAAAIYTAQCSLYQFKQWTKTTEWYTDYSEEKLLECSRLMVTFHQKAGSGKLTGVYRKYNTWKYGCAAKIEPALFLLDN

SEQ ID NO: 164845 - protein, 980 aa, Glycine max
  Coding DNA Sequence Number=SeqID_48067
  Gene Ontology: Mol. function=aminoacyl-tRNA ligase activity; Cellular component=membrane fraction; Biological process=alanyl-tRNA aminoacylation
  Homolog annotation: Hit_ID=Q9FFC7; Match level="QueryCoverage=92%, HitCoverage=95%, E-value=0.0, Identity=69%"; Hit description=Alanyl -tRNA synthetase
  Pfam annotation: Domain name=DHHA1; Domain location=896-969; Score =69.4; E_value=1.2e-17; Accession=PF02272.9; Description=DHHA1 domain
  Pfam annotation: Domain name=tRNA-synt_2c; Domain location=85-650; Score=873.7; E_value=8.9e-260; Accession=PF01411.9; Description=tRNA synthetases class II (A)
  Pfam annotation: Domain name=tRNA_SAD; Domain location=747-790; Score= 82.0; E_value=1.9e-21; Accession=PF07973.4; Description=Threonyl and Alanyl tRNA synthetase s
  Pfam module annotation: Pfam domain module=DHHA1::tRNA-synt_2c::tRNA _SAD; Domain location=896-969::85-650::747-790
  Subcellular localization annotation: CTP_CleavageSite=51; ConfidenceScore=5.34e-01
MEGLALPVAQSQSQQLPFPRPKLSAIPAGTAYGFVSLKRHRGSGFRFRTCLCSQAQAQAQAQAQGVPLPEQVTVTDPDNSVSGDSIRQRFLNFYASRGHKVLPSASLVPDDPTVLLTIAGMLQFKPIFLGKIPRQVPCAATAQRCIRTNDIHNVGLTARHQTFFEMLGNFSFGHYFKKQAILWAWELSTAEFGLPPDRLWISVYEDDDEAFQLWSHEVGVPVERIKRLGEEDNFWTSGVTGPCGPCSEIYYDFYPERGYVDADLNDDTRFIEFYNLVFMQYNKKDDGSLEPLKQKNIDTGLGLERMARILQKVPNNYETDLIFPIIEKASKLANVSYGIADDQTKRNLKIIGDHMRAIVFLISDGVVPSNVGRGYVVRRLIRRVVRTGRLLGINGDGRGDLEGAFLPMIAEKVVELSTHIDADVKNKAPRIFEELKREELRFVQTLERGEKLLEEKLSDALSSAERNGTVPCLAGEDVFLLYDTYGYPMEITKEVAEERGVSIDMDGFDIEMEKQRRQSQAAHNTVKLAIENGENIAENVPDTEFIGYDRLHCKAMIESLTVNGNPVPQVSEGSNVEVLLNKTPFYAESGGQIGDHGFLYISEGENQLKAVVEILDVQKSFGNIFVHKGTVQKGVVEVGKEVKAAVDVKLRQRAKVHHTATHLLQAALKKVIGQETSQAGSLVAFDRLRFDFNFHRPLRDSELAEIEKLINGWIEDATLLQTKVMPLVDAKSAGAIAMFGEKYGEEVRVVEVPGVSMELCGGTHVRNTSEIRGFKIISEQGIASGIRRIEAVAGEAFIEYINARDFYLKQLCSTLKVKPEEVTTRIENLLEELRVVRNENSAVRAKAAIYKASVIASKALLVGNSKQYRVLVECFDDVDAESLKSAAEYLLETLTDPAAVILGSCPGEGKVSLVAAFTPGVVDQGIQAGKFIGQIAKLCGGGGGGRPNFAQAGGRKPENLASALDKARSELIATLCEKGN

SEQ ID NO: 164846 - protein, 460 aa, Glycine max
  Coding DNA Sequence Number=SeqID_48068
  Gene Ontology: Mol. function=ATP binding; Cellular component =endoplasmic reticulum; Biological process=response to stress
  Homolog annotation: Hit_ID=Q0WM51; Match level="QueryCoverage=93%, HitCoverage=86%, E-value=1e-113, Identity=42%"; Hit description=HSP like protein
  Pfam annotation: Domain name=HSP70; Domain location=1-422; Score= -136.3; E_value=1.2e-10; Accession=PF00012.10; Description=Hsp70 protein
MMLGHTASLAEFHAKVPIKDAVIAVPPNLGQAERRGLLVAVQFAGINVLSTYAAVVYFSSCGKVNPELGGQHMELRLVEYFADEFNAQVGGGIDVRHFPKAMATLKKQVKRRKEMLSANTVAPISVESLDDGVDFGSTMNREKFEDLCQDIWDKSLLPVKEVLQHSGLSLDLIYALQLIGGATRVPKLQAQLQQFLGRKQLDRHLDADEAIVLGSAPHAANLSDGIKLKSKLGILDASMYGFVVELSAPDLSKDESSRQLLVPQMKKVPTYESEHHLPPGVTSPEIAQYQISGLTDANAIIEITERVEVPRKNMTIENSTISSNVSAESAGSNSSEENMQTDSEISKTSNGSAEEQATAAEPATEEKLKKRTFRERQSFIEKLDQVQDWLYRDGEDANATEFQELLDQLKTVGNPIFFRLKELTARPAAVEHAHRYIDELKEWKANKSWFPQEQEARIYL

SEQ ID NO: 164847 - protein, 32 aa, Glycine max
  Coding DNA Sequence Number=SeqID_48069
MKVNSPDEGKGSKDSKTVSYQEVSTIKLKLYD

SEQ ID NO: 164848 - protein, 94 aa, Glycine max
  Coding DNA Sequence Number=SeqID_48070
MGVASNIGGFKTNHHPYKLIFQFSTKVILLEDGAVPNIVVRIECTLFGEYVDKLNASLLLEKVNGLICFGSVGYVILGSDLIYLDNMRLKETMV

SEQ ID NO: 164849 - protein, 126 aa, Glycine max
  Coding DNA Sequence Number=SeqID_48071
  Gene Ontology: Mol. function=DNA binding; Biological process=DNA integration
  Homolog annotation: Hit_ID=Q1SKC8; Match level="QueryCoverage=60%, HitCoverage=22%, E-value=1e-19, Identity=53%"; Hit description =Integrase, catalytic region
MGSKIYPKVRENPKAFFINSSPILLEPLAHDFGNWSFPKEDCIIREQRKIQLLELEEMKLIAYESSRLYKERVKAYHDKKQLKKDFEPGQQVKSKWSGPFIIKEVRPYGAIELYDPQSQDPDKTWV

SEQ ID NO: 164850 - protein, 133 aa, Glycine max
  Coding DNA Sequence Number=SeqID_48072
MEASMRRLNGCGKGNLGIMGVPKSHIGQYGMINGIFKCLVIMLIQTSVLSSVEAGLCYVSDDGKDVLCDRMPSGETWQVGLKCNKYPLDWCRKAEPVEEDKRNADDPYRSSCLVSFGQPSTASIMTENTTPNM

SEQ ID NO: 164851 - protein, 89 aa, Glycine max
  Coding DNA Sequence Number=SeqID_48073
MVSGNRLPGDRDGSLVIDYQIAMVAQLIRERVEMECLEGAWETLEGNTRCRFRGTIRFTATSLVHPDEPARTLQRTVEWTALWIRFVYF

SEQ ID NO: 164852 - protein, 150 aa, Glycine max
  Coding DNA Sequence Number=SeqID_48074
VIRKNPSSEILPEELLLPESIRKRCSGRLPEEVFFRKTFGIFWKNTSSEKFPENLLPDVPKEPLTGLPEASAVSPLSPFFPASSTLVFYPKQWRVRETNLEGSSRRRRRSLARGVAEKTKKLGSRCHKGAAGIGRRKEAASGLPGRGARF

SEQ ID NO: 164853 - protein, 283 aa, Glycine max
  Coding DNA Sequence Number=SeqID_48075
  Gene Ontology: Mol. function=chromatin binding; Cellular component =chromatin; Biological process=regulation of transcription, DNA -dependent
  Homolog annotation: Hit_ID=Q946J8; Match level="QueryCoverage=53%, HitCoverage=32%, E-value=5e-24, Identity=43%"; Hit description =Protein LIKE HETEROCHROMATIN PROTEIN1
  Pfam annotation: Domain name=Chromo; Domain location=63-113; Score =76.8; E_value=6.9e-20; Accession=PF00385.14; Description='chromo' (CHRromatin Organisation MOdifier
MKKRSCSSSSSVFEEANGVEDEAEPQQPSSCAAAALDELHKEKNENGEETLVPPNPNLDDGFYEIETIRRKRLRKGQLQYLIKWRGWPETANTWEPLGNLQSVPDLIDAFEESLLKSGKHHKRKRKHADVVQLTQLKKRSERSTTSYSLRHFPPQVPTLTNDYDPKLSELKEAPTNTGVQLDNLAIHFQHPIPSRGAKRRKSASSVKRFKRDPDAAAIQPIAAPIHMPDATNTACNIVKIIKPIGYSASLSDNMHDVLVTFMAMRFVTQPTTPNFALTPFIKK

SEQ ID NO: 164854 - protein, 86 aa, Glycine max
  Coding DNA Sequence Number=SeqID_48076
  Gene Ontology: Mol. function=hydrolase activity, acting on ester bonds; Biological process=lipid metabolic process
MTSTKEGKMMMKPTTKKEERRGRIMCHPYLSFQASDKFLGFRDALYLIDIGQNDLANSFAKNLSYAQVIKKIPTVITEIENVVKLK

SEQ ID NO: 164855 - protein, 54 aa, Glycine max
  Coding DNA Sequence Number=SeqID_48077
MLGCVCGVRDQDKVMNIRVEPGAEAPNTGTLDGGCACRVFFKNVMADALYSPKY

SEQ ID NO: 164856 - protein, 182 aa, Glycine max
  Coding DNA Sequence Number=SeqID_48078
  Gene Ontology: Mol. function=mRNA (guanine-N7-)-methyltransferase activity; Cellular component=nucleus; Biological process=mRNA processing
  Homolog annotation: Hit_ID=Q9LHQ7; Match level="QueryCoverage=73%, HitCoverage=36%, E-value=6e-55, Identity=74%"; Hit description=mRNA cap guanine-N7 methyltransferase 1 (EC 2.1.1.56) (mRNA (guanine- N(7)-)-methyltransferase 1)
  Pfam annotation: Domain name=Pox_MCEL; Domain location=1-173; Score= -84.9; E_value=8e-09; Accession=PF03291.7; Description=mRNA capping enzyme
MVRLDKVLVDDAPFDICSCQFALHYSWSIEARARQALANVSALLHPGGIFIGTMPDANVNIKKLREAEGLTFGNRVYWVRFDEEFSDNKFKSSSPFGIKYTFHLEDAVDCPKWIVLFHVFKSLAEGIFISVICIEKGQYPKHLSWLLHADNENDSNSSIQQSQVITRPIRNRNKPAYLNDYA

SEQ ID NO: 164857 - protein, 197 aa, Glycine max
  Coding DNA Sequence Number=SeqID_48079
  Homolog annotation: Hit_ID=Q9LHQ7; Match level="QueryCoverage=46%, HitCoverage=24%, E-value=3e-19, Identity=82%"; Hit description=mRNA cap guanine-N7 methyltransferase 1 (EC 2.1.1.56) (mRNA (guanine- N(7)-)-methyltransferase 1)
MEIVELNFQHGKNLFDSIVGVEVPIYFSKVLKKVVYNFLEDEITKILKVADHYSARSNQTLKEREASPIIHLKKLNNWLLFIYQKTFSVSWLTIESILFCFIMFTRVVILSNGTRPKLDIMLVLTLLKARQQLHLLPMKHQSCIFFMYPYRIYIGYELMQSYPARALGRRLQVDWARDPREGPRVLMSLRVDFEPMG

SEQ ID NO: 164858 - protein, 68 aa, Glycine max
  Coding DNA Sequence Number=SeqID_48080
MSSSEMCIDPRSLLPLGWVLSETSRLGDLRAPSSIHRAMSITKLNLHRSERGYDEDIGKRSWVVDERG

SEQ ID NO: 164859 - protein, 295 aa, Glycine max
  Coding DNA Sequence Number=SeqID_48081
  Gene Ontology: Mol. function=chromatin binding; Cellular component =chromatin; Biological process=chromatin assembly or disassembly
  Homolog annotation: Hit_ID=Q1SAV4; Match level="QueryCoverage=81%, HitCoverage=43%, E-value=9e-35, Identity=55%"; Hit description =Integrase, catalytic region
MSGQQLYLSKLLGRFIQDPRDTNSAITVIHSQFPFNGVTPTSVSGELHISGAPPPDIICKLHGSPGSLVFDRCLIFISSFWRELFFLSGTKFCMSMAYHPQTDDQTGVLNRSGRITPLYMPARASLHLKLHTTNPRLHFHYTSKVLQQWKPSIHSLPPRFCMSMAYHPQTDDQTGVLNRVFEQHLCSFVHDQPNHWYKFLSLVEWSYNTFVHASTGFTPFEVTYNKPSPSLPLYLQGSSTVEAIDSLLTSRAAIHSVLQQRLQKYQTSMKTQANAHHRDLKFTVGNWVYVKLRSY

SEQ ID NO: 164860 - protein, 147 aa, Glycine max
  Coding DNA Sequence Number=SeqID_48082
  Gene Ontology: Mol. function=phosphopantetheinyltransferase activity; Biological process=macromolecule biosynthetic process
  Homolog annotation: Hit_ID=Q2RAV1; Match level="QueryCoverage=73%, HitCoverage=44%, E-value=4e-21, Identity=42%"; Hit description=4' -phosphopantetheinyl transferase superfamily protein
  Pfam annotation: Domain name=ACPS; Domain location=1-53; Score=-3.4; E_value=0.086; Accession=PF01648.10; Description=4'-phosphopantethein yl transferase superfamily
MRASPGAAVKLCLGDLLVMGSNPETASLHMQRYWSLKEAYVKAIGSGLTEGLNKVEFSHTRWTNISAKVDGKTMTEWRFWLFELGDRHCVSIARVHPISATTSYKTTLKKVDFTEEEYTLGLHLPNVGIVKLDVEQLISILQKASDF

SEQ ID NO: 164861 - protein, 179 aa, Glycine max
  Coding DNA Sequence Number=SeqID_48083
  Gene Ontology: Mol. function=phosphopantetheinyltransferase activity; Biological process=macromolecule biosynthetic process
  Homolog annotation: Hit_ID=Q2RAV1; Match level="QueryCoverage=71%, HitCoverage=45%, E-value=5e-35, Identity=59%"; Hit description=4' -phosphopantetheinyl transferase superfamily protein
MEEGVRRWVVDISKWDPHPSHFSFALSLLPSHEHSSVTRFVKMEDRKRALVSRMLQYVLVHDVLQIPFPDIVIKRTLEGKPYLDYYDKFDLRFPNFNFNVSHHGDYVAIASEPVCLVGVDIVSYDVPQGETTTEFIQFFSSYFSSLEWDNIVNSGTLNDVLTEFYRFNSSRCCCSSMQK

SEQ ID NO: 164862 - protein, 351 aa, Glycine max
  Coding DNA Sequence Number=SeqID_48084
  Gene Ontology: Mol. function=RNA-directed DNA polymerase activity; Cellular component=chromatin; Biological process=chromatin assembly or disassembly
  Pfam annotation: Domain name=Chromo; Domain location=286-334; Score =9.7; E_value=0.069; Accession=PF00385.14; Description='chromo' (CHRromatin Organisation MOdifier
  Pfam annotation: Domain name=rve; Domain location=36-186; Score=2.2; E_value=0.0039; Accession=PF00665.16; Description=Integrase core domain
  Pfam module annotation: Pfam domain module=Chromo::rve; Domain location=286-334::36-186
DHPNYAIIQDLIMHKGSIWLPKELGFITSLLNKFHTSPTGGHMGVTKTLARIGENFTWSGMKHNDISLDQFSKGIHLGILQTHFTAYTVALFFMDIMDKIHGMPYSLISDQYPLFICHLWQELFKLSGTKLRMSSAYHPQTDGQKEYLAGTSKLEVVDDFLINREIMFASLKKKMIKAKETMKRFADNHRRDISFKVGDWVLVKLRPHRQTSVKGESYSKLAKCFYGPYQILERIGNVAYKIKFPDNSHIHPVFHCSLLKPCPYSLATAFKGVELPPTTVNDYPIISLLVILDSKWEHSEPEVQLMVLVHWEGLSLDDTSWENWNKLKADYHLEDKVLLDVGRNVIDQQAH

SEQ ID NO: 164863 - protein, 86 aa, Glycine max
  Coding DNA Sequence Number=SeqID_48085
  Gene Ontology: Mol. function=RNA-directed DNA polymerase activity; Cellular component=chromatin; Biological process=chromatin assembly or disassembly
MGLGDFALIITPGTPLQNPFPIPTIDELLDELGEASWFSKLDLLQGYHQILMKEEDISKTAFRTHHEHYEFRVIPFGLCNTPSTFQ

SEQ ID NO: 164864 - protein, 206 aa, Glycine max
  Coding DNA Sequence Number=SeqID_48086
MVWRDKSQLFEPLDSKNQICPTQWKNIKVNGETLALNMNGDHCIKMVAFNLITIAHHHSKRVAGVERVKVEEVGLRVGDMVMVEEGKVDGFGPGNSDIGQEAFLPKVEPRLRPGPVGFRWDHHSGTGQNKPQGPKGILAMKRFGHSGQRGSFHQIVELPTSLAEDVMRNGTGSQMKKKVEKSVVGIAVVVEWFPGWSFAGVARPIW

SEQ ID NO: 164865 - protein, 103 aa, Glycine max
  Coding DNA Sequence Number=SeqID_48087
MSGGGGGGVFVTLMDPHNPSMLSNGGQGERLWTGSLVWFHAISRTMQGCLLCPTNVLEKLSATDFGQSFEVFGISIIAIGASPICQQLPQHQCDCDFRNLVPA

SEQ ID NO: 164866 - protein, 144 aa, Glycine max
  Coding DNA Sequence Number=SeqID_48088
  Homolog annotation: Hit_ID=Q0Q5B3; Match level="QueryCoverage=24%, HitCoverage=15%, E-value=1e-09, Identity=69%"; Hit description=2C -methyl-D-erythritol 2,4-cyclodiphosphate synthase
GITGFQTVEVKAVTNPKGKKLGGSGGDRGFVDLDGGGVADLGAAGNTEELDKFSSCTSETVESPEKLGVSAESHPGNGIFDFMDLLQNVKLTVIELVSRVSGFLQNIFPPPDADAMKEKMSGDVDGNTKASFMDSKISMGGTFT

SEQ ID NO: 164867 - protein, 682 aa, Glycine max
  Coding DNA Sequence Number=SeqID_48089
  Gene Ontology: Mol. function=RNA binding
  Homolog annotation: Hit_ID=Q69N36; Match level="QueryCoverage=61%, HitCoverage=42%, E-value=2e-42, Identity=28%"; Hit description =Agenet domain-containing protein / bromo-adjacent homology (BAH) domain-containing protein-like
  Pfam annotation: Domain name=Agenet; Domain location=298-379; Score =76.9; E_value=6.5e-20; Accession=PF05641.3; Description=Agenet domain
  Pfam annotation: Domain name=BAH; Domain location=73-190; Score=38.7; E_value=2e-08; Accession=PF01426.8; Description=BAH domain
  Pfam module annotation: Pfam domain module=Agenet::BAH; Domain location=298-379::73-190
MDVLYSVQLEHSAQADESLKTLTPGINVNNRILPDKMISRKLKFQSSDIEWSGFSWFCAKQLKHYSGFCRNGTTINVHSFVYIMAEEENHYLGYLEDMYEDKKRQKKVKVRWFHRGQEVKHVIAQLKLQEGEVFITPHVQVISAECVNGPATVLTPKHYEKYLAAVSHTSLSEIHMCFRQFKNNKLKPFALTKLRGYSNQSVVSSLNSSTHSKRKAKFEKSHTDDDENFTQDDPLRSSNKRVRSSKDHVLEKGFSGLQISLPTKEMAKCEPKYPSLKLKLSRKTMGIKVIGPKPQLSFQVGAKIEVLCQDSGIRGCWFRCKILSMSPRLLKVQYDDLLEIDGPQKLEEWVPASRVAAPGKLGMRCSGRLTVRPCPPEYNTGHTFEIGAPVDAWWCDGWWEGVITAVNVSGDGILQVYTPGEERFLKVEKKNIRISRDWINNRWVDIQGKPDICSYLSSNVRSSIRMSANSAAVDASMSDCSAILESKASTIAKVEVAKKVEPELSGLEAPVDLENKKGITLREPLYAIHEDKDNNSGGIRMSANSAVVDASMSDGSAILKSKPSTIAKVEVAKKVEPELSGLEAPLDLENKKGITLREPLYVIHEDKDNNSGGGCDDDEADKAVKTLLALNEHKDKNSGGGSDSDTDNDDVDIDTDNDDEDSGEDFNCSEPKLNAAEAIQVA

SEQ ID NO: 164868 - protein, 282 aa, Glycine max
  Coding DNA Sequence Number=SeqID_48090
  Homolog annotation: Hit_ID=A0CIC5; Match level="QueryCoverage=48%, HitCoverage=4%, E-value=6e-08, Identity=25%"; Hit description =Chromosome undetermined scaffold_19, whole genome shotgun sequence
  Subcellular localization annotation: CTP_CleavageSite=81; ConfidenceScore=5.74e-01
MASGTVKPSSRYRSYDSRSSTSSHFSDPSSSHEFNNLKTKTSSSSSRALVKAKPSNTAKLDPTFTTMVKKFMDRKPKSSSSAAATATRLIIPSDFLAKDLKKDAKKVAGFSALQKKLFGKGASEKKEKVKALTEVKNNTRTLAMVLRSERELLSINKEQEQQVSQLKQMLEDKNKEVEKLKDLCLKQREEIKSLKSAILFPDVMNSQLQELLEKQGSELKQAKQVIPALQQQVSSLTGQLQSLAEDLAEVKADKYSAKAGLPGYGSSPRTPTHAREDASNFW

SEQ ID NO: 164869 - protein, 554 aa, Glycine max
  Coding DNA Sequence Number=SeqID_48091
  Gene Ontology: Mol. function=transferase activity; Cellular component= nucleus; Biological process=regulation of transcription, DNA-dependent
  Homolog annotation: Hit_ID=Q10CS4; Match level="QueryCoverage=98%, HitCoverage=98%, E-value=1e-176, Identity=56%"; Hit description =Transcriptional adaptor, putative, expressed
  Pfam annotation: Domain name=Myb_DNA-binding; Domain location=105 -151; Score=52.1; E_value=1.8e-12; Accession=PF00249.21; Description =Myb-like DNA-binding domain
  Pfam annotation: Domain name=SWIRM; Domain location=468-554; Score =38.3; E_value=2.7e-08; Accession=PF04433.7; Description=SWIRM domain
  Pfam annotation: Domain name=ZZ; Domain location=44-89; Score=43.1; E_ value=9.6e-10; Accession=PF00569.8; Description=Zinc finger, ZZ type
  Pfam module annotation: Pfam domain module=Myb_DNA-binding::SWIRM::ZZ; Domain location=105-151::468-554::44-89
MGRSRGNFHHADEDPNQRSRRKKNAASGENSESGAAGQGAGEGKKALYHCNYCNKDITGKIRIKCAMCPDFDLCIECFSVGAEVTPHKSSHPYRVMDNLSFPLICPDWNADDEILLLEGIEMYGLGNWTEVAEHVGTKNKESCIEHYRNVYLNSPFFPVPDMSHVVGKNRKELLAMAKGQGEDKKGISMGDLSIKAESSFSPSRAKVEDSHKAGSSNRLASGLNSESDGPLGNTHAANQKASNVGRGKGGPGIIKMEDSQLDRDFGGKKPTSSGNEGPSLVESSGYNAKRQEFDPEYDNDAEQLLAEMEFKDTDTDDERELKLRVLRFYAKRLDERKRRKDFILERNLLYPNPFEKDLTPEEKTICRKYDLFMRFHTKEEHEELLRTVISEHRTRKRLQELKEARAAGCRNSAEADRYLAQKRRREAEESGCRTKESAQGGPSNQGVPNALMSPDSAGKDLSGRPPGPATSSSVNEMDVTGYYGADLLSEPEKRLCCELRLPPAMYLKMQEQLSLQILAGTVAAKSDAHQLFKMDAMKIDRVYDMLIKKGIGSP

SEQ ID NO: 164870 - protein, 272 aa, Glycine max
  Coding DNA Sequence Number=SeqID_48092
  Gene Ontology: Mol. function=ferredoxin hydrogenase activity; Cellular component=periplasmic space; Biological process=electron transport
  Homolog annotation: Hit_ID=O23488; Match level="QueryCoverage=86%, HitCoverage=28%, E-value=1e-26, Identity=52%"; Hit description=LET1 like protein
  Pfam annotation: Domain name=DUF588; Domain location=26-246; Score =92.5; E_value=1.3e-24; Accession=PF04535.3; Description=Domain of unknown function (DUF588)
MSSYLGVGVSPGNVPVYHSTNVKVLDRKIKITELVLRCVILGLGVLAAVLVGTDSEVKEFFSFQKEAKFTDMKSLVFLVVANGLAAGYSLIQGLRCILSMIRGRVLFSKPLAWAIFSGDQFEHLIFSFLEFMLSTCVRGPTWVGLRLRLKFRQQNIRISSLSCQARVTGTVGDPFREPYLIDVKTWALFTVMAYVTVVALAAAGQSGMIARVGQPELQWMKICNMYGKFCNQVGEGIASAFVASLSMVVMSCISAFSLFRLYGGNKTKNVHW

SEQ ID NO: 164871 - protein, 395 aa, Glycine max
  Coding DNA Sequence Number=SeqID_48093
  Gene Ontology: Mol. function=hydrolase activity, acting on glycosyl bonds; Cellular component=cellular_component; Biological process =carbohydrate metabolic process
  Homolog annotation: Hit_ID=Q68UW1; Match level="QueryCoverage=99%, HitCoverage=100%, E-value=1e-162, Identity=68%"; Hit description =Polygalacturonase
  Pfam annotation: Domain name=Glyco_hydro_28; Domain location=60-394; Score=355.8; E_value=6.9e-104; Accession=PF00295.8; Description =Glycosyl hydrolases family 28
MANPTPKPSPSLIILRVILGCWLCSSVALGATYNVVNFGAKSDGKTDSTKAFLNAWAKACASTNPASIYVPQGKFLLKSATFNGKCNNKGISITIDGTLVAPSDYRVTENSGNWLEFERVNGVSIHGGALDGQGTALWDCKNSGKGNCPSGATTLAFTNSNNIAIGGLTSMNSQLFHIVFNGCQNVKLQGVKVLADGNSPNTDGIHIQMSSHVAIINSKIRTGDDCISIGPGTTNLWIENIACGPGHGISIGSLGKDLKEAGVQNVTVKTVTFTGTQNGVRIKTWGRPSNGFVRNVLFQDAIMENVENPVIIDQNYCSDNKGCPGFWSQSDVTYQDIHGTSATHVAVKFDCSSKYPCSGIKLEDVKLTYKNQPALASCNHAGGAALGSVQPESCF

SEQ ID NO: 164872 - protein, 111 aa, Glycine max
  Coding DNA Sequence Number=SeqID_48094
MLIGQSNRVFSLCMWGKEAQAYLSFFWVRRGKSIAKAEKDNDKKPRGMSEVAHGRDVRKLATYKHKKLMRLYRLRDYTSQIHLSETVALRLIYMSQLPKVLTTLLILKPEI

SEQ ID NO: 164873 - protein, 96 aa, Glycine max
  Coding DNA Sequence Number=SeqID_48095
  Gene Ontology: Biological process=cell adhesion
  Homolog annotation: Hit_ID=Q2QVD8; Match level="QueryCoverage=80%, HitCoverage=31%, E-value=2e-08, Identity=37%"; Hit description =Expressed protein
SQSQPFNHAFNHTDLQAAIGDMRAKSYYGFVMLLQMLNGTSQPNRDLTFLMPDDKELSASSISTDEVEEFFLKHALPMPLYFNDLSHFPTGTHPTD

SEQ ID NO: 164874 - protein, 161 aa, Glycine max
  Coding DNA Sequence Number=SeqID_48096
MMEVNTATVVAASTTTEVDPTHPSGINQASHPVPDMVGQGGGALGSTSGPHFVQVPQPMGETYEAPRDHTLADSEPHLGYATEGQAFGGIPLPNTLGGPSVSATTTTLTFCGGKTTSYHGGRNYAFADMVELCLVPDVVIPLKFKVPDFDKYTGLLAPRIT

SEQ ID NO: 164875 - protein, 146 aa, Glycine max
  Coding DNA Sequence Number=SeqID_48097
MSVAFSGRSLSQTNWLSEKVLYTKVSRIDRLTIAQSNSCRLRFPALIIALCRARGVVSNSLTFERLSPAINLAYIRKNCWNVDDLTVAFRGAKRARARPADIPSTSAAPAPTPASTSAAPSVPAHVDYERFKAMLQSIHQGQILLL

SEQ ID NO: 164876 - protein, 152 aa, Glycine max
  Coding DNA Sequence Number=SeqID_48098
  Gene Ontology: Mol. function=structural constituent of ribosome; Cellular component=ribonucleoprotein complex; Biological process =metabolic process
  Homolog annotation: Hit_ID=Q2PEV2; Match level="QueryCoverage=61%, HitCoverage=14%, E-value=9e-41, Identity=87%"; Hit description =Putative UDP-glucose pyrophosphorylase
MALGPREMREKKLLTDLYTCREGVLTRNPARTNPLNPVIDLGPEFEKFGDFQSRFRSIPSIIELDSLMVRGDVWFGANITLKGQVTIAAKPGLKLEIPDGVTIENKVGCVLGEFVLFGLFFLSAFGLGIMGDQRPCRYLRMNVVEVAEIWFQ

SEQ ID NO: 164877 - protein, 267 aa, Glycine max
  Coding DNA Sequence Number=SeqID_48099
  Gene Ontology: Mol. function=calmodulin binding; Cellular component =integral to membrane; Biological process=response to biotic stimulus
  Homolog annotation: Hit_ID=O49621; Match level="QueryCoverage=65%, HitCoverage=33%, E-value=1e-67, Identity=74%"; Hit description=MLO -like protein 1
  Pfam annotation: Domain name=Mlo; Domain location=2-255; Score=37.1; E_value=6.3e-20; Accession=PF03094.6; Description=Mlo family
MEVNQAQSPKISEAHLFCSRLMMSLSLIQKDRGKWRDTCKGTLMPTPSLAVSHSYGSQVWPLGNPHRMWIPLFAEPLLLLAVGTKLGHVITQLAQEVAEKHAAIEGDLVVQPSDEHFWFHRPHVVLFLIHFILFQNAFEIAFFFWIWVTYGFDSCIMGQVRYIVPRLVIGVFIQVLCSYSTLPLYAIVTQMGTHYKRAIFNEHLQQNIVGWAQKAKKRKGLKADGNPGQGSSQESANTGIQLGSIFKKASAPGGSSSATKADGTNSV

SEQ ID NO: 164878 - protein, 282 aa, Glycine max
  Coding DNA Sequence Number=SeqID_48100
  Gene Ontology: Mol. function=nucleoside-triphosphatase activity; Cellular component=membrane; Biological process=DNA strand elongation during DNA replication
  Homolog annotation: Hit_ID=UPI0000584EE9; Match level="QueryCoverage =97%, HitCoverage=75%, E-value=4e-25, Identity=28%"; Hit description =PREDICTED: similar to replication factor C, 38-kDa subunit isoform 1
MVNNLQVRVKKSLHHVEVNLSETKGYEKHVIVDLFKETYGQLINNSEPCCPENCKEKYKGCNKVFFCCSDESKLQPVKPLCITVRLSSPSTQELVQILENIGKEEGIKLSRNLVEKIILRSKNNLRQAIRSLEATCRNKDAVKDDDLILTGWEEDIFNIAKKVAEEQSPRQLYVIRRKLQSLMIHDVPPDFIYKSLVPELTNLVDESLRAGVAKLDKEFIRPSDIKFQTMKQFGHAQNKQAESDEKNYDSTNQNRLTYLKVEEFIAKFMSWYKNSSEKGNKQ

SEQ ID NO: 164879 - protein, 588 aa, Glycine max
  Coding DNA Sequence Number=SeqID_48101
  Gene Ontology: Mol. function=zinc ion binding; Cellular component =nucleus; Biological process=regulation of transcription, DNA -dependent
  Homolog annotation: Hit_ID=Q5UBY2; Match level="QueryCoverage=50%, HitCoverage=51%, E-value=1e-58, Identity=37%"; Hit description=FAR1 -related 1 protein
  Pfam annotation: Domain name=FAR1; Domain location=66-202; Score =139.4; E_value=9.4e-39; Accession=PF03101.5; Description=FAR1 family
MEIDLELPICEHEMLKSGSSGNDVTDTACDIYLEEQSINPSSMTEHSKKVLSENAFCCQDQEAAYSFYREYARSVGFGITIKASRRSKKSGKFIDIKIACSRFGSKRESGTVVNPRPCKKTGCKAGIHIKKKQDGNWIIYNFVKEHNHGICPDDFFRGSKQTSIVASQKKGMQLALEEGDVQSMIEYFVSMQFNHHFQYILLGCALVGEETVSAFIWLMRAWLKAMSNLPPKVIITDQEQFLKEAVMEVFPDKHEQFEKRWWKLINRFELKNDEWVQSLYEDRKKWVPTFMQDISLAGLSTTVRYESISSSFDKYICVDSTFKEFIEQYKVFSIDSFDMEAKADFETKQKQPALRTAHRVQRFNDLCRQAIILSEIGSLSEDTYRVASQALEEIYKHCVNANNFARSTLESNKLVLNGFDVEEKNDGCHRAKPTKKRKSFNKRECSDPERINIKMLDDFQKREQRNTRAHNFDNCYISQQDIQTVDLDSRASTLDVYYGAQRNVLGDLNSVSVMRDCYYGSQLAILGLGQLHSMPSRGSHYEMQHSMQRPLQGLLTFRTPKAMEQPIRDSQFHGITSKQLDVDKSLSS

SEQ ID NO: 164880 - protein, 61 aa, Glycine max
  Coding DNA Sequence Number=SeqID_48102
MAIKFYSLSFYMYEEAKLFILNSVLELLVVSKVSETSGKKDNGIIRVAGLQVTVNNPNVSI

SEQ ID NO: 164881 - protein, 163 aa, Glycine max
  Coding DNA Sequence Number=SeqID_48103
  Subcellular localization annotation: CTP_CleavageSite=52; ConfidenceScore=5.26e-01
MERKVTYPNPILTLLPKLERIQPPPRSKQVFSVKMRPGSFPTTIQKHEYAVVVSTSSSSLRAQRQRSFTYQSVTTFDLFLLCSWNGGNKHLLSYSIVVHALDYEMIVCPLYLAHASDQCAVAFRTPSLGSFPSRCFGLRATKDVSYSLIFAWAVLNYAQAFYD

SEQ ID NO: 164882 - protein, 180 aa, Glycine max
  Coding DNA Sequence Number=SeqID_48104
MEKNFKELIGKNVEVYVDDIVVKSLSIEQHARNSAKIFVELIKHNMRLNPKNCTFEVGGGNSLVLQKKRKRFHDTGGRLELNLTNEIKFTNDKGEKERAIWGRGSLPKRVGYLALKEFHGPGELDASLGELDSRNFQKWPFHPFPCGFCPGSNNQFERSLDLALQWVSNDKKHSPDEIRV

SEQ ID NO: 164883 - protein, 202 aa, Glycine max
  Coding DNA Sequence Number=SeqID_48105
MEEGKEWSVKEKNETTTRPSLKSDVPFNKYELWKHKLRDNCYKRVREDRTRLLWKFRYNQQEEEDIVKCAFQDIVSDELNKIKRTDELLWEYEGPHQDLECDIETWEDEVDEYLARAVFEHMQLNEDEAHGKEIWCPICKQGELKDSHNLIHCTRCELQLNKASEGYLWVELVWIFPLLENMEVVFVYLFLNLFENQGAMML

SEQ ID NO: 164884 - protein, 158 aa, Glycine max
  Coding DNA Sequence Number=SeqID_48106
  Homolog annotation: Hit_ID=Q8L8H3; Match level="QueryCoverage=59%, HitCoverage=57%, E-value=2e-17, Identity=52%"; Hit description=Iron -stress related protein
MWDLNFSQCTSSRPTLLGLVRGKHDRLDRTNSIGNDLEKNQVAYSRSVHIPDHGDAGSSNLLNENHYSRLIALEGCSCSAAAQLLNDRWTAALQSYNNPKDSSEKPVMYSSGTSGWTPFRPPQQIMAPATSASSSVSQQDFLGELRRQMHSANPSFTT

SEQ ID NO: 164885 - protein, 502 aa, Glycine max
  Coding DNA Sequence Number=SeqID_48107
  Gene Ontology: Mol. function=protein transporter activity; Cellular component=nuclear pore; Biological process=protein import into nucleus, docking
  Homolog annotation: Hit_ID=Q9LHS4; Match level="QueryCoverage=82%, HitCoverage=35%, E-value=1e-164, Identity=70%"; Hit description=RAN binding protein 16-like
MGICTISGDFPVLLDLHYENSASYKNSDCYIDHAGSVVEKRKSGDMRSKKQNVTAYDKKAQDCYLLMSYPLQNQLVQKRCYYRGIEHDWKVFLSLESTPDAVFRTDAVRYALVGLMRDLRGIAMATNSRRTYGFLFDWLYPAHMPLLLKGISHWTDTPEMAEETRVAYGANPKLLRCPWPSQYKIGSHLQLGEIPHLKECVTTPLLKFMAEFVLNKAQRLTFDSSSPNGILLFREVSKLIVAYGSRVLSLPNAADIYTYKYKGIWICLTILSRALSGNYVNFGVFELYGDRALSDALDAALKMTLSIPMSDILAYRKLTRAYFAFLEVLFNSHITFVLNLDTNTFMHMVGSLESGLKGLDTSISSQCASAVDNLAAFYFNNITMGEAPNLPASVNLARHIAECPNLFPEILKTLFEIILFEDCGNQWSLSRPMLSLILINEQIFSDLKAQILSSQPMDQHQHQRLSSCFDKLMADVALSIDSKNRDKFTQNLTIFRHEFRAK

SEQ ID NO: 164886 - protein, 139 aa, Glycine max
  Coding DNA Sequence Number=SeqID_48108
  Homolog annotation: Hit_ID=Q9LHS4; Match level="QueryCoverage=65%, HitCoverage=8%, E-value=5e-31, Identity=75%"; Hit description=RAN binding protein 16-like
MDCGGRHYTFVRSLWHRHNRHVTILLRIWIFGLTQSQKLAQRRYGEISKQRLDRAILTFFQHFRKSYVGDQAIHSSKQLYARLSELLGLHDHLLLLNVIIGKIVTNLKCYTESEEVIDHALSLFLELASGLVLVGLKSI

SEQ ID NO: 164887 - protein, 185 aa, Glycine max
  Coding DNA Sequence Number=SeqID_48109
MVDGANMDLEAMFFSLVVGFSVLIEHVTSTIELPSLWSADFKASKFIVADKLLTKVDTKTMDYVGANNSWDSTKRIKYVELEVKFKMILEERKKLIKAINEKNFWLTTKIEVIDGLQQNIFDHKKMVFAKAIENEKFIKDVKNGELVIESQMKSFEEASRNGETSKERDIEATSRPAPTSNALTT

SEQ ID NO: 164888 - protein, 196 aa, Glycine max
  Coding DNA Sequence Number=SeqID_48110
MMSEIEEVQEQMKANMEAMKEQMTIMVEAVMSMRRMIEVNTAIDVASSTTTKVDPTHPPGFNQVNCPTLDMVGQVQNKHFLPSCGLPPNYTPPNVVHAPDENVNNSAPIAIESQQPQSNHAHVSQPMGETHEVPRDHTLADFEPHLGYATGGEAFFRPPAMVEREKFDHIEERLRVIEGGGNYAFADMAELCLVPD

SEQ ID NO: 164889 - protein, 40 aa, Glycine max
  Coding DNA Sequence Number=SeqID_48111
GLADHDNYHEFCRLLGRFRVNYQGDGVHAVEARYILWLRS

SEQ ID NO: 164890 - protein, 39 aa, Glycine max
  Coding DNA Sequence Number=SeqID_48112
MAGGSEFHPKIVYRLAEGCLVLEWAPEWKFGSKPHYHCE

SEQ ID NO: 164891 - protein, 40 aa, Glycine max
  Coding DNA Sequence Number=SeqID_48113
MEDVTKTRISGACDGSTSRGTNSFTVLRLVHVIEIWILNG

SEQ ID NO: 164892 - protein, 152 aa, Glycine max
  Coding DNA Sequence Number=SeqID_48114
  Gene Ontology: Mol. function=identical protein binding; Cellular component=proton-transporting two-sector ATPase complex; Biological process=negative regulation of enzyme activity
  Homolog annotation: Hit_ID=O65835; Match level="QueryCoverage=98%, HitCoverage=23%, E-value=5e-33, Identity=42%"; Hit description=P69E protein
  Subcellular localization annotation: CTP_CleavageSite=35; ConfidenceScore=5.44e-01
MAAPPDFFTSSPLAILPIPPPLSHKTTLPQKVGSRVGEKSEGWKIDSSSNSCPFPSFVVAAMLLLIMLAPTMRIQGAPLTMEPRRGPEFPTTQLTKIPFYIATNVPIAMLSSKKEFGFLELRDIGNTSIPSSTAASNATNISLSRKPLKHTL

SEQ ID NO: 164893 - protein, 99 aa, Glycine max
  Coding DNA Sequence Number=SeqID_48115
MLVIAKLAIGLGRIAFLFWVLGLIQAEKLVKVVWTYAKKTIKDANEESTSHVIKRAEATIDEEGHGTHRTSTVVGAFVDHAEVLGNVEGTVARIPLMLT

SEQ ID NO: 164894 - protein, 127 aa, Glycine max
  Coding DNA Sequence Number=SeqID_48116
METNTFLPPATKSEAKYSYDKEIQNGKTNTKRLSVPSQEASFGKDIPNNMKQRKYKSKKIPSRQKIKIWNFCLTKQKLVHFFGGVNPTDAASSFAGASMVSSSAATALIVLENLRGFKREKERRGRN

SEQ ID NO: 164895 - protein, 60 aa, Glycine max
  Coding DNA Sequence Number=SeqID_48117
  Homolog annotation: Hit_ID=Q9CAB3; Match level="QueryCoverage=70%, HitCoverage=6%, E-value=8e-10, Identity=77%"; Hit description =Putative ABC transporter; 82503-78258
MDGVLRSVRSDSATRSVIVIAHRLSTIQAADRIAVMDGGQIVEVGIRLPFLDPLGGNLVH

SEQ ID NO: 164896 - protein, 223 aa, Glycine max
  Coding DNA Sequence Number=SeqID_48118
MACTKKSGQMTSKATKKIIDRIVSDSHLSMGSFVTHGHQDVLTAAIGRPEHSGCVCAVGAGVTIKQYFGLASRISRTSTSMAPKDLEQLTQKIKDQLEKSITQKGLALPLELVVDPSTTHVSTKESCVDPSRQDPNTADSEKWVNHCPQHPLGNDQVKVGVEEVRDVDARIIVSTQEGKQGAKGPAKPADRPDPDVDPLYLMTLTIPHLFLKPLQAIGCYRVW

SEQ ID NO: 164897 - protein, 404 aa, Glycine max
  Coding DNA Sequence Number=SeqID_48119
  Gene Ontology: Mol. function=sugar porter activity; Cellular component=integral to membrane; Biological process=carbohydrate transport
  Homolog annotation: Hit_ID=Q1S244; Match level="QueryCoverage=96%, HitCoverage=70%, E-value=1e-169, Identity=74%"; Hit description =Sugar transporter
  Pfam annotation: Domain name=MFS_1; Domain location=6-376; Score =29.4; E_value=1.3e-05; Accession=PF07690.6; Description=Major Facilitator Superfamily
  Pfam annotation: Domain name=Sugar_tr; Domain location=27-403; Score =195.2; E_value=1.6e-55; Accession=PF00083.14; Description=Sugar (and other) transporter
  Pfam module annotation: Pfam domain module=MFS_1::Sugar_tr; Domain location=6-376::27-403
MEERVASKTEFTECWRRTTESPYIMRLALSAGIGGLLFGYDTGNHCECGCCWSCNWCAFGGWMNDKLGRKGTILVADVVFFIGALVMAIAPAPWVIILGRVFVGLGVGMASMTAPLYISEASPAKIRGALVSINAFLITGGQFLSYLINLAFTKAPGSWRWMLGVAGVPAVIQFVSMLSLPESPRWLYRQNKEEEAKYILSKIYRPSEVEDEMRAMQESIETEREEEGLIGHSLAQKLKNALANVVVRRALYAGITVQVAQQFVGINTVMYYSPTIVQFAGIDSNSTALALSLVTSGLNAVGSILSKVFSDRYGRRKLMLISMIGIIVCLIMLSVTFNQAAHHAPAISNQDTLSFGANSTCRAYTKAPNFSSWNCMHCLQVDCAFCASSKRDVSVTKDLSLLLI

SEQ ID NO: 164898 - protein, 226 aa, Glycine max
  Coding DNA Sequence Number=SeqID_48120
MQREQERERRRIRDRQRRQSMTREQRERHLARRRRNYQLRRQRAANAQIPYSPVPQLQLLESSAGEASTSDELQVVTSSTFLDYGVLSQGIVSPHHGLNQGQETLHFGTKVLEGSSLPLETLVYKPANSPRRMRLNHIKGLMRNRTHSIDDPAVTHQLAAELIAKEDQDVSLGNFGSTPKSMRLNCVKRLARSKNSPPKETADQKDLKLPPEGIQVLGNESFIASN

SEQ ID NO: 164899 - protein, 53 aa, Glycine max
  Coding DNA Sequence Number=SeqID_48121
MALKVQLCSSSLISETIRQKHKTLKGPSTRRYNKSSDVEHGKIETGIAVTIEW

SEQ ID NO: 164900 - protein, 409 aa, Glycine max
  Coding DNA Sequence Number=SeqID_48122
  Gene Ontology: Mol. function=transferase activity, transferring glycosyl groups
  Homolog annotation: Hit_ID=Q7XAG2; Match level="QueryCoverage=91%, HitCoverage=84%, E-value=1e-118, Identity=58%"; Hit description=GDP -fucose protein-O-fucosyltransferase 1
  Pfam annotation: Domain name=DUF246; Domain location=46-369; Score= -175.0; E_value=0.00019; Accession=PF03138.5; Description=Plant protein family
ILRALLVPPSPGFGGVEWSNFVYIRNHSPSFGVGVRQDKFLEVPQIVWGLNNQKIAFARACHTARTMNRILLMPSLSASLFYKEIDLLQPISFDRVFQYDKFNALCSGFVQLGRYSDLSNQTRVLEMQKGSGRKWTVERDLDQLRDYSKGEFEDHEVIRIVGKNPFLWHDHWPVKDYAKVFECLVLIDEIGREADRVVSRIRAVGRETQSNSESVELENDSSSFQPLPYVAVHMRVEIDWMIHCKKLEQRLNTNQICSSKKEIMERVANIKGLKTPSVVYLAVADKLLQNSSVLEGWEEGFLPYEKKKLGVDGIYKKYPYLIQSAIDYEVCLRADIFVGNSFSTFSSLIVLERTQKIITMGVNMCGKDVTWPSYAYNIQGESNGPMRWVTNMSHSTLQEISYGTNHISC

SEQ ID NO: 164901 - protein, 552 aa, Glycine max
  Coding DNA Sequence Number=SeqID_48123
  Gene Ontology: Mol. function=transcription factor activity; Cellular component=nucleus; Biological process=regulation of transcription, DNA-dependent
  Homolog annotation: Hit_ID=Q1S255; Match level="QueryCoverage=99%, HitCoverage=100%, E-value=0.0, Identity=59%"; Hit description=GRAS family transcription factor, putative
  Pfam annotation: Domain name=GRAS; Domain location=153-460; Score =453.7; E_value=2.4e-133; Accession=PF03514.5; Description=GRAS family transcription factor
MQTSQKHPTSAGIHLYHQPAQDIDPYTHYQILQSNSCHEIHDNSSSQGTTISFETSKDQYFTLESSPVINDLIGCDSPSYASVSSNRSPFSPQASHSYHSDQHQSSDNTYGSPTSSHSTADDSYELKNKLRELEISLLGPDSDIVDSCHCSYKGGCHGASPMAKYNWDQIVEMIPKLNLKEVLIRCAQAVADDDIETAVGFMNNVLAKMVSVGGDPIQRLGAYMLEGLRARLESSGSIIYKALKCEQPTSNDLMTYMHILYQICPYWKFAYTSANAVIGEAMLNESRIRIIDFQIAQGTQWLLLIQALASRPGGPPFVHVTGVDDSQSFHARGGGLHIVGKRLSDYAKSCGVPFEFHSAAMCGSEVELENLVIQPGEALVVNFPFVLHHMPDESVSTENHRDRLLRLVKSLSPKVVTLVEQESNTNTSPFFQRFAETLSYYTAMFESIDVALPRDDKQRINAEQHCVARDIVNMVACEGDERVERHELLGKWRSRFSMAGFAPCPLSSLVTDAVRNMLNEFNENYRLEYRDGALYLGWKNRAMCTSSAWRCY

SEQ ID NO: 164902 - protein, 456 aa, Glycine max
  Coding DNA Sequence Number=SeqID_48124
  Gene Ontology: Mol. function=thymidine kinase activity
  Homolog annotation: Hit_ID=Q1S250; Match level="QueryCoverage=99%, HitCoverage=95%, E-value=9e-94, Identity=60%"; Hit description =Thymidine kinase
  Pfam annotation: Domain name=TK; Domain location=259-431; Score =176.2; E_value=8e-50; Accession=PF00265.9; Description=Thymidine kinase
  Subcellular localization annotation: CTP_CleavageSite=60; ConfidenceScore=5.84e-01
MKSLLNPKFSALSPKASPFALFSLPSQSTTRFSFRSNPRRIPNRLLRLNPPPFSSNNFICAIQNRSLQTEPSPPPSGEIHVIVGPMFAGKTTSLLRRIQSETANGRHLIRSAQQVLGFVSIGNVSNTAATLRIREVSVLHSVYLKGWRRNAYSGNSIRGGGFRLFSKISEDFKPNYVTFLTVLVGERHRCWILCCLGNAYASSGFWDNVKEVRATKEPGHSRIAGPHPLGMSLISPQALECCLGPELKVLWWVLNTYNVSLTCLLGSEHKVLWWVLNSYTALKNVAIIKSSKDTRYGLDSIVTHDGAKLPCWALANLSSFKQKFGMDAYEKLDVIGIDEAQFFDDLYEFCRQAADHDGKTVIVAGLDGNYLRRSFGSVLDIIPLADSVTKLTARCEICGKRACFTLRKTQDKQIELIGGVDVYMPVCRQHYASGQVAMEATRHVLESKKVECGSHT

SEQ ID NO: 164903 - protein, 217 aa, Glycine max
  Coding DNA Sequence Number=SeqID_48125
  Homolog annotation: Hit_ID=Q9SJD5; Match level="QueryCoverage=61%, HitCoverage=76%, E-value=7e-40, Identity=61%"; Hit description =Expressed protein
MNAVRRRLLHTLRSDAPSGTLKRRALELEKKRKTRHSKSKDQFIVTVPESLSYLDTATIPMYFAAIGIALFAKLLMTYDDSRSQELLERKIKNAPEGQGSVRMLTREEWDEFREVRPRTPFESTLARPNSRIRTGEPLRLFLIYFRPWHPKLWSLEGIKKYIGTMLSMTDGETRQKAKILPYRHAIVAYGTTIASLPSQIVYGSWRKNLHAIPPWWP

SEQ ID NO: 164904 - protein, 143 aa, Glycine max
  Coding DNA Sequence Number=SeqID_48126
  Gene Ontology: Mol. function=binding
  Homolog annotation: Hit_ID=Q1S238; Match level="QueryCoverage=66%, HitCoverage=21%, E-value=3e-32, Identity=74%"; Hit description=IMP dehydrogenase/GMP reductase
LAGDVAAAGGEVAEGLRQIEELLLRRRVFHRFAVPQRQLAETEVDDGVGEVFRETRGFLGEGAAAAVVVLEEIGAYSAHGPSNLTLRFGRNRGVVLAVMIRWDPLNRRDKCVGRILVLGNTVVKYKERVARVDGIRAWVLHFT

SEQ ID NO: 164905 - protein, 95 aa, Glycine max
  Coding DNA Sequence Number=SeqID_48127
  Gene Ontology: Mol. function=catalytic activity; Biological process =metabolic process
  Homolog annotation: Hit_ID=Q01CB8; Match level="QueryCoverage=97%, HitCoverage=30%, E-value=4e-08, Identity=40%"; Hit description =Homology to unknown gene
MEKEFSKTFAYFLYNCHLLFHLKVPEIPFSDLRLFPHSDDPLLQETSSELVEHQSGVGVWGHVELHLSVRGAAFAMHHAAEVLACAEGLGHALRR

SEQ ID NO: 164906 - protein, 159 aa, Glycine max
  Coding DNA Sequence Number=SeqID_48128
  Gene Ontology: Mol. function=GPI anchor binding; Cellular component =membrane; Biological process=auxin mediated signaling pathway
  Homolog annotation: Hit_ID=Q9FGK4; Match level="QueryCoverage=86%, HitCoverage=35%, E-value=8e-25, Identity=43%"; Hit description =Arabidopsis thaliana genomic DNA, chromosome 5, P1 clone:MNJ7
MVGKLLVMRLVLVIYMLSTVILKSSAQACKNKTFNDNKVFAKCRDLPQSSSYLYWTYDQATGKLDMTFTHAGITAPERWVAWAINPNNNLKTAMVGAHAGSGGAPRAYTTSTTNYSTHLEEGNISYPHSGLAATRQNNEITIYAILHQSCSPLARWSSL

SEQ ID NO: 164907 - protein, 53 aa, Glycine max
  Coding DNA Sequence Number=SeqID_48129
MTAQTIENRWKRKVGAVVTGNRAFGEVTVIVGGTCGGGAAIRCKEIKKGASFA

SEQ ID NO: 164908 - protein, 205 aa, Glycine max
  Coding DNA Sequence Number=SeqID_48130
  Gene Ontology: Mol. function=chitin binding; Cellular component =extracellular region; Biological process=chitin metabolic process
  Homolog annotation: Hit_ID=UPI00006A17C9; Match level="QueryCoverage =81%, HitCoverage=98%, E-value=6e-12, Identity=29%"; Hit description =UPI00006A17C9 related cluster
MSKSCGFGMTGPLDESISCFLIRMDPWLLVPITFRGLHVLALRGLHVLTFRGLHVLTFRGLRALAFVGLHALTFRGLHVLTFRGLHALGSEDYSSSSSEDYMSSPSEGYAPSPLGLRALAFVGLHALTFRGLHVLTFRGLRALAFVGLYVLTFRATRPHLQRTTSPRTIRPHLQRTTCPHLQRATRPRLCRATHPHLQRTTCPHL

SEQ ID NO: 164909 - protein, 37 aa, Glycine max
  Coding DNA Sequence Number=SeqID_48131
MRMMRDFGLGLWGGLKYLGSDLRSSPNEQWSTNVHNR

SEQ ID NO: 164910 - protein, 150 aa, Glycine max
  Coding DNA Sequence Number=SeqID_48132
  Gene Ontology: Mol. function=protein transporter activity; Cellular component=nuclear pore; Biological process=protein import into nucleus, docking
  Homolog annotation: Hit_ID=Q9LHS4; Match level="QueryCoverage=69%, HitCoverage=9%, E-value=1e-39, Identity=72%"; Hit description=RAN binding protein 16-like
MPATNHRRVACSFRDQYLFQIFQISLTSLGQLKNDVVNQLQELALALSLKCLSFDFVGTSVDESSDEFGTVQIPSPWKPVLEDSSTLQIFFDYYAITKPPLSKEASYLRVEIGNDEKAFRMEMCWPKNDKRMTGKFWWHTFLVVAEISYF

SEQ ID NO: 164911 - protein, 323 aa, Glycine max
  Coding DNA Sequence Number=SeqID_48133
  Homolog annotation: Hit_ID=Q9ZVX3; Match level="QueryCoverage=57%, HitCoverage=45%, E-value=1e-30, Identity=40%"; Hit description =Expressed protein
  Pfam annotation: Domain name=PEARLI-4; Domain location=68-321; Score =144.5; E_value=2.9e-40; Accession=PF05278.3; Description=Arabidopsis phospholipase-like protein (PEARLI 4)
MDRFNRVRIKLGAPPPIKLDKKKKLGSKPEPPVLDSVPASKVGAIYLSDASSPISQYSEKKKVETENNEHVSPQTNIQAVKPVNNKDQPIKEGEQHVGNPMLTNDDEDKIASNKIVPISLPISESDDDESVMSSEGRLQVGRYQIKESFGSILQSILDKYGDIGESCQLESVAMRSYYIECVCFVVQELHNSSSIMQLSKSKVKELLAILKDVESAQLGVAWLRSALDELAQNIELINRHQEVEAQKDNSGRQVESLRQELETELESLAQKEQEVANIKTRIPEIRGRLSQLQLKSEELNRSMLSIKSKVHNLHIKSLVDELL

SEQ ID NO: 164912 - protein, 439 aa, Glycine max
  Coding DNA Sequence Number=SeqID_48134
  Gene Ontology: Mol. function=heparan-alpha-glucosaminide N -acetyltransferase activity; Cellular component=integral to membrane; Biological process=glycosaminoglycan metabolic process
  Homolog annotation: Hit_ID=Q2R301; Match level="QueryCoverage=84%, HitCoverage=83%, E-value=2e-98, Identity=45%"; Hit description =Expressed protein
  Pfam annotation: Domain name=PepSY_TM; Domain location=154-183; Score= 18.4; E_value=0.025; Accession=PF03929.6; Description=PepSY -associated TM helix
MYYIPRNLGQRQVGVGVGPMSWRHAVKDIEQHKHLMIFVDYAASIFPIIAHAPWNGIHLADFVMPFFLFIAGISLALVYKRRPHRTQATWKAFARALNLFALGILLQGGYFHGVTSLTFGVDIQRIRWLGILQRISIGYIVAALCEIWLPAPRWKELGFVKSYYWQWFVAVILLALYSGLLYGLYVPDWQFDVSASTSSLPPIGGGDIYMVNCSVRGDLGPACNSAGMIDRYILGLDHLYRKPVYRNLKGCNMSAKGQVSDSSPSWCHAPFDPEGILSSITAAVSCIIGLQYGHVLAHLQDHKGRLYNWMCFSLSFLALGLFLALIGIPLNKSLYTVSYMLLTSAASGLTFIALYFLVDVHGHRRLTALLEWMGKHSLSIFVIVSSNLAVIAVQGFYWTKPENNIVRCFMLENVPVSLGSAIVLTLTPFSVGLAQVVLS

SEQ ID NO: 164913 - protein, 90 aa, Glycine max
  Coding DNA Sequence Number=SeqID_48135
  Subcellular localization annotation: CTP_CleavageSite=68; ConfidenceScore=5.09e-01
MDLKSRTTIIFTITYPLSFRRSASCCRSKKIIALPPLLSLPQPLYSAGIAVSSNDNNRLTVIADNNVLAKAKKKSDSARLWMRFDRLGQS

SEQ ID NO: 164914 - protein, 386 aa, Glycine max
  Coding DNA Sequence Number=SeqID_48136
  Gene Ontology: Mol. function=metal ion binding; Cellular component =integral to membrane; Biological process=metal ion transport
  Homolog annotation: Hit_ID=Q8H658; Match level="QueryCoverage=55%, HitCoverage=58%, E-value=8e-74, Identity=67%"; Hit description=High -affinity nickel-transport protein-like
  Pfam annotation: Domain name=NicO; Domain location=168-386; Score =113.2; E_value=7.4e-31; Accession=PF03824.6; Description=High -affinity nickel-transport protein
MGFVHKFAINIIRSGETLSRFEISPGNVKVRDLWIPRRFSDSWRKFTVAGEIEEEKGDRIDAERVGPEGLSEGNGNEVEELEDDGLWAQIDGIGTVRGCQKHVGEDNIQLNEGRNEAITARTLVILSALAMILIQPAIAPAAFATFQTAAKTGGPAAAVGRKLIHTELLSSAWTGFLAGCLHTLSGPDHLAALAPLSIGRTRMESAAVGALWGCGHDAGQVLFGLIFLILKDQLHIEIIRTWGTRVVGLTLLIIGALGIKEASEVHAPIVALESDECNVNVYESLDNPTVGKKKIGFATFATGIVHGLQPDALMMVLPALALPSRLAGAAFLIMFLIGTVIAMGSYTVFIGSCSQALKDRVPRITEKLTWASSLIAIALGLAIIIS

SEQ ID NO: 164915 - protein, 59 aa, Glycine max
  Coding DNA Sequence Number=SeqID_48137
MHKKKKKKKQEVESLHDIDSTVKFGVREADGKHVSSRNPRIEKCSSMLDNLVGSLDFPK

SEQ ID NO: 164916 - protein, 159 aa, Glycine max
  Coding DNA Sequence Number=SeqID_48138
MECLLLLQLSSHIPHLRFEDVQSQVVAPPGTILTVEQFMGKVEVPVLKHLSSYMMHLQRPPSLSHLFLRQEAATPERSPQISLDPPSPVVDQSSPQQLADPPTPVHEMPADLSTPLLEILEDLSTLVLGLTTTPPATPMLHFIDEEGTQDQDTQQDDQS

SEQ ID NO: 164917 - protein, 102 aa, Glycine max
  Coding DNA Sequence Number=SeqID_48139
  Gene Ontology: Mol. function=inositol or phosphatidylinositol phosphatase activity; Biological process=carbohydrate metabolic process
  Homolog annotation: Hit_ID=O49071; Match level="QueryCoverage=96%, HitCoverage=31%, E-value=6e-19, Identity=50%"; Hit description =Inositol monophosphatase (EC 3.1.3.25) (IMPase) (IMP) (Inositol-1(or 4)-monophosphatase)
MSHANKKKEVVIMRSHYVKRMLLHEATVKVYPYIVFVYFEVDLVTETDKACEELIFNHLKQLYPTHKFIGEETTAAYGTTELTDEPTWIVDPLDGTTNFVHG

SEQ ID NO: 164918 - protein, 544 aa, Glycine max
  Coding DNA Sequence Number=SeqID_48140
  Gene Ontology: Mol. function=transporter activity; Cellular component= membrane; Biological process=sodium ion transport
  Homolog annotation: Hit_ID=A0FKR1; Match level="QueryCoverage=99%, HitCoverage=100%, E-value=0.0, Identity=61%"; Hit description =Vacuolar citrate/H+ symporter
  Pfam annotation: Domain name=CitMHS; Domain location=74-483; Score= -121.0; E_value=0.011; Accession=PF03600.6; Description=Citrate transporter
  Pfam annotation: Domain name=DctM; Domain location=144-536; Score= -248.1; E_value=0.1; Accession=PF06808.2; Description=DctM-like transporters
  Pfam annotation: Domain name=Na_sulph_symp; Domain location=43-535; Score=27.9; E_value=2.1e-13; Accession=PF00939.9; Description =Sodium:sulfate symporter transmembrane region
  Pfam module annotation: Pfam domain module=CitMHS::DctM::Na_sulph _symp; Domain location=74-483::144-536::43-535
MVGEHSTTSPASGDHKIPLLPVHEPVEGTHTNISFSTKSILTLQNFYVILGPMLSLFICLFVKLDAPPTSQKMLGVIAWVFSWWVTQAVPLPVTSMCPLFLFPIFGIASADSVAHSYMDDVITLVLGSFILALAVERYNVHRRLALNVTLLFCGDPVNPALLLLGLCATIFFVSMWLHNVATAVMMMPVATGIVQRLPPAHEQSEAVNKFCRAVILTVVYATPIGGISTLTGTGVNLIIIGMWKSLFPEAKPISFNTWFFYGFPVAVLILICYWCIICLLYVPKGSARALSAYLDRAHLKRDLEALGPMAFAEKMVLSVFGLLIILWMTRRITDDIPGWGSLFHDLVGDGSVSVSTVPTIEIMVAVLLFIIPNMKQEGEKLMSWNDCKKLPWNLILLLGAGFAIADGVQSSGLADVLSRALDFLEDAPYLAIVPAVSLICSIITEFITSNDATATLLVPLLYHIARTMHVHPLLLMVPGGIATEFAFWLPTSTPSNVVGFATGHIEIKDMLKVGVPLKVVGIVVLSLLMPSLGTIVFGTNNDTQ

SEQ ID NO: 164919 - protein, 442 aa, Glycine max
  Coding DNA Sequence Number=SeqID_48141
  Gene Ontology: Mol. function=DNA binding; Cellular component=nuclear pore; Biological process=DNA integration
MEPFDYTPPQTELEAKTQQNPLPDSHTSDAIDTSHNLIPVPQCPTMRIRKPPSYLQDYHCNLATATDVPHQSSGKGNLYPLSQVFSYDRLTPSYQSFVMNITTTPEPTNYSEAVKHECLRIAMDQELEALARNNTWVLVDKPPDKNLIGRKWVYKVKHKQDGTVERYKARLVMKGYTQIEVVLHQLDVDNAFLHSNLEEEIYMALPQGLSTSKPNQEMTFLCFKAATTPMDTSIKLGAAIGKPLFDISSYRRLIGRLLYLTTTRPNIAFAAHMGVAFSTQHQTLTAYSDSDWAGCIDSRKSIAGYCLYIGSSLISWRSKKQTTTTRSSYEAEYHAIAATVCEVQWISYLFKDLQAAEPSPVSLFYDNRSTIHISHNPSLHEHTKHIELDCHIVREKLNQGLIHLLPIPSAQQLVDIYIKPLTLAPFRSIFSKLGMINIHSPV

SEQ ID NO: 164920 - protein, 371 aa, Glycine max
  Coding DNA Sequence Number=SeqID_48142
  Homolog annotation: Hit_ID=P93743; Match level="QueryCoverage=37%, HitCoverage=35%, E-value=1e-24, Identity=51%"; Hit description =Expressed protein
  Pfam annotation: Domain name=WRC; Domain location=232-277; Score =72.8; E_value=1.1e-18; Accession=PF08879.1; Description=WRC
MRIRKRQVPFPLLPVTHSDPNLINRSPVMVQLNDDTKASSCTTYHGSTITAPSPLLDRPQPADQPLPPIGKPTNGSDESSGEWHKKQEESLVEDGRRNEEGEGHKGNDARKGSISCSETLAETFSSPSPPKQDGRWFEGDKAFPLKKRRGAFENATEDDNNNNDNDDNDNKNLKTKGKRMKTKINQKCSRQDDSKEKEEEEEVRENEEEVATRATKPEQENVGKKRVRGGALMEGSRCSRVNGRGWRCCQQTLVGYSLCEHHLGKGRLRSMTSVRNKSIGTTSVAPKNNINIVPQSENLFEKQTTKSSTTSRVTHEEYPLGNDAENNDEKKQVIVTKRRMKLGMVKARSISSLLGQTNTEIVAIAEDNDKK

SEQ ID NO: 164921 - protein, 62 aa, Glycine max
  Coding DNA Sequence Number=SeqID_48143
MVAETRIPLGRDTLIGDVIRGTNYHCLSELNEYKRLHGQCSVWSPSDLAVAVEASNFDIGSQ

SEQ ID NO: 164922 - protein, 219 aa, Glycine max
  Coding DNA Sequence Number=SeqID_48144
MGDKLLELIVYNNGIQACTTRKSIFYDSETTRGEAHRCVFQRRKDARSRHQRLFVENVGKTEGNRSKIKILSSGVVFTLEEGINTSYVDKSGTFAPTYPPLERKSDLRSSFLCMDQGPRPPRRECLQDQIHQDDVLVLISHCAARSSRPFDALSLIPTTVLRNLVDELYEKRKNTALDVMRILKLSKYRLKTQVEKDEGPSGEGQSPQMEKDEGLSGEG

SEQ ID NO: 164923 - protein, 456 aa, Glycine max
  Coding DNA Sequence Number=SeqID_48145
  Gene Ontology: Mol. function=nucleic acid binding; Cellular component= membrane; Biological process=DNA integration
  Homolog annotation: Hit_ID=Q1S1G2; Match level="QueryCoverage=60%, HitCoverage=20%, E-value=1e-46, Identity=34%"; Hit description =Integrase, catalytic region; Zinc finger, CCHC-type; Peptidase aspartic, catalytic
  Pfam annotation: Domain name=zf-CCHC; Domain location=231-248; Score =12.1; E_value=0.01; Accession=PF00098.13; Description=Zinc knuckle
  Pfam module annotation: Pfam domain module=Retrotrans_gag::zf-CCHC; Domain location=85-186::231-248
MADEATYPYTMQDAQNASNPLYIHPNESPSTILASPLLSDGNYHSWSRAMKMSLLTKNKLGFVDGTIAEPPKNHAVLPFWERGNMLVLSWLIKSMSVEIAQSILWREKASDVWKELHEHVSHADLFRISEIQEEIFNERQGDNFVSKFYTALKTLWDELDVLNPLPKIEEERNKNQVVRFLRGLKDQYSEQQFATENASVPKALLVVGDDTSNSKRNQGSGNGWNNRYTSKKCSWCGKMGHIVDICYRKHDFPAGFKFKNSKNNAPRSANMLMAKKNETNCPDDSSRKDTQGDAWVYNKTKRFEGFKEKIRPGNVVACNLTCKCFSEYPRLLPVYNEYSIDVVECNGEMLVVLLSEFLEIATLRVWKYDEANRGWHQIVAMPAANSHEWYGKKVDINCVGVGNQIFICLNSTELCTYVMCDLETNKWVELPNCCINGQVIDFMSAFSFEPQIEASV

SEQ ID NO: 164924 - protein, 69 aa, Glycine max
  Coding DNA Sequence Number=SeqID_48146
  Homolog annotation: Hit_ID=Q2HT48; Match level="QueryCoverage=52%, HitCoverage=4%, E-value=3e-08, Identity=70%"; Hit description =Ubiquitin
MAFLLKIGRHIPSTRVIKRLIVIYHGFRRLLGESALTQNLKTQVYGSSPHLYGVQPFHFYPMWDFIPHL

SEQ ID NO: 164925 - protein, 126 aa, Glycine max
  Coding DNA Sequence Number=SeqID_48147
MAPALRDHRSIAIQTQTHVLLIAIGERWAKGVFSMVHQGHLAAKKVQICLKVFGGPKQQSKYWQLHPFPFPYPSEIRYSMACGQKTHQCDTNLAIICMLLHSSQQKGQCGTGLVYNAHAKATVQHE

SEQ ID NO: 164926 - protein, 145 aa, Glycine max
  Coding DNA Sequence Number=SeqID_48148
  Subcellular localization annotation: CTP_CleavageSite=50; ConfidenceScore=5.80e-01
MASFSITGPIKCKTFASFSPLSFSATYNSCNITISNNLTRKVRAHSNSLSSFSYQSSCHRSLYSEKLQRGQSLIAFDGNNSESEAEDDHALDSVMKLYSAFKNKNTHELSADERRRVSNFLSFFETFQGRTVSFPPCLGRLSFRF

SEQ ID NO: 164927 - protein, 255 aa, Glycine max
  Coding DNA Sequence Number=SeqID_48149
  Gene Ontology: Mol. function=Rho GDP-dissociation inhibitor activity; Cellular component=cytoplasm; Biological process=negative regulation of cell adhesion
  Homolog annotation: Hit_ID=Q705X3; Match level="QueryCoverage=78%, HitCoverage=85%, E-value=7e-96, Identity=88%"; Hit description=Rho GDP dissociation inhibitor 2
  Pfam annotation: Domain name=Rho_GDI; Domain location=54-255; Score =60.9; E_value=4.2e-15; Accession=PF02115.7; Description=RHO protein GDP dissociation inhibitor
MSLGIAKDMGFDDKLKDNEGAGDDDASRVHAGKAGTDHEESEDEGGGGGGGGGTLSRYRSESSIAATEDEDDDDEERKIELGPQYTLKEQLEKDKDDESLRRWKEQLLGSVDINSVGETLEPNVKILSLAIKSADRPDIVLAIPEGGNPKGLWFTLKEGSRYRLMFTFQVENNIVSGLKYTNTVWKTGIKVDSSKEMIGTFSPQAEPYTHEMPEETTPSGMFARGQYSARSKFVDDDNKCYLEINYTFDIRKEWQ

SEQ ID NO: 164928 - protein, 229 aa, Glycine max
  Coding DNA Sequence Number=SeqID_48150
  Gene Ontology: Mol. function=transferase activity
  Homolog annotation: Hit_ID=Q2HT39; Match level="QueryCoverage=96%, HitCoverage=57%, E-value=9e-89, Identity=67%"; Hit description =Membrane bound O-acyl transferase, MBOAT
MVIILAALIPIYGKKEYFHPKFVLFLYGLHMYIGLEFIFAMISALTTKLIGVQLEPQFNEPYLCTSLQDFWGKRWNIMVNRVLHPTVYEPVMNLSARALGRKWAPLPAILASFAVSGLMHELVFYYIKREKRTWEAWEPSWDATCFFLIHGVCVAVEVGIKKSLLIRGKQWQVPRLLSWLLTLVFVVYTAMGLFLPALARCRVYDKATTEFTALTQFLKHLYALPSLVR

SEQ ID NO: 164929 - protein, 92 aa, Glycine max
  Coding DNA Sequence Number=SeqID_48151
  Subcellular localization annotation: CTP_CleavageSite=34; ConfidenceScore=5.34e-01
MASGASGTPASAHYDRRGVNLSNRRGVSQRALLRASEARLTAALSKGGKMRGVATNEGISTSYVDKSGALAPTYPPSKRKSDLRSSSLCVNQ

SEQ ID NO: 164930 - protein, 77 aa, Glycine max
  Coding DNA Sequence Number=SeqID_48152
MSSSAPLSSRDGKSNDMRRYLMIIRTFCQLEASELVDTQRLTSSSAPFRRCQHLSAEIAKKSRLLSVRLKGPVACSD

SEQ ID NO: 164931 - protein, 514 aa, Glycine max
  Coding DNA Sequence Number=SeqID_48153
  Gene Ontology: Mol. function=fumarylacetoacetase activity; Cellular component=nucleus; Biological process=aromatic amino acid family metabolic process
  Homolog annotation: Hit_ID=Q2HT34; Match level="QueryCoverage=77%, HitCoverage=95%, E-value=0.0, Identity=85%"; Hit description =Fumarylacetoacetase
  Pfam annotation: Domain name=DUF1969; Domain location=6-123; Score =229.4; E_value=8e-66; Accession=PF09298.1; Description=Domain of unknown function (DUF1969)
  Pfam annotation: Domain name=FAA_hydrolase; Domain location=154-364; Score=343.5; E_value=3.6e-100; Accession=PF01557.9; Description =Fumarylacetoacetate (FAA) hydrolase family
  Pfam module annotation: Pfam domain module=DUF1969::FAA_hydrolase; Domain location=6-123::154-364
  Subcellular localization annotation: CTP_CleavageSite=51; ConfidenceScore=5.08e-01
MAVLQSFVSVHPDSHFPIQNLPYGVFKPQSASPPRPGVAIGDFVLDLSEISSAGLFDGPLLKNSDCFLQPNLNKFVSLGRPAWKEARATLQKLLSATEPTLRDNVVLRQKSLLPVSTVELLLPVVVGDYTDFFTSLHHTKNCGLIFRGPQTPVLDNWYRLPVAYHGRASSVVISGTDIVRPRGQAHPIGSSTPYFGPSLKLDFELEMATIVGPGNELGKPVDINNAEDHIFGLVVMNDWSARDIQAWEYIPLGPFLGKSFGTTISPWIVTLEALEPFACEAPKQDPPPLPYLTEKVSRIYDISLEAHIKPAGHEDSGVVSRTNLKHLYWTLTQQLAHHTINGCNLRPGDLLGTGTVSGPEPESRACLLELTWNGQNAVPVNGLNKKFLEDGDEVILTGYCKPLEHDPELACQLLIQEKLSKALKALRGGALNWWLTWKWHYPNAAWWIFVKVLVKRFQPEHDFDQLVWVWKEEQELWEPRCSNEDMEVENKKKHHGRDEANLCKPEPETKLEIN

SEQ ID NO: 164932 - protein, 91 aa, Glycine max
  Coding DNA Sequence Number=SeqID_48154
  Subcellular localization annotation: CTP_CleavageSite=37; ConfidenceScore=5.20e-01
MKMKITTSHEKMTTKPLQKSKSEGKPMKSVTLKPVLRNSLSKGHARTICVLPEEPSSGNFPEEQIVVLPKEGSSRKFSEEGSSGRTICSSG

SEQ ID NO: 164933 - protein, 294 aa, Glycine max
  Coding DNA Sequence Number=SeqID_48155
  Gene Ontology: Mol. function=transcriptional activator activity; Cellular component=nucleus; Biological process=positive regulation of transcription
  Homolog annotation: Hit_ID=Q2HT28; Match level="QueryCoverage=98%, HitCoverage=42%, E-value=3e-71, Identity=53%"; Hit description =Transcription initiation factor IIF, alpha subunit
  Pfam annotation: Domain name=TFIIF_alpha; Domain location=18-294; Score=-171.9; E_value=0.014; Accession=PF05793.3; Description =Transcription initiation factor IIF, a
MSTDLQLKSSCSGCGSTTDLYGSNCKHMTLCLSCGKTMAEKRAKCFDCGATLTRLIREYNVRASSTNDKNYFIGRFINGLPDFSKKKSAENKWSLQKDGLHGRQITDTLRVLKSILVLLLLLCRYSFQAWYLVRRSALKHCISQKKCSLKNWKLVILKYYFMLRNTTTYHVTEKYKNKPWLLEDETGQSQFQGHLEGSQSATYYLLMKERKEFVAIPAGSWYNFNKVAQYKQLTLEEAEEKMKNRKKTADGYQRWMMKAANNGPAAFGEHGKFDDKESNTGGVRIRKKTGEDDE

SEQ ID NO: 164934 - protein, 98 aa, Glycine max
  Coding DNA Sequence Number=SeqID_48156
MQLVVWAKILGYQELYTAFKNYDSVLDIKKVDCGGLKNASEFSTISEDKLEDFDNFQRQQLQQVSTITETLRLCFMAKKCLSKQGTCLCLSQEGLGPF

SEQ ID NO: 164935 - protein, 259 aa, Glycine max
  Coding DNA Sequence Number=SeqID_48157
  Gene Ontology: Mol. function=transcriptional activator activity; Cellular component=nucleus; Biological process=positive regulation of transcription
  Homolog annotation: Hit_ID=Q2HT28; Match level="QueryCoverage=75%, HitCoverage=31%, E-value=1e-51, Identity=58%"; Hit description =Transcription initiation factor IIF, alpha subunit
DEEEEDEDNEEGGGLSKSGKELKKLLGKASGLNESDAEDDDDDDDDMKKLNIALVQAAIPFVVEDDVGVPPAIATKQKDALKEEPVDNSPSKPTATGPARGTPSSKSSKGKRKLNEEAKPSNTAPPKKVKVENEPKVSTKDGNGSASKNSAPPKGTPPLSSKAGSSTTTSGPVSEEEIRAVLRQKTPVTTQDLVAKFKARLRCSELVKAQHGLLLCSKAKRIGSCIKWEDKQAFAEILKRISKIQKTTSGASYVILRDK

SEQ ID NO: 164936 - protein, 58 aa, Glycine max
  Coding DNA Sequence Number=SeqID_48158
MAARGKRRAEEEGKEEKQEGGKVGTVLDTWPFEYHGYQQVLMVSDGSLLEKFLWRLNL

SEQ ID NO: 164937 - protein, 143 aa, Glycine max
  Coding DNA Sequence Number=SeqID_48159
  Homolog annotation: Hit_ID=O82230; Match level="QueryCoverage=49%, HitCoverage=39%, E-value=1e-29, Identity=91%"; Hit description =Expressed protein
  Pfam annotation: Domain name=DUF149; Domain location=15-84; Score =26.0; E_value=5.3e-06; Accession=PF02575.7; Description =Uncharacterised BCR, YbaB family COG0718
MAGILGNMQNLYETVKKAQMVVQVEAVRVQKELAAAEFDGYCEGELVKVTLSGNQQPVRTEITEAAMELGPEFEIPFSNSQLFPHTDDPLLQETLSELAECRSGAGIGGHAERHLLVRGAAIVAYYAIEVLVGAEGLGHALRR

SEQ ID NO: 164938 - protein, 234 aa, Glycine max
  Coding DNA Sequence Number=SeqID_48160
MTKNIMTLGIHNLACLFNTGHALGNTYLRFFGLSSGFGIRLGVSLLLGAKARISLIDRLRDTTVGGGGNVNCRGGGANGSNCRGDGADGRGVYGGGGGGNSGTVFNTSSHNSRTINKGSRTAARSDMPTPATTFCDFGREAATLTLQEATGCRDMMLQCNSIAIALQNGDTHLIAERTLQKTLECGTGPGELHKAMASVTDSQRAPGRGGGGGARQDIAAPQVWRAACATVFDF

SEQ ID NO: 164939 - protein, 239 aa, Glycine max
  Coding DNA Sequence Number=SeqID_48161
MKFKVLFTESVHARKTASICGFFRHVEREPQASEKAVLHADRKREVGRSVLDGGSWGPAGAVLDPWKKKWIHVSPSSASSNSNANNHASNASHLLLYKWTPLTQSQNTTNNANANGNAKDAPPEPPAEPPRRKFKYVPVALLEEQKNEAAENEGTEKVDEESKPIDVDSGAAEATRKNETLDEKPDINDVPMEESQSQYKNQVVRQDLNESTLDLSLGLTSHDDEHDSDSKTNQTRDGQ

SEQ ID NO: 164940 - protein, 65 aa, Glycine max
  Coding DNA Sequence Number=SeqID_48162
MEKRNNGLVHELLASVYHLTRLEYGIDQPEKIRILWRVDAQGVHNTIKDGASSTWKRGGRHEYIG

SEQ ID NO: 164941 - protein, 106 aa, Glycine max
  Coding DNA Sequence Number=SeqID_48163
  Subcellular localization annotation: CTP_CleavageSite=59; ConfidenceScore=5.40e-01
MSSAIYAFNDDNVFISKTAMSFFLISKKGQLSYPNFVRGLSFANIFFLLAKLSCLILVVAQSVRFFDVSEGNVQNTQKEGKMVTFGAFSAPGPTRKLRVEVTSSLG

SEQ ID NO: 164942 - protein, 367 aa, Glycine max
  Coding DNA Sequence Number=SeqID_48164
  Gene Ontology: Mol. function=calcium ion binding; Cellular component =mitochondrion; Biological process=RNA-dependent DNA replication
  Homolog annotation: Hit_ID=Q1SRK0; Match level="QueryCoverage=95%, HitCoverage=69%, E-value=6e-32, Identity=22%"; Hit description =Peptidase S8 and S53, subtilisin, kexin, sedolisin; Tetratricopeptide - like helical
  Pfam annotation: Domain name=PPR; Domain location=132-166; Score =39.7; E_value=1e-08; Accession=PF01535.11; Description=PPR repeat
  Pfam annotation: Domain name=PPR; Domain location=167-201; Score =34.7; E_value=3.2e-07; Accession=PF01535.11; Description=PPR repeat
  Pfam annotation: Domain name=PPR; Domain location=202-236; Score =32.4; E_value=1.5e-06; Accession=PF01535.11; Description=PPR repeat
  Pfam annotation: Domain name=PPR; Domain location=237-271; Score=4.7; E_value=2.1; Accession=PF01535.11; Description=PPR repeat
  Pfam annotation: Domain name=PPR; Domain location=272-306; Score =12.7; E_value=0.23; Accession=PF01535.11; Description=PPR repeat
  Pfam annotation: Domain name=PPR; Domain location=28-62; Score=18.7; E_value=0.021; Accession=PF01535.11; Description=PPR repeat
  Pfam annotation: Domain name=PPR; Domain location=307-341; Score =27.1; E_value=6.3e-05; Accession=PF01535.11; Description=PPR repeat
  Pfam annotation: Domain name=PPR; Domain location=63-96; Score=4.0; E_ value=2.5; Accession=PF01535.11; Description=PPR repeat
  Pfam annotation: Domain name=PPR; Domain location=97-131; Score=34.4; E_value=3.9e-07; Accession=PF01535.11; Description=PPR repeat
  Pfam module annotation: Pfam domain module=PPR::PPR::PPR::PPR::PPR::PP R::PPR::PPR::PPR; Domain location=132-166::167-201::202-236::237 -271::272-306::28-62::307-341::63-96::97-131
ALGRRKFFDFMMDALCDMRRNAIDGDLFMLSVVVDSFVRAGHVSRAIQVFGNLDDLGVRRDTEALNVLLLCLCRRSHVGAANSVLNSMKGKVDFDVGTYNAVAGGWSRFGRVSEVERVMREMEADGLRPDCRTFGFLIEGLGREGRMDEAVEILCGMKEMNCQPDTETYNAVIFNFVSVGDFEECIKYYNRMLSDNCEPNLDTYARMINRFLRARKVADALLMFDEMLRRGVVPSTGTITTFIKRLCSYGPPYAALMIYKKARKLGCVISMEAYKILLMRLSMVGKCGTLLSIWEEMQECGYSSDLEVYECIISGLCNVGQLENAVLVMEEALRKGFCPSRLLVFEPAWMLILKLIPSASIFPTLCE

SEQ ID NO: 164943 - protein, 72 aa, Glycine max
  Coding DNA Sequence Number=SeqID_48165
MTESIFLYRILEQATVAHGGHQGLWVVEEEFLRLFGQSFEREREMSINELISLSGNPLLALSVTFCIERNSS

SEQ ID NO: 164944 - protein, 43 aa, Glycine max
  Coding DNA Sequence Number=SeqID_48166
VKAGKHVLQAKADAAPSRRFKETRVSGGMVTSLLHNVVLLPKA

SEQ ID NO: 164945 - protein, 51 aa, Glycine max
  Coding DNA Sequence Number=SeqID_48167
MKGSQETQKHVLRIEYHIFGVEFLRGVLSQQRRLQRVLLECCLESASRKGL

SEQ ID NO: 164946 - protein, 178 aa, Glycine max
  Coding DNA Sequence Number=SeqID_48168
  Gene Ontology: Mol. function=sequence-specific DNA binding; Cellular component=nucleus; Biological process=regulation of transcription, DNA-dependent
  Homolog annotation: Hit_ID=Q1SD46; Match level="QueryCoverage=86%, HitCoverage=65%, E-value=7e-40, Identity=53%"; Hit description =Transcription factor, MADS-box
  Pfam annotation: Domain name=SRF-TF; Domain location=25-75; Score =76.9; E_value=6.5e-20; Accession=PF00319.9; Description=SRF-type transcription factor (DNA-binding and dimerisation domain)
  Subcellular localization annotation: CTP_CleavageSite=47; ConfidenceScore=5.00e-01
MESNNMPDLNGVAKKTKGRQKIEMKKMRNESNLRVTFSKRRTGVFKKASELATLCGVDVAVIMFSPGNRVFSFGSPGVDYVVQRYKTQGPPPLLTLDLNEVHSTVDEVELHTHLHCLSNQIAIEKKRTKDLNHLVKAAEDQFWWARPIESMTDSQLDKYKKMLEEFKRQLKEKRGNLN

SEQ ID NO: 164947 - protein, 212 aa, Glycine max
  Coding DNA Sequence Number=SeqID_48169
  Homolog annotation: Hit_ID=Q1T493; Match level="QueryCoverage=98%, HitCoverage=46%, E-value=5e-18, Identity=28%"; Hit description =Nucleic acid-binding, OB-fold, subgroup
MARSPDKIKSIDGSKETLKFSVRINDLWFIGTPNKSEQAGMVFVDSDGDEIHAVCKQDQLKVTVVRECVLGDIPFRKYRFVGFADVVVGQFEHGLLVDVIGLVEEVVFRQVSGKGRRVVFKLKDLSQQLLSCTLRDDYCLQFVKFLDDYEGDGAITVLLSHCRIKEAQGSYLASINNSFKASKLIINQPVMEIQEFNEQYFLLAELGIEARS

SEQ ID NO: 164948 - protein, 268 aa, Glycine max
  Coding DNA Sequence Number=SeqID_48170
  Homolog annotation: Hit_ID=Q47522; Match level="QueryCoverage=13%, HitCoverage=45%, E-value=7e-14, Identity=97%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSDAPDTGVKRRLKTWEEIRTPSMISEYHHRKQKIDQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 164949 - protein, 74 aa, Glycine max
  Coding DNA Sequence Number=SeqID_48171
MEHCNRPNNQRTTATGFAGGKGRKPTTFSTQIICFKCDKRGIFKDIEQNGGGLNDQIGRLKAKRRVFTLNGVEA

SEQ ID NO: 164950 - protein, 178 aa, Glycine max
  Coding DNA Sequence Number=SeqID_48172
  Gene Ontology: Cellular component=integral to membrane
  Homolog annotation: Hit_ID=UPI00005F84E8; Match level="QueryCoverage =63%, HitCoverage=60%, E-value=2e-21, Identity=57%"; Hit description =COG4291: Predicted membrane protein
  Subcellular localization annotation: CTP_CleavageSite=89; ConfidenceScore=5.71e-01
MAATIFTAYWINRSWFFTNQLPAPLMPSTTFKSFIRVVLTQSLTGETRKNTLASAASRKPPPKARRSTFARSPGDRMKAPARCWRWSVSRQTGQRLAENPASGVNRRNAGGLLAAAADRLHHALRPSILSPGCAAGAFAAAVSRQSHRADLSGLRLLLFHHRGRVANRRRGGRRRGGA

SEQ ID NO: 164951 - protein, 157 aa, Glycine max
  Coding DNA Sequence Number=SeqID_48173
  Gene Ontology: Mol. function=DNA binding; Biological process=DNA integration
MQPNRKDWSTRLDDAVWAHRTTYKAPIGMYPYRVVFGKACHLPVEIEHRAYWVVKTCNFSIDQAREERKLQLSELDEIRLEAYENSKFYKEKTKKFHDSLIAKKDFVVATEIEIKSESTNKSFKVNGHRLKSFLTNLSLMDVVVEETSLLHPTSLPP

SEQ ID NO: 164952 - protein, 87 aa, Glycine max
  Coding DNA Sequence Number=SeqID_48174
MENNDGLWRLMVAVDDGESAWDIRNGFGRKKGEEMAFFLSYTKAKAEMLSGTEASSTLQTSSQRSQRSDCGQMSCEDEDRISRRSNG

SEQ ID NO: 164953 - protein, 167 aa, Glycine max
  Coding DNA Sequence Number=SeqID_48175
MGSEIYPVVHENPRAFFSNSSPILLESSIQYPWGPHLKYATEGQAFGGIPPPNTLDGPQYHPQPLHFAVGRVLPAMVEKEKFNHIEERLRAIEEGENYVFADMAKLCLVPDVVIPLKFKVSDFDKYKGTACPKNHLKMYCRKMGAYTKDEKLLMNFFQESLIGATIT

SEQ ID NO: 164954 - protein, 283 aa, Glycine max
  Coding DNA Sequence Number=SeqID_48176
  Gene Ontology: Mol. function=chitin binding; Cellular component =extracellular region; Biological process=chitin metabolic process
  Homolog annotation: Hit_ID=UPI000044A8F0; Match level="QueryCoverage =77%, HitCoverage=100%, E-value=5e-40, Identity=31%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHILAFRGLHALAFRGPHVLTFRGLRALTFRGVHVVALRGLHAIAFSRLHVLPFRGLHVFAIRGLHIVTIRGLHALTFRGLHVLAFRGLHVLPFRGLHVLAIGGLHVLTFRELHALAFRGLHALAFRGLHILAFRGLHVLAFRGLHALAFRGLHVLSFRGLHALTFRGLHVLAFRGLHALTFRGLHALAFRGLHVLAFRGLHVLPFRGLHVLSFSGLHGHTPSPSVDLEKSSRVLGFLALITGLCQFNGVPVAPNKVIKPPTNQAFIKKYCAPRQAQGETPQ

SEQ ID NO: 164955 - protein, 110 aa, Glycine max
  Coding DNA Sequence Number=SeqID_48177
MWTTTANLREYAVPRRLNPYLFTPPPIYSKIGEELATQLAQVSLACPGEQGCFLQKQQPFGGRIWKAQVTNLHGLCIYSFLAFEEVTKTHGLRKTPPFDFRHITEFSRIA

SEQ ID NO: 164956 - protein, 63 aa, Glycine max
  Coding DNA Sequence Number=SeqID_48178
MEETMSLTVISRALEEETNVKIYILGATIIGPKFTWNYKWRLRWLGGYVATFSGVTSYISGLQ

SEQ ID NO: 164957 - protein, 46 aa, Glycine max
  Coding DNA Sequence Number=SeqID_48179
MKKGKSAQALYVQKSLDIYLFYKWYQTKPHPQTRKSMKTEQVEKPQ

SEQ ID NO: 164958 - protein, 82 aa, Glycine max
  Coding DNA Sequence Number=SeqID_48180
PTGCPFPLARSRHHDIGIAPARHPVDPKKSNKFYGVPVTSSKGIRPPTNRAFIKKYCVPRQAQGETPQQPGDGRQRATDAPP

SEQ ID NO: 164959 - protein, 141 aa, Glycine max
  Coding DNA Sequence Number=SeqID_48181
MNCVFVHVSSTFEFGAMRIDCLGQFSILTIFRSPMNWVFVQVSPTLKFGAMRMDCLGQFPIHTIFRSPINCVFIHVPSTFEFGAMRRDCLGQFSILTLFQSPKNCVFVRVPPTFEFGAMHRDCLVQFSILTLMKLIDTGDL

SEQ ID NO: 164960 - protein, 81 aa, Glycine max
  Coding DNA Sequence Number=SeqID_48182
  Subcellular localization annotation: CTP_CleavageSite=47; ConfidenceScore=5.28e-01
MNAVKGENVNPYPRKKKSGRKQKKKRRKIPKSKSGRKQKKKRRKIPKSKSGRKKRKERKFPIKDRRKTEEMCRKVVGPDDI

SEQ ID NO: 164961 - protein, 188 aa, Glycine max
  Coding DNA Sequence Number=SeqID_48183
  Gene Ontology: Mol. function=oxidoreductase activity, acting on paired donors, with oxidation of a pair of donors resulting in the reduction of molecular oxygen to two molecules of water; Cellular component=membrane; ...
  Gene Ontology: Cellular component=Biological process=fatty acid biosynthetic process
  Homolog annotation: Hit_ID=O82729; Match level="QueryCoverage=95%, HitCoverage=95%, E-value=2e-30, Identity=45%"; Hit description=Delta- 12 fatty acid desaturase
MGDTMKRVPFEKPPFSLSKIKKAIPPHCSPFIFMSHYIATSYFHNIPHPLSFLSLPIYWAVQGFTLAGVWMQEYLTCSNAMDFSILSWQKGLLGWCVFMEFHCLHCHTTIPLSGTGCRGALATVDRDYGILNKATKAIKPILGEYYQFDETPFLKAMWRKARECIYVEPDTENKGVFWYNDRKVVREL

SEQ ID NO: 164962 - protein, 84 aa, Glycine max
  Coding DNA Sequence Number=SeqID_48184
MLNPTQFQAKEEKIKAANDSLSEVYPLNEMHPLSETSCPLSGWENLEEEKSKICALNQPAQRGCCFFLRLARPLLLSENSLTLA

SEQ ID NO: 164963 - protein, 100 aa, Glycine max
  Coding DNA Sequence Number=SeqID_48185
  Subcellular localization annotation: CTP_CleavageSite=87; ConfidenceScore=5.03e-01
MVTGLQKIDGHWALGTSENKWDLPNNVSKYTPWVPPQLDGRRTSATANRSLLNTASLRSPNLCPPLSHPPLHTFSVRSNKHSRSHFQCQTEAHDCLEVRI

SEQ ID NO: 164964 - protein, 95 aa, Glycine max
  Coding DNA Sequence Number=SeqID_48186
MGVKYLKMIKQRLHAIKQWSPDEIRAINLWGSRPDGGGCTNNARQSIRGAPGLDGGGCMNGNQFMGLRIRFDGGGCTNSARQSIRGAPNSMVEDA

SEQ ID NO: 164965 - protein, 183 aa, Glycine max
  Coding DNA Sequence Number=SeqID_48187
  Gene Ontology: Mol. function=DNA-directed DNA polymerase activity; Cellular component=nucleus; Biological process=DNA replication
  Homolog annotation: Hit_ID=O48520; Match level="QueryCoverage=97%, HitCoverage=40%, E-value=8e-69, Identity=67%"; Hit description=DNA polymerase delta small subunit
  Pfam annotation: Domain name=DNA_pol_E_B; Domain location=1-137; Score=63.5; E_value=6.8e-16; Accession=PF04042.6; Description=DNA polymerase epsilon subunit B
MAEPIKELDILLSQIAAGLPLDIMPGPSDPANFSLPQQVNRLLSILLPLMLNLLYLEHDPHTASRFLGTSGQNVDDLEKYSEAKDKLEFMERTLRWRHLAPTAPNTLGCYPYTDKDPFFIESCPHVYFVGNQDKFETRVIKGSEGQLVRLICVPKFSETGVAVMLNLRDLDCHALSFGTQFSS

SEQ ID NO: 164966 - protein, 51 aa, Glycine max
  Coding DNA Sequence Number=SeqID_48188
MRSASNSGSAGSNCLQIDAFCMRSKSENALDKAQVKLSLANIIIPSWQIGI

SEQ ID NO: 164967 - protein, 136 aa, Glycine max
  Coding DNA Sequence Number=SeqID_48189
MDTTIVIATAAEANKVQHVTKKSSDELLRKFAEAGSDEAAGENKRRKKKKRESELCECDSPSSNGGAAMVERRSLLLPKVTRRSVLLRQLRVRDVRNKSSLFGTIHKTWRRTVEGASRVFLEKHYHRHKRLINDIV

SEQ ID NO: 164968 - protein, 229 aa, Glycine max
  Coding DNA Sequence Number=SeqID_48190
  Gene Ontology: Mol. function=RNA-directed DNA polymerase activity; Biological process=RNA-dependent DNA replication
WQKQERYGRGSYIMKEKLKAMKNSLKNWNRLREYTQECSEEFGRHALFRESLLKQQSRSKRLQEGRPCLDGVMFERITHEDNTMLIGKFGEMEIQEAIWECGSAKSLGPNGYNFRFIKKFWETIKGDVFNFLNDFHDSANFVRGANASFTSLIRKNDDPQGSNEVVDEARRNKKRCMIFKVDFEKAYALFQQSGGGQECIEEEGDMGANNNKIQEETCNVEAQAPNHCR

SEQ ID NO: 164969 - protein, 65 aa, Glycine max
  Coding DNA Sequence Number=SeqID_48191
MGEEEVLESESNVTNGNVQIQLLLLSSLRSPDGSPTTTLSASSLHSILIIHYREPEATPPLLLTS

SEQ ID NO: 164970 - protein, 229 aa, Glycine max
  Coding DNA Sequence Number=SeqID_48192
MRRAYPNALKAEFYRATKNLTRGRTTIRAIVNLCALQSISARDILLSPDAAASEPLLDLWFSYATLKLPVGRHAERLERCAKCFSDVLKASEKDHYVPQMKVVLRRFRLNRQLLREMHLDVYEEYKSRYEEQGPYSQRVHLNRAMDLALQMAEGDAEKMGSISRLQHAAKQIAQRCNVSLEAGFSVLLGARNVLKALSENRLRKKPSGSRDLMDLTSTRRAVKTSRSFA

SEQ ID NO: 164971 - protein, 48 aa, Glycine max
  Coding DNA Sequence Number=SeqID_48193
MSGDIIATKQVITTVEPITNLSCINSSSLKDLCSQPASAPDRTSSVKR

SEQ ID NO: 164972 - protein, 284 aa, Glycine max
  Coding DNA Sequence Number=SeqID_48194
  Homolog annotation: Hit_ID=Q1S0F5; Match level="QueryCoverage=37%, HitCoverage=26%, E-value=5e-10, Identity=36%"; Hit description=IMP dehydrogenase/GMP reductase
INAFLAFHDYKESPVVAILADLYDTFDRRCEKSSTRIVFCTPALYVWLASHLFRQEVIHACPLESHRSCTEKREARFPNVPLIGTRGCISYNPVLAIRQLGYPMRGAPLKEEELAPIIARGSNNGPIGGYHRWLKAHMQGLDWLPSLRTSKVVEVEAPEEDEEVQALRAELEKAQTVKERFKSAALKIRKENAELRDVNIANTKALEQETKRARKGPITSRQFDLEGWVKGLPKVQEKLVSMFMRDKDQHVSHHQQVPRRIKSSHGPRAQSGGRVCPSVRGKGG

SEQ ID NO: 164973 - protein, 66 aa, Glycine max
  Coding DNA Sequence Number=SeqID_48195
MHETQCGPLRVHRMNRKAWFEQNRGGGCRPARPGEPGCFLQKQQPSGGIFLEGPSGPGCYLHPHFY

SEQ ID NO: 164974 - protein, 153 aa, Glycine max
  Coding DNA Sequence Number=SeqID_48196
  Homolog annotation: Hit_ID=Q1SDY9; Match level="QueryCoverage=46%, HitCoverage=12%, E-value=1e-20, Identity=63%"; Hit description =Peptidase S8 and S53, subtilisin, kexin, sedolisin; Zinc finger, CCHC- type
MFAGEHYDLWKIVKNGSNPAPLPDNPTAMQIRFHIDEVVEEGRALVIIQTALHDNVFIKIVSLETTKEAWDKLNEKFQGSERTRRIRESEIKYDEGRGFSPLLHIPLLLSFRDSEMEPVSALTKYKLVFLGDQSVGNVWIFGEKRDMHSSGNV

SEQ ID NO: 164975 - protein, 172 aa, Glycine max
  Coding DNA Sequence Number=SeqID_48197
  Gene Ontology: Mol. function=transition metal ion binding; Cellular component=cytoplasm; Biological process=electron transport
SLEDMICDLGQESFQQAHAPMYDTLQSHSKKPLYPGCKNSLTLLSAVLSLVSVKVRYGWSDKSFSSLLQVVYDMFLEENTLPKSYYQAKKILCSMGVGVSRYIVKDDDECSSDENSKKGPLAKVLWYLSIVPRFKRLFANGNDAKDILHGMQMRATAMEWSVIRMIAPSGKG

SEQ ID NO: 164976 - protein, 92 aa, Glycine max
  Coding DNA Sequence Number=SeqID_48198
MLHSMLQSLHGGQSIIMQSLQGLGLPSIMSMAEFDAQEPKPEEPVAAADGKDELTPPKPFYFEAVPIPDDSMPSAPASELEQPISQDSPAAQ

SEQ ID NO: 164977 - protein, 95 aa, Glycine max
  Coding DNA Sequence Number=SeqID_48199
MGGTGAVEEEGATISGGVEVVGTFDLLPLALLGPLNLMAGLKFSRDLESDWTPLALHRVVIKVGNPSLDVSCCAVREIWWEMRYPTFISIFIMMP

SEQ ID NO: 164978 - protein, 74 aa, Glycine max
  Coding DNA Sequence Number=SeqID_48200
VGSKDSKETLPIVESPRTKLKASYTFPSGTRCPLVLETSVEEATSSITKLRALESKEEEDIERTSHDNLPRSSV

SEQ ID NO: 164979 - protein, 70 aa, Glycine max
  Coding DNA Sequence Number=SeqID_48201
MEWYLQHFVRQQAANHRGQVQFRAEVAWPGDWPEAQTEEAPAGAPDDAKEARMDEEMIDLLGFLGGSGAT

SEQ ID NO: 164980 - protein, 39 aa, Glycine max
  Coding DNA Sequence Number=SeqID_48202
  Gene Ontology: Mol. function=protein serine/threonine kinase activity; Cellular component=membrane; Biological process=protein amino acid phosphorylation
  Homolog annotation: Hit_ID=Q8LQ53; Match level="QueryCoverage=100%, HitCoverage=10%, E-value=2e-12, Identity=76%"; Hit description =Protein kinase 6-like
MLDWGEEGHRTEAEIAALRSAFTQEVAVWHRLEHPNVTK

SEQ ID NO: 164981 - protein, 121 aa, Glycine max
  Coding DNA Sequence Number=SeqID_48203
  Gene Ontology: Mol. function=structural molecule activity; Cellular component=flagellin-based flagellum; Biological process=ciliary or flagellar motility
  Homolog annotation: Hit_ID=Q1GZU1; Match level="QueryCoverage=99%, HitCoverage=100%, E-value=6e-30, Identity=56%"; Hit description =Flagellar hook-basal body complex protein
  Pfam annotation: Domain name=FliE; Domain location=23-121; Score =116.8; E_value=6.1e-32; Accession=PF02049.8; Description=Flagellar hook-basal body complex protein FliE
  Subcellular localization annotation: CTP_CleavageSite=56; ConfidenceScore=5.13e-01
MNAGGIDAQRITSMLAQLRAAAQKPEGLGSSAIANPVQKTNAASPTSQVSFSDALKASLDQVNNMQLQSEKLGQDFAMGNDNVSLSDVMISGQKANIAFQATVQVRNKLVTAYQDMMNMQV

SEQ ID NO: 164982 - protein, 44 aa, Glycine max
  Coding DNA Sequence Number=SeqID_48204
MANWLRLPCMVLSACASLGSMRTLKRPFTMAILTLTSPSRGKCK

SEQ ID NO: 164983 - protein, 45 aa, Glycine max
  Coding DNA Sequence Number=SeqID_48205
MEVQMAADAALLTSNDESNGSPNMFGQLGQKLMLVAGIAAVVAVM

SEQ ID NO: 164984 - protein, 90 aa, Glycine max
  Coding DNA Sequence Number=SeqID_48206
  Gene Ontology: Cellular component=flagellum; Biological process =protein secretion
  Homolog annotation: Hit_ID=Q1GZU0; Match level="QueryCoverage=83%, HitCoverage=89%, E-value=4e-21, Identity=59%"; Hit description =Putative flagellar biosynthetic protein
MRRMKTGGNMQRDKAYTQSAVALAYEAGDLAPRVVAKGNGLLAERIIALAKEHEVELDAHIPPQLYQAIAEILAWLYQLEQGELREPPAV

SEQ ID NO: 164985 - protein, 127 aa, Glycine max
  Coding DNA Sequence Number=SeqID_48207
MSASDHAILRDRVHQPTKMSLLELSSQDAVLAQNKLLSKKLEILIETIEQMQEVSYMGNQQRQGYNQGGFSSFQQGPYNQQGQWRSHPGNQFNKDQGGPSNRPPQQGPNIFQRGLPNWRKTWLNSCK

SEQ ID NO: 164986 - protein, 130 aa, Glycine max
  Coding DNA Sequence Number=SeqID_48208
NMNAQLRGQMLTQDCLDWAQLVVKVAKVEQFMNEKDEKKSYRGEEDLDDNLTTDHMATKLDKGKLYSCLALQPFKGKGAKGKESYLFAISKAEQVFDYLVKDLQIWLLTSKGVMLRGNITSNRGPSLTWE

SEQ ID NO: 164987 - protein, 80 aa, Glycine max
  Coding DNA Sequence Number=SeqID_48209
MGAEWRWKKYDWRRHFKEKRSQEEAHHHGRADPAQILLLQLKIISHSKFVIMIIPTALQPWLGDSKKIGPKMQEKALGFS

SEQ ID NO: 164988 - protein, 35 aa, Glycine max
  Coding DNA Sequence Number=SeqID_48210
MGDKMQDGVCLLKLSTMGPEIMDHAVLLHRKAKHS

SEQ ID NO: 164989 - protein, 241 aa, Glycine max
  Coding DNA Sequence Number=SeqID_48211
  Homolog annotation: Hit_ID=Q1T493; Match level="QueryCoverage=100%, HitCoverage=46%, E-value=6e-25, Identity=28%"; Hit description =Nucleic acid-binding, OB-fold, subgroup
MARVADKIKLIDGSREALKLSVRITDLWFIGIPEKTEQAEMVVIDSDEDEIHVVCKQDQLKSRKADLKENLTYVMHNFKVIKKDGKFRVCDHEYKLCFTGVTVVRQCDMEQLPFRKFRFVAFSSVIVGHFKIGLLVDVIGVVDEVVFRYVSSKNTRVEFKGFEVLSCTLWENYCLQFLSYLNDIEDERPIIILLTHARIKEAQRSYLASVSNSFKASKLMINDLVLEIQEFRESLLDLGIE

SEQ ID NO: 164990 - protein, 153 aa, Glycine max
  Coding DNA Sequence Number=SeqID_48212
  Homolog annotation: Hit_ID=Q09JM0; Match level="QueryCoverage=37%, HitCoverage=98%, E-value=1e-10, Identity=63%"; Hit description=10 kDa putative secreted protein
DPTPKDGELCLSGAKPEETLVEARSDTDVQIVRLTWVGRCGCSVEPRHGIESSKWAIFGKQNWRCGMNRKLGYGAQLRANLDPTKGVGRLRQQDGGHGSRNPLRRRGGRCKTQGASPGGAVVGADLGGSSKYSNENFEGRRGEKVPCERHLHM

SEQ ID NO: 164991 - protein, 97 aa, Glycine max
  Coding DNA Sequence Number=SeqID_48213
MIIQCFDQECENTQRGWQKGHFKAFLNLGSPRLASGSPGPPNNFMVKLRDGYQGPALREIREDKKKKEEKNEVKALPNCDHNRLLPRSSFVLRLSSG

SEQ ID NO: 164992 - protein, 615 aa, Glycine max
  Coding DNA Sequence Number=SeqID_48214
  Gene Ontology: Mol. function=kinase activity; Biological process =carbohydrate metabolic process
  Homolog annotation: Hit_ID=Q67Y17; Match level="QueryCoverage=93%, HitCoverage=97%, E-value=0.0, Identity=58%"; Hit description=MRNA, complete cds, clone: RAFL25-18-P16
  Pfam annotation: Domain name=FGGY_C; Domain location=367-589; Score= -25.9; E_value=2.3e-05; Accession=PF02782.6; Description=FGGY family of carbohydrate kinases, C-terminal domain
  Pfam annotation: Domain name=FGGY_N; Domain location=34-283; Score= -25.0; E_value=1.9e-08; Accession=PF00370.11; Description=FGGY family of carbohydrate kinases, N-
  Pfam module annotation: Pfam domain module=FGGY_C::FGGY_N; Domain location=367-589::34-283
KEDAIDNKKGLIHTLSPSKWPLLLPLPTSLLALSFLGVDVGTGSARAGLFDEEGKLLGSSSSPIQIWKDGACVEQSSTDIWLAVCAAVKAACSKAKVASTEVKGMGFAATCSLVAVDSDSSPVSVSWSGDSRRNVIVWMDHRAIEQAERINSSKSPILEYCGAAVSPEMEPPKLLWVKENLQESWSMVFRWMDLSDWLSYRATGDDTRSLCTTVCKWTYLGHAHMQHVNDKESRDLEACGWDDDFWEEIGLGDLIEGHHAKIAYDYSSIFVPFIAGSVFPLLNLIVNHNNRTKCCFPWPSFGFWSYSYCSKGKNFCIILKFELVLSEELGLVPGIPVGTSLIDAHAGGVGVIESVPQSEAADHDKEAICNRMVLVCGTSTCHMAVSRSKLFIPGVWGPFWSAMVPEYWLTEGGQSATGALLDHIIEDHAASACLANQAASQKISLFELLNKMLETMMVELNLSFIAALTKDVHVLPDFHGNRSPIADPKAKGVIYGLTLDTSDKQLALLYLATVQGIAYGTRHIVEHCNAHGHKVRICRKESEPVLLGAAILGAVATRKYHSLSEAMKALNAAGQVIHPSKDPKVKKYHDAKYKIFRGLYEQQLSYRSAMAQALS

SEQ ID NO: 164993 - protein, 1169 aa, Glycine max
  Coding DNA Sequence Number=SeqID_48215
  Gene Ontology: Mol. function=protein-tyrosine kinase activity; Biological process=protein amino acid phosphorylation
  Homolog annotation: Hit_ID=Q9FKL3; Match level="QueryCoverage=94%, HitCoverage=99%, E-value=0.0, Identity=49%"; Hit description =Similarity to protein kinase
  Pfam annotation: Domain name=PB1; Domain location=37-124; Score=97.2; E_value=4.9e-26; Accession=PF00564.15; Description=PB1 domain
  Pfam annotation: Domain name=Pkinase; Domain location=814-1102; Score= 191.2; E_value=2.6e-54; Accession=PF00069.15; Description=Protein kinase domain
  Pfam annotation: Domain name=Pkinase_Tyr; Domain location=814-1102; Score=233.1; E_value=6e-67; Accession=PF07714.7; Description=Protein tyrosine kinase
  Pfam module annotation: Pfam domain module=PB1::Pkinase::Pkinase_Tyr; Domain location=37-124::814-1102::814-1102
MDSPIRSPATGSGSGSGEDNRRVKFLCSFLGSIMPRPQDGKLRYVGGETRIVSVHRDISYEELMGKMRELYDGAAVLKYQQPDEDLDALVSVVNDDDVVNMMEEYDKLGSGDGFTRLRIFLFSQSEQDGSSHFIDGDDSERRYVDALNSLNDGSDFRRLQQGEFPMMSPVEDIHVVADQFYSPISVESGIHSQRSGDLSMSPYNMHHLTVQHPKSMGQRYNEMDAPWNPAYYSPRHHGLHEFPSSPSGTRYRVPFPELPDKCIDRVSEEYVRHHVNHHPVYDNQLQYSENVMWVPTGAAHGEKSAFPGNILHSPHVVDGNSICEQCRMGFHRGQPHMEHSNISNGLPQAANPCAECPPPNRDTFTVNADAKLHPAIYPNEPNNDHRSVYNDTQNHERGWGLQHPTARVEESRVHVSGSGRMFDVPVANFSLGHGSVTDGHNLSSNYVHQQAGPELGPELFPDQTVTSIPPIQIPPLEECNVQYGNSPSPYGLDCNYAVPRGHPPGFWRNTPVPVHIGPSYEAATSPQPLNSMMNVGLIRGEGSTGFFIGPDSQNHWVDSSQKLTGHDGTAIPEYPYAHALNPVPLGQENQHPDIVDTIHPPQDMNAGTCLEPLQLPKSSFNMVQNQQVLRDDTHLTEAKSFESNSLLGEGIVIKIEDNVENPGAQTISSSEQNKIAEHACEAAASVESNNLKSKPEADCVHVEKLADKDPSVPEDSKHLVDQFSFLPELIASVKKAALEDAEELKAAADEPANSQNHNSDTKDETTNEVEPTNAHGDLELDSENDHVDTNKIESTRAEEEAFANGLQTINNDDLEEIRELGSGTYGAVYHGKWKGSDVAIKRIKASCFAGRPSERARLGCVGLWDSPVKRCVGLWDSPVKRCVITDFWKEALMLSSLHHPNVVSFYGIVRDGPDGSLATVTEFMINGSLKQFLHKKDRTIDRRKRLIIAMDAAFGMEYLHGKNIVHFDLKCENLLVNMRDPQRPICKIGDLGLSKVKQHTLVSGGVRGTLPWMAPELLSGKSNMVSEKIDVYSFGIVMWELLTGNEPYADMHCASIIGGIVNNSLRPQIPTWCDPEWKSLMESCWASDPVERPSFSEISKKLRITCTIAWILSQKQLGVLKKATYITLVMTTIAVALPSQMNRAFWRDVYIKSTNDMPPVLSHGKDNDE

SEQ ID NO: 164994 - protein, 666 aa, Glycine max
  Coding DNA Sequence Number=SeqID_48216
  Gene Ontology: Mol. function=pyridoxal phosphate binding; Biological process=biotin biosynthetic process
  Homolog annotation: Hit_ID=Q6ZKV8; Match level="QueryCoverage=98%, HitCoverage=71%, E-value=1e-168, Identity=49%"; Hit description =Putative adenosylmethionine-8-amino-7-oxononanoate aminotransferase
  Pfam annotation: Domain name=Aminotran_3; Domain location=186-645; Score=-106.6; E_value=2.7e-06; Accession=PF00202.11; Description =Aminotransferase class-III
EGVGPPPELLCKTLYAWEEAVSPHLAAEREGLVVKDSAVLETLGECLEDVAECGAGKERSEVLCVVETAGGVASPGPSGSLQCDLYRPFRIPAVLVGDGRLGGISGTISAYESLKLRGYDVVAVVFEDHGLLNEGPLMSYMRNKVPVLVLPPIPKDPLNDLMEWDIIWWPFTQHKLVPDGGVTVIDSRCGENFSIFKVQKTEVIAPQFDACASWWTQGPDAIMQTELAREMGYAAARFGHVMFPENVHEPALNCAELLLQGVGKGWASRTYFSDNGSTAIEIALKMAFRKFSVDHGLIVHCHEDTTNERSTELMVLALQRSYHGDTLGAMEAQAPSSYTGFLQQPWYTGRGLFLDPPSVFMHNSTWNVSIPEGYHLESLKGKSITFASPDEIFHKGRDKSELATVYSSYISKVLSGFRGGSSPCEGMGEGCCTQPYPCICKEAVSRFEPMTNKSPRHNFTAAPGLALIPHGSLDILINLFSPFLDIDHLIWGLSCYVVIQGAGGMHMVDPLFQRVLVNECRSRKIPVIFDEVFTGFWRLGVETAVELIHCVPDIACFGKLLTGGIIPLAVTLATNAVFDSFIGDSKGSEERRGHVVSCESIGVFVHWEVQTPLKYYKLGTLKALLHGHSYSAHAMGCAAAVKSIQWFKDPCSNPNITSEGRLLREV

SEQ ID NO: 164995 - protein, 589 aa, Glycine max
  Coding DNA Sequence Number=SeqID_48217
  Gene Ontology: Mol. function=calmodulin binding
  Homolog annotation: Hit_ID=Q9FKL6; Match level="QueryCoverage=99%, HitCoverage=97%, E-value=0.0, Identity=60%"; Hit description =Calmodulin-binding protein
  Pfam annotation: Domain name=Calmodulin_bind; Domain location=60-363; Score=675.0; E_value=5.7e-200; Accession=PF07887.2; Description =Calmodulin binding protein-like
MGKRSLEGGEDDQPERKRPALASNTDEQVSEEVERALAKLGPARLSGRSPPKMIEGPDGRSLQLKFRSRLSLPLFTGGKVEGEQGAPIHVVLMDVNSGSVVTSGPESCVKLDVVVLEGDFNNEDDEDWTQEDFESHVVKEREGKRPLLTGDLQVTLKEGVGTLGELTFTDNSSWIRSRKFRLGLKVASGFCESLRIREAKTVAFTVKDHRGELYKKHYPPALTDEVWRLEKIGKDGSFHKKLNNAGIVTVEEFLRLVVKDQQKLRNILGSGMSNKMWEALLDHAKTCVLSGKLYVYYPEDARNVGIIFNNIYELRGLISGDQFYSADSLTDSQKVYVDSLVKKAYENWDQVVDYDGKSLVNAKIASENELRVESIDYGSGLDHQLQLPALPVSVPSEQQINSGMPVGALCYIADCNSRTQFDSSLYVSNDQLISNAHQTQSTSNDRGPIGLALGPPQSSTSGFHAGSSSIQPSTINPFDDWSHNRDKGADEFFSEEEIRFRSHEMLENEDMQQLLRLFSMGGNGSMSAEDGYSFPSFMPSPSIPNYDEDRSRPGRAVVGWLKIKAAMRWGFFIRKIAAERRAQIEELDE

SEQ ID NO: 164996 - protein, 183 aa, Glycine max
  Coding DNA Sequence Number=SeqID_48218
  Gene Ontology: Mol. function=hydrolase activity, hydrolyzing O -glycosyl compounds; Cellular component=cell wall; Biological process= carbohydrate metabolic process
  Homolog annotation: Hit_ID=Q8GTJ0; Match level="QueryCoverage=99%, HitCoverage=87%, E-value=7e-49, Identity=75%"; Hit description =Xyloglucan endotransglycosylase
  Pfam annotation: Domain name=Glyco_hydro_16; Domain location=2-107; Score=-55.1; E_value=0.0017; Accession=PF00722.11; Description =Glycosyl hydrolases family 16
  Pfam annotation: Domain name=XET_C; Domain location=130-180; Score =108.9; E_value=1.5e-29; Accession=PF06955.3; Description=Xyloglucan endo-transglycosylase (XET)
  Pfam module annotation: Pfam domain module=Glyco_hydro_16::XET_C; Domain location=2-107::130-180
  Subcellular localization annotation: CTP_CleavageSite=39; ConfidenceScore=5.30e-01
MVVPRYSTTAIFLLFPLTKPPDQGFSPRTSISLARLICNSSLYPEILQALSLPISFSVDGTPIREFKNMESKRVSFPKEQPMRIYSSLWNADDWATRGGIVKTDWSQAPFTASYRNFNANACVHSGASSCTSNSASSNAWFNQQLDSTSQDRLSWVQKNYMIYNYCTDTNRFPQGLPPECQAS

SEQ ID NO: 164997 - protein, 143 aa, Glycine max
  Coding DNA Sequence Number=SeqID_48219
MVRYLSLFFWGRNLSYPNFAQELSFVDLLILVSRLTVLNVSYSAKQMIIQCFDQECENTQRGWQKGHFKAFLNLGSPRLASGSPGPPNNFMVKLRDGYQGPALREIREDKKKKEEKNEVKALPNCDHNRLLPRSSFVLRLSSG

SEQ ID NO: 164998 - protein, 96 aa, Glycine max
  Coding DNA Sequence Number=SeqID_48220
MESKEPMVLFHLQEGEIALRKWMMDRVTLGIMGEELEDQCILYSYMAITPNCHPCNCIRPLRPRRLGGKGWALLRDKCASYALRISKVLLAWKNHM

SEQ ID NO: 164999 - protein, 102 aa, Glycine max
  Coding DNA Sequence Number=SeqID_48221
MRCTHGPKIYPKAHENPRAFSCILGPIYLESSIQCPWGIGLHHIRSSWLSSFQQRGFSLPLSWRLYNYKRGIFSKGDKDKKENGGKEWFSMLAFPSSSIFLL

SEQ ID NO: 165000 - protein, 56 aa, Glycine max
  Coding DNA Sequence Number=SeqID_48222
MEREKGITRRQYIWRLQCLLRLSDVWELYRSSWRKNWRNLREPLEMPLSLSEDTDP

SEQ ID NO: 165001 - protein, 90 aa, Glycine max
  Coding DNA Sequence Number=SeqID_48223
MDSDSCSLDWWVQFYVSPYAHIQSMLNELRRCFLKKRIIGVREESRAREQEFQELSGGREEKDKVLYMQVEWWTMKLKWTEVFELLVWPP

SEQ ID NO: 165002 - protein, 167 aa, Glycine max
  Coding DNA Sequence Number=SeqID_48224
MFLVKEKWKKMRETVFSSLSVLLLSVFHVVEWLARLWLWWSPLVFRQLGVLKALGLLSTERLAERDARRDNDLARRAGCALSAQIYDLSSSRVSHLSSELDASLSGWGSLTYSTSLSEFQGSEVERIERRGKEEEEERRGNEVEALSNRDCDRPNVVSCSVFFAPVS

SEQ ID NO: 165003 - protein, 62 aa, Glycine max
  Coding DNA Sequence Number=SeqID_48225
MASSHSRAQNKAKFSKRKQEECSQSALNMHHDQQQTWTKWKKKWKMKLSKSLQTNGVLLSLS

SEQ ID NO: 165004 - protein, 76 aa, Glycine max
  Coding DNA Sequence Number=SeqID_48226
MTSRLKSLNKAKKSLRQRLKNFLENGELRKISHWITLLEKFQRVESGNIDEALCDEHWLMVMHEELNQLREMKCGT

SEQ ID NO: 165005 - protein, 185 aa, Glycine max
  Coding DNA Sequence Number=SeqID_48227
MAERGFWELPQKKSGRFFRGFLRKKLLQDIPRDPTEEGYILLSRKNLRKLLPQGIFSSRRRSCGSFSADHELVEVEALVRMRMRLMLLGVAGLLPQHARRQRVRLREDVTERHEDVPQLHEDVPHVFDATPEMTGVADAVQTEGVATDGSLGSPAADEGFPDGPRDPSILTDFAEHVEHSIWSRQ

SEQ ID NO: 165006 - protein, 168 aa, Glycine max
  Coding DNA Sequence Number=SeqID_48228
TLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVPETTGAVAKASLHRAIVTAYGPEP

SEQ ID NO: 165007 - protein, 44 aa, Glycine max
  Coding DNA Sequence Number=SeqID_48229
MVVASKAHGFPAPLSATSIPTDSWFQYHTVVEDASTKATSKRMG

SEQ ID NO: 165008 - protein, 158 aa, Glycine max
  Coding DNA Sequence Number=SeqID_48230
  Gene Ontology: Mol. function=hydrolase activity, acting on ester bonds; Biological process=lipid metabolic process
  Homolog annotation: Hit_ID=Q9FFC6; Match level="QueryCoverage=70%, HitCoverage=33%, E-value=1e-40, Identity=71%"; Hit description=GDSL -motif lipase/hydrolase-like protein
EIIGFTSYQPAYLNLKTKGKNLLNGANLPQLLLSLYALGARRIGVTTLPPIGYLPGAITLFGAHTNECVTSLNSDAINFNEKINTTSQNLKNMLPGLNLVVFDIYQPLYDLVTKPSENGFFEARKACCGTGLIETLCNKKSIGTCDHTYLKIVIVKYG

SEQ ID NO: 165009 - protein, 90 aa, Glycine max
  Coding DNA Sequence Number=SeqID_48231
MKNMEHRRRKEEEAPMKEEVTRIRTSHFFFYREKLLGVPVKMLDAQNNRLWFRCESISKSQIEVNGNEFFGKTTYPKNDEEDEVQAEDIG

SEQ ID NO: 165010 - protein, 160 aa, Glycine max
  Coding DNA Sequence Number=SeqID_48232
MIRLFEDKVKRDAAETTTTKVVADAENVNVGGLVTSKNVLVKKVNDEARRSKRPHHDIGEKDLISLDESQEHPGSARSGHHSPMDADVEENWDVQNLGNALNQAKSFSTCNETKRGFYLPTLIRILKKRLYMSFMIKHLSRFASMPRFVSMKLRNFPLRH

SEQ ID NO: 165011 - protein, 85 aa, Glycine max
  Coding DNA Sequence Number=SeqID_48233
  Gene Ontology: Mol. function=cyclin-dependent protein kinase regulator activity; Cellular component=cytoplasm; Biological process= cell cycle
  Homolog annotation: Hit_ID=O23249; Match level="QueryCoverage=83%, HitCoverage=82%, E-value=9e-33, Identity=88%"; Hit description=Cks1 protein
  Pfam annotation: Domain name=CKS; Domain location=1-72; Score=169.2; E_value=1e-47; Accession=PF01111.9; Description=Cyclin-dependent kinase regulatory subunit
MGEISYSDKYYDDTYEYRHVVLPPEVAKLLPKNRLLSENECRAIGVQQSRGWVHYAIHRPEPQIMLFRRPLNCQEQQQENQAQII

SEQ ID NO: 165012 - protein, 957 aa, Glycine max
  Coding DNA Sequence Number=SeqID_48234
  Gene Ontology: Mol. function=translation initiation factor activity; Cellular component=cytoplasm; Biological process=multicellular organismal development
  Homolog annotation: Hit_ID=Q9SJK3; Match level="QueryCoverage=91%, HitCoverage=87%, E-value=0.0, Identity=58%"; Hit description =Argonaute-like protein At2g27880
  Pfam annotation: Domain name=DUF1785; Domain location=266-325; Score =83.6; E_value=6.2e-22; Accession=PF08699.1; Description=Domain of unknown function (DUF1785)
  Pfam annotation: Domain name=PAZ; Domain location=326-461; Score =141.0; E_value=3.3e-39; Accession=PF02170.12; Description=PAZ domain
  Pfam annotation: Domain name=Piwi; Domain location=613-922; Score =438.9; E_value=6.7e-129; Accession=PF02171.8; Description=Piwi domain
  Pfam module annotation: Pfam domain module=DUF1785::PAZ::Piwi; Domain location=266-325::326-461::613-922
  Subcellular localization annotation: CTP_CleavageSite=56; ConfidenceScore=5.65e-01
MSPRGGSKQQPDSRRQAPPSAAAAVPSPPGRGRGRGRGESSVPAPSLVNAPSAPPPASTIGVPSGAAPFRAALPPPAVESLTSAVEKQLTMQPSAPSSSKAVRFKERPGFGLAGEKIKVRANHFQVQVAEQDLFHYDVSINPEITSKKVSRDVMTLLVQAHREKILGNRIPAYDGGKSLFTAGSLPFESKDFVIVLKDDDEPGSSSSSSPTRKKREREYRVTIRLASRTDIHHLSQFLRRRQLDCPYETIQALDVVLRATPSERFVVVGRSFFSPSLGKPGSLGSGTEYWRGYYQSLRPTQMGLSLNISWFYFSYYVSARAFYEPIPVIDFIESHFRANPSRPLPDQDRIKLKRVLRGVKVEVTHGKNLRRYKITGVTKEQLRKLMFTLDDNRTKSSVVQYFHEKYNIVLKHTLLPALQAGSDIKPIFLPMELCQIVAGQRYTKRLNEEQVTNLLRASCQRPRDRENSIRQVVRQSNFSTDKFVSHFGIQVREDPALLDARVLPAPMLKYHDTGRESSVEPKMGQWNMIDKKMFNAGVVEHWTCLNFSGKINREFPSAFCHKLARMCSNKGMRFNSKPLLPITSAQSSQIESALVNLHKQSITRLANQGRLQLLIIILPDFEGSYEKIKRICETELGIVSQCCQPRHVCQMKPQYLENVALKINVKVGGSNTVLNDAIARIIPRVSDRPTLILGADVTHPQPGEDSSPSIAAVVASMDWPYVTRYRGVVSAQTHREEIIQDLYNTCEDPVKGKVHSGIIRELLRAFRLSTNQKPERIIFYRDGVSEGQFSQVLLYEMDAIRRACASLQEGYLPRVTFVVVQKRHHTRLFPVDHGSHDQTNKSGNIMPGTVVDTHICHPREFDFYLNSHAGMQGTSRPTHYHVLFDENNFTADGYARCTRSVSIVPPVYYAHLAAFRARCYIEVATSDSGSASGGRAANCEVRLPSVKENVKDVMFFC

SEQ ID NO: 165013 - protein, 71 aa, Glycine max
  Coding DNA Sequence Number=SeqID_48235
MYREKVRGFPIESWNGVGIQNTWLDGTMERKWRITSAFCSAAYAARMTDRIVGHSVFFTRLSWNLDVTRAL

SEQ ID NO: 165014 - protein, 236 aa, Glycine max
  Coding DNA Sequence Number=SeqID_48236
  Gene Ontology: Mol. function=peptidase activity; Cellular component =cellulose and pectin-containing cell wall; Biological process =proteolysis
  Homolog annotation: Hit_ID=Q9FFC3; Match level="QueryCoverage=86%, HitCoverage=38%, E-value=7e-73, Identity=67%"; Hit description =Protease-like protein
MEWMECFQYLQCTWVPAPGKVPCVRPHYNLNLQSISVNGQIVPIAPAVFATSNNRGTIVDSGTTLAYLAEEAYNPFVNAITALVPQSVRSVLSRGNQCYLITTSSNVDIFPQVSLNFAGGASLVLRPQDYLMQQNYIGEGSVWCIGFQRIPGQSITILGDLVLKDKIFVYDLAGQRIGWANYDCSLPVNVSASAGRGRSEFVDAGELSGSSSLRAGLHMLINTLFLALFMHITLIL

SEQ ID NO: 165015 - protein, 141 aa, Glycine max
  Coding DNA Sequence Number=SeqID_48237
  Subcellular localization annotation: CTP_CleavageSite=49; ConfidenceScore=5.16e-01
MTLLLSNIPSSDHNADLLLQKYQLGSRPQGTQWTRRSPTGPWGFQLWLRASVSPKCPSPQQGHAIVTYVRIMPARNPVDPEKSNSVMGFPALIMGLCQFYRVPVAPNKVIRPPINRAFIKKYCTSRQARHHNSLGMADNGQ

SEQ ID NO: 165016 - protein, 112 aa, Glycine max
  Coding DNA Sequence Number=SeqID_48238
MSLPTLETQCAKEGGGRWWRSVRRVQELAQWRMRSLPPREDEGGGTMWRTRSLPSWVKEKPSRREYACEEGYNMGGASLKCHSYHIRPTSCMWASYAFELTFLLQLDSFKKH

SEQ ID NO: 165017 - protein, 146 aa, Glycine max
  Coding DNA Sequence Number=SeqID_48239
  Gene Ontology: Mol. function=nucleic acid binding; Cellular component= integral to membrane; Biological process=protein amino acid phosphorylation
  Homolog annotation: Hit_ID=Q9FNZ2; Match level="QueryCoverage=100%, HitCoverage=33%, E-value=4e-42, Identity=58%"; Hit description=Zfwd1 protein
VITGIALPVGSDKLYSGSTDGTVRIWDCHTGQCAKVINLGAEVTSLISEGSWIFVGLQNAVKAWNIQTMSEFTLDGPKGRVRAMTVGNNTLFAGAEDGVIFAWRGSSKADSPFELVASLTGHTKAVVCLAVGCKMLYSGSMDQSIK

SEQ ID NO: 165018 - protein, 204 aa, Glycine max
  Coding DNA Sequence Number=SeqID_48240
EEVRALKLELGKARLAKEKFKSAATHIRKECTGLQEENAATAKALEQETKRARKEEYGREKFRGALWGSNNELKLRREERDRSRVHGMILKEELVACARSKRSLAQHLEATEQSMLAIIGQYKEKLNQSMAHEQKLVEDFAQVYAKKEARGRVIDALHQEATMWMDRFALTLNGSQDLLRLLAKAKAMAEVCTAPEEIHGIIDY

SEQ ID NO: 165019 - protein, 420 aa, Glycine max
  Coding DNA Sequence Number=SeqID_48241
  Homolog annotation: Hit_ID=P0AAR5; Match level="QueryCoverage=29%, HitCoverage=100%, E-value=2e-27, Identity=49%"; Hit description =Inner membrane protein ybaN
NQRADHRQHQRRHQSAGTAGKHPPLQPAGSQANNNPDDKGHASPPVSAVSSIEESERLTAAPRSPVYAARRGSAPAAPAESPPRASAAAARSAFQLAPGAVRAAAAWPAIAFRSRGTHHASAAADRDAAVHAPRAVAGYCTRAAARQSGPAPSAPATGGATHHCRTPRAAPHCAAALADSQPVACLCSETAARQSAADGSYRPAAAQSAGAACQSLRADAVGRAVEASLRFRIWHAAHFTVKPWLAGDCAGHAGHCITFTTDHAIRVAGRLVFCPLVAALSSLAAVALAVWPLSASLAAASRHAARCQRPGHVADCHHLCGFNLAGEAAVAAHPARCDAGAIVAHAVAHPGCSRKCEPARTVASGLHLAGCLLRFGHLRAWLPFEKRLRLTRFPGIGAVGAARFRYFSRRNLYDRNCAAA

SEQ ID NO: 165020 - protein, 88 aa, Glycine max
  Coding DNA Sequence Number=SeqID_48242
MGHFAFLRSLYPEDPSSGKIPEDVTTENSRKNLLLEEVGGLPETLEYVPEGCVPEFFRKKGLPEDHLLSEEGRCLEKMNSRKLFPEEL

SEQ ID NO: 165021 - protein, 516 aa, Glycine max
  Coding DNA Sequence Number=SeqID_48243
  Gene Ontology: Mol. function=zinc ion binding; Cellular component =integral to membrane; Biological process=protein transport
  Homolog annotation: Hit_ID=P93231; Match level="QueryCoverage=93%, HitCoverage=55%, E-value=0.0, Identity=71%"; Hit description =Vacuolar protein sorting-associated protein 41 homolog
  Pfam annotation: Domain name=Clathrin; Domain location=231-378; Score= 37.5; E_value=4.7e-08; Accession=PF00637.10; Description=Region in Clathrin and VPS
MEECTNADCSDVIWVIIVVQDTEDHIAWLLQHGWHEKALAVVESGQGRSELLDEVGSRYLDHLIVERKYREAASLCPKLLRGSASAWERWVFHFAHLRQLPVLVPYMPTENPRLRDTAYEVALVALATNPSFHKDLLSTVKSWPSVIYSALPVISAIEPQLNTSSMTDSLKEALAELYVIDGQFEKAFLLYADLLKPEVFDFIDKHNLHDAIRGKVVQLMRLDCKRAVPLLIQNRDLISPPEVVNQLLNADDKSDCRYFLHLYLHSLFEVNPHAGKDFHDMQVELYADYDPKMLLPFLRSSQHYTLEKAYEICIKRDLLREQVFILGRMGNSKQALAVIINKLGDIEEAVEFVTMQHDDELWEELIKQCLHKPEMHTVGNLDPLYIVNKVPNGLEIPRLRDRLVKIITDYRTETSLRHGCNDIIKYYKEARHGISLGNEDEPRVKMSDTRASQNVSVIVFFCCHGYHTTCLMDSSYTSSNQKEVQATSLEAETYDGYNGYEEDASEDDEEAKSGGP

SEQ ID NO: 165022 - protein, 703 aa, Glycine max
  Coding DNA Sequence Number=SeqID_48244
  Gene Ontology: Mol. function=nucleic acid binding; Biological process= DNA integration
  Homolog annotation: Hit_ID=Q1S7C5; Match level="QueryCoverage=53%, HitCoverage=61%, E-value=2e-77, Identity=47%"; Hit description =Integrase, catalytic region
MVHKFIGCITSWLLRDKIHNHFHAHMHAKNLVDSLTAIGDPITIKEHNYASFLSYINNCSESPTIDEIQTVLGHEACIDKFRKKVVVSVNVASTSTVSSTSSSTAPQANFVQQTIISNNLLVRITSKLIKISIKILMVAVAVVLAMAVVGVALLVEEAVDVAIFRATSAKNLIMMLRTVGTSHHLPLVFHNPMCMPQPHPPAAFGAPPQFTSPYIFSPPMMTSSSAFGVSPEIMLTPMTQQMQPSTQFVQQSTQQPLQTFWGNSSQASMPQQMSSSNPMQQQMQPINPISSHNPQAMTIGSTAAQSSNWYPDSGASHHVTSNVENIQQCAPFEGPDQVIIGNGQVLSPSPSIEHPVQSLSPSPQPLPQNVHPMQTKSNDTTWLAAMQTEYDALIKNNTWSLDSNPIGCKWVFRKHSHQLSSLSLKLLLTLAVTNNWPIQQLDVNNAFLNGILEEEVYMQQPPGFVTSNKSLVCKLHKAIYGLKQAPRAWFDRLKEQLLKFDFKSSKLNNVLSLKDLGCLDYFLGIEVKAQTDGSLILTQGKYNRDLLAKVNMSEAKPISSPMVTGCKLTKASDPNDRRSTSGACVFFGPNLISWWSKKQSVVARSSTEAEYRNLALVTAEVSWLQSLLSELAVKHTMPVIHSDNMSTASLACNPVLHARTKHVELVLCRGKNAQQAAASEPSSQSVIPQLRLRITHHELAGEY

SEQ ID NO: 165023 - protein, 37 aa, Glycine max
  Coding DNA Sequence Number=SeqID_48245
MGLRSLLIKGDELGYFPASLMARMENWLQRIQVQPHS

SEQ ID NO: 165024 - protein, 236 aa, Glycine max
  Coding DNA Sequence Number=SeqID_48246
  Gene Ontology: Mol. function=chitin binding; Cellular component =extracellular region; Biological process=chitin metabolic process
  Homolog annotation: Hit_ID=UPI00006A17C9; Match level="QueryCoverage =89%, HitCoverage=100%, E-value=7e-33, Identity=34%"; Hit description= UPI00006A17C9 related cluster
RGLHVLTFRGLHALAIRGLRVLTFRGLHALAIRGLHVLTFVGLHALTFRGLHVLANRGLHALTLRGLHVLANVGLHALTFRGLHVLALRGLHVLTIRGLHALTSRGLHVLTLRGLHVLTIRGLHAITSRGLHVLALRGLLALALGLHALTFRGPHVLTFRGLHALAIRGLHVLTFRGLHALAIRGLHVLTFVGLHALTFRGLHVLANRVLHALHLERTTRSRQRRATRSSPFIGLH

SEQ ID NO: 165025 - protein, 1159 aa, Glycine max
  Coding DNA Sequence Number=SeqID_48247
  Homolog annotation: Hit_ID=Q336V4; Match level="QueryCoverage=95%, HitCoverage=78%, E-value=2e-76, Identity=50%"; Hit description =Expressed protein
AAARSRGLKFAMQPNLFPFGSVLGNPFIFNGDGDLSEGGGGIESSRVFFLLPFFLLSQGGAMDLSKVGEKILSSVRSARSLGLLPPVSDRPEITPYDWIVEMYCVFVVKLGRSSNCAAFNAFDASFGFDDVCTVAMRLPPRCDLVAILDIAGDAVAIVVMVSEKTLDFAVAIAVADIFLQPWGLLNNLFNLVAIGDIRLIQWLGKGEGRREGGEVAARAAAAAAVARALAGLPPHQRYSLSSSSEELSSIYGSIPQGQVVEELEDEFYEEDFDPIRHVLEHVPVEENELTYFEKQPAAGTAYLSNGCKPLNELMLASPGAAVKLCLGDLLVMGSNPETASLHMQGEEPLGNGAALRLAQLDRVAERLSRHVMEHHEVMVADTYFCPVKGMNLVRELEKDLRIANVICMNGRRHLTSSMNEVSRDLIVNSYSKKKQALLDMLPTLTELRRALDMQSTLESLVEEGNYWKAFQVLSEYLQLLDSLSELSAIQEMSRGVEVWLGRTLQKLDALLLGVCQEFKEDGYITVIDAYALIGDTAGLAEKIQSFFMQEVISETHSVLKAIVHEWGQPSLYELAFGIELGPNHSKMCIEKNSSSTSTRDSVKIEYTSEGQPSPYELAFGVELGPNQHSKTQQDSAAQTSNKCNEEISCSPGEPQEVDSDVRACNNSMSSSGDVIHGSSSREESATVSSLTETSGSPYSDSHDTIKEAGKEDSATSSIESPWYHLRKEATTFVSQTLQRGRRNLWHLTASRVSVLLSSATAYTASIHQFLKNYEDLSIFILTGEAFCGIEAVEFRQKLKSYNVDRDFLCSSFESGTCKMQCHFYPPMSARCLQDDDGALKMVLEKETWLKLPPDTVQMISFAGLIGDGAPLISLSSGKSTNVSAVHSTKSVNVVHTGARKNGFSHWIKSGNPFQQKLPTSNEGRGYSQPNGSVCGEFDGSSTNNFHDDKTPRKNDFNQMNGANSVSEDENEDLLADFIDEDSQLPSRSSQPHHSRTLSSHGNDEENTTQTGSSLCLLKSMDKYARLMQKLEVVNVEFFKVWDLCLTLEGWDFRWVYNVLALQLHVHSGLVLGVRTTAQPVHVGAGAPDEHGGMLGSNCKEWDLSFKLEVWESSVGFEERCVAVDTISLVARILNRSKAHLQSMLLQSNSTILEDFYVHL

SEQ ID NO: 165026 - protein, 130 aa, Glycine max
  Coding DNA Sequence Number=SeqID_48248
TARKHVDTDNHSGISARQRDSKVSMTDRVSAEDDIAKKNVYTDNHSGISARQRDSKVSMTDLVSAEDDIAKKNVYTDKQSGISARQRDSKVSMTDLVSAEDYTEKKNVYTDNHSGISARQRDSKVSMTDL

SEQ ID NO: 165027 - protein, 164 aa, Glycine max
  Coding DNA Sequence Number=SeqID_48249
  Gene Ontology: Mol. function=catalytic activity; Cellular component =intracellular; Biological process=superoxide metabolic process
  Homolog annotation: Hit_ID=Q9SLU9; Match level="QueryCoverage=93%, HitCoverage=19%, E-value=2e-66, Identity=76%"; Hit description=ZW18 protein
  Pfam annotation: Domain name=DUF676; Domain location=1-163; Score =147.8; E_value=2.9e-41; Accession=PF05057.5; Description=Protein of unknown function (DUF676)
MGHHLDLRLVRNQWLLIDPKVDFLMSEANEDKTFGDFREMGHRLAKEVIAFLKSKMDKASRYGSLGDIRLSFVGHSIGNLIIRTAIADSIMEPFLCHLYTYVSVSGPHLGYLYSSNSLFNSGLWFLKKLKGTQCIHQLTFTDDPDFQNTFLYKLCKVGIVSYNG

SEQ ID NO: 165028 - protein, 56 aa, Glycine max
  Coding DNA Sequence Number=SeqID_48250
MTKVNRCHKHNIDKQVKESQVPSSPQRIKEENDAAIGVWMILRKEPYMKKQGGKVP

SEQ ID NO: 165029 - protein, 551 aa, Glycine max
  Coding DNA Sequence Number=SeqID_48251
  Homolog annotation: Hit_ID=Q49L63; Match level="QueryCoverage=94%, HitCoverage=94%, E-value=1e-125, Identity=43%"; Hit description=GEX1
MDHQGRLLVFILLSFLLRGESWGWFSSSKETPSSDKTHTTNEGNFRGSSAEFSIESFNDHKGVKLIENAKKKMISSNSCWQNAYQHLFAGCSEILAVDEKRSRLAWHLSDCFQRDSGRTHAFKYETERLVTELKSSAQYVEDKLDSIEEKSEHLLQGSRQIHDSLDSIGSHTKQVAQTAKNLEGHIDSVLTHSKSVYEQTTKIALSQTQLKEGQENMKRNLEDGVGMLKDSYNYLGREIEKLRNEAIEIENEVIKVGDAMSSKMDNLQSKAEDIGNMAEISLDKQQILLDGQSAALEGLNSLTESQAKALEESRKTLQYFAEYGHRQHEELLQRQQQIQGFHDRLMENSKEILSSQESFESKQASMFVVLDRIFALQNTLLLESRMIKAFFVYSVLIFVIFMLTSTKQTYNIRPFLYIELCATLFVEVLIIRLTGDNIEHQTWIINMARLFFLVAALVQLLHAIFTYKNYETLNHQMLLTLINKVNSMQKEKELSWDLYTDYEDWSEWIDADLPDDVNCLDDPDYILPQEVAENSITVTKNYNLRNRNLFH

SEQ ID NO: 165030 - protein, 144 aa, Glycine max
  Coding DNA Sequence Number=SeqID_48252
  Gene Ontology: Mol. function=nucleic acid binding; Cellular component= intracellular; Biological process=chromatin modification
  Homolog annotation: Hit_ID=Q39263; Match level="QueryCoverage=97%, HitCoverage=68%, E-value=7e-28, Identity=43%"; Hit description=Zinc finger protein 4
  Pfam annotation: Domain name=zf-C2H2; Domain location=5-27; Score =19.3; E_value=0.014; Accession=PF00096.16; Description=Zinc finger, C2H2 type
NPRVFSCNYCKRKFFSSQALGGHQNAHKRERTIAKRAMRMGIFSERSLGIKAHSSLHHGFSPTMRPPEMKSSARFEQGYVGLPIFLEEDEAELLWQGSYHQVPSEGGHTHQNFTLSGSSNLSFVGSSLPPVDLENSTPELTLKL

SEQ ID NO: 165031 - protein, 65 aa, Glycine max
  Coding DNA Sequence Number=SeqID_48253
MDDGSQSFFYQPHLLHGAEPNDTGLRKDNAKNMGDDDIDMQPQSNNPDFSSYFMTDEVFSRAQIF

SEQ ID NO: 165032 - protein, 405 aa, Glycine max
  Coding DNA Sequence Number=SeqID_48254
  Gene Ontology: Mol. function=DNA binding; Biological process =regulation of transcription
  Homolog annotation: Hit_ID=Q1S588; Match level="QueryCoverage=99%, HitCoverage=84%, E-value=2e-98, Identity=53%"; Hit description=Myb -like DNA-binding domain, SHAQKYF class, putative
  Pfam annotation: Domain name=Myb_DNA-binding; Domain location=289 -340; Score=41.7; E_value=2.5e-09; Accession=PF00249.21; Description =Myb-like DNA-binding domain
  Subcellular localization annotation: CTP_CleavageSite=66; ConfidenceScore=5.44e-01
MPLEGIFIEPTSTSTPDLSLHISPPSTSFSSSSICNNNNTSGGGGGINYEARNSTSTNFPSQAHIELSLGRNFSVGGGRGGGVPEEPLPHHNNNINNNPYYQTQQAHFHHLQHHSNASRATTTTSTTTSSSNHMSHINYGVSLLDVSSEGLRPIKGIPVYHNRSFPFLPSEHSRDNKDHHAKMCLYHHMPTYPSLSSSCSPLCSSSSSSSSPAAPYFAAAAAAYRAATATRFNGISGEAFKSHHPLHHHHSSSPHYGVGLGPSHETSAGLMRSRFLPKLPAKRSMRAPRMRWTSTLHARFVHAVELLGGHERATPKSVLELMDVKDLTLAHVKSHLQMYRTVKTTDKPAASSGLSDGSGEDDMSPMGSSGGMRQFSDQRSLSDRPLQQDMDYSSGNNTLWSNSSR

SEQ ID NO: 165033 - protein, 242 aa, Glycine max
  Coding DNA Sequence Number=SeqID_48255
  Gene Ontology: Mol. function=RNA-directed DNA polymerase activity; Biological process=RNA-dependent DNA replication
  Pfam annotation: Domain name=RnaseH; Domain location=93-211; Score= -15.3; E_value=0.0016; Accession=PF00075.14; Description=RNase H
MIQNVALPLAHREDHNIVWCPSVSGTLSFKLTYDFMRPRQSPVVWSKLLWHPAIPPSRSFLFWRFLHDKVPTDDKLKKTGSYFLGSMLLVMQAKLLSLRGFIGTLLLWGWTKCNIDGVATGGGVTTTFCAELQATMEAIRIAKKRGWDHLWLECDSTLVVRACTSQDLDTWWHKSQWFNCCLATHSMSFNISHVFREGNQCADRLANFGVTSHGSTWCDTIPDFVRELFSRDISRSPNFRFG

SEQ ID NO: 165034 - protein, 83 aa, Glycine max
  Coding DNA Sequence Number=SeqID_48256
  Subcellular localization annotation: CTP_CleavageSite=44; ConfidenceScore=5.53e-01
MKHFTDTLISANIVTPLNFVSPPPLSTLLPSTPKTTFKKLSPVEMAARREKGLCYNCDIEFLQPGGSTSSRAAATAVELQFAL

SEQ ID NO: 165035 - protein, 201 aa, Glycine max
  Coding DNA Sequence Number=SeqID_48257
  Homolog annotation: Hit_ID=O21999; Match level="QueryCoverage=43%, HitCoverage=53%, E-value=1e-19, Identity=60%"; Hit description=LacZ -alpha
VPPVQLLTGWCVNGQKHRRDISAGKCSGPAARRVPFAIQAAQLLGRAIGAGLFAITPAGERGMCCKAIKLGNARVFPEFDITIVAQPLLSACCHFYRREFLEGGLWAGVFDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 165036 - protein, 238 aa, Glycine max
  Coding DNA Sequence Number=SeqID_48258
  Homolog annotation: Hit_ID=Q47522; Match level="QueryCoverage=18%, HitCoverage=56%, E-value=3e-14, Identity=84%"; Hit description=LacZ protein
DLPSQWLLFLSAVPPVQLLTGWCVTAKAPPDISAGKCSGRVPFAIQAAQLLGRAIGAGLFAITPAGERGMCCKAIKLGIRCSKVSSSYPWKRKVWKLTLPNPELEVGRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 165037 - protein, 67 aa, Glycine max
  Coding DNA Sequence Number=SeqID_48259
MAYLSVTWANSGGAMEARQSRRHSGFPYQVAKGSDTRLELEAFYLGIIFNFDKFDSFSKIHQKSILF

SEQ ID NO: 165038 - protein, 131 aa, Glycine max
  Coding DNA Sequence Number=SeqID_48260
MAITPDYHPYDYTRRYICHTRVHVVPIDRLDVVPIIVDQTLTYYIPFGFTFHIEVWYYEDSRLYFRLEEPHYDLEFLLTPIEYDEQDNVCGYNMELVHPGGGYRGLRRQLRHVVRGDQGVPNTSEAIGAYA

SEQ ID NO: 165039 - protein, 207 aa, Glycine max
  Coding DNA Sequence Number=SeqID_48261
  Gene Ontology: Mol. function=RNA-directed DNA polymerase activity; Cellular component=signal recognition particle, endoplasmic reticulum targeting; Biological process=RNA-dependent DNA replication
MEGGIGHILNITPKEAKMIEGLKRERRIHENPPVEYWNDLKSVLRKGHIPIYYERGLIDKLQRLRQGSMSVKEYRQQMELLFLRAGLREEERTSIARFLSGLNMEVKDKVELHPYRDLDELVQLCIRVDQQLKRKSSLKSYGFHCYPRKDQAQGILEVAPSKPKEDKGKTIEKSTPKTSSQARISNINSVFGWSNLAGEFIFSRNLK

SEQ ID NO: 165040 - protein, 106 aa, Glycine max
  Coding DNA Sequence Number=SeqID_48262
IIPFNKHIAAVGTTSNNMLSKRKTLDEGSLLSSKSETQHDHRFTSTPYVPMDPGPSSPRPAFGSLGPPNNFKAKGLARLGELTASGLSFGSPGRAATAPSWLFAYK

SEQ ID NO: 165041 - protein, 60 aa, Glycine max
  Coding DNA Sequence Number=SeqID_48263
MARSLNASYSLAKRETSPLSPFRCDLNWDELAKHAYRAKRGHLLEKNISLPDELPMAKRG

SEQ ID NO: 165042 - protein, 113 aa, Glycine max
  Coding DNA Sequence Number=SeqID_48264
  Subcellular localization annotation: CTP_CleavageSite=49; ConfidenceScore=5.69e-01
MGPIKLFFDSMFRSGMQKLPKGGGKKFFSLSFLDPSSPSLASGSPRRANCFMAKSQLAWVSCRGLSKGLQGSALKDIKRIERVEEQRRENEAEALLNHAVIEPYIVPCSVFFV

SEQ ID NO: 165043 - protein, 72 aa, Glycine max
  Coding DNA Sequence Number=SeqID_48265
  Subcellular localization annotation: CTP_CleavageSite=62; ConfidenceScore=5.42e-01
MRAQFGKPFLHPPSKALVPHCPSKAFPPRTLSLANPFSILLRKLQFIIVLQSCDPRNHPFCVTEALAGSSFT

SEQ ID NO: 165044 - protein, 37 aa, Glycine max
  Coding DNA Sequence Number=SeqID_48266
MGFLVDGSARVKAQPQDDSKATLAPKVSIVGAPVDQK

SEQ ID NO: 165045 - protein, 49 aa, Glycine max
  Coding DNA Sequence Number=SeqID_48267
MENWRTALRNNFAGLQTRCGEWRIGEQRYARTSRGSRLEGGGHMNSARQ

SEQ ID NO: 165046 - protein, 291 aa, Glycine max
  Coding DNA Sequence Number=SeqID_48268
  Homolog annotation: Hit_ID=Q1RZK3; Match level="QueryCoverage=31%, HitCoverage=6%, E-value=4e-34, Identity=71%"; Hit description=WD40 -like
MAPPRLDYRMVYIFVMQQRMGDCHELGMEDLTLLEEEMDKAAKVVHERKMEALIYSLHFFSLNSSKHDAWLKMILDDDGIAAPGEILRPYDIYINKQSPIDTRTPKIGPANLPDSAYRSNAQSFNDNGGEVVDRVVLCSDKDNNMCIKFLIRHTRMPEVKASFSLWFDNWQLMFFGVFYKIWNHEKAILLNSFDNHDFPDEGIPKLCLVNELDDSLLLDASSDGNIQIWKDYTLKGKQKLVTAFSLIHGHKPGMRSLNAVVDWQQQCGYLVCGCSLIIFGNVGYLPLPPMS

SEQ ID NO: 165047 - protein, 69 aa, Glycine max
  Coding DNA Sequence Number=SeqID_48269
MTEDIFVFEMYADYRIGCLRMLPDFSQVGVAKLSNETFSQSQSEDADISGKGTDDDVSHCMLSGFESYT

SEQ ID NO: 165048 - protein, 173 aa, Glycine max
  Coding DNA Sequence Number=SeqID_48270
  Gene Ontology: Mol. function=kinase activity
  Homolog annotation: Hit_ID=Q94CG5; Match level="QueryCoverage=66%, HitCoverage=11%, E-value=8e-11, Identity=33%"; Hit description =Kinase interacting protein 1
MMVTRWRTNTDELQKQIRTLENDKESLMKDINKLNEQLRKMEEKMHGVQDLNQIVEDHNNTLQTQFNEAHSNLDQLSEKVENDSSSQAELKSKSEGQVPLNEDNMLLNDIKSEKELTNGLVEDDAKDKELKIAGTVEDDVTSDNKLEATGSPFANEPNVTRSLENDAKSVDKT

SEQ ID NO: 165049 - protein, 214 aa, Glycine max
  Coding DNA Sequence Number=SeqID_48271
MEKVTDADAPVPIPTDECSLVGQAFHTFLARPTHLVKSLSQQAVVSPAKPPQKPDLEVDDPHYLMTLTIPELFLRPYQVTCDAIVFGVFNSDFPLYIKHEDLFEIAHGGQCLSISMLQLWILGHWQVVVIVPKEHLVVWFCSLHNRPANYLKGIINSALKGLDDAPQPKSKAPAWWIVVKYFNDPRPLEPERLKALQMQWAQYYLRVRDQTPRI

SEQ ID NO: 165050 - protein, 56 aa, Glycine max
  Coding DNA Sequence Number=SeqID_48272
MRKMQGSCMSAVKKVIWTFRLPMTKDETNIQHVHDDMMQTRKSTTRGCTQYGNIRK

SEQ ID NO: 165051 - protein, 45 aa, Glycine max
  Coding DNA Sequence Number=SeqID_48273
MPGRIGQIELKDRWDISEDEEEERRRPGISITGRKGWDIWFSSRS

SEQ ID NO: 165052 - protein, 110 aa, Glycine max
  Coding DNA Sequence Number=SeqID_48274
  Gene Ontology: Mol. function=cytokine activity; Cellular component =chloroplast; Biological process=carbohydrate metabolic process
  Homolog annotation: Hit_ID=Q58IU5; Match level="QueryCoverage=63%, HitCoverage=13%, E-value=6e-30, Identity=91%"; Hit description=Non -intrinsic ABC protein
MTNANYPQESLHSVSNGNLRMCVVVMLVKIEGKLVISVVKNPTARIEHEASTSKIGEDQLFYFQQRGIDYEKAMGAMISRFCCDVFNELPYEFGSEVNQLMSLKLEGSVG

SEQ ID NO: 165053 - protein, 176 aa, Glycine max
  Coding DNA Sequence Number=SeqID_48275
MSVHVAQLITDAIYLFAGMPPTRHPLDPDKSNRALGFPALITGLCQSFGVPVTPSKVIQLMITRAFIEKYCTPRQVQGDAPLAADAPPPPHQADPARSLGMERYLQHLVRQQAANHRGQGFAPFACPIPEQFRAEVAWPKAQVGEAPAGSPGDAEEARMDEEMTDLLGFLGGSRAT

SEQ ID NO: 165054 - protein, 81 aa, Glycine max
  Coding DNA Sequence Number=SeqID_48276
MGLRIRFDGGGCTKSAMQSIRGAPDSKVEDAINSWGSELNAGGSMNDNQLKGLRKRFDGGGCTNSAMLSIRGASDSTVEDA

SEQ ID NO: 165055 - protein, 176 aa, Glycine max
  Coding DNA Sequence Number=SeqID_48277
  Homolog annotation: Hit_ID=Q8GSM7; Match level="QueryCoverage=38%, HitCoverage=15%, E-value=3e-22, Identity=72%"; Hit description =Hydroxycinnamoyl transferase
MKEALSKALVPFYPMAARLCRDDDRLMEIYCDAQGMLFVEAKTTAAIEDFGDFSPTLELRQLIPSVDYFTRTRFFPSFTLFYSSVDLPHRHMTSSGNWILIVGTYLHNRYYDKGDDKNLKGQSKNEFKIFKIESRTLQDSRGKLISRIKIQEIKISRIKIQEIKIQDSRFKNQEKA

SEQ ID NO: 165056 - protein, 57 aa, Glycine max
  Coding DNA Sequence Number=SeqID_48278
MKTAYEQGRLVLLQNLDPSLSSSEVQNARNETMKAMSEARCNPFKEFSDLRTRIETI

SEQ ID NO: 165057 - protein, 207 aa, Glycine max
  Coding DNA Sequence Number=SeqID_48279
  Homolog annotation: Hit_ID=O64885; Match level="QueryCoverage=30%, HitCoverage=19%, E-value=3e-14, Identity=60%"; Hit description =Protein BCCIP homolog
  Subcellular localization annotation: CTP_CleavageSite=50; ConfidenceScore=5.57e-01
MRVAPAWACQPLTQEATAFSPFARALTRITSLSSMPTQRHSSNPTPTLFSAMKLDYARPPLSIIICFYFTFELTNILLVQGSCPRRFIRRGFRHETSYPIPNPNDFPGAKTLLQTFLDGQERDLTAFVDLILAQTTVAFIVKIEDDDDEGLFALVTALNLYRYKTVATCPSRASKGEALGCAFQRRKDARSRHQRLFVGNVGKTEGN

SEQ ID NO: 165058 - protein, 119 aa, Glycine max
  Coding DNA Sequence Number=SeqID_48280
  Homolog annotation: Hit_ID=Q1RV51; Match level="QueryCoverage=69%, HitCoverage=19%, E-value=6e-26, Identity=69%"; Hit description=HCNGP- like
MWWAWVMLAVNRWEIPEKYLMEYVISSDLQDRTPLGIVQVLTPSNQANTPQFFEPLKFDTMNKDAIIRSDDAEFGEADQDEQKYVDPLDKFLPPPSKAKCSEELQDVGCFQLLAFYLMV

SEQ ID NO: 165059 - protein, 202 aa, Glycine max
  Coding DNA Sequence Number=SeqID_48281
  Gene Ontology: Mol. function=porphobilinogen synthase activity; Cellular component=chloroplast; Biological process=tetrapyrrole biosynthetic process
  Homolog annotation: Hit_ID=P43210; Match level="QueryCoverage=43%, HitCoverage=22%, E-value=4e-26, Identity=69%"; Hit description=Delta- aminolevulinic acid dehydratase, chloroplast precursor
  Pfam annotation: Domain name=ALAD; Domain location=2-139; Score= -175.8; E_value=1.2e-05; Accession=PF00490.11; Description=Delta -aminolevulinic acid dehydratase
MGSTWCLNSQMKKLMLHCSYQKAQAGADVVSPSDMMDGRVGALRAALDVEGFQHVSIMSYTTIFTLLIVGLLINLAWLNKSYQMNPANYKEALTEMREDEFEGVDILLIPVQGLHVPTPSSGQKMHLQLFHTSLVLKSILNIPRYDFPVRRHNQCMYTTHKQHQGISWYHEADMRTGQEEQLIGNLQAFKHFGLAYRLVAGL

SEQ ID NO: 165060 - protein, 222 aa, Glycine max
  Coding DNA Sequence Number=SeqID_48282
  Subcellular localization annotation: CTP_CleavageSite=26; ConfidenceScore=5.32e-01
MNISRPYSAMLVQVSQPHHIFDPPCSSSVSWGNKFSGRATTCKTNHLTDSYIVNFGMGFSLPKILKTFDLKESMALDAEPSLLERVVDSVDECSVRRALLSSVNLLQLLHCLGVVLAAECGECALTFELDYEVIETLRLECGQFDLPRVVNGNIARGVGVRRGGNTVGGGGREGLFRKVVRNKRRRIVIVGAAAAKDGVEIITEVGDAGGQGKRKRKRLNGL

SEQ ID NO: 165061 - protein, 135 aa, Glycine max
  Coding DNA Sequence Number=SeqID_48283
  Gene Ontology: Mol. function=diacylglycerol kinase activity; Biological process=protein kinase C activation
  Homolog annotation: Hit_ID=Q9LHZ4; Match level="QueryCoverage=72%, HitCoverage=39%, E-value=4e-18, Identity=40%"; Hit description =Pentatricopeptide (PPR) repeat-containing protein-like
  Pfam annotation: Domain name=PPR; Domain location=90-124; Score=20.0; E_value=0.0086; Accession=PF01535.11; Description=PPR repeat
MPKPNAATITPPTVVTAISALLLFEALAWQASNKDFSVNHQAKWIHGLAITTCMNKNVFVSIAVVDMYAKCGAMKTARKLFNMMQEQHAITWNAMLDRYGTHDLGKEALDHFNEKQKEAVNPKEFMLFLGLLEMR

SEQ ID NO: 165062 - protein, 370 aa, Glycine max
  Coding DNA Sequence Number=SeqID_48284
  Gene Ontology: Mol. function=protein serine/threonine kinase activity; Cellular component=integral to membrane; Biological process=protein amino acid phosphorylation
  Homolog annotation: Hit_ID=Q9M0G7; Match level="QueryCoverage=83%, HitCoverage=46%, E-value=2e-43, Identity=34%"; Hit description =Receptor protein kinase-like protein
  Pfam annotation: Domain name=LRR_1; Domain location=120-142; Score =2.8; E_value=86; Accession=PF00560.23; Description=Leucine Rich Repeat
  Pfam annotation: Domain name=LRR_1; Domain location=144-166; Score =5.1; E_value=31; Accession=PF00560.23; Description=Leucine Rich Repeat
  Pfam annotation: Domain name=LRR_1; Domain location=192-214; Score =15.6; E_value=0.18; Accession=PF00560.23; Description=Leucine Rich Repeat
  Pfam annotation: Domain name=LRR_1; Domain location=248-270; Score =10.3; E_value=3.4; Accession=PF00560.23; Description=Leucine Rich Repeat
  Pfam annotation: Domain name=LRR_1; Domain location=272-295; Score =7.0; E_value=14; Accession=PF00560.23; Description=Leucine Rich Repeat
  Pfam annotation: Domain name=LRR_1; Domain location=48-70; Score =19.5; E_value=0.012; Accession=PF00560.23; Description=Leucine Rich Repeat
  Pfam annotation: Domain name=LRR_1; Domain location=72-94; Score =13.9; E_value=0.58; Accession=PF00560.23; Description=Leucine Rich Repeat
  Pfam annotation: Domain name=LRR_1; Domain location=96-118; Score =16.0; E_value=0.14; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=120-142::144-166::192- 214::248-270::272-295::48-70::72-94::96-118
  Subcellular localization annotation: CTP_CleavageSite=36; ConfidenceScore=5.23e-01
MAHEKKSETKWKKSMTKNSYLVKHRAMFKLSGSRISSSISAELGNFTSLQTLDLSSNSLSGFIPSELGQLQNLRILQLYSNDLSGNIPSKIGDLRKLQVLRIGDNMLTGEIPPSVANMSELKVLALGYYHLNGSIPFGIGKLKHLISLDVQMNNINGHIPEEIEGYEELQNFATSNNMLDGDLPSSMGSLKSLKILDLANNSLSGSIPTALSSIPSNFCLRGSKRQQLFLARNMLFGKFPLELLNFSSIQQLDFSDSSFEGKLPSILDKLQNLTDLVLNNNSFVGQPRNIGIARLTGASSKGGKCAESPPTFTCGKRRKNRRKPVMKNIPDSGVVFTFEEGISTSHVDKSGALAPTYPPSKRKSDLCSSF

SEQ ID NO: 165063 - protein, 61 aa, Glycine max
  Coding DNA Sequence Number=SeqID_48285
FSGKCDELAKQACCAKRVHQYSLCIKAFSEELAKRTHHAKRVHPVRMNTHPLTGLPVAKRG

SEQ ID NO: 165064 - protein, 135 aa, Glycine max
  Coding DNA Sequence Number=SeqID_48286
  Subcellular localization annotation: CTP_CleavageSite=65; ConfidenceScore=5.42e-01
SLLNNKEKNKMKDWKNTSGEDFSFTSRISQSLTNSFQALKSAPASSPARLSRLADELKQSVALSRCSLSQQIGLARSGHWQMVVILPKENLVVWFCSLHNRPDNYLKGIINSALKGLDDTPQPKSKAGARWIVVK

SEQ ID NO: 165065 - protein, 157 aa, Glycine max
  Coding DNA Sequence Number=SeqID_48287
MTQELVARGDTLRLSAPRHSVTPSVIDEQRPIWSSAPFPEMSAFSDGDFSSLTNYPELRRGGGPDDKQRPSLVILHPCIIQRRAGPMIRGDTLRLSAPFCHPEAAGPMTSRDQVWSFCTLVSSRGGGPDDTRKYPSGYPYKHSFAICKKERLIACRG

SEQ ID NO: 165066 - protein, 43 aa, Glycine max
  Coding DNA Sequence Number=SeqID_48288
  Homolog annotation: Hit_ID=Q9ZVD5; Match level="QueryCoverage=86%, HitCoverage=4%, E-value=2e-10, Identity=68%"; Hit description =Argonaute (AGO1)-like protein
MCVPRNGRWNFNNKKIVKPTKIERWVAVNYSARCHNERTIDAI

SEQ ID NO: 165067 - protein, 432 aa, Glycine max
  Coding DNA Sequence Number=SeqID_48289
  Gene Ontology: Mol. function=protein dimerization activity; Cellular component=nucleus; Biological process=regulation of transcription, DNA-dependent
  Homolog annotation: Hit_ID=Q1SYN6; Match level="QueryCoverage=80%, HitCoverage=47%, E-value=4e-48, Identity=31%"; Hit description=Zinc finger, BED-type predicted
  Pfam annotation: Domain name=hATC; Domain location=342-427; Score =98.5; E_value=1.9e-26; Accession=PF05699.5; Description=hAT family dimerisation domain
MVHELPFSIIEDEVWMWAFQYANSEFKKISQKIVRSDCLALHEAEKKQLKTLLKTISNISLTTDMWKSSHQVVEYMVITDGLDKIKDVIQNVRESVKYINHNDSRLKAFCDVAEQKHLKERKLIIDCPTRWNSAFQMLSTTLKFKTAFSTYSERDPHYTYAPLHEDWEKVQKVCTLLEVFNVATHVISGNEYPIANLCLAEVWRVKQVIDNALEDTTFFMREMAGSMRVKFDKYWGECNMLMSIASVLDPRCKFHVVNICFPLIYKSKEIAMENIEKVRNSLQQLYDEHVTLSINESSLNEMNDIGINSSTTSASKSSIVIGFDQIMNIVRANEATPPVNSELEDYLKENVYIPETSNSYFSVLEWWRNNSLKYKVLSKMAGDILAIPISTVVSESTFSAKGRVIDEYCSKLNEESIEALICRGIDFAIIII

SEQ ID NO: 165068 - protein, 100 aa, Glycine max
  Coding DNA Sequence Number=SeqID_48290
MTLQLTNFSADPSSPHLNFQSSAWHHNSRRPAWRSDEINGEGEEFDKIEIMKQKCGTRNCFPKWKIRWSEARGPLLEFGGSVFELLRVRRVQHIYLLLVL

SEQ ID NO: 165069 - protein, 54 aa, Glycine max
  Coding DNA Sequence Number=SeqID_48291
MVGVKCQNPLKRNLKLHRERWKAEVPVTVNGEIAATFLKVLGIICYLPSIFSDP

SEQ ID NO: 165070 - protein, 111 aa, Glycine max
  Coding DNA Sequence Number=SeqID_48292
  Gene Ontology: Mol. function=RNA-directed DNA polymerase activity; Biological process=RNA-dependent DNA replication
MRNMISTFFGVTNQIERGRYLGLPSIIGRSKKAVFGYLKGKIWSRINHSARKHYSKASKEVLVKSCAQEIHSYCMSVYLLPTSLEDEMQKMMNSFYWRSKHGSSRGINWLN

SEQ ID NO: 165071 - protein, 55 aa, Glycine max
  Coding DNA Sequence Number=SeqID_48293
MDFLVVHAKYDANSRGEPEIAYMLTAKKHMPRVLQIGLTILREIEDDGEVVDSSM

SEQ ID NO: 165072 - protein, 171 aa, Glycine max
  Coding DNA Sequence Number=SeqID_48294
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=90%, HitCoverage=48%, E-value=1e-24, Identity=37%"; Hit description =Similarity to MADS-box DNA-binding protein
  Pfam annotation: Domain name=SRF-TF; Domain location=9-60; Score =41.0; E_value=4.2e-09; Accession=PF00319.9; Description=SRF-type transcription factor (DNA-binding and dimerisation domain)
MARKKVDFTYISNPRKRKAALKKRKNGLLKKIDEITTLCGIQACAIIYTPDEPEPEVWPSNQGVESVIFNFRGVSESARNKRMFCQESLLMKNITLAQGQLKKLRDENRKKEIGLFLCQYFAGGNNLGKCNIIDLNDITFLADKKLEEITKKIEMLLVQEVTPATENEDKP

SEQ ID NO: 165073 - protein, 171 aa, Glycine max
  Coding DNA Sequence Number=SeqID_48295
MIMRSQDICSSQDEATTSPSSSESEEAKGEEYSEEIYPQEEGQPLMFKEECKEVSVSSKSLAKKERHFEIKTNIKEISPLRQPPHFLLCKKTLVSIATPLGLEFIPQVKELLDEGLLPKSLNPCALLVPVATYPSAGGRHGARGCVFQDRNMRRVATNVYFRKTSEKPEKT

SEQ ID NO: 165074 - protein, 139 aa, Glycine max
  Coding DNA Sequence Number=SeqID_48296
MKANMEAMKDQMAALMEAMLSMKKIMEVNAAAVAATSATTMVNPTHPSGINQISRPVPDVVGQGGEALGSTGGPHVVQSKNSFPPYSLPPNYAPPNVAHAPDKNVNNSTPILIESQQPQSQPMGEKHEAPHHNLADFEP

SEQ ID NO: 165075 - protein, 73 aa, Glycine max
  Coding DNA Sequence Number=SeqID_48297
MKNLEMGGGLRARRRGPGWRAVSGGCHDGGLFHAIPNSERVEHAWSESIWPVGLYGLGKKGSFLFGLHFISLA

SEQ ID NO: 165076 - protein, 80 aa, Glycine max
  Coding DNA Sequence Number=SeqID_48298
MTYYKSTKNGRGKRITSSGSACSLPNQAVVAEENECRPMVSLCNCNTWVQIVGEGLFEDVARGAWELKAITAKGWESDKD

SEQ ID NO: 165077 - protein, 58 aa, Glycine max
  Coding DNA Sequence Number=SeqID_48299
MDTSEPYTRAMRGTVHEPQANLGTDQEFLPGVESNPKGTSNALEVLTQYNPQTLFEPL

SEQ ID NO: 165078 - protein, 95 aa, Glycine max
  Coding DNA Sequence Number=SeqID_48300
MKTLGGVDDIYYAALINKDDILQKRQKKLAKAIANKDKALETFGLAMKVKRILREQKGKVQTKKPAHQQKEEEKIVIEEQRMKKKHEVPRPSLPV

SEQ ID NO: 165079 - protein, 119 aa, Glycine max
  Coding DNA Sequence Number=SeqID_48301
MAASDHAILHDRSHIPTKRSLLELSSQDALLAHNKLLSKQLEALTKTLTKLPTQLHAGQPLPSFVLRVAGCVICGGAHDSGCCIPTKDIAHEVNYMGNQPRPNFNAGGYSGFQHGQQYN

SEQ ID NO: 165080 - protein, 221 aa, Glycine max
  Coding DNA Sequence Number=SeqID_48302
  Gene Ontology: Mol. function=DNA binding; Biological process =transposition, DNA-mediated
  Homolog annotation: Hit_ID=Q10CY9; Match level="QueryCoverage=58%, HitCoverage=17%, E-value=5e-12, Identity=29%"; Hit description =Expressed protein
MESSNVKNKSSGKRKMSSEDTRSYFAWNLEMERVLADVLRDQRNLGNKGGGNWKAVAYSTAAQILSKRFGVHLMADNVKNRFKLWRTWYGIVSVILSQSGFDWDSIKYMITVENEIAWSEYVKSHEEAKQFRFKVIPNWDDIVDLCAKDRAIGLGAENALDADDIMSKETNEEEAIHSVSFDLEGSSSATRKNIRPSKSGEKEGMIFSMKEVAESLKEFVE

SEQ ID NO: 165081 - protein, 107 aa, Glycine max
  Coding DNA Sequence Number=SeqID_48303
  Pfam annotation: Domain name=zf-CCHC; Domain location=38-55; Score =22.2; E_value=0.00022; Accession=PF00098.13; Description=Zinc knuckle
MMISDSVKRFNKFLRNKENQRRLNFNPKNKGEDSSLVPKCYECDQPEHLRFDCPVFKRRMKKSDKKSFKDKKDKKTYITWEDNYMDSLSDSENEIINLGLMAKDYET

SEQ ID NO: 165082 - protein, 80 aa, Glycine max
  Coding DNA Sequence Number=SeqID_48304
MATIQHLVMENKKIRPIICKTKPNLNKIFKEDTNAIELLTKPICRLSEPSTENTTLVAEREEESGRRMRWTHALSKHSSF

SEQ ID NO: 165083 - protein, 87 aa, Glycine max
  Coding DNA Sequence Number=SeqID_48305
MVAWPRTQPSLHKEDEGPTTQRSLEATSEPSAPVVTLPSRQPAADSSTPLLQMPEDPTTPVLAVDTSPPTTLVLQLTDEEDGQTQDT

SEQ ID NO: 165084 - protein, 1019 aa, Glycine max
  Coding DNA Sequence Number=SeqID_48306
  Gene Ontology: Mol. function=protein serine/threonine kinase activity; Cellular component=integral to membrane; Biological process=protein amino acid phosphorylation
  Homolog annotation: Hit_ID=Q9FN37; Match level="QueryCoverage=96%, HitCoverage=98%, E-value=0.0, Identity=57%"; Hit description =Putative receptor protein kinase
  Pfam annotation: Domain name=LRRNT_2; Domain location=38-76; Score =28.6; E_value=2.1e-05; Accession=PF08263.3; Description=Leucine rich repeat N-terminal domain
  Pfam annotation: Domain name=LRR_1; Domain location=113-135; Score =12.9; E_value=1.1; Accession=PF00560.23; Description=Leucine Rich Repeat
  Pfam annotation: Domain name=LRR_1; Domain location=137-159; Score =11.0; E_value=2.5; Accession=PF00560.23; Description=Leucine Rich Repeat
  Pfam annotation: Domain name=LRR_1; Domain location=161-182; Score =10.9; E_value=2.6; Accession=PF00560.23; Description=Leucine Rich Repeat
  Pfam annotation: Domain name=LRR_1; Domain location=184-207; Score =5.8; E_value=23; Accession=PF00560.23; Description=Leucine Rich Repeat
  Pfam annotation: Domain name=LRR_1; Domain location=209-230; Score =6.1; E_value=20; Accession=PF00560.23; Description=Leucine Rich Repeat
  Pfam annotation: Domain name=LRR_1; Domain location=233-255; Score =11.5; E_value=2; Accession=PF00560.23; Description=Leucine Rich Repeat
  Pfam annotation: Domain name=LRR_1; Domain location=257-279; Score =8.4; E_value=7.5; Accession=PF00560.23; Description=Leucine Rich Repeat
  Pfam annotation: Domain name=LRR_1; Domain location=281-303; Score =16.6; E_value=0.087; Accession=PF00560.23; Description=Leucine Rich Repeat
  Pfam annotation: Domain name=LRR_1; Domain location=305-327; Score =7.8; E_value=9.9; Accession=PF00560.23; Description=Leucine Rich Repeat
  Pfam annotation: Domain name=LRR_1; Domain location=329-351; Score =17.7; E_value=0.041; Accession=PF00560.23; Description=Leucine Rich Repeat
  Pfam annotation: Domain name=LRR_1; Domain location=353-376; Score =13.4; E_value=0.85; Accession=PF00560.23; Description=Leucine Rich Repeat
  Pfam annotation: Domain name=LRR_1; Domain location=413-435; Score =6.0; E_value=21; Accession=PF00560.23; Description=Leucine Rich Repeat
  Pfam annotation: Domain name=LRR_1; Domain location=437-459; Score =14.2; E_value=0.47; Accession=PF00560.23; Description=Leucine Rich Repeat
  Pfam annotation: Domain name=LRR_1; Domain location=461-483; Score =16.1; E_value=0.13; Accession=PF00560.23; Description=Leucine Rich Repeat
  Pfam annotation: Domain name=LRR_1; Domain location=547-569; Score =13.6; E_value=0.74; Accession=PF00560.23; Description=Leucine Rich Repeat
  Pfam annotation: Domain name=LRR_1; Domain location=571-593; Score =23.4; E_value=0.00082; Accession=PF00560.23; Description=Leucine Rich Repeat
  Pfam annotation: Domain name=LRR_1; Domain location=595-617; Score =1.4; E_value=1.5e+02; Accession=PF00560.23; Description=Leucine Rich Repeat
  Pfam annotation: Domain name=LRR_1; Domain location=89-111; Score =2.7; E_value=88; Accession=PF00560.23; Description=Leucine Rich Repeat
  Pfam annotation: Domain name=Pkinase; Domain location=738-1009; Score= 156.8; E_value=5.5e-44; Accession=PF00069.15; Description=Protein kinase domain
  Pfam annotation: Domain name=Pkinase_Tyr; Domain location=738-1009; Score=107.8; E_value=3.2e-29; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::Pkinase::Pkinase_Tyr; Domain location=...
  Pfam module annotation: Domain location=38-76::113-135::137-159::161 -182::184-207::209-230::233-255::257-279::281-303::305-327::329 -351::353-376::413-435::437-459::461-483::547-569::571-593::595 -617::89-111::738-1009::738-1009
MVLLRCFSVTLLQWCFLACLLCLSLGLNNNNNQALSCDPHDLSALKEFAGNLTSGSIITAWSNDTVCCNWLGVVCANVTGAAGGTVASRVTKLILPEMGLNGTISPSLAQLDQLNLLNLSFNHLKGVLPVEFSKLKLLKYLDVSHNMLSGPAAGALSGLQSIEVLNISSNLLTGALFPFGEFPHLLALNVSNNSFTGRFSSQICRAPKDLHTLDLSVNHFDGGLEGLDNCATSLQRLHLDSNAFAGSLPDSLYSMSALEELTVCANNLSGQLTKHLSKLSNLKTLVVSGNRFSGEFPNVFGNLLQLEELQAHANSFSGPLPSTLALCSKLRVLDLRNNSLSGPIGLNFTGLSNLQTLDLATNHFIGPLPTSLIENLSGAVSVLQQCKNLTTLILSKNFHGEEISESVTVGFESLMILALGNCGLKGHIPSWLFNCRKLAVLDLSWNHLNGSVPSWIGQMDSLFYLDFSNNSLTGEIPIGLTELKGLMCANCNRENLAAFAFIPLFVKRNTSVSGLQYNQASSFPPSILLSNNILSGNIWPEIGQLKALHALDLSRNNITGTIPSTISEMENLESLDLSYNDLSGEIPPSFNNLTFLSKFSVAHNHLDGPIPTGGQFLSFPSSSFEGNQGLCREIDSPCKIVNNTSPNNSSGSSKKRGRSNVLGITISIGIGLALLLAIILLRLSKRNDDKSMDNFDEELNSRPHRSSEALVSSKLVLFQNSDCKDLTVADLLKSTNNFNQANIIGCGGFGLVYKAYLPNGTKAAIKRLSGDCGQMEREFQAEVEALSRAQHKNLVSLKGYCRHGNERLLIYSYLENGSLDYWLHECVDESSALKWDSRLKIAQGAARGLAYLHKGCEPFIVHRDVKSSNILLDDKFEAHLADFGLSRLLQPYDTHVTTDLVGTLGYIPPEYSQTLTATFRGDVYSFGVVLLELLTGRRPVEVIKGKNCRNLMSWVYQMKSENKEQEIFDPAIWHKDHEKQLLEVLAIACKCLNQDPRQRPSIEVVVSWLDSVRFAGSQQ

SEQ ID NO: 165085 - protein, 75 aa, Glycine max
  Coding DNA Sequence Number=SeqID_48307
MDSHSCNCKSRPNLSKVVDSQIRSLVGQANGHLQATVERKRKTSDVIFFINILRNCGRKDMVGHYETKEKDYELV

SEQ ID NO: 165086 - protein, 146 aa, Glycine max
  Coding DNA Sequence Number=SeqID_48308
  Subcellular localization annotation: CTP_CleavageSite=70; ConfidenceScore=5.04e-01
MPSSSLRVMSLLSLTINLLLPSEEGNSSTPVKVPKVISDFGRLTFGSSSQTSLEAYFESQKPTFFIFLVEAGHEKAKVEREKFNVGHESVDVALVKLKQRDKKPNEGDFVSFGLESYLGHCEGLGSSHLFSMAFLPTLIILCIIFS

SEQ ID NO: 165087 - protein, 69 aa, Glycine max
  Coding DNA Sequence Number=SeqID_48309
MNGSSFLGDPIVPSFEGKDGNSHPRSRLKTACNLGTADARDHIFLNGSASSKEVRKFIIPQLRLSLSEE

SEQ ID NO: 165088 - protein, 128 aa, Glycine max
  Coding DNA Sequence Number=SeqID_48310
  Subcellular localization annotation: CTP_CleavageSite=43; ConfidenceScore=5.55e-01
MAYRKISRSFCLFLSSPSLLLFFSKFFPELAFSFSASSSSFLKVSHIAEDSEAVMQRAINGHRLFFLSWFTTMLSKLSRIVMAKAKKANASSVLSQAMKKGKELGFDIVLCDTSSVYILYLFLYPPPV

SEQ ID NO: 165089 - protein, 79 aa, Glycine max
  Coding DNA Sequence Number=SeqID_48311
MKRRFGSGRLLNGLYRLKGTIAQHSQHPPKTIDHVGDLVIYLYDGLSKNLVRVCKKLKGMEIKGAKFGEVQEVVIIARL

SEQ ID NO: 165090 - protein, 311 aa, Glycine max
  Coding DNA Sequence Number=SeqID_48312
  Homolog annotation: Hit_ID=Q9FN40; Match level="QueryCoverage=100%, HitCoverage=56%, E-value=2e-98, Identity=56%"; Hit description =Arabidopsis thaliana genomic DNA, chromosome 5, TAC clone:K19P17
MTSSRERLVKAVKQFVEVRYKVFSNRYGQNIIDILDFPIKVVLSPFTLAFDIAGSAPRGFGVPELISKLSATSVFEMEIKGHFLDAASFAYLDSENVFVFVIKMSFFFFTIPPSIAVKLFMLSALEFEYWAIAALGTYDIAFELGRKVICQRNCNSCNGWRALRCTMCRGSGRVHYQVKNCNLKSGEKATAESVADAIANNRAELVHIPSSLDFQKPLPSKECPTCDGTGVMSCPECKHRLLHVRISADDIMEPPWQAYNVLKKIDYPYEHILHSMKDPSIAAFWLITFPQIMGGFTYDDDVKQKIWWQYK

SEQ ID NO: 165091 - protein, 67 aa, Glycine max
  Coding DNA Sequence Number=SeqID_48313
MMRLPRPVPTLSVKVGGGNTGEDEGNGGNNNERELIVLIKWEKIVKFSFTAKIILKVLNEEDEMGTF

SEQ ID NO: 165092 - protein, 563 aa, Glycine max
  Coding DNA Sequence Number=SeqID_48314
  Gene Ontology: Mol. function=phosphoglycolate phosphatase activity; Biological process=methionine biosynthetic process
  Homolog annotation: Hit_ID=Q9FN41; Match level="QueryCoverage=96%, HitCoverage=97%, E-value=0.0, Identity=64%"; Hit description =Similarity to enolase-phosphatase
  Pfam annotation: Domain name=Aldolase_II; Domain location=30-247; Score=197.2; E_value=3.9e-56; Accession=PF00596.11; Description =Class II Aldolase and Adducin N-terminal domain
  Pfam annotation: Domain name=Hydrolase; Domain location=280-543; Score=19.1; E_value=0.0013; Accession=PF00702.16; Description =haloacid dehalogenase-like hydrolase
  Pfam module annotation: Pfam domain module=Aldolase_II::Hydrolase; Domain location=30-247::280-543
MAAIGLNGVKVGTTSSQAYLEGKAVKETRALMAELCRHFYTLGWVTGTGGSISMKVHDDSIPKPQQLILMAPSGVQKERMEPEDMYVLSHSGSVLSAPSPKPWPHKPPKCSDCDPLFKKAYEMRDAAAVFHSHGIESCLVTMINPLSKEFRITHMEMIKGIKGHGYYDELVVPIIENTAYEYQLTESFAKAIEDYPKATAVLVRNHGVFVWGDSWISAKTQSECYHYLFDAALKLHQMGLDWSTPNHGPIQSARRGLSIAGESNVSVKARKSNGDSDPFPRCVVLDIEGTTTPISFVSEVLFPYARDNVGRHLSLTYDTPETKADIKLLCSQVQSDLEQGIAGAVPIPPDDAGKEEVVAALVANVNAMIKADRKITALKELQGHIWRTGYENNELEGIVFDDVPEALEKWHTLGIKSYQGIGTENWPKELASQLSPPRHHLSKESLLDCIAQIFLLRVYIYSSGSRLAQRLIFGKTNHGDLRKYLSGFFDTTVGNKRETRSYVEISESLGVDKPSDILFVTDVYQEATAAKAAGLEVIISIRPGNGPLPDNHGFKTIKSFSEI

SEQ ID NO: 165093 - protein, 104 aa, Glycine max
  Coding DNA Sequence Number=SeqID_48315
MTETSMQARNVDVYGFLEPQSIQKSGQSQFESEDYIKKWMQNSQRDVYLGAYLNGAHWQMIVILPKDNVLSWFCSLHNSPNNYPLYFCFEGTQRQTSKSKAAAR

SEQ ID NO: 165094 - protein, 376 aa, Glycine max
  Coding DNA Sequence Number=SeqID_48316
  Homolog annotation: Hit_ID=Q1S735; Match level="QueryCoverage=44%, HitCoverage=24%, E-value=2e-37, Identity=50%"; Hit description =Probable transposase [imported]-Arabidopsis thaliana-related
  Subcellular localization annotation: CTP_CleavageSite=33; ConfidenceScore=5.12e-01
AYRWKGNTSSSSNPFSTKFIALQSILAQKDALKAMVTSKDWTSSAYAKEAKAKRFMEQVLDSRFWKACAEIVKLTKPLMRVLRIVDNEDKLVMRFLYQAMYKAREEMLRRFQRNKKKVKPYLEILDHCWDSQLRGDFHAIVYWLNLGCCFNDQEFEKHMNTTSAFYEVLEKYSHGNLELNCHLTKQYPKEYYPNDQTLTRRVSSSSSSSTTSVHVTALDGLVNVNSLFTIAVFVGLSLTTPGQRSLENRSSCDADVDVAKKLLVFEVVSFSFFLFSSLVAQGLKLALNLLNSKDADEAFRAHINLRALRLGMLGSAIGSVMGCLFLVLSMVNVIEIRLGMLSCGSKAAAHAVAAMVVLVSSALVLYISTAIYAFTH

SEQ ID NO: 165095 - protein, 208 aa, Glycine max
  Coding DNA Sequence Number=SeqID_48317
MVGNKVGHVGSSTHNVESKDEVQREHDIHIGEWKQPSTMEHMMAEMVKIKRESVDARMETTEIKRMADEAFQAQEVLQQQNEEMHQRADEAQANVQTQVTNLRHLEGVATIEQPRDFQPFTTSIMNTKISILISGVTDQIKCKLFIGTLTGIDLDWFSELPNDSVEHIDDFTHLFLWTDRVLDHDERMTMVTFCKGLRAGSFGESSSY

SEQ ID NO: 165096 - protein, 92 aa, Glycine max
  Coding DNA Sequence Number=SeqID_48318
WHPGRERTLLLNLQLSMIPGDSNLWKLGIDTRTTFLAGGTQLADPPTPVHEMPTDPSTPLLEIPEDPATPVLGLTTTPPATLVLHFTDEEGT

SEQ ID NO: 165097 - protein, 59 aa, Glycine max
  Coding DNA Sequence Number=SeqID_48319
MDVVGKIYLNSSKRHSFILVITNYFMKWVEAGPWFNIKLIHSTPCCNLLFDGRATRDSW

SEQ ID NO: 165098 - protein, 64 aa, Glycine max
  Coding DNA Sequence Number=SeqID_48320
MDKFKRSFTLPARVASSSSSTSMDQHHHHHHHHHQGVEYRNSEGVLQDNPSKLSSYDLDGVMEE

SEQ ID NO: 165099 - protein, 57 aa, Glycine max
  Coding DNA Sequence Number=SeqID_48321
MVMIDKGSNGGSSSDIGGGDDNGSNIGCCGGDSNIGDSDSKVSSDNDKSDIDGGGRF

SEQ ID NO: 165100 - protein, 194 aa, Glycine max
  Coding DNA Sequence Number=SeqID_48322
  Homolog annotation: Hit_ID=Q5U8L4; Match level="QueryCoverage=31%, HitCoverage=36%, E-value=8e-20, Identity=70%"; Hit description=SBP transcription factor
  Pfam annotation: Domain name=SBP; Domain location=90-169; Score=81.9; E_value=2e-21; Accession=PF03110.5; Description=SBP domain
  Subcellular localization annotation: CTP_CleavageSite=24; ConfidenceScore=5.13e-01
RQGSNRFLAPALSSTSSSSLSPPLTMEIKSRERIQVSIEKVRRDSTVEVEDEEEEDESVVGGEGGLAEDEKKKGGGGSGRRGSSGVSPPSCQAEMCGADLTVAKRYHRRHKVCELHSKAPSVMVAGLRQRFCQQCSSWQSLMKLKEAAGDAWPDITSGAGKAMLKLAMKDAVEAKGSTLQKATAEMLMSGEEFR

SEQ ID NO: 165101 - protein, 80 aa, Glycine max
  Coding DNA Sequence Number=SeqID_48323
MVDRLGQRCKTLNESHKNERDLEAVQAKGPSGEGRRPKLKAQVEKDEGLSGEGQSPRVEKDEGQEAETLPRLLIVAEGPN

SEQ ID NO: 165102 - protein, 102 aa, Glycine max
  Coding DNA Sequence Number=SeqID_48324
MEMGTHEGERKLVYYDTSRGDTSLNFSLVRILHRSKAFVGSPFQDFKNQLFLLSGSMIVPINQHETFQRGLSSLTRFLGNFPECHPSHNYSKLSTLNYGVLM

SEQ ID NO: 165103 - protein, 279 aa, Glycine max
  Coding DNA Sequence Number=SeqID_48325
  Pfam annotation: Domain name=DUF247; Domain location=1-268; Score= -172.4; E_value=0.018; Accession=PF03140.6; Description=Plant protein of unknown function
MNAYKHYHETEMEKIRQCYAEKFPDIAKERFVDMINYLLKSIIFKHERGVNQTESFRERNSEDMILIHPWLSRSITKDLILLEDQIPFFVLEKLYDDVVPDYMKMEKQTAGFVDLAIKYFAFYNTQMFYSIKYKKQFFSGSHRSSSKSTKHFTDLIRFDYLPVGIAVKSGYARHVLRTATKLRDSGVSFEKGDGWVGTELRRLDPTRDYVTGLENPSCHAENGAPNAKTTMEGGVLPLAPLVQGLATQDRHGTGGDMTATVATLRKHDDANKTRKKEKR

SEQ ID NO: 165104 - protein, 77 aa, Glycine max
  Coding DNA Sequence Number=SeqID_48326
  Subcellular localization annotation: CTP_CleavageSite=67; ConfidenceScore=5.32e-01
MAEVRKKKNKTLLFTTSAGCTSKNGNDNNKWWQAPQRRRRRTSSCNLLLTATTNGNAGDVSNNNTKMAEVRKKNKTL

SEQ ID NO: 165105 - protein, 166 aa, Glycine max
  Coding DNA Sequence Number=SeqID_48327
MSTEHAIRGLSPVLATSPSMAGTSLPKLWTFLPCIYNTGCIRGMHHIHQAEYMSFLVQLVVAQFLGFPLIGIVLGGSPAINGGFYSRANQQSTLSDHPNSGNNGGNDMVRELTSTVDGEEAPSMVDGGIALRGSLLNAPRQPPIHDNNGGKLLNEEEEEPLPATST

SEQ ID NO: 165106 - protein, 115 aa, Glycine max
  Coding DNA Sequence Number=SeqID_48328
MEHLECNNRVLKTHGDGSSRPKKGNHQKKPYNRPQQHHGGPIVSRTGNKGVSNAFKGYFDDAKESRVKQSFKQRFKNQVSSFKIQDSRIKFQESRIIKIKIQDSRFKNHEKTKSR

SEQ ID NO: 165107 - protein, 179 aa, Glycine max
  Coding DNA Sequence Number=SeqID_48329
MACPEDKKVSYVVFMLATKAEFWWHGTQSMIEAHGEAFKERFLGKYFLERNLFVHEDATKFECLAHYYSQVTTKAWRCKKFAEGLRFKVQRTIFLMAIIEFLAMVEKMKIVDVTPQSNHTRMRGIQRLYNPSLKNFIVKYAWLGVVVGWVTIWEVSQKAWLPMECSNQWRVLSSNQQGC

SEQ ID NO: 165108 - protein, 72 aa, Glycine max
  Coding DNA Sequence Number=SeqID_48330
MVDEMIDYKWDQIAGRVVWEQTYGEIVKLPRTLLTPQPPFNSAQIARAFEIMATTLHKKSTTIAPQHQAALA

SEQ ID NO: 165109 - protein, 124 aa, Glycine max
  Coding DNA Sequence Number=SeqID_48331
MGERWKQFKSDLTSKWALAAGKNSVDDTVCEKYDISKEKWAQFCQSCKDPSWEDVRKKAQTIQKKNSALHVLSRGGYECEYLFQDSLKIKPCLRTKGFKVMQGSGNRLPGSVIDYQKGRMKKSC

SEQ ID NO: 165110 - protein, 70 aa, Glycine max
  Coding DNA Sequence Number=SeqID_48332
MTVILPKENVVIWFCLLHNWLDNYLKGIINSALKGLDNTPQSKSKAATKWIVVKCNGQKGSTECGYYVMH

SEQ ID NO: 165111 - protein, 177 aa, Glycine max
  Coding DNA Sequence Number=SeqID_48333
  Gene Ontology: Mol. function=RNA-directed DNA polymerase activity; Cellular component=chromatin; Biological process=RNA-dependent DNA replication
MYHPDKANVVVDALSRKTIQVSALMIKELELVEKFRDLNLCVDLWKMIEMLGTKKVVNFNMGDDCILRFKSRVCIPQAPELKGLILDEGHKRKLSLLQGTTKMYQDLKKMFWWFGMKKDVTDYMAACLACQKAKVENHSPGGLLQTIEIPEWKWETIIMDFVTHTCQDLLEVVMLYG

SEQ ID NO: 165112 - protein, 110 aa, Glycine max
  Coding DNA Sequence Number=SeqID_48334
  Gene Ontology: Mol. function=transferase activity; Biological process= DNA integration
  Homolog annotation: Hit_ID=Q2HRZ3; Match level="QueryCoverage=57%, HitCoverage=35%, E-value=1e-23, Identity=81%"; Hit description=FAR1
MEMRGKKSTILMLVRVMDFKNIMTWILKRMKILISNLGDKDKKIVELTMELERQDQLCAAYREKLLSFISNVEEETEELSTKIQLIIENVRRAESDMKKCSQNRKPWCLT

SEQ ID NO: 165113 - protein, 178 aa, Glycine max
  Coding DNA Sequence Number=SeqID_48335
MGDHVFLEVTPTTGVGRVIKSKKLTLSSLDLIRFSGVLASGSPEPSKDFSLKEPARLGEPITSGVSLGSPGRAAMVPSAHFPINMRAWEAEERFQGSEVKRIERREKEEETRPRRYQIATAIIPYLVSCFVFFMRPIKKLRGKTINLVNVVWRDTMGSTMWELKDKMCEQYPNLFPVK

SEQ ID NO: 165114 - protein, 70 aa, Glycine max
  Coding DNA Sequence Number=SeqID_48336
MEQSSNDNTRNVRWPERRAATAPERTVAGTQQRRRNGRWTERRAATAVLGFSQCFPAQQWSPDKSRNNRF

SEQ ID NO: 165115 - protein, 220 aa, Glycine max
  Coding DNA Sequence Number=SeqID_48337
SEEDLILMWAFLTGRQIDWAHLVRYRMHKALWANAPLPYPQLVTLFLRHFQIPLDDEPFVQVKCSFAIGVGVVTSFGYRKDRNGQWLKKDALPPQVERTPSPPPQRDDSTLMTEVLSELRGLRTYVGDRFDSLDNRFAGMDIRLTQLEEDVGGTREIPLDEELTEFGDGNIDVANVKEFYANLYGPEDKSPKQVRVRGHLIKFDEDMLNIFLKTPVVVEE

SEQ ID NO: 165116 - protein, 116 aa, Glycine max
  Coding DNA Sequence Number=SeqID_48338
MANRISLVMSHKNLVKHLHSTSTKNANAHVHTQGGDSIVGAAAQGAVKATEVLENVGERAKETVGTALDAAKKTTKLVTETTTTMVEADTNVVDTVEYRCTEDLGGQLGDGHDSYN

SEQ ID NO: 165117 - protein, 103 aa, Glycine max
  Coding DNA Sequence Number=SeqID_48339
MVHDSHVVVENRIMLNTFKLSYISGFQNSFIHNKLLLSGRPYLQMLMQHITIVQNMPLLQILRVTRIKDQHLPFLTDAKLSYKASQPSTQYGQAEHSKITRAC

SEQ ID NO: 165118 - protein, 102 aa, Glycine max
  Coding DNA Sequence Number=SeqID_48340
MYLSPDLLLPALTPYHPSLSLEVPPYEHPLTSNNKVLMVVRKTQATLIEKAPKKWTVEKSPTMRVPLKKQAPHDDGKMVLAKSTMHRSPRYESTFCMSTHTK

SEQ ID NO: 165119 - protein, 146 aa, Glycine max
  Coding DNA Sequence Number=SeqID_48341
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=O80919; Match level="QueryCoverage=96%, HitCoverage=41%, E-value=9e-31, Identity=42%"; Hit description =Expressed protein
MWEKLRGKRLMFVGDSLNRGQWISMVCLLQSVIPADKRSMSPNAHLTIFRAEEYNATVEFLWAPLLAESNSDDPVNHRLDERIIRPDTVLRHASLWTHEENGACEELDGHGAMELAMGAWADWVSSKVDPLKKRVFFVTMSPTHLW

SEQ ID NO: 165120 - protein, 112 aa, Glycine max
  Coding DNA Sequence Number=SeqID_48342
MLGVGCQGYLVFEESVPPENCIILLGNITNNKFSYACPLAADKITQQHSFCQLSISTASNVITQSQTVEQKSISNQHGGIDNDSQISQNRMRYDEIECNRSKDKENRVIYSS

SEQ ID NO: 165121 - protein, 353 aa, Glycine max
  Coding DNA Sequence Number=SeqID_48343
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=5e-37, Identity=28%"; Hit description= UPI00006A17C9 related cluster
GLHDLTIRGLHTLAFRELHAVAFIRLHALSFRGLHVLAFRGLHVLGFRGLHVLAFRGLPDLTFRGLNDFAFRGLHVLSFRGLHVPAFRGLQALAFRGLHVLTFRGLHALTLSGLKTLTFRGLHVLVFRGATCPRLQRTAHPRLQRATCPHLQMATCPRLQRTACPHLQRTTCPHLKRATRARLQRTARPRLLRGIYVLAFRGLHVLIFRGSLHALAFGGIHTLALKGLHVLAFIGLHVLAFRGLHVLTFRGLHVLIFIGLHVLTLRGLHALAFKGLHALACIGLHTLTFRGLHVLAFRGLHALTFRGLHVLNFRGLHVLTFRGLHVLTFRGLHVLTLRGLHALTLRGLHVLAF

SEQ ID NO: 165122 - protein, 123 aa, Glycine max
  Coding DNA Sequence Number=SeqID_48344
  Gene Ontology: Cellular component=endoplasmic reticulum; Biological process=lipid biosynthetic process
  Homolog annotation: Hit_ID=Q6EUN0; Match level="QueryCoverage=50%, HitCoverage=20%, E-value=1e-24, Identity=73%"; Hit description=ASC1 -like protein 1
MDFQTHERKKKIRKFKESAWKCVYFLSAEIFALAATYDEPWFTDTRYFWVGPGNQIWPDQKIKEERILEAIEVSIEVCSQGCRWREYNPNPPKKYPLGLGLPTGPKLFALVDPGYDPISNLKG

SEQ ID NO: 165123 - protein, 248 aa, Glycine max
  Coding DNA Sequence Number=SeqID_48345
  Gene Ontology: Mol. function=RNA-directed DNA polymerase activity; Cellular component=chromatin; Biological process=chromatin assembly or disassembly
MTQAPVLASSDFSLPFVLKTYAFAIAMGAILQQRSHPIAFYSKMFCPRLQHASTYIHELHAITSAVRKWRHYLLGYPFIIITDHKSLKDLMSQVLQTPEQQHYLSKLLGFDYSIQYRPGSRNVPVDALSRLPVTDITHFSLSVVNFEILEQLRTSLQDNHDFQELSSRITADPVDHPDFATRRGLIFHKRKIWLPPVHPFIPLLLDEFHSTLVGGHLGFAKTLRRLQDNFTRPAMHSDVRHFVSTCLT

SEQ ID NO: 165124 - protein, 710 aa, Glycine max
  Coding DNA Sequence Number=SeqID_48346
  Gene Ontology: Mol. function=nucleic acid binding; Cellular component= beta-galactosidase complex; Biological process=DNA integration
  Homolog annotation: Hit_ID=Q1S4N1; Match level="QueryCoverage=99%, HitCoverage=70%, E-value=0.0, Identity=73%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam module annotation: Pfam domain module=RVT_1::RVT_2; Domain location=283-490::261-517
MTNDRELFKDLKPTNITKVRIGNGDYISVKGKGTIAISSGSSTKFIPDVLFVPEIQQNLLSVGQLIERGFKVAFEDNFCLIRDAANQDIFKIKMKGKSFALNPLEEEQVAFPIKENITEVWHKRLGHYHHQGLLQMKSKKMAADFPELYNHVPTCKACLFGKQKRKPQTGSIVVSRDVHFVEDEEWNWDEVKKKDQTVADLQLNSLASRTEEEEDWQSELVDDAPARGTRSLSDIYERCNIAVYEPVDFGAAKKDQNWMAAMKEELSMIEKNRTWELVDRPQDRKVIGVKWVYKTKLNADGSINKHKARLVVKGYAQIFGVDYSDTFAPVARLDTIRILLVVAAQMNWKVYQLDVKSAFLNGVLHEEIYVEQPEGFVKNEEKDKVYLLKKALYGLKQAPQAWYNKIDDHLLSISFKKSLSEATLYVKHQSNEVPMISLYVDDLLVTGNNPGMIQEFKQEMMKVFEMTDLGLMTFFLGLEIKQAEYEVFICQKKYVKEILKKFKFQECKKVSTPMNQKEKLCKEDGADKADEGYFRSLIGCLMYLTATCPDILNDVSILSRFMHNASELHLRAAKRIIRYVKGTSDFGVKFTWSKEFKLVGFSDSDWGGSIDDMRSTSGYYFTLGSSVFSWSSKKQETVAQSTVEAEFIAATAAVNQALWLRKILMDLNLEQKESTKIFIDNQAAISISHIPVFHGKTKHFNIKLFFLREV

SEQ ID NO: 165125 - protein, 101 aa, Glycine max
  Coding DNA Sequence Number=SeqID_48347
MYYNGKWNIPRQGEFLGYSFTETNPIRFDIHSGCDMEKLKDLIKRLFFRQPGHSKYSENLIEYDITELKNDEDVLKVLAQFNYWKRLCTTEILAIFSKSVI

SEQ ID NO: 165126 - protein, 100 aa, Glycine max
  Coding DNA Sequence Number=SeqID_48348
MPARALRINWGVSGKGVEAMTNNSFVIALIIEATISARTRNGWCDGDHGAYPPEARNEIAQKEGMREPDGTVGQALKVREVIIDGTSLLELEQGAMWIIV

SEQ ID NO: 165127 - protein, 66 aa, Glycine max
  Coding DNA Sequence Number=SeqID_48349
  Subcellular localization annotation: CTP_CleavageSite=54; ConfidenceScore=5.04e-01
MAALSYARRFALTLPSRSKELGPIVTDYTSRTMSFTLLGSPVQLTTDVSLFPASASIHQVHRLVHT

SEQ ID NO: 165128 - protein, 217 aa, Glycine max
  Coding DNA Sequence Number=SeqID_48350
  Homolog annotation: Hit_ID=Q6NQI8; Match level="QueryCoverage=42%, HitCoverage=39%, E-value=7e-25, Identity=75%"; Hit description=LAG1 longevity assurance homolog 3
  Pfam annotation: Domain name=LAG1; Domain location=55-202; Score= -25.3; E_value=6.9e-06; Accession=PF03798.6; Description=Longevity -assurance protein (LAG1)
MQWYSKNWVILKIHPSGSWPSNLGMSSFMCGRGKGDEGGEDLGEVGGGVILGKGLLALSETEHGLLESLDGGLPGVMFRHSRRDRAGRTKDDREKELHYKATLKFVRVGSVVLALHDASDVFIETGKMSKYSGAETTASIAFILFVLCFTVTRIIYYPFWILRSTSYEVVHALKMDLVDGCLLNKSKKKEKLVKIYDLIQKMNMNINMKNEQKNVQD

SEQ ID NO: 165129 - protein, 58 aa, Glycine max
  Coding DNA Sequence Number=SeqID_48351
MEVGVQREISRELGDGRGVVELGDWQGNEWGWDLSWRRRFQWENINMKCFTVKKHMEW

SEQ ID NO: 165130 - protein, 205 aa, Glycine max
  Coding DNA Sequence Number=SeqID_48352
  Gene Ontology: Mol. function=oxidoreductase activity; Cellular component=vacuole; Biological process=hydrogen peroxide catabolic process
  Homolog annotation: Hit_ID=Q96519; Match level="QueryCoverage=90%, HitCoverage=55%, E-value=6e-74, Identity=72%"; Hit description =Peroxidase 11 precursor
  Pfam annotation: Domain name=peroxidase; Domain location=48-204; Score=185.0; E_value=1.8e-52; Accession=PF00141.13; Description =Peroxidase
MDPSFPSKSFLHVVLIFCFLGATRLYANDPYLTLDYYASTCPAVFDIVRKEMECAVLSDPRNAAMIIRLHFHDCFVQGCDGSILLDDTITLKGEKNAATNIHSLKGLGIVDKIKNIVESECPGIVSCADILTIAARDAVILVGGPYWDVPVGRKDSVTANFDLANTNLPTPDESLLSIIAKFLYQGLSVTDMVALVGVLVFLIMQ

SEQ ID NO: 165131 - protein, 91 aa, Glycine max
  Coding DNA Sequence Number=SeqID_48353
  Homolog annotation: Hit_ID=Q69M22; Match level="QueryCoverage=48%, HitCoverage=12%, E-value=5e-07, Identity=57%"; Hit description =Integral membrane protein-like
MTLIQALDEPSIIYVGSHHKREEVVVEDEAPCVEAEPHDHVLDVDYLDGDGDEDIGVGEDSEVEDECDGEEVLAVGRMKESWWRNPNFSSL

SEQ ID NO: 165132 - protein, 159 aa, Glycine max
  Coding DNA Sequence Number=SeqID_48354
  Homolog annotation: Hit_ID=Q1SPF0; Match level="QueryCoverage=31%, HitCoverage=9%, E-value=4e-11, Identity=68%"; Hit description=Zinc finger, U1-type
MIDNITSTTKKLIGIYEDNDNVRQDEIVALRGQIATEIKVFSAFYDKLKEGTFGIVLWRVILVVVKTLGEELFTDDNKKWVHKVQVEVHNCQIGLDLLFKQPSQSDVAPCGACRTWIFFTVEAMTSKIILMMPKNQELSKFQRIRLQESSLKESRFKNN

SEQ ID NO: 165133 - protein, 90 aa, Glycine max
  Coding DNA Sequence Number=SeqID_48355
  Gene Ontology: Mol. function=RNA-directed DNA polymerase activity; Biological process=RNA-dependent DNA replication
MVKKPNGKRRICTSYINLNQACPKDAYPFRNINRLVDGASKHKLLSFLDAYSGGKGLSELDMSWRIAFIITTFLTSLILEYSMGYHDDIL

SEQ ID NO: 165134 - protein, 99 aa, Glycine max
  Coding DNA Sequence Number=SeqID_48356
  Subcellular localization annotation: CTP_CleavageSite=57; ConfidenceScore=5.00e-01
MINDGTYKFGDPTVMWLCMPPDPWVMHFVSKRPFRGNTGSNKDRRKSLKVYQSHTVRGEKVTSTLDFVGNQRERTTLGRGFLFLVYLVTILYCSDIVWP

SEQ ID NO: 165135 - protein, 138 aa, Glycine max
  Coding DNA Sequence Number=SeqID_48357
SEIPKWLSVQTIPVNPDLRSQVAVGEASEPVDTQRLTSSFAPFVIQRRRVRCHAEIPKRLSVQTIFVNPDPGSQVIRTFCQPEASEPIDAQRLTSSSAPFLNQRQASPDSKSDDMLGIPYGYPHLSSTKTNEVDGIGI

SEQ ID NO: 165136 - protein, 245 aa, Glycine max
  Coding DNA Sequence Number=SeqID_48358
  Gene Ontology: Mol. function=chitin binding; Cellular component =extracellular region; Biological process=chitin metabolic process
  Homolog annotation: Hit_ID=UPI000044A8F0; Match level="QueryCoverage =73%, HitCoverage=99%, E-value=5e-22, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLAFRGLHVLDFRGLHVLAFRGLHALTFKGLHVLAFKGLHVHAFRGLHVLAFRGLRILGFGGLHILAFRGLHVLAFRGLHVLDFIGLGVLNFRGLHILALRGLHVLTFRGLHALAFRGPHVLIFRGLHALTFRGLHILAFRGLHVLAFRGLHSLAFRGLHILAFGGLHVLDFRGLHVFAFIRLQVSILASSPPCRSVSRDCAHKTLSGPREVQKGPGVSSSDYGPLPVLWSAHHPQQGHQAPY

SEQ ID NO: 165137 - protein, 77 aa, Glycine max
  Coding DNA Sequence Number=SeqID_48359
MYLDENLHLIGLGMDQVAKACKVRKETLKKVYRDLHSLALVQIPSWYANAEDIKRLCIVEAHLPIESSSLQLPRWDA

SEQ ID NO: 165138 - protein, 77 aa, Glycine max
  Coding DNA Sequence Number=SeqID_48360
MVLGDTICSKCGLVLESRSIEEEAPKRRLYNDDDDDDDDENIGIFVWTSYPCICKEAISGFELMTNKSPRHNFTAAP

SEQ ID NO: 165139 - protein, 38 aa, Glycine max
  Coding DNA Sequence Number=SeqID_48361
MEEGTTMAEGVVRQREGPIFLVFGSLSIGLILVLNALV

SEQ ID NO: 165140 - protein, 123 aa, Glycine max
  Coding DNA Sequence Number=SeqID_48362
  Homolog annotation: Hit_ID=Q76FZ8; Match level="QueryCoverage=44%, HitCoverage=4%, E-value=5e-08, Identity=63%"; Hit description =Brassinosteroid receptor
  Subcellular localization annotation: CTP_CleavageSite=28; ConfidenceScore=5.18e-01
SISPPTTSQALPPVVFNTCTSLQSFDISSNLFVDVLPMDILTQMKSLNELAMALNWHPLVPKFPTPRVEEEELELGSSTARRSQRHEGHKPVKFSCGYGGGCNMVGVGEAAAATETAVPEKVK

SEQ ID NO: 165141 - protein, 81 aa, Glycine max
  Coding DNA Sequence Number=SeqID_48363
MRKGGSAGGVGCGSRSCIPYIEALAKVAATKTKGARMPKENNRKVENGNNAVLHDGKQHANNIFPMNQYPPDSSTPSNKFC

SEQ ID NO: 165142 - protein, 110 aa, Glycine max
  Coding DNA Sequence Number=SeqID_48364
  Pfam annotation: Domain name=EAP30; Domain location=12-109; Score= -37.6; E_value=0.00073; Accession=PF04157.6; Description=EAP30
MYAKTSYLTRQELIVDICLATRVHSGGLIDVQELCHLLCQRRKSDREVVSEIDCLRAIKKLKVLTFFAGVLLEKQIVVVCSNLMCIESILGGSHVEDVLATYMSRCSPNR

SEQ ID NO: 165143 - protein, 101 aa, Glycine max
  Coding DNA Sequence Number=SeqID_48365
MTNEEHQTKNDVEVDYGRNSVAPWPRFLFFLLLLSNFSIEGVWDFGSSPRRAGYFTPKLFGGLGEPGCRKKAKKDPFALPFGYFLHSSPKCRMIFLILRGN

SEQ ID NO: 165144 - protein, 237 aa, Glycine max
  Coding DNA Sequence Number=SeqID_48366
  Homolog annotation: Hit_ID=Q2HVK4; Match level="QueryCoverage=28%, HitCoverage=28%, E-value=2e-14, Identity=64%"; Hit description=Malic oxidoreductase
GLVTTERSNLDPAAVTFAKNPRDLERLSKGASIIEVVKKVKPHVLLGLSGVGGVFNAEVFMLSTSNVVAMVTKEPMCVQNTKEVENVVPNGVNEESIAPENEKMGDQSGSRCFARMLQPYAISIGIKEHSNPVTPKAYTPKSPSGPLPPDSAIPFSLYMTIISQITTVKTVLGFYVKEKGYDAKGISLSSNMISKLPTEEVVPHQLVPKENEVSTDMDMEIENDDVYHEMQPVLGGV

SEQ ID NO: 165145 - protein, 88 aa, Glycine max
  Coding DNA Sequence Number=SeqID_48367
MLQMHINKLNHQGVHISSIGRSQRQIMHQLDNLNNLLRGSLGEKSHPTRTNSRKSIDMSSDSVGARVMVVAAVGCLGIFLMKVLLNKK

SEQ ID NO: 165146 - protein, 171 aa, Glycine max
  Coding DNA Sequence Number=SeqID_48368
MTDIEISLENFSLIPSVKEVDSQIKEKNKGHDEIRRERDNVKSPNVNSETKEGKKESVQRLEIEDASTTNPPKHKQDRRGLRPNQSRWHNEGPKLELSWGWLPTNSWSYLKAYYPPNSQFGVSHGDKEESGDNGKARAVKHVYKSQGAQAVLTCFYMFPKQAKKPLSWDML

SEQ ID NO: 165147 - protein, 106 aa, Glycine max
  Coding DNA Sequence Number=SeqID_48369
  Gene Ontology: Mol. function=RNA-directed DNA polymerase activity; Biological process=RNA-dependent DNA replication
MNGWFDRRLKWKIGEGDQAIFWLDNWVGEESLASKIPRLYSLSKQQNECTKNMGHWREGGWVWKFEWTMEMFEWEKRSGGSMESLLLVVGYKIGLTKFTGSTYKPT

SEQ ID NO: 165148 - protein, 85 aa, Glycine max
  Coding DNA Sequence Number=SeqID_48370
MKVQSRNQVDRERGTHKSIGLRQRKTATPENKLKRLLKKLALTDPLKLLQEYNKGLDETYLREVAKEKKHRLVTMLEYDEHDARP

SEQ ID NO: 165149 - protein, 69 aa, Glycine max
  Coding DNA Sequence Number=SeqID_48371
  Gene Ontology: Mol. function=oxidoreductase activity; Cellular component=cytosol; Biological process=leukotriene metabolic process
  Homolog annotation: Hit_ID=Q8LA26; Match level="QueryCoverage=74%, HitCoverage=14%, E-value=4e-19, Identity=90%"; Hit description=Allyl alcohol dehydrogenase, putative
MTAYAGFFELGSPKKGENVFVSAASGAVGQLVGQFAKLAGCYVVGSAGSKEKSKACPSAFTPIINLSLY

SEQ ID NO: 165150 - protein, 100 aa, Glycine max
  Coding DNA Sequence Number=SeqID_48372
MEMEAMEIGKHKMYQFLRIVRFSFLAVLFCIQIASLEEDKNAFGMTHSKELATLLKAEKISCVEISKHRMYRFLRIVRFAFLAGSFGRLSKPMGMENLPS

SEQ ID NO: 165151 - protein, 337 aa, Glycine max
  Coding DNA Sequence Number=SeqID_48373
  Gene Ontology: Mol. function=adenosylhomocysteinase activity; Cellular component=cytoplasm; Biological process=one-carbon compound metabolic process
  Homolog annotation: Hit_ID=UPI00006B285B; Match level="QueryCoverage =66%, HitCoverage=61%, E-value=6e-84, Identity=68%"; Hit description =S-adenosyl-L-homocysteine hydrolase
  Pfam annotation: Domain name=2-Hacid_dh_C; Domain location=54-201; Score=-52.2; E_value=2e-05; Accession=PF02826.9; Description=D -isomer specific 2-hydroxyacid dehyd
  Pfam annotation: Domain name=AdoHcyase_NAD; Domain location=55-213; Score=114.9; E_value=2.3e-31; Accession=PF00670.12; Description=S -adenosyl-L-homocysteine hydrolase, NAD binding domain
  Pfam annotation: Domain name=IlvN; Domain location=74-242; Score= -85.8; E_value=0.031; Accession=PF07991.2; Description=Acetohydroxy acid isomeroreductase, ca
  Pfam annotation: Domain name=Shikimate_DH; Domain location=57-170; Score=-7.4; E_value=0.0015; Accession=PF01488.10; Description =Shikimate  quinate 5-dehydrogenase
  Pfam annotation: Domain name=TrkA_N; Domain location=80-185; Score =5.4; E_value=0.0064; Accession=PF02254.8; Description=TrkA-N domain
  Pfam module annotation: Pfam domain module=2-Hacid_dh_C::AdoHcyase _NAD::IlvN::Shikimate_DH::TrkA_N; Domain location=54-201::55-213::74 -242::57-170::80-185
MGADLTTRLHQSPSGPQIVAGLEATGSGISRLNGVAPRYPIFNWDDLPVKEGLHNRHMVGLTAWHTFFQTTHLTLHEKRVLVIGYGLVGQGTAAAARAYGGQVMVAEIDPARALQARYDGWQVVDLASAVAQADVIATATGAKNVLSAQLLQQAQDGVFILNVGHVAEEIDVGFLQGLPHHEPMPYVNAYQLNEKTVYLLANGSMFNLTAGYGDSLNAFDVTLAVMAAGIGHIVGAVGLAAGAVTFSTRAFIPERPRAASFFSGQNLSQIRHTIPAGAGFAPRALASDNAAALHATQPELASGSAMVVDMQTHKVMYARNPDEVVSIASITKLMTAM

SEQ ID NO: 165152 - protein, 93 aa, Glycine max
  Coding DNA Sequence Number=SeqID_48374
  Subcellular localization annotation: CTP_CleavageSite=85; ConfidenceScore=5.45e-01
MGSKSTLRLMRTLGPSLGSLANLLGVFYPMPLRARIASNVPFSGRARRDRNVLLPKRRMPGSHHQRLFEKNVRKTKKRVDKAVVLAPMYPQVR

SEQ ID NO: 165153 - protein, 63 aa, Glycine max
  Coding DNA Sequence Number=SeqID_48375
MEKSKVDTLIAISPNTWHASKLIHISPQDSEYVIYGDNKQRPLDQHAQQVISNDTNRLSLMID

SEQ ID NO: 165154 - protein, 107 aa, Glycine max
  Coding DNA Sequence Number=SeqID_48376
MCFDLLRIQSFTLVSKDKEKVLKPFVTSVQHFISQIDRSGAVVVWTSTSEEVEVGGGLYWWFWEQIWGRGGWWWFGQLDLVKGRPLVCGGVVWVRGSNEREIGGKQI

SEQ ID NO: 165155 - protein, 164 aa, Glycine max
  Coding DNA Sequence Number=SeqID_48377
  Gene Ontology: Mol. function=nucleic acid binding; Biological process= DNA integration
MVTRAKNGIDQPRIHPTLLLARAEPKYVKQALQGPKWVTTMTDEFNALQISYTCTLVPLPQNRIAIRYKSFVCKLNKAIYGLKQAPRAWFEWLKTTLLQLGFSDSKCNPSLFTYKTKTATVYILLYADFIIIAGCFLLQSIVGALQYVTYPEQLMLSFNKHGSN

SEQ ID NO: 165156 - protein, 120 aa, Glycine max
  Coding DNA Sequence Number=SeqID_48378
MWFDLLRIQSFTLVSKNKEKVLKPFVTSVQHFISQIDRNGASKSFSSNDQIDLVQWLFGRAHLKKWRLVVAYWWFWEQIWGRGGWWWFGQLDLVKGRPLVCGGVVWVRGSNEREIGGKQI

SEQ ID NO: 165157 - protein, 119 aa, Glycine max
  Coding DNA Sequence Number=SeqID_48379
MAEPSKKRKGTSSHSQRHSGSQEMPIPSSIPSGSLFSLEEQSIQCLAPIIRQFVKFRDVPEIKRKHRCTIVRFRNIPGANSNQAHLGPPEDSSRRLLLLEEATLLAWASWVASLSPNFL

SEQ ID NO: 165158 - protein, 97 aa, Glycine max
  Coding DNA Sequence Number=SeqID_48380
MRRRNEFWIQGRSFPPLQEQAHYHNITKIPKTITNKIKNPKINVFYELPWMLYEKTKMESKEGKSGAYHSMAQPNNIKGRGKSPPLITNTKSQAFRI

SEQ ID NO: 165159 - protein, 129 aa, Glycine max
  Coding DNA Sequence Number=SeqID_48381
SSSSLSKPASNVDFEKAVENFKRLAFEGSFEFALSKADYKAESRKHYLHVCLKIVLSTPRQVLACISVTPPCPPLKEELSHPTTALQGKLVDVFIFRVCVNILPWQEPARLGVCTIELAVESSEPSTDD

SEQ ID NO: 165160 - protein, 146 aa, Glycine max
  Coding DNA Sequence Number=SeqID_48382
  Gene Ontology: Mol. function=hydrolase activity, acting on glycosyl bonds; Cellular component=cellulose and pectin-containing cell wall; Biological process=carbohydrate metabolic process
  Homolog annotation: Hit_ID=Q68UW1; Match level="QueryCoverage=94%, HitCoverage=34%, E-value=2e-44, Identity=60%"; Hit description =Polygalacturonase
MARIVLLHALVLFLFTFTSAIAEAVTLNVVNFGAKPDGETDSTNAFVSAWGRACSSTAPTTIYVPLGRFLVGKVVFKGRCNNKGITIRIDGAMLAPSNYDVIGNGGNWLFFDDVDGVSIIGGVLDGQGTGLWACKRSGKTCPTGAT

SEQ ID NO: 165161 - protein, 99 aa, Glycine max
  Coding DNA Sequence Number=SeqID_48383
MSLIVQDLPTTTMRMITPTHVHHRHWHPPPCLICHIPRLTGHVGCTVACGEVGLLPQCNKTPILICRTSIGVQRNSNLERCRGDHDHECVDAEQQSGGT

SEQ ID NO: 165162 - protein, 91 aa, Glycine max
  Coding DNA Sequence Number=SeqID_48384
MDKIIVGEVLASDRSGRVTVEKVAFDGGRRSSLLEIVEVFGSDKKEKSTIVVVPNTTIVITTTNMLSPPPKPPPMPHHHNQLHENYDRVFV

SEQ ID NO: 165163 - protein, 603 aa, Glycine max
  Coding DNA Sequence Number=SeqID_48385
  Gene Ontology: Mol. function=nucleic acid binding; Cellular component= nucleus; Biological process=red or far red light signaling pathway
  Homolog annotation: Hit_ID=Q9M0V3; Match level="QueryCoverage=98%, HitCoverage=57%, E-value=0.0, Identity=83%"; Hit description=DNA damage-binding protein 1a
  Pfam annotation: Domain name=CPSF_A; Domain location=289-542; Score =362.1; E_value=8.9e-106; Accession=PF03178.5; Description=CPSF A subunit region
  Subcellular localization annotation: CTP_CleavageSite=50; ConfidenceScore=5.06e-01
HLPLANKPALQVTSSSVRLVSSNPRELRNEWHAPSGYSVNVATANATQVLLATGGGHLVYLEIGDGILQEVKHAQLEYEISCLDINPIGENPNHSNLAAVGMWTDISVRIFSLPDLSLITKEQLGGEIIPRSVLLCAFEGTSYLLCALGDGHLLNFMLNISTGELTDRKKVSLGTQPITLRTFSSKNTTHVFAASDRPTVIYSSNKKLLYSNVNLKEVSHMCPFNSAAFPDSLAIAKEGELTIGTIDDIQKLHIRSIPLGEHARRICHQEQSRTFAICSLKYNPASGEDSEMHFVRLLDDQTFDCSFSDDNNVYYCVGTAYVLPEENEPTKGRILVFAVEDGKLQLIAEKETKGAVYCLMAFNGKLLAAINQKIHLYKWVLWDDGTHELQSECGHHGHILALYVQTRGDFIVVGDRMKSISLLIYKHEEGAIEERARDYNANWMSAVEIVDDDIYLGATDEERGRLEVVGEYHLGEFVNRFRHGSLVMRLPDSDVGQIPTVIYGTINGVIGVIASLPHEQYVFLEKLQSNLRKVIKGVGGLSHEQWRSFNNEKKTVEARNFLDGDLIESFLDLNRSKMDEISKAVDVSVEELCKRVEELTRLH

SEQ ID NO: 165164 - protein, 82 aa, Glycine max
  Coding DNA Sequence Number=SeqID_48386
  Subcellular localization annotation: CTP_CleavageSite=51; ConfidenceScore=5.13e-01
MASKTPIPLKAINTKLPSLKAKKDRHTKGEPSIIAATSTGYHLLASSMVVSASTPTPSLSEDQNIVDMHANSMVAPTNIEIE

SEQ ID NO: 165165 - protein, 496 aa, Glycine max
  Coding DNA Sequence Number=SeqID_48387
  Gene Ontology: Mol. function=protein kinase activity; Biological process=protein amino acid phosphorylation
  Homolog annotation: Hit_ID=Q10G25; Match level="QueryCoverage=72%, HitCoverage=76%, E-value=5e-51, Identity=35%"; Hit description =Expressed protein
  Pfam annotation: Domain name=DUF860; Domain location=120-457; Score =444.6; E_value=1.3e-130; Accession=PF05898.4; Description=Plant specific of unknown function (DUF860)
MTIWNYVVTAHKPTNVTHSCVGNFTSPRDLYLIIAYLLILFPFPRVPFFSFIFVSTYLPFHFVFLPGNARASRFTCFLPKACSMFHWLFGIARNFGFVRGYQQGYIYQQKFSLVNIKLKWVKDRTLDAVVTGQRDLKAVGILVSIIYSSSECCLPIYHLSRHRGQLGLPSDLKLSTFIRRYPNIFNESSFLDSGGSPVPCFSLSPEALELHHEEVNILQQNQLELRDRLCKLLMLTSDRILPLQTIDQLKWDLGLPYDYQHSFVPNHPESFLYVRLPDDRIGLKLLFWDDKLAIPELQKNTSLQQKAEDIKNGSLEFPISFTRGFGLKRKCMEWLKEWQKLPYTSPYINASHLDPRTDVSEKRIVGVFHELLHLTLHKQTERKNVSNLRRPLALPQKFTKVFERHPGIFYISKRSDTQTVVLREAYNGQEPVQNHALVQIREEFASLLKKGLLDRSKGVYKKSRHTNLVEGLRKEVCIAKKTNQLSSEDESDSMFF

SEQ ID NO: 165166 - protein, 190 aa, Glycine max
  Coding DNA Sequence Number=SeqID_48388
  Gene Ontology: Mol. function=nucleoside-triphosphatase activity; Cellular component=integral to membrane; Biological process=transport
  Homolog annotation: Hit_ID=Q53KA2; Match level="QueryCoverage=79%, HitCoverage=13%, E-value=9e-42, Identity=51%"; Hit description=ABC transporter-like protein
MNLPNQTRKVPFVIVVVLINFIVGPRLIFCQKSSGGGGGLEIIAQEVYRSMSNYTSVFKSAIKKELGYCIVDVDADWNGAFNFTKDLTFLTICAQQLKGDITQRMCTEAEIQAYGQSFASGKSGTRSSFLKPNINCNLSSWVNGCEPGWGCKANKKVDIGSNKKDIPIRSLDCQPCCEGFFCPHGLTCMI

SEQ ID NO: 165167 - protein, 68 aa, Glycine max
  Coding DNA Sequence Number=SeqID_48389
  Gene Ontology: Mol. function=metal ion binding; Cellular component =integral to membrane; Biological process=ubiquitin cycle
  Homolog annotation: Hit_ID=Q6EPF2; Match level="QueryCoverage=98%, HitCoverage=16%, E-value=5e-17, Identity=61%"; Hit description=Ring zinc finger protein-like
FDNLACDMENALKSVAYNPQPERHVGILVAAENQDSGGDGDEGEVLENVQDDDGLGIGLIALPLFELP

SEQ ID NO: 165168 - protein, 469 aa, Glycine max
  Coding DNA Sequence Number=SeqID_48390
  Gene Ontology: Mol. function=nucleoside-triphosphatase activity; Cellular component=integral to membrane; Biological process=transport
  Homolog annotation: Hit_ID=Q9FF46; Match level="QueryCoverage=99%, HitCoverage=43%, E-value=0.0, Identity=75%"; Hit description =Putative white-brown complex homolog protein 29
  Pfam annotation: Domain name=ABC_tran; Domain location=295-469; Score= 107.1; E_value=5e-29; Accession=PF00005.17; Description=ABC transporter
  Pfam annotation: Domain name=MobB; Domain location=296-405; Score= -40.6; E_value=0.099; Accession=PF03205.4; Description=Molybdopterin guanine dinucleotide synthesis protein B
  Pfam module annotation: Pfam domain module=ABC_tran::MobB; Domain location=295-469::296-405
YRYQLPPGKPNHTCGGADIWADIQSSGEVFCSAGSFCPSTIVKNPCNKGYYCRTGSTTQERCFKLASCEPKSSNQNITAYGVLVFAGLCFLLIIIYNCSDQVLATREKRQAKSRERAAQSVRESQAREKWKSAKDVAKKHAVGLQSQLSRTFSRKTSKKPDLKGAALPPVGTSKGKKKDKNNLSKIINDIEENPDSSEGFNVQIGDKNVKKQAPRGKQLHTQSQIFKYAYGQIEKEKALAEQNKNLTFSGVISMANDIEIRKRPTIEVAFKDLTLTLKGKNKHLLRCVTGKLHPGRVSAVMGPSGAGKTTFLSALTGKATGCHTTGQVLVNGKESSIRSYKKIIGFVPQDDIVHGNLTVEENLWFSARCRLSADLPKEEKVLVVERVIESLGLQAIRDSLVGTVEKRGISGGQRKRVNVGLEMVMEPSLLILDEPTSGLDSSSSQLLLRALRREALEGVNICMVLHQPR

SEQ ID NO: 165169 - protein, 131 aa, Glycine max
  Coding DNA Sequence Number=SeqID_48391
  Gene Ontology: Mol. function=protein serine/threonine kinase activity; Biological process=protein amino acid phosphorylation
  Homolog annotation: Hit_ID=Q2R4L1; Match level="QueryCoverage=51%, HitCoverage=10%, E-value=3e-15, Identity=52%"; Hit description =Protein kinase domain containing protein, expressed
  Pfam annotation: Domain name=DUF26; Domain location=55-108; Score =35.1; E_value=2.3e-07; Accession=PF01657.8; Description=Domain of unknown function DUF26
MDIVKINVISVSENATGFRVVGQQALMDASKLQHPKSKVFMQLLRHKWHLVVGAIYAVAQCVETTTETDCLKCMQVGYNNLHTCPPNTEGRAYDAGYFMRYSTTPYFADYQTIDIAPYFKQGTITIIPPFR

SEQ ID NO: 165170 - protein, 281 aa, Glycine max
  Coding DNA Sequence Number=SeqID_48392
  Homolog annotation: Hit_ID=Q1SQR0; Match level="QueryCoverage=20%, HitCoverage=7%, E-value=8e-22, Identity=82%"; Hit description =Esterase/lipase/thioesterase; Peptidase S9B, dipeptidylpeptidase IV N- terminal
MTPELGQEDSNTGTTFMVVDVVELSKEQLGSYMILSTMSRDEIMFYLRLRVCYMRLASRPQRITRPKELRSYNLLGPSVLAANGLDNGSLVQCRFSSRTKYGALHSLYELVLPSTSDWILNRHHTNIKIVKFDIRTGQRKNILVEENNSWINIHDCFTPLDKGVTKFSGGFSWANRERETHRERERERERKRYKQGYKNKDCSSGSASVVELVVALFCSFSQLICFEPTNVLQGQPVQILFFTLQNQNGAPGKGIFVGDCVHCEVEDLSNTIWAGSIAMEE

SEQ ID NO: 165171 - protein, 109 aa, Glycine max
  Coding DNA Sequence Number=SeqID_48393
TGDSTMVKISEKNNNVDAGDCMILDDHEGQEHCCGKGTNARSVSFLPRSQEKIGDSAKVVIKQDMKGGEHKYGFNYNKRDKPEKVRVVDAETGDKHELYEVLRMPSRCV

SEQ ID NO: 165172 - protein, 154 aa, Glycine max
  Coding DNA Sequence Number=SeqID_48394
QKHKPKRVESVNADAETFGDHWETSDCSMYSEAEALEHMKKRDRGHQSVSLENKTEDSTMVKISEKNNNVDAGDCMILDDHEGQEHCCGKGTNARSGGEHKYGFNNNKRENPEKVRVVDDETSDKHELYEVLRMTSRSVKTDASSFLLRAGGVL

SEQ ID NO: 165173 - protein, 275 aa, Glycine max
  Coding DNA Sequence Number=SeqID_48395
  Homolog annotation: Hit_ID=P35694; Match level="QueryCoverage=34%, HitCoverage=33%, E-value=8e-37, Identity=80%"; Hit description =Brassinosteroid-regulated protein BRU1 precursor
  Pfam annotation: Domain name=Glyco_hydro_16; Domain location=32-194; Score=-30.6; E_value=3e-05; Accession=PF00722.11; Description =Glycosyl hydrolases family 16
MAPSSAHNNGFYVLMLVGIVVSTMVATCAASFYQDFDLTWGGDRAKILNGGHLLSLSLAKVSASGFKSKKEYLFGRIDMQLKLIAGNSDGIVTTYYGKGNFTKEKKHRVVMMLELNMRYPSHVYFTKCAIHECGEGEEAQSCHDAQVRRTRCTSLDKTILRWRTDSFKVNGQQREQESLDGEEDSEKEKTTRRRRNIPRYGSEGEEAQSCHDARVRRKRCSSLDKTILRWRTDSFKEKKQRLVTMLECDEHDAQMQNRDLQGRRRLEKEEESAKA

SEQ ID NO: 165174 - protein, 131 aa, Glycine max
  Coding DNA Sequence Number=SeqID_48396
MPICMNSSSHNLSRDLANHNLNQKVTLRTGCKVQRDVYLGAYMNGPDNYLKGIINSALKRLDDTQQSKSKLTVRWIVVKCNRQKGSTECEYYVMHGMSTIILGNFKNNWEMYFTDARPLEPERLKALHIQW

SEQ ID NO: 165175 - protein, 129 aa, Glycine max
  Coding DNA Sequence Number=SeqID_48397
MFSKAWNTVQRNNKELRGSSNGVIGSYHKWLRVQTQGLDWLPKVKAARKEEAEAPEESEEVQALKAELERPRAVKEKFKSMTIKVRKEYDELRDVGHHQSLGMRNQEDPKGRTRSEQVPRSFMGQQQQA

SEQ ID NO: 165176 - protein, 97 aa, Glycine max
  Coding DNA Sequence Number=SeqID_48398
  Gene Ontology: Mol. function=RNA-directed DNA polymerase activity; Biological process=RNA-dependent DNA replication
MKPHHEETEIINLGVGEEKKKVKVDMPGLNPDIVQHRLPLNPKCSSVKQKLRRMKPEMFLKIKEEVKKKFDAGFLAVARYLEWVANIVPVPKKNGKV

SEQ ID NO: 165177 - protein, 94 aa, Glycine max
  Coding DNA Sequence Number=SeqID_48399
MVERESCREEEEEEEEGLFGWGGEDGSETEIVLVVFNVQDLDEKINGVRRKKRDGFWGNIYSGSHSHRKGFVGLWNREGSRLNSAAAAYGQIIV

SEQ ID NO: 165178 - protein, 56 aa, Glycine max
  Coding DNA Sequence Number=SeqID_48400
MDCQCRNLTVVNLDPERKRSGGLRTKQAGRGSCRGLCAQGIAGLMPFFGRSVAIIP

SEQ ID NO: 165179 - protein, 84 aa, Glycine max
  Coding DNA Sequence Number=SeqID_48401
MAEASKKHKGSSSRSQQHSEAQDTPIPSSISSSSLFSLEEQHIRYTNLFSSHSIIDPKFIDMDFFSDESFECIQAFQKSNLIPF

SEQ ID NO: 165180 - protein, 309 aa, Glycine max
  Coding DNA Sequence Number=SeqID_48402
  Gene Ontology: Mol. function=pyruvate kinase activity; Biological process=glycolysis
  Homolog annotation: Hit_ID=Q1S8N3; Match level="QueryCoverage=99%, HitCoverage=82%, E-value=5e-50, Identity=55%"; Hit description =Pyruvate kinase
  Pfam annotation: Domain name=PK; Domain location=66-292; Score= -212.3; E_value=0.00011; Accession=PF00224.11; Description=Pyruvate kinase, barrel domain
MPDSALSLSDRVGSSSRQKVKVLSVLDTLPPIAETMSSVMMERHGVRPEHGSVEHGGGLSHGKFGAKGNGRVIGPEQAVKLLQKVVAHILMGVGFEGAMEGSVEDFSEVLSGQICTEMQVVNKSERAISLEANGQVVLTPDQGQEASSEILPINFDGLAKNIATLVGSLFTLHASQIHIDLPTLTEKDQEVISSWGVKNKIDFLSLSYTRHAEDVHHAREFLSKLGDLSQTQIFAKIENVEAEKVFNQDLYFKRTVKYVGEPMTHLESIASSTVRAAIKVKASIIICFTSSGRAARLIAKYRPTMNYLL

SEQ ID NO: 165181 - protein, 101 aa, Glycine max
  Coding DNA Sequence Number=SeqID_48403
  Gene Ontology: Mol. function=iron-sulfur cluster binding; Biological process=electron transport
  Homolog annotation: Hit_ID=Q39881; Match level="QueryCoverage=80%, HitCoverage=71%, E-value=4e-09, Identity=50%"; Hit description =Nodulin 24
MLAMLLLISLSEVATSDLKEGEVVKVTNEQGDAKFVGGGGDLDDFMVICFPPPPPYGRGVYYKYVDNISQKKQADKCYCGCCWMIKSGDYRQCCQEYYWSP

SEQ ID NO: 165182 - protein, 170 aa, Glycine max
  Coding DNA Sequence Number=SeqID_48404
  Homolog annotation: Hit_ID=Q1S784; Match level="QueryCoverage=50%, HitCoverage=26%, E-value=2e-07, Identity=34%"; Hit description=Zinc finger, CCHC-type
MPRVGEVIRQEETLQDPIKKCLMSTWEDLDDTSSDEGEEEANLCSMVDTTSKEYESNQEDKELEKKLKGLQKDLKELNELHNHQSQERYDLWTEYAQAHKYYENLKIIESKRLSWYLDNGCSQQMTRERCIFQCLTPNHGGIVTFEGNQEIRITRVGLVNLLNTLGFMST

SEQ ID NO: 165183 - protein, 131 aa, Glycine max
  Coding DNA Sequence Number=SeqID_48405
MDLSLPLKKKNPSLSLYLFNINGFLVLGLFQGPNVLLQDSPHNFIHPTLQTITTTTRTTKGIAIDLNLMTEEFKSSSSENDNYSTTTQTNNNEGFLEKSVEVLEKIDNSNNINEVNNHVETTSFPCESVVL

SEQ ID NO: 165184 - protein, 146 aa, Glycine max
  Coding DNA Sequence Number=SeqID_48406
MGSDASIFSESGHKIHDLLEKRETKKDVGYVHYPSSIWTKQAWDGISNEGFNGFQHQCGSSYTERAIGKSLHFSFPNPSSVCAPCYRLCSGLSTNYSFSSAYAIAKYCSHTATNHIRRGDKILCWVVKQQLCLVVLEASIACRTLS

SEQ ID NO: 165185 - protein, 98 aa, Glycine max
  Coding DNA Sequence Number=SeqID_48407
  Gene Ontology: Mol. function=heat shock protein binding; Cellular component=integral to membrane; Biological process=protein folding
  Homolog annotation: Hit_ID=Q1SQA8; Match level="QueryCoverage=65%, HitCoverage=23%, E-value=2e-17, Identity=63%"; Hit description=Heat shock protein DnaJ, N-terminal
  Pfam annotation: Domain name=DnaJ; Domain location=40-98; Score=26.7; E_value=1.1e-05; Accession=PF00226.21; Description=DnaJ domain
MMISMLKPVSVLPLVGIDSSIGPSSMRKILSGGVSDRLALGLSVSGPLKLEDVKNAYRPCALKWHPDRHQGSSKAVAEEKFELCSAAYQSLCDSLALD

SEQ ID NO: 165186 - protein, 66 aa, Glycine max
  Coding DNA Sequence Number=SeqID_48408
MVDAFDASIHEEKDVIFIFIVALAGNGGQTIGTVTNTAPWIVTIAAIVALKGLLRALYSWEMARML

SEQ ID NO: 165187 - protein, 570 aa, Glycine max
  Coding DNA Sequence Number=SeqID_48409
  Gene Ontology: Mol. function=zinc ion binding; Cellular component =intracellular; Biological process=intracellular signaling cascade
  Homolog annotation: Hit_ID=Q9FNE5; Match level="QueryCoverage=88%, HitCoverage=85%, E-value=2e-66, Identity=33%"; Hit description=CHP -rich zinc finger protein-like
  Pfam annotation: Domain name=C1_1; Domain location=123-173; Score =0.4; E_value=0.024; Accession=PF00130.12; Description=Phorbol estersdiacylglycerol binding
  Pfam annotation: Domain name=C1_1; Domain location=6-60; Score=14.3; E_value=0.00056; Accession=PF00130.12; Description=Phorbol estersdiacylglycerol binding
  Pfam annotation: Domain name=C1_2; Domain location=195-222; Score =0.0; E_value=2.9; Accession=PF03107.7; Description=C1 domain
  Pfam annotation: Domain name=C1_2; Domain location=279-308; Score =27.0; E_value=6.6e-05; Accession=PF03107.7; Description=C1 domain
  Pfam annotation: Domain name=C1_2; Domain location=28-56; Score=13.7; E_value=0.088; Accession=PF03107.7; Description=C1 domain
  Pfam annotation: Domain name=C1_2; Domain location=336-363; Score =35.9; E_value=1.4e-07; Accession=PF03107.7; Description=C1 domain
  Pfam annotation: Domain name=C1_2; Domain location=444-473; Score =23.2; E_value=0.00092; Accession=PF03107.7; Description=C1 domain
  Pfam annotation: Domain name=C1_2; Domain location=85-112; Score =25.3; E_value=0.00022; Accession=PF03107.7; Description=C1 domain
  Pfam annotation: Domain name=C1_3; Domain location=134-163; Score =8.0; E_value=0.059; Accession=PF07649.3; Description=C1-like domain
  Pfam annotation: Domain name=C1_3; Domain location=194-222; Score =8.5; E_value=0.051; Accession=PF07649.3; Description=C1-like domain
  Pfam annotation: Domain name=C1_3; Domain location=27-56; Score=37.9; E_value=3.6e-08; Accession=PF07649.3; Description=C1-like domain
  Pfam annotation: Domain name=C1_3; Domain location=278-308; Score =34.1; E_value=4.9e-07; Accession=PF07649.3; Description=C1-like domain
  Pfam annotation: Domain name=C1_3; Domain location=335-363; Score =20.5; E_value=0.002; Accession=PF07649.3; Description=C1-like domain
  Pfam annotation: Domain name=C1_3; Domain location=387-415; Score =10.0; E_value=0.034; Accession=PF07649.3; Description=C1-like domain
  Pfam annotation: Domain name=C1_3; Domain location=443-473; Score =17.7; E_value=0.0042; Accession=PF07649.3; Description=C1-like domain
  Pfam annotation: Domain name=C1_3; Domain location=505-535; Score =4.4; E_value=0.15; Accession=PF07649.3; Description=C1-like domain
  Pfam annotation: Domain name=C1_3; Domain location=84-112; Score =25.5; E_value=0.00019; Accession=PF07649.3; Description=C1-like domain
  Pfam annotation: Domain name=PHD; Domain location=135-218; Score=1.9; E_value=0.037; Accession=PF00628.19; Description=PHD-finger
  Pfam annotation: Domain name=ZZ; Domain location=331-373; Score=4.7; E_value=0.06; Accession=PF00569.8; Description=Zinc finger, ZZ type
  Pfam annotation: Domain name=ZZ; Domain location=80-125; Score=8.7; E_ value=0.018; Accession=PF00569.8; Description=Zinc finger, ZZ type
  Pfam module annotation: Pfam domain module=C1_1::C1_1::C1_2::C1_2::C1_ 2::C1_2::C1_2::C1_2::C1_3::C1_3::C1_3::C1_3::C1_3::C1_3::C1_3::C1 _3::C1_3::PHD::ZZ::ZZ; Domain location=123-173::6-60::195-222::279 -308::28-56::...
  Pfam module annotation: Domain location=336-363::444-473::85-112::134- 163::194-222::27-56::278-308::335-363::387-415::443-473::505-535::84 -112::135-218::331-373::80-125
MEKMEHFSHIHPLLLKQEHSNNFNNQVLCSGCEELISSGPVFCCVQCNYVLHKKCAQIARHVKHPFHPQHPLVLLSTTPYEGPYVCDSCRGLFSNFVYHCYQCNYDLDVSCASQFNPDDGHKHEFLSLTNPQSFVCYACGMYANEGLACLCTVCQIWVHSGCAELPLAIRIKGHDHPLKLTYTLHHFYGFWGKLTCGFCNEAMNPAFAGYFCSTCKFAVHCPQQHLGEYEDKESFSGYETEEESLDIDFTFNFFGHEHLLKFTEELESNDDDVQCFDKLCDACVQPIMPPFFSCEEENCGFFLHQSCAELPRTKQHPFHKHPLTLQSKAPYDGIYKCDGCRRLGNGFVYRCDVCQFDLDVCCASLEERIEHESHKHPLFLKKTSVARQCKGCHLWSKLVFVCDVCEDFAIDCGCATLLSKAWHVYDKHPLSLNYCIEGDLREHECGICNEKMSKKQWFYCCDDCDSGAHPYCVAGKFRRMKFGGSFQYDVHSHPLALVEETEQKNECGACGEHCNGWTLECGQCKRYFHREGQCFWKEFKKSAKYLELSGMMRHRYAANVLASTPNATTK

SEQ ID NO: 165188 - protein, 36 aa, Glycine max
  Coding DNA Sequence Number=SeqID_48410
MAAKGMKEVLYLSLKLKLPLVQGAAAIEVKVVKVHR

SEQ ID NO: 165189 - protein, 437 aa, Glycine max
  Coding DNA Sequence Number=SeqID_48411
  Gene Ontology: Mol. function=zinc ion binding; Biological process =intracellular signaling cascade
  Homolog annotation: Hit_ID=Q9FM39; Match level="QueryCoverage=45%, HitCoverage=88%, E-value=2e-20, Identity=30%"; Hit description =Arabidopsis thaliana genomic DNA, chromosome 5, P1 clone:MNF13
  Pfam annotation: Domain name=C1_2; Domain location=144-174; Score =23.9; E_value=0.00055; Accession=PF03107.7; Description=C1 domain
  Pfam annotation: Domain name=C1_2; Domain location=33-62; Score=1.7; E_value=1.9; Accession=PF03107.7; Description=C1 domain
  Pfam annotation: Domain name=C1_2; Domain location=91-118; Score =21.3; E_value=0.0034; Accession=PF03107.7; Description=C1 domain
  Pfam annotation: Domain name=C1_3; Domain location=143-174; Score =31.7; E_value=2.6e-06; Accession=PF07649.3; Description=C1-like domain
  Pfam annotation: Domain name=C1_3; Domain location=32-62; Score=15.5; E_value=0.0076; Accession=PF07649.3; Description=C1-like domain
  Pfam annotation: Domain name=C1_3; Domain location=90-118; Score =12.9; E_value=0.016; Accession=PF07649.3; Description=C1-like domain
  Pfam annotation: Domain name=PHD; Domain location=91-151; Score=3.1; E_value=0.028; Accession=PF00628.19; Description=PHD-finger
  Pfam module annotation: Pfam domain module=C1_2::C1_2::C1_2::C1_3::C1_ 3::C1_3::PHD; Domain location=144-174::33-62::91-118::143-174::32 -62::90-118::91-151
MGSAHKDPNVFHFSHPHPLECTTPPSTGNNVIICFGCKLKVKHGEDYYECKTCAFSLHNVCYKMPLITNHPSHASHNLVLLAIPSTKATLNCVACGNHVTGFCYHCAECSIFFHSLCLALPVSLAITYHPHKIKLEFSAPYHFFCDLCNKPSYNNNGWLYRCNMCEFDTHIACAVENLEPHSFKNESFHQSSPLLRQLTSDHRVEHKRVSASVGDSCKGYDEYEIMRLVAQQIIGGGIRENSDSAVAGWDKRLYSIPWKKLNKTGSGKMKIISELELQEKELSPAQLLLKLEERTPLRDKSTPFSDHLGTPYSNQYSDSYFSIDLAKSYSNQHGHRSQVPREGGSDQITRDVTMPERVGVGQQNKVNNATFYIKEGRTSYFGKSSQRVVKKNPNESIAKSSVQDQTIAKSDSPPHPAYITSFLVDLARIASFDFISF

SEQ ID NO: 165190 - protein, 372 aa, Glycine max
  Coding DNA Sequence Number=SeqID_48412
  Homolog annotation: Hit_ID=P93743; Match level="QueryCoverage=35%, HitCoverage=33%, E-value=4e-22, Identity=47%"; Hit description =Expressed protein
  Pfam annotation: Domain name=WRC; Domain location=236-281; Score =70.6; E_value=4.9e-18; Accession=PF08879.1; Description=WRC
  Subcellular localization annotation: CTP_CleavageSite=48; ConfidenceScore=5.26e-01
MRIRKRPALFPSSLSPLRLSDPHLINRSPVVVQLSDATSTAPKLSFSSSAHHAAFAHPSTLDRFQPSDQPLPLIGKQSNGSDDPSGIGESGAHRQHNKQDPLDEVVRREESGEDSGEKGNHIRKGRTFDSEKTQAELLPPLSSSSTQDGRWYEGEKAIPLKKRRGNFEENNNNNNAAAHSKKMMKAKMKTKMNKKCSTPRNNEDSTGEEEVKKKVEETIKVEVNVVSKKRARGSALMEGSRCSRVNGRGWRCCQQTLVGYSLCEHHLGKGRLRSMTSVRSRSIIASTAPKEVHVHHVPHPSSSSPSFCSLEKQIECVDDAEPFGEKEEKKPGIIMTSTKKRMKLGMVKARSISSLLGQTSNHIAAVAHENSK

SEQ ID NO: 165191 - protein, 72 aa, Glycine max
  Coding DNA Sequence Number=SeqID_48413
MVMFDGDLGRGWLVTMVIQLQGWQCRSGGVLDVGGGAGVWVGMTSFCERKEKKSGRRREYTTRTNLTHISCL

SEQ ID NO: 165192 - protein, 32 aa, Glycine max
  Coding DNA Sequence Number=SeqID_48414
MDICLCVIGYPMNGVQRSWSVSHSYDEVYYKL

SEQ ID NO: 165193 - protein, 330 aa, Glycine max
  Coding DNA Sequence Number=SeqID_48415
  Gene Ontology: Mol. function=oxidoreductase activity; Cellular component=vacuole; Biological process=response to oxidative stress
  Homolog annotation: Hit_ID=Q9XFL6; Match level="QueryCoverage=93%, HitCoverage=93%, E-value=1e-132, Identity=74%"; Hit description =Peroxidase 5
  Pfam annotation: Domain name=peroxidase; Domain location=42-292; Score=491.4; E_value=1e-144; Accession=PF00141.13; Description =Peroxidase
  Subcellular localization annotation: CTP_CleavageSite=46; ConfidenceScore=5.65e-01
MFSFNYLFTTIFLVLTFFLYPSNAQLSSTFYSSTCPNVSSIVRSVVQQALQSDPRIAASLTRLHFHDCFVNGCDGSILLDVGGNITLSEKTAGPNNNSARGFDVVDNIKTSIENSCPGVVSCADILALAAEVSVSLGGGPSWNVLLGRRDGLIANQSGANTSIPNPTESLANVTAKFAAVGLNITDLVALSGAHSFGRAQCRFFNQRLFNFSGTGSPDPTLNTTYLATLQQNCPQNGSGNTLNNLDPSSPDTFDNNYFQNLLSNQGLLQTDQELFSTNGAATVSVVNNFAANQTAFFQAFAQSMINMGNISPLTGSQGEIRSDCKRVNGS

SEQ ID NO: 165194 - protein, 288 aa, Glycine max
  Coding DNA Sequence Number=SeqID_48416
  Gene Ontology: Mol. function=sequence-specific DNA binding; Cellular component=nucleus; Biological process=regulation of transcription, DNA-dependent
  Homolog annotation: Hit_ID=P46665; Match level="QueryCoverage=83%, HitCoverage=89%, E-value=1e-52, Identity=44%"; Hit description =Homeobox-leucine zipper protein HAT14
  Pfam annotation: Domain name=HALZ; Domain location=183-227; Score =84.4; E_value=3.5e-22; Accession=PF02183.8; Description=Homeobox associated leucine zipper
  Pfam annotation: Domain name=Homeobox; Domain location=128-182; Score= 62.8; E_value=1.1e-15; Accession=PF00046.19; Description=Homeobox domain
  Pfam module annotation: Pfam domain module=HALZ::Homeobox; Domain location=183-227::128-182
MELALSLGDTPKTVSLATKNDSVSLCIALADDKRGSSYPPVQLDLLPSTPVLPFSHSHLRIPWLSDALGMERVTSEIPVRVVDDTDDGAALSSPNSAVSSFQMDYCVRNNRKSSEGASDDDENGSSRKKLRLSKQQSAFLEDSFKEHTTLNPKQKLALAKQLNLRPRQVEVWFQNRRARTKLKQTEVDCEYLKRCCESLTEENRRLQKELQELRALKTCQPFFMQLPATTLTMCPACERVATNTATGAAAAAASTTTTNNNNASAPTNNNSVSQISAAMSVDKPRILP

SEQ ID NO: 165195 - protein, 77 aa, Glycine max
  Coding DNA Sequence Number=SeqID_48417
MEKCGTMPKLRQHETWVIVVQGRRGGASTQELRSIWIEIWCGRVDLYLQISHADEWLFGYWGSAEIEEVELPYLDLE

SEQ ID NO: 165196 - protein, 622 aa, Glycine max
  Coding DNA Sequence Number=SeqID_48418
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q69T67; Match level="QueryCoverage=64%, HitCoverage=46%, E-value=1e-150, Identity=62%"; Hit description =Lustrin A-like
  Pfam annotation: Domain name=DUF231; Domain location=444-608; Score =245.0; E_value=1.6e-70; Accession=PF03005.6; Description=Arabidopsis proteins of unknown function
  Subcellular localization annotation: CTP_CleavageSite=25; ConfidenceScore=5.57e-01
MADATKYVPIAGTNVSSILKTRKTVAAAYSFILAFVAFTVFLAFSPSSNASSPWFTNIFSPTSTTDGSYKPQIPNIFSLLFPNTTSPSNSSDPLHNNTHSFRSTNATSLSPYPKTALESQTLKQTSLENRTQTTLVNSTQHAVPVPTTNQTTDSHAPSLEVKSPPFLASKEPPGAVKNQTFNSDEAKSASTNQTTNATATATATNVSVSFPVQNVPNLNTSSNSSVKVDLVKGTVVSNDNYTASLARKQNNGKDHAKGNDESMESLMKCDFFDGEWVKDDAYPLYKPDSCSLIDEQFNCIRNGRPDKDYQKYKWKPKGCTLPRLDAHRMLQLLRGKRLVFVGDSLNRNMWESLICILRNAVKNKHNVYEVNGRVNFRGEAAYSFVFEDYHFSVELFVSPFLVQEGEMTDKNGTKKETLRLDLVGKSSSQYKDADILVFNTGHWWTHDKTSKGQDYYQEGNHVYSELNVLEAFRRALTTWSRWVDANINPSKTTVFFRGYSASHFSGGQWNSGGQCDSETDPIDNEKYLTEYPDKMKVLEKVLKNMKTRVTYQNITRMTDFRKDGHPSIYRKQNLSPEELKSPLRFQDCSHWCLPGVPDLWNEILYAELLLREYRNQHEQKKA

SEQ ID NO: 165197 - protein, 165 aa, Glycine max
  Coding DNA Sequence Number=SeqID_48419
MTTLTQTWMTLLLSNILPSDHNSDLPLPKCMAPTRHPLDPDKSNRALGFPALITGLCQSFGVPVAPSKVIRPPITRAFIEKYCTQRQAQGDAPQAAGAPPPPHQADPAGSFDTERYLWHSMRQHAANHRGLGQVHECLYHLSLNMQSQGFAPFPCPTPDQFRERR

SEQ ID NO: 165198 - protein, 328 aa, Glycine max
  Coding DNA Sequence Number=SeqID_48420
  Gene Ontology: Mol. function=methyltransferase activity; Cellular component=nucleus; Biological process=chromatin modification
  Homolog annotation: Hit_ID=Q7W2M3; Match level="QueryCoverage=53%, HitCoverage=55%, E-value=6e-59, Identity=62%"; Hit description =Putative membrane protein
RQHGATARRGAAEALVAFLQGLGDAAVQDQAVVVGEFGAARDVLQRDDVDALAVLAFLGLAVGLTGVVDPAGVVALVAAVDDAAGAEGEEEGVEGIVGVGGVATVGFLGADAGAAVLDDAGARGDLAGGEDAVAVQLGAAHDVPGLDGGVFGVGAASFLAYLHHDCPSASFRAGFVLCFARFDHSPHLQPHPGHYAAVVRGGVDVPPPMVLAHAPVGGAVLAVRAGAVGVHGVSQQRLLRPLVGSAQAMGRPDRAGPQPGARERGAAGGQYRQSGAGKAGAALHRLRLRAGGAAARPGCAGGRAALGAAGGTGYAGGQSQRAGCAAAG

SEQ ID NO: 165199 - protein, 96 aa, Glycine max
  Coding DNA Sequence Number=SeqID_48421
DFEPCLGYATEGQAVGDIPLQNTLEGPQYHPQPHPLHSTPGKNPHAMAEMGELDHRKERLRAIEGGEDYAFANLEELFLVPNIITPPKFKVPDYFP

SEQ ID NO: 165200 - protein, 51 aa, Glycine max
  Coding DNA Sequence Number=SeqID_48422
MEDRVTTDRSSSLPGAGQAENVAARQPKFVKQFTCEFMLDYCELTGCKGWA

SEQ ID NO: 165201 - protein, 227 aa, Glycine max
  Coding DNA Sequence Number=SeqID_48423
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=14%, E-value=9e-75, Identity=61%"; Hit description=Chromo
  Pfam annotation: Domain name=RnaseH; Domain location=83-204; Score= -32.4; E_value=0.06; Accession=PF00075.14; Description=RNase H
MDQEKVQAVLNWPYPINLKQLRGFLRLTGYYNKLIKGYASIATPLSNSLKKENVHWNDHASKAFDNLKAAITKAPVLALPDFSKAFTLETDASGIGIRAVLSQEQHPIAFFTKKFTPRMQRQSAYIRESYAITEAVAKFRHYLHGHRFVIKTDQRSLKSLTEQAIQTPEQQKWLHKLLGYDFSIENKLDNENLVADSLSRSFFMAWSEPKLKLIQLLKEAIQADSQL

SEQ ID NO: 165202 - protein, 124 aa, Glycine max
  Coding DNA Sequence Number=SeqID_48424
  Gene Ontology: Mol. function=protein binding; Biological process =defense response to fungus
  Homolog annotation: Hit_ID=Q1SWI6; Match level="QueryCoverage=72%, HitCoverage=44%, E-value=6e-23, Identity=51%"; Hit description =Leucine-rich repeat, plant specific
  Pfam annotation: Domain name=LRRNT_2; Domain location=27-67; Score =49.5; E_value=1.2e-11; Accession=PF08263.3; Description=Leucine rich repeat N-terminal domain
MNSSSIYILVFVQLWLLSLPCRESVCIPSERETLLKFKNNLIDPSNRLWSWNHNNTNCCHWYGVLCHNLTSHLLQLHLNSSDSIFNDDWEAYRRWSFGGEISPCLADLKHLNYLDLSANEYLGE

SEQ ID NO: 165203 - protein, 177 aa, Glycine max
  Coding DNA Sequence Number=SeqID_48425
TAKREEVEAPEEDEEVQALRIELEACREEHGRNKFRGALWGNNSELKLRREERDQSRVDSLILKDELKVCSRSKRNLSQRLCETETNMLAIITKYQEELNLAPAHEHRVADEYAQVYAEKEARGRVIDSLHQEATIWMDRFALTLNGSQELPRLLAKAKAMADTYSAPEEIHGLLGY

SEQ ID NO: 165204 - protein, 453 aa, Glycine max
  Coding DNA Sequence Number=SeqID_48426
  Gene Ontology: Mol. function=catalytic activity; Cellular component =glycerol-3-phosphate dehydrogenase complex; Biological process =metabolic process
  Homolog annotation: Hit_ID=Q2KU51; Match level="QueryCoverage=59%, HitCoverage=99%, E-value=1e-118, Identity=78%"; Hit description =Putative enoyl-CoA hydratase
MGRRAWPDPARRGAGRGRQPPLSERRVGPEVRRPPIAQRLHAFAHVRAAEPHEFQRQRRIEGRAGHAQPVVQRILGPADRGLRAGRQAVGDLEGAADQLGLVHAQRHQADTLGLFAAHGFAQHQVVLGARHAAQQRPDDGGMVAGGDAQAGVAVDDAGIARGDRDVGQQAGHQPRTHGGAVHRRHDRLAAIDDVVDQIARLAPDAGAHVEVLGHLLHQVQVATAREALALSADHHHPGVRVGIDIAPDVGQLAVHAVVGGGQLARLAVLGAHDQLQHAVGMAAQLEGLVGGIVFQRDIGRAFWGTIVDSPCPDDPGASAHEHPRLLLCRRDPPRRSARPVRRARPGHPQRQFRHRRRGRRRARHGRRGAAGRARRAQDRRGQGAGGLRPGRRAAALRSAATRTDAARRPLAAGHGLGRDRLGRRVRHRHRRDGRQRPVGTVRAAPRRAAGGIL

SEQ ID NO: 165205 - protein, 191 aa, Glycine max
  Coding DNA Sequence Number=SeqID_48427
  Gene Ontology: Mol. function=sequence-specific DNA binding; Cellular component=intracellular; Biological process=regulation of transcription, DNA-dependent
  Homolog annotation: Hit_ID=Q1BVE3; Match level="QueryCoverage=94%, HitCoverage=52%, E-value=3e-37, Identity=40%"; Hit description =Transcriptional regulator, AraC family
  Pfam annotation: Domain name=HTH_11; Domain location=82-131; Score =3.5; E_value=0.038; Accession=PF08279.2; Description=HTH domain
  Pfam annotation: Domain name=HTH_AraC; Domain location=134-178; Score= 41.6; E_value=2.8e-09; Accession=PF00165.13; Description=Bacterial regulatory helix-turn-helix proteins, araC family
  Pfam annotation: Domain name=HTH_AraC; Domain location=83-128; Score =10.6; E_value=0.17; Accession=PF00165.13; Description=Bacterial regulatory helix-turn-helix proteins, araC family
  Pfam module annotation: Pfam domain module=HTH_11::HTH_AraC::HTH _AraC; Domain location=82-131::134-178::83-128
MLQARYPQARLAKGKTLEEDDRVITSGGCFSWISLALYIIEKSAGKAVADLTREMSLADNPVLHTHLPGSPGMGKSSTPFLVRAQEIIRLENPAINAAQLAAALNVTGRTLQRRMKALSQETPKEFITRIRIELACTILASTDVSVRQTAMQCGYSEDTAFRKAFHQVMAMTPAQYREWIAHRKAQVISAK

SEQ ID NO: 165206 - protein, 125 aa, Glycine max
  Coding DNA Sequence Number=SeqID_48428
  Homolog annotation: Hit_ID=Q9AVH2; Match level="QueryCoverage=37%, HitCoverage=16%, E-value=3e-20, Identity=97%"; Hit description =Putative senescence-associated protein
MARHKAQGGGGAWSSVRPGTHLVSTRQAKRERADERILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 165207 - protein, 53 aa, Glycine max
  Coding DNA Sequence Number=SeqID_48429
MGMKVVTETTDRQKKDRSFFNTPGKLKTGSTPEKQMHLLNWKTVEESRLVNQR

SEQ ID NO: 165208 - protein, 206 aa, Glycine max
  Coding DNA Sequence Number=SeqID_48430
  Subcellular localization annotation: CTP_CleavageSite=31; ConfidenceScore=5.05e-01
MEEQLKKQKGSLSRSQRSFGSQDTPIPPSISSSTLFSSEEQRIRVGVPFEGTLDDDWKFDFSVSDACRLVYTNKADMTGRLLAGSLAFDCCILHYLIVRILLPRSSNLAQVPLDSEPSVQIKKSFSIGAAVVASFGYHKECDGSWVKKDAQQHDVEGCSPAREDSSLLQSVMDRFDSLQAYVGERFDSFESQVDIRFVPSPDIQSS

SEQ ID NO: 165209 - protein, 168 aa, Glycine max
  Coding DNA Sequence Number=SeqID_48431
MTLTIPELFLRPYQVTWDATVFGVFNPDFPLYIKHEDFSEITHGGLCLSISVLQLWILHLTETSMRAGNFDIYGFLEPQSIQRPDNYLKGIINSALKGLDDAPQSKSKAPARWIVVKCNRQKGSTECDYYVMHWMSTIILGSFRNNWEAYFNDPRPLEPERLKAQRIQ

SEQ ID NO: 165210 - protein, 39 aa, Glycine max
  Coding DNA Sequence Number=SeqID_48432
MAIMEATGLQMRVEMIGRKESLFPARATHKGCESPLIQP

SEQ ID NO: 165211 - protein, 147 aa, Glycine max
  Coding DNA Sequence Number=SeqID_48433
MQRRSVAGDLIPIDLEINATCRRQNAERIRIFLQDLEAVATPGEEPRSFEAFSSFPTQGQSHTRVKGDTIMAEQPRRMILEDYSNVIRLSLFSFSLSGEAKRWLHSFKGVKTWDEVVEKFLKTISLSLRLQKEKRPSLLFTNFEMNP

SEQ ID NO: 165212 - protein, 124 aa, Glycine max
  Coding DNA Sequence Number=SeqID_48434
MDGILISSVVLLADSRFTRPDMGFHPTKLNFVPSDADEAPLDVSICLHAFGIVGCGSFSGVKSCEREDPFHPGLFVGDAGGFQSPTREPLNVGGLVPPHCSLKSVVSDDACPGACFVQRDATTL

SEQ ID NO: 165213 - protein, 175 aa, Glycine max
  Coding DNA Sequence Number=SeqID_48435
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=74%, HitCoverage=30%, E-value=5e-70, Identity=98%"; Hit description =Photosystem II 44 kDa reaction center protein precursor
  Pfam annotation: Domain name=PSII; Domain location=1-173; Score= -133.3; E_value=0.00011; Accession=PF00421.9; Description=Photosystem II protein
MTTFGYHLSCSIVRLLVSALIGVYMIRGLRGAEIEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWPFMARGKSSRSCRRI

SEQ ID NO: 165214 - protein, 75 aa, Glycine max
  Coding DNA Sequence Number=SeqID_48436
MEQSSKGKGIAVEPESSPPIFVPMPSLSQSSDYDPENSTCLTPTKRISCQQTSSDFDSDEHTQYQLSNNKHIKAE

SEQ ID NO: 165215 - protein, 37 aa, Glycine max
  Coding DNA Sequence Number=SeqID_48437
MSPPSRPYIMNDKDIGANKRVQEWRRVDTQDVAKDIM

SEQ ID NO: 165216 - protein, 63 aa, Glycine max
  Coding DNA Sequence Number=SeqID_48438
ETTESTQRAFKSVVIQVGKLAEEVTKVMARREENFVVVEAQEESPVEEHDSREKDEEEMEEEA

SEQ ID NO: 165217 - protein, 66 aa, Glycine max
  Coding DNA Sequence Number=SeqID_48439
NRPMAYTHIPVKVENPDLAPYTSEPYNAQWNAPGLLRDKHTLRSSRILGEMEVVFVIGSAVDRLCG

SEQ ID NO: 165218 - protein, 93 aa, Glycine max
  Coding DNA Sequence Number=SeqID_48440
MKNDEERWKAFAKSPTETSQKRYGSASAWIFFTKTIFLTNFKGKEGGGCRPAHPGELGCFHQKAPPSVGTSYKAQVGLIAICTPLFTKYTPSP

SEQ ID NO: 165219 - protein, 137 aa, Glycine max
  Coding DNA Sequence Number=SeqID_48441
MTDLVSAEDDVNLRVSTGLSAAIDEGRRRRHSKKVYTDNHSGISARQRDSKVSMTDLVSAEDDVNLRVATGLSAAIDEGRRRRHSKKVYTDNHSGISSRQRDSKVSMTDLVSAEDDVNLRVSTGLSVAIDEGRRRRR

SEQ ID NO: 165220 - protein, 35 aa, Glycine max
  Coding DNA Sequence Number=SeqID_48442
MRGSSIPPGDPAGSSPAWASGQSLGHATLAANYSG

SEQ ID NO: 165221 - protein, 51 aa, Glycine max
  Coding DNA Sequence Number=SeqID_48443
MPSRSDDESLEGTNTWDPTIDFKQEAGQMESEEDEDVGLPPELEKIVTQKD

SEQ ID NO: 165222 - protein, 68 aa, Glycine max
  Coding DNA Sequence Number=SeqID_48444
MSGFTRDSPQISASPHQLDLAPYASGPYNAQWNAPGILHDKHTLRSSRILGEIEVVFVIGSAVGRLCG

SEQ ID NO: 165223 - protein, 150 aa, Glycine max
  Coding DNA Sequence Number=SeqID_48445
MGEVEEVQERMKADMEAMKEQMDTMMEAMMSMKKIMEVYAAVVSATSTVAVVDRNPLSGLNQINPLALDMIAQGGKELGSTGGPHFVPIQNKHVFPPYGLPPNYTPPNVAHTPDENVNNSTPILIESQQPQSDHAMSLNMREAHEIPHTI

SEQ ID NO: 165224 - protein, 216 aa, Glycine max
  Coding DNA Sequence Number=SeqID_48446
GVVKGFCLANLPGDAFSLWGNFFEQRTMMADAKFAGCLVSHCLSFSMCPVVGFGPWLGLGKPLVEILPPGQLRGFCPLLAWLGSAVLGYGPVLSFGLVGPLLPPVISFVARILPTLACAPLAKSVPRWWIIMQNEREPTNGSLFWPNIVEEERDTGLIGEGRIKATRAESQWIVAARPLCHLQYPVAYLSRLQRILPAARWELRFKASRRANPPHE

SEQ ID NO: 165225 - protein, 205 aa, Glycine max
  Coding DNA Sequence Number=SeqID_48447
VASGGAHGDMTPAEARNLIEKMASNSQQFSARSDAIIIRGVHEVATNSSGETKKLEGKLDALVNLVTQLAMNQKSAPVARLCGLCSSADHYTDLCPSEAIEQPEAYAANIYNRPPQPQQQNQPQQNNYDLSSNRYNLGWRNHPNLRWSNPSQQQQQQQPYFQNATGPSRPYVPPPIQQQQQLQPRNSKHPQPSLEELVRQMTMPN

SEQ ID NO: 165226 - protein, 225 aa, Glycine max
  Coding DNA Sequence Number=SeqID_48448
  Gene Ontology: Cellular component=flagellin-based flagellum; Biological process=flagellum biogenesis
  Homolog annotation: Hit_ID=Q7WJA5; Match level="QueryCoverage=59%, HitCoverage=95%, E-value=6e-47, Identity=71%"; Hit description =Flagellar protein FliS
MAGWICVSGPSGLRYASRSVDGGLPSLGQVRQQAVGDIELLGIRFQICRQQGADDVIVEPGEVGGDVAAGLHVQPGLQAFIDDLDRFRDSRAALGDPTFLQVDARLPDRCPGTQVQQGDQPLGARAQHLGFQADIGVGADGLGPCGAAGGVVGGGLHLHVELVQRHETRAHLVDFRVAGGLGALLLGVQVAHRLGQAVGARLQRTGAAQHVLEGGFEVLGQAVFA

SEQ ID NO: 165227 - protein, 170 aa, Glycine max
  Coding DNA Sequence Number=SeqID_48449
  Gene Ontology: Mol. function=transcription factor activity; Cellular component=integral to membrane; Biological process=regulation of transcription, DNA-dependent
  Homolog annotation: Hit_ID=Q6DB44; Match level="QueryCoverage=98%, HitCoverage=98%, E-value=1e-64, Identity=73%"; Hit description=ECF -family RNA polymerase sigma factor
  Pfam annotation: Domain name=Sigma70_ECF; Domain location=5-170; Score=-89.1; E_value=0.093; Accession=PF07638.2; Description=ECF sigma factor
  Pfam annotation: Domain name=Sigma70_r2; Domain location=16-82; Score= 51.6; E_value=2.6e-12; Accession=PF04542.4; Description=Sigma-70 region 2
  Pfam annotation: Domain name=Sigma70_r4; Domain location=117-166; Score=18.7; E_value=0.0067; Accession=PF04545.6; Description=Sigma -70, region 4
  Pfam annotation: Domain name=Sigma70_r4_2; Domain location=111-164; Score=59.7; E_value=9.7e-15; Accession=PF08281.2; Description=Sigma -70, region 4
  Pfam module annotation: Pfam domain module=Sigma70_ECF::Sigma70 _r2::Sigma70_r4::Sigma70_r4_2; Domain location=5-170::16-82::117 -166::111-164
MARKEAAAANGFAQQLYLEHHSWLCHWLRQKVGCAHHAEDLAQDTFISILLSPQLLAIRQPRPFLATVARRLVANYYRRKTIEESYLQALSELPAIEAPSPEVRQQTLEMLEQLDQALDGLPAHVREAFLLAHLQGMRYCDIAERLRVSTSSVKQYLQRANLHCFFALAA

SEQ ID NO: 165228 - protein, 75 aa, Glycine max
  Coding DNA Sequence Number=SeqID_48450
  Homolog annotation: Hit_ID=Q6DB45; Match level="QueryCoverage=83%, HitCoverage=7%, E-value=4e-22, Identity=73%"; Hit description =Putative TonB-dependent heme receptor
IVTGRQRSDGVVWALPKTSGYALHGLFASWQPAVCRASKARVAVDNLFNRDYYPYLGESVSGVGRNIKFSVSQRF

SEQ ID NO: 165229 - protein, 82 aa, Glycine max
  Coding DNA Sequence Number=SeqID_48451
MLKNGRESSRNYSRKRYGSASAWIFFTEIIFLSNIERIRSAKKGRSLPPSSPRRTQLAQASQVASSRSNSLLEEESGRPKWA

SEQ ID NO: 165230 - protein, 70 aa, Glycine max
  Coding DNA Sequence Number=SeqID_48452
MNLGIPRSCGSACHQTLGSRISFLNDHIKEILGPTKIGENHSKCINLTQRVARKSLAHRILSAIKGRGPL

SEQ ID NO: 165231 - protein, 37 aa, Glycine max
  Coding DNA Sequence Number=SeqID_48453
MALYPGSWEHKEWSMFFEGDDTSRNHQERYDYLGGYH

SEQ ID NO: 165232 - protein, 74 aa, Glycine max
  Coding DNA Sequence Number=SeqID_48454
MTKLGLFLSSGPPPLDDKRVRITVRMTKLGLCLSSGPPPLDDKKVRITVRYLRVSWVQNDQTWSLLVIGPAAFG

SEQ ID NO: 165233 - protein, 84 aa, Glycine max
  Coding DNA Sequence Number=SeqID_48455
MGANNHKVSPRIMGISAYHGCRMTKLGLCVPSDTTVSEWQRGADNRKVSPRISAYHGCRMTKLGLCVPSDTTVSEWQRGADNHK

SEQ ID NO: 165234 - protein, 209 aa, Glycine max
  Coding DNA Sequence Number=SeqID_48456
MAFLGETRSQTVVNSTLGNQFRFQCMQLKDDADVNTMLMCNHEFSFVGPIELLCSIARNPDDILNLLEATMTPTYDALLYYNGRWNMSRQNEFVGYSFTGKNPKNFDIPIGCTMDELNDLIKQVAPHGIPPYGIDETQMIRRLFFRKPSHHEYSEKVIKFEIIELKTNEDVMKVLIESNYWKKIGPIEILAVFSKPIPQMEDELSLSQN

SEQ ID NO: 165235 - protein, 193 aa, Glycine max
  Coding DNA Sequence Number=SeqID_48457
  Gene Ontology: Mol. function=phosphoenolpyruvate carboxylase activity; Biological process=carbon utilization by fixation of carbon dioxide
  Homolog annotation: Hit_ID=Q6Q2Z9; Match level="QueryCoverage=47%, HitCoverage=8%, E-value=3e-37, Identity=85%"; Hit description =Phosphoenolpyruvate carboxylase
LSFSSTFLQQLCGSGVLADGRLADLIRRVATFGMVLMKLDLRQESSRHAETIDAITRYLDMGTYSEWDEEKKLDFLTRELKGKRPLVPPSIESFQGVVDFLAQELFNQNASIILHTYTITLQKKMREKERERGRETERGRERRRVTDRDRRNERWSETDTARTSVKQYRNTARTSTNRRTPNGSPSRRWRSMD

SEQ ID NO: 165236 - protein, 102 aa, Glycine max
  Coding DNA Sequence Number=SeqID_48458
MSNEELKLQDPRCRIQCPDILPENTGVAAQCISQDKMSNEALKLQDPRCRIRYFQENDRSHPAQAVAAQKRTLLYNHGGCTSSVPSPGLKSYFVSFWDLSVL

SEQ ID NO: 165237 - protein, 125 aa, Glycine max
  Coding DNA Sequence Number=SeqID_48459
MGDQEETQEQMKADMSALKEQMASMMEVMLGMRQLMEKNVATAVAVSSAAEANPTLLATVHHPPSIFVEPSVSSKWSKSLAFVRRPTISAILTLGSCDMRKFPSGYPYKLSFAISKTQSMIACSD

SEQ ID NO: 165238 - protein, 269 aa, Glycine max
  Coding DNA Sequence Number=SeqID_48460
KDAAAEGTSAAPEFDSHHFRSAEHQQHFEAIKGCLPALDVAGHAHGGGRAGHAVMEKEPGDGFDEEAIAQLLCIPGQDFARTVVGRQVWIMRTSMTTLTQMWMTLLLSNVLPSDHNFDLPLPKCQLVYAILTRMSVHVAQLIADAIYLFVGMPPTRHPLDPDKSNRALGFPALITGLCQSFGVPVAPSKVIRPPITRAFIEKYCTPRQAQGDAPQAVDAPPPPHQADPAGSFDTERYLRHSVRQQAANHRKQVQVHECLYQLSLSLQSQ

SEQ ID NO: 165239 - protein, 54 aa, Glycine max
  Coding DNA Sequence Number=SeqID_48461
MQLSARSMSDERAGTDSVPFIIQEQRVEWNNKLGGKRAEIDSAPFIIQEQRVKW

SEQ ID NO: 165240 - protein, 120 aa, Glycine max
  Coding DNA Sequence Number=SeqID_48462
  Homolog annotation: Hit_ID=Q9LW42; Match level="QueryCoverage=95%, HitCoverage=7%, E-value=3e-17, Identity=44%"; Hit description =Helicase-like protein
MWYNERISKDKTCATPSQHSGIQPDIVSRLSHMLDEHNAHAKSFRMARDRLTDGQVNNIKLKLIADREKDGCVYNIPNVPEVVALIVGDFDPSSKRDIIVETQNGQLQRIHELHSSYLAL

SEQ ID NO: 165241 - protein, 192 aa, Glycine max
  Coding DNA Sequence Number=SeqID_48463
  Gene Ontology: Mol. function=chitin binding; Cellular component =extracellular region; Biological process=chitin metabolic process
  Homolog annotation: Hit_ID=UPI00006A17C9; Match level="QueryCoverage =72%, HitCoverage=100%, E-value=1e-14, Identity=27%"; Hit description= UPI00006A17C9 related cluster
  Subcellular localization annotation: CTP_CleavageSite=27; ConfidenceScore=5.12e-01
MIDPLDESISCFLIRRTTCPRLQRTTRLSSVKGSCTFTFVGLHALTFRGPHALAFRGLHVLTFRGLHVLTFRGLHVLTFRGLHVLTFRGPHALAFRGLHVLTFRGLHVLTFRGLTSSPLEDYTSSPSEDYMSPIFKGGHALTFRGLHILAIIGLHSLAFKRRHVLNFKGLHALTIRGLRVLTLSGPHIHTLR

SEQ ID NO: 165242 - protein, 47 aa, Glycine max
  Coding DNA Sequence Number=SeqID_48464
MSEVVRMLEGDGLAEKWEASQSAESTRNGGEDFCGKCPSGSFNMFEE

SEQ ID NO: 165243 - protein, 205 aa, Glycine max
  Coding DNA Sequence Number=SeqID_48465
  Gene Ontology: Mol. function=nucleoside-triphosphatase activity; Cellular component=integral to membrane; Biological process=transport
  Homolog annotation: Hit_ID=Q9FF46; Match level="QueryCoverage=90%, HitCoverage=16%, E-value=1e-74, Identity=70%"; Hit description =Putative white-brown complex homolog protein 29
MLSSNNALLSALLSKIAALRSFSLDKLHYWRESSSGMSSLAYFLSKDTVDHFSTIIKPLVYLSMFYFFNNPRSSVTDNYMVLLCLVYCVTGIAYVLAIFLQPGPAQLWSVLLPVVLTLVATYSSEKDSKYIKFLSDLCYTKWALEAFVISNAKRYTGVWLLSRCGALYTNGYDLKHWYQCLGLLIVTGIISRMLAFFCMITFQKK

SEQ ID NO: 165244 - protein, 91 aa, Glycine max
  Coding DNA Sequence Number=SeqID_48466
MERNPTCKGRRRKVVVWHHEEGVGVARWRTRLLSSWEGEGGGVMWNTRSHVKEELLRREYTYEVSVVAEFKCLLMAVRKAHCFIRVGAINA

SEQ ID NO: 165245 - protein, 103 aa, Glycine max
  Coding DNA Sequence Number=SeqID_48467
MILKEVFNLEVSIRLPHTKPLRLGSEATKYYRYHHDQTITKQEQDLQDTQRSKIGTRKHTEEEQKTKVDKDTNNSDINTTSIRIGTRPAHQRCNQHHCWRHFL

SEQ ID NO: 165246 - protein, 227 aa, Glycine max
  Coding DNA Sequence Number=SeqID_48468
  Gene Ontology: Mol. function=RNA-directed DNA polymerase activity; Biological process=RNA-dependent DNA replication
MKFPTLTSEIVTVKVDQKQVRQCYVVSLKVAPYPSIRELVMLDSRRSMGREFDIDSRDDTSDRGLKPIEELVQLQLGPKSGKCTRLNWDLTNHEHRCIPDVLHRNADLFTWSLSDMSGIHPDIIYHKLAICPRPNLYHRRKGKPERSGVKSSKKKSKSSSMQTSSERACPKDAYPLHNTDRLVDGASRYNHIRMHPPDEEKMKFITENANFCYRVIPFNLKNVGVTY

SEQ ID NO: 165247 - protein, 404 aa, Glycine max
  Coding DNA Sequence Number=SeqID_48469
MDQEVISISGSSSKDTCRGLRTELVGVLLALTEGHDFLLMPGSQSWYYDAFRGARRASGEKDVRMSPRVRPSMCGGSSSSPSGVADYEWVKDDGLKYKSCLTTTASVAALQHQVKLVNPEGSCPMDHFSLDHLLVCSVGALECGPFLAPPKQLDNGMASPTSRSTSNLIPPAILSLPLVSNPLAALDGIMGDFAWRPFVKQVGPVGETVPSFAATPFAREGGWMMFLDWKKSKAPMSVRALRQAAGLGPTAGYLTTTQDVPPAPPVVKAPPTAAATLTTFAPSPPLVAMVQEVSPTIVEAIVLAAQAESVVVSSSTVAAPLLSAGVATTSAPTVLLLSSLASVVMPIVVFEDMASPSSSLRPRISLDHLYTSSDADSMWGTLSTSKALNAKHRLNGNNTLSGRK

SEQ ID NO: 165248 - protein, 87 aa, Glycine max
  Coding DNA Sequence Number=SeqID_48470
MYIKYGPKYIMKHSQQNKLVVSFKTRKGKQGSKGLSKELIQGKSIWLEAYKNKIASIISKYACELGSINKNQAKAIVQAINGAKHTK

SEQ ID NO: 165249 - protein, 70 aa, Glycine max
  Coding DNA Sequence Number=SeqID_48471
EYVSSVEGGQLGMVGFMCDLWMWRVDLHHRPIATYGTWRYVAGGQETLGTSGGVLLAKTKLDQSRPNPGI

SEQ ID NO: 165250 - protein, 185 aa, Glycine max
  Coding DNA Sequence Number=SeqID_48472
  Gene Ontology: Mol. function=nucleotide binding; Cellular component =intracellular; Biological process=cellular process
  Homolog annotation: Hit_ID=Q6ZJ99; Match level="QueryCoverage=99%, HitCoverage=40%, E-value=4e-62, Identity=64%"; Hit description =Putative GTP-binding protein ERG
  Pfam annotation: Domain name=KH_2; Domain location=135-183; Score =7.9; E_value=0.014; Accession=PF07650.7; Description=KH domain
MGARSIPNQRRILCMNKIDLVEKKKDLLKVAEEFKDLPGYERYFMISGLKGSGVKDLTQYLMEQACIFLLLLSTRFQRPWEEDPFTMSEEVMKMIALEVVRERLLDHVHQEIPYDVEHRLIDWKELRDGSLRIEQHFITNKLSQCKILVGKNGSKIGRIGIEANEELRSIFKKQVHLILRVRHKK

SEQ ID NO: 165251 - protein, 66 aa, Glycine max
  Coding DNA Sequence Number=SeqID_48473
MEVPSIIYTVSQDDEAEETREIEPQQENSASELAKVFLASDKANPAQSRNVIHVSPFKFSFLHKHV

SEQ ID NO: 165252 - protein, 614 aa, Glycine max
  Coding DNA Sequence Number=SeqID_48474
  Gene Ontology: Mol. function=methyltransferase activity; Cellular component=nucleus; Biological process=mRNA editing
  Homolog annotation: Hit_ID=Q9C866; Match level="QueryCoverage=87%, HitCoverage=91%, E-value=0.0, Identity=46%"; Hit description=PPR -repeat protein
  Pfam annotation: Domain name=PPR; Domain location=175-209; Score =35.0; E_value=2.6e-07; Accession=PF01535.11; Description=PPR repeat
  Pfam annotation: Domain name=PPR; Domain location=245-279; Score =14.9; E_value=0.13; Accession=PF01535.11; Description=PPR repeat
  Pfam annotation: Domain name=PPR; Domain location=307-341; Score =43.1; E_value=9.5e-10; Accession=PF01535.11; Description=PPR repeat
  Pfam annotation: Domain name=PPR; Domain location=342-376; Score=8.1; E_value=0.83; Accession=PF01535.11; Description=PPR repeat
  Pfam annotation: Domain name=PPR; Domain location=408-442; Score =46.0; E_value=1.3e-10; Accession=PF01535.11; Description=PPR repeat
  Pfam annotation: Domain name=PPR; Domain location=443-477; Score =18.4; E_value=0.026; Accession=PF01535.11; Description=PPR repeat
  Pfam annotation: Domain name=PPR; Domain location=479-513; Score =15.4; E_value=0.11; Accession=PF01535.11; Description=PPR repeat
  Pfam annotation: Domain name=PPR; Domain location=548-582; Score =11.2; E_value=0.35; Accession=PF01535.11; Description=PPR repeat
  Pfam annotation: Domain name=PPR; Domain location=74-108; Score=38.0; E_value=3.2e-08; Accession=PF01535.11; Description=PPR repeat
  Pfam module annotation: Pfam domain module=PPR::PPR::PPR::PPR::PPR::PP R::PPR::PPR::PPR; Domain location=175-209::245-279::307-341::342 -376::408-442::443-477::479-513::548-582::74-108
MQCSKLMKGTYISLLKSCKSMSQLKQIQAHIFCVGLQQDRDTLNKLMAFSMDSSLGDFNYANRIFNYIHDPSLFIYNLMIKAFVKSGSFRSAISLFQQLREHGVWPDNYTYPYVLKGIGCIGEVREGEKVHAFVVKTGLEFDPYVCNSFMDMYAELGLVEGFTQVFEEMPDRDAVSWNIMISGYVRCKRFEEAVDVYRRMWTESNEKPNEATVVSTLSACAVLRNLELGKEIHDYIASELDLTTIMGNALLDMYCKCGHVSVAREIFDAMTVKNVNCWTSMVTGYVICGQLDQARNLFERSPSRDIVLWTAMINGYVQFNRFEETIALFGEMQIRGVKPDKFIVVTLLTGCAQSGALEQGKWIHNYIDENRIKVDAVVGTALIEMYAKCGCIEKSFEIFNGLKEKDTTSWTSIICGLAMNGKPSEALELFKAMQTCGLKPDDITFVAVLSACSHAGLVEEGRKLFHSMSSMYHIEPNLEHYGCFIDLLGRAGLLQEAEELVKKLPAQNNEIIVPLYGALLSACRTYGNIDMGERLATALAKVKSSDSSLHTLLASIYASADRWEDVRKVRNKMKDLGIKKVPGYSAIEVDGKWQQRLSEGPFPFPDKNWSSCRG

SEQ ID NO: 165253 - protein, 61 aa, Glycine max
  Coding DNA Sequence Number=SeqID_48475
MVHGSPKLPVTNQSAPSAPQSPRMMRYELKEGGKCGLNDAVKVPTYRVAGCVGEVFVGPSD

SEQ ID NO: 165254 - protein, 127 aa, Glycine max
  Coding DNA Sequence Number=SeqID_48476
MECVKFMKNTNALQEELILNGIREPASNVGLGDGFNGEDQFGFYDVKENMGIDDGINDVVETENDVSEDDANEGSDVSKDVAAPKAHKKLSATDILEIDTFRKVGIRPSQMMGDGSLLVGLLWRLDL

SEQ ID NO: 165255 - protein, 64 aa, Glycine max
  Coding DNA Sequence Number=SeqID_48477
MAPNLIEAVPESNKHENAGELPGNHITSETSKRVGLRPQKETTPENLAFHGFKQKMQLKHEAET

SEQ ID NO: 165256 - protein, 260 aa, Glycine max
  Coding DNA Sequence Number=SeqID_48478
  Gene Ontology: Mol. function=nucleoside-triphosphatase activity; Cellular component=membrane; Biological process=cobalt ion transport
  Homolog annotation: Hit_ID=UPI0000526CAD; Match level="QueryCoverage =100%, HitCoverage=73%, E-value=1e-103, Identity=60%"; Hit description=ABC transporter related
  Pfam annotation: Domain name=ABC_tran; Domain location=1-88; Score =18.4; E_value=4e-09; Accession=PF00005.17; Description=ABC transporter
MDAFRTPPADAAIAPLSGGEKRRVALAKMLLQKPDLLLLDEPTNHLDAESVLWLEQHLQAYKGTVIAITHDRYFLDHVAEWIAEVDRGRLIGYEGNYSTYLEKKGERLEIQGKKDAKLAKRLKEELEWVRSSAKGRQTKSKARLARYEEMASEAERTRKLDFEEIQIPAGPRLGNVVIEAKNLQKGFDGRSLIDGLSFSLPPNGIVGVIGPNGVGKTTLFKTIVGLEPLDGGTLKIGETVKISYVDQSRANIDPNKTLWE

SEQ ID NO: 165257 - protein, 1725 aa, Glycine max
  Coding DNA Sequence Number=SeqID_48479
  Gene Ontology: Mol. function=RNA-directed DNA polymerase activity; Cellular component=chromatin; Biological process=chromatin assembly or disassembly
  Homolog annotation: Hit_ID=Q108V0; Match level="QueryCoverage=90%, HitCoverage=99%, E-value=0.0, Identity=38%"; Hit description =Expressed protein
LIGVSVAGLEPEFQPVVNYLLPNILSHKQDPHDIHLQLLQDMTSRLLVFLPQLETDLSSFPDSPESNLRFLAMLAGPLYPILHVVNERTTSKPPGNITDLDVSKSSQLSPTLTVSSNFEASRIMQKLINPDTEQDVSKPQDEVTSPLEDKSNSELSSSFTLVDYSNLLGEEFQMPYEQCDCSYLNILDIGAVEEGTLHVLYSCASQPVLCSKLAERSSDFWAALPLVQALLPALRPWVSNSFDVVDDTFSQWKQPIVQQALSQIVATATSAAYRSLVHACAGYLSSYSPSHARAACVLIDLCSGVLAPCMTQVIAKVDLALELLEDLLGIIHDAHNSLVRARAALKYIVLALSGHMDDILGKYKEVKHKILFLVEMLEPFLDPAIAVSKSKIAFGDLASLFPEKQEHNCTIALNIIHTAVRKPAVLPCLESEWRHGSVAPSVLLSILEPHMLLPPDVDLCKSVLRPTDHETASISPLSSGISGGGDFSKSNGQDESIGKTDVSETAGKSDFVEDRNLLFAPPELQSMTLTDFSNIPNQNSSVSNIGDMSLEPKHVAEKHASHHFPTSILDAGLGFEYFNLQADYFQLLNYNDCELRASEFRRLALDLHSHNDVSVESHDAAIDALLLAAECYVNPYFMLSIGASSKLTDLLNVNEFKAVQSHDKVKAAELDRKYHLQVSNGEDEAYSAEGFDEQGDQISMHEILLQSLVYILHTGTKLYCPPEHVIDIILKYAEDLNKLLASFHHQLKEGEEQTFGTNVQNNYLCGNLIPSSAWMQRISHFSGSSYPLVRFLGWMAISHNAKQYMKDRIFLASDLSHLTYLLSIFADDLAVVDGVVDKKYEEVKIEDSRLEHSSSAKREFERGNQCDEERSFCAIYPELWKFFPNMKRQFKSFGEAILEAVGLQLRSVSSILVPDVLCWFSELCLWPFSFASSIGSDNLKGYNAKNARAIILYILEAIIVEHMEAMVPETPKLVQVLVSLSSSTYCDVSFLDSVLRLLKPIISYSLSKISHDEKLLDGDSCLNFEELCFNILFMKLKQKSEFEHSSEDKEYNTALPIFILASIFPDLSIRYRREFLQSLLKPANFAAFAPTTSFFDYLSAFQCVMDNCKLLLVNALTEFGVIPLRLPPYPHANGAGLSDDNLKPNPWFLSDVCCTSCENDVHNVESNNSDVGHCHLPSDDLEGFCKDIEGLILELNPAIERCWNLHHQISRKLTIAFAECFVFSKCLTSVSQKFHKAEDDDQNSSPTKSSDIFTLHWRFGLQGLCELIVMLQESSCWEVSCLMLDCLLGVPDSFCLDGVVGIICSTIKNVSCSAPRISWRLQIDKWLSSLISRGIYNSQESEVSLIDLFCTLLAHAEPEQRIVAVKHLGILLGQCTNGERAEMNSKICTDFIRNKLVLSIPNYVLSRLVSSTWDEVVVLASSDLSLQIRIHAMALLSNYIPFAEHHHLQSFLVAADSICCLCNAQPSQEGPILQLSLALIAYACLYSPAEDISLIPQKVWENVETLGSTKHDGKLGDLAKKTCQVLCRLRDEGDEAKEALKEVLSQNSSKQYDPDFSNTRQSVVQVLGNLTAVHSYFDLFSRKIDQDDMELEEAELELDIIQKEHALQGRMEDSKDWNQIPGLPSYKKDVSRLQQIRECIRSLEKSKLKEDIIARRQKKLLMRHARQKHLEEASLREADLLQELDRERTAEMEKELERQRLLEIERAKTKELRHNLDMEKERQTQ

SEQ ID NO: 165258 - protein, 82 aa, Glycine max
  Coding DNA Sequence Number=SeqID_48480
MGFGGKMCDVGILDGEGICEEVLGAFSVRDDYVALHEERVGSHQVEVMKHFGNSRVQHKACFLIWRIIGKNHKYTVLTVIVK

SEQ ID NO: 165259 - protein, 84 aa, Glycine max
  Coding DNA Sequence Number=SeqID_48481
MSSKYTLRFMRILWPSPASQFGSIFLESSIQCPWGVGLHQIGSQRQQGGGQEGGKEQILIENGGQGESAYGRGLRGKPGERDEE

SEQ ID NO: 165260 - protein, 214 aa, Glycine max
  Coding DNA Sequence Number=SeqID_48482
  Gene Ontology: Mol. function=RNA-directed DNA polymerase activity; Biological process=RNA-dependent DNA replication
MAEGLCGMMREAVKKNLYQSNKVGDNEMQVNLLQYADDTIYLGESTFDNVVVIKSILRCFELIFGLKVNIFKSNFRAIGVGERWWKGVNFFKGLLWSEVSKSKYGGWKGLLCEECLSSSSMWWRDLREVSGAKSESRWFEKFIEWKVGDGEKTKFWFDNWVGDQPLGISFPRLFLNSNKKIYIVANMGGWEFEWRICSFKRRGGRLMEVVAGGY

SEQ ID NO: 165261 - protein, 171 aa, Glycine max
  Coding DNA Sequence Number=SeqID_48483
  Gene Ontology: Mol. function=RNA-directed DNA polymerase activity; Cellular component=nucleus; Biological process=RNA-dependent DNA replication
  Homolog annotation: Hit_ID=Q1SFJ7; Match level="QueryCoverage=70%, HitCoverage=13%, E-value=2e-23, Identity=47%"; Hit description=RNA -directed DNA polymerase
MNELERKVNHGELGEEERNRKLSLQEELWKIVRHNESLARQKVRARWVVEVEYHEHGILPRGSNASFISIIPKFEWPINLGDFRPISLVGCMYKILAKILSTMLKKVLGGVMDQRQSEFFGGRHLLHRALVVNEVIEEAKKKKKKCLVLKVDYEKRMIREIGNFFCTSYKD

SEQ ID NO: 165262 - protein, 68 aa, Glycine max
  Coding DNA Sequence Number=SeqID_48484
MMRRNCLAKQELIFTNKILNLRDDELVMLHGVTEDLHQRECLTIQLHACRDKNSSMRKEELSELLNGS

SEQ ID NO: 165263 - protein, 147 aa, Glycine max
  Coding DNA Sequence Number=SeqID_48485
  Gene Ontology: Mol. function=RNA-directed DNA polymerase activity; Biological process=RNA-dependent DNA replication
MFGNIFRKKCQLEACIKGIHTKLDNGSSSSLIALEKHLQDQYNQILHQEEMLKYQKSREKWVRFVDHAISTGHINKGLAETLIVPIPMVDNPITFRDFRPINLCNVLLKVVSKVIVNRVGPFLDNIIGSLQSSFIPGRSTSVSAIIA

SEQ ID NO: 165264 - protein, 195 aa, Glycine max
  Coding DNA Sequence Number=SeqID_48486
  Gene Ontology: Mol. function=RNA-directed DNA polymerase activity; Cellular component=chromatin; Biological process=RNA-dependent DNA replication
MGSSYCREEALIRLTNQNVYLGESMNYMTLKIDELIQRLGPTLSTLSPTSSPLPPPSPGPVVTHRMKLEGPRFDGTEPLSWIFMINQFFEYHGTPEQDKLTIASFYMEGQALTWFQWMNTIGQFTSWLVFLKALCTRFAPSQYDDPTRAFCKLTQKGTVAQYLSEFEDLANRIIGLPSPFLLSCFISGLAPEIRR

SEQ ID NO: 165265 - protein, 171 aa, Glycine max
  Coding DNA Sequence Number=SeqID_48487
  Homolog annotation: Hit_ID=Q1S319; Match level="QueryCoverage=61%, HitCoverage=6%, E-value=4e-32, Identity=62%"; Hit description=RNA polymerase Rpb1, domain 5
MKMVMVVVLKMQKVMKILVQMHKRKQQETDEIAQKIAKKVCIHNFGKVGECKAITCKENGVIYYDEDGSKRNCIPTSMKEKRLALKTSRVHFKEFLELQDDLDVWYIFSNNVHAMLKAYLVEATSKFIVKATCNISNFQLLGGSHTDISCGDTLLNILVGQNPPPVRTLYR

SEQ ID NO: 165266 - protein, 86 aa, Glycine max
  Coding DNA Sequence Number=SeqID_48488
  Gene Ontology: Mol. function=nucleic acid binding
  Homolog annotation: Hit_ID=Q10KX7; Match level="QueryCoverage=96%, HitCoverage=60%, E-value=1e-09, Identity=36%"; Hit description=OB -fold nucleic acid binding domain containing protein, expressed
  Subcellular localization annotation: CTP_CleavageSite=55; ConfidenceScore=5.55e-01
MSDTVTYTAPLKQLSLPLTLATVPSLMSEAKRVVRPTERELASLSQSKQGTQPMSSFMTKRRNQSCFNSCNVIVPMISMCEIRIPL

SEQ ID NO: 165267 - protein, 79 aa, Glycine max
  Coding DNA Sequence Number=SeqID_48489
  Gene Ontology: Cellular component=protein complex
  Homolog annotation: Hit_ID=Q076B1; Match level="QueryCoverage=65%, HitCoverage=14%, E-value=2e-11, Identity=67%"; Hit description=RPN9
MGCRSGGICVDLVILEQITSSPWNNFLFMMYYGLVIEDFETKINLLKLAHFAVIISRQYSEKEASVGYLGRVIRKLQDI

SEQ ID NO: 165268 - protein, 105 aa, Glycine max
  Coding DNA Sequence Number=SeqID_48490
MALSEKAMGPGSKLTSFETNVFAMESNTNTIPCVCYGLGTTKVDCTAHAFLLGMPWPSSCANVHGYVASFTSHMGQVSVRHSLLCEDVPFYIPKNGLHLALASLS

SEQ ID NO: 165269 - protein, 1043 aa, Glycine max
  Coding DNA Sequence Number=SeqID_48491
  Gene Ontology: Mol. function=RNA-directed DNA polymerase activity; Cellular component=chromatin; Biological process=chromatin assembly or disassembly
  Pfam annotation: Domain name=RVP_2; Domain location=334-453; Score= -56.0; E_value=0.023; Accession=PF08284.2; Description=Retroviral aspartyl protease
  Pfam annotation: Domain name=RnaseH; Domain location=825-946; Score= -33.6; E_value=0.078; Accession=PF00075.14; Description=RNase H
  Pfam module annotation: Pfam domain module=RVP_2::RVT_1::Retrotrans _gag::RnaseH; Domain location=334-453::567-736::105-195::825-946
MADHATRKTTTDRLEEAIVRLTNSHTAINDRYNDLSGKVDAILEHLRLHDSANHTPSTPTNLPKHSRSAVKIDIPRFDGRDPLGWIFKITQLFQYQNTPEDERITVASLYLDGAALSWYQWMFNNGLITSWNGFLEALESRFAPTFYEDPKGALFKLTQRGTVNEYLTEFERLANRVTGLPPPFLLSCFVSGLNPELKREVMALQPISLLQATALAKLQEEKLRDRANLAPRNFPPYKTSSIPPPSSVGKPKSSFVQRTPAEMAFRREKGLCYNCDEKWGAGHRCKGKVMLFIADEQPTLPDSENLEVEDDRVPAITSHEALRGDVDCSHISLHALAGVPSSETFRIYGSIKNAKLTILVDSGSTHNFLQPRIAQFLHLPTAATHPLRVMVGNGEMLTSDQVCLETPLVLQGNPFIVSFHLLPISGADAVLDIDLAEAIGPNRDISLRADVAIGPEPASATQLKRLIQTGSTSEFYQLHVISPNQPDPPDFPHHIQSIELLLQRYAHLFQPPTRLPPPRQVVHRITLQPSTAPVSVRPYRYPYFQKNEIEQQVSDLLSAGLIRPSTSPYSSPVLLVKKKDGTWRLCVDYRALNSNTVRDRFPIPTIEELLDELGCASWFSKLDLWQGFHQILMEEHDVEKTAFRTHNGHFEYLVMPFGLCNAPSTFQSAMNRLLQPFLRRFATVFFDDILIYSDSLSSHIQHLETVFRTLQQNEFFLKRSKCLFAQESIEYLGHIVFGKGVKPEPSKIQAMVRWPTPSTAKELRAFLGLTGFYRKFIKNYAAMASPLTKLLCTDAFQWTPESQIAFDKLKTAMTSAPVLALPNFSDPFVIETDAFGTTIGAVLMQHGHPLAYFSKNLGPRLLHASTYIRELHAIVAAIRRWRQYLLGRPFTILTDHKSIRELMTQVIQTPEQHYYLSKLLRYDYSIQYKPGASNVVADALSRTPATDGELLILSIPQLDFLQDIKHSLTTNLEFQTLAKAIQNDPTSHSDYTLCDGLILFKGRIWLNNGNPSIPSLLLEHHATPLGGHLGITKTIHRITASFF

SEQ ID NO: 165270 - protein, 987 aa, Glycine max
  Coding DNA Sequence Number=SeqID_48492
  Gene Ontology: Mol. function=transferase activity, transferring phosphorus-containing groups; Cellular component=membrane; Biological process=two-component signal transduction system (phosphorelay)
  Homolog annotation: Hit_ID=Q1SE10; Match level="QueryCoverage=99%, HitCoverage=99%, E-value=0.0, Identity=81%"; Hit description=CHASE; Lantibiotic regulatory protein
  Pfam annotation: Domain name=CHASE; Domain location=108-320; Score =305.8; E_value=7.7e-89; Accession=PF03924.4; Description=CHASE domain
  Pfam annotation: Domain name=HATPase_c; Domain location=493-677; Score=125.3; E_value=1.7e-34; Accession=PF02518.16; Description =Histidine kinase-, DNA gyrase B-, and HSP90-like ATPase
  Pfam annotation: Domain name=HisKA; Domain location=381-446; Score =94.1; E_value=4.3e-25; Accession=PF00512.15; Description=His Kinase A (phosphoacceptor) domain
  Pfam annotation: Domain name=Response_reg; Domain location=852-976; Score=101.2; E_value=3.2e-27; Accession=PF00072.14; Description =Response regulator receiver domain
  Pfam module annotation: Pfam domain module=CHASE::HATPase _c::HisKA::Response_reg; Domain location=108-320::493-677::381 -446::852-976
MGLSLKMQSHHPVALRLHDQMGSKRKYTFIQAHRAWLPKFLLLWILLMALISWCIYSKMDDDTKVRRKEVLGSLCDQRARMLQDQFSVSVNHVHALAILVSTFHYYRYPSAIDQETFAEYTARTAFERPLLSGVAYAQRVVNSERERFEKEHGWVIKTMERKSSLVRDEYAPVIFAQETVSYLESLDMMSGEEDRENILRARATGKAVLTSPFSLLGSHHLGVVLTFPVYKSKLPQKPTVEERIEATAGYVGGSFDVESLVKNLLGQLDGNQAILVNVYDITNYTNPLVMYGNLYEEGDMSLVHESKLDFGDPYRKHQMICRYHQKAPTNWIALTTAFLFFVILFLVGYILYGAGNHIVKVEDDFHAMEELKVRAEAADIAKSQFLATVSHEIRTPMNGILGMLALLLDTELSSTQRDYAQTAQACGKALITLINEVLDRAKIEAGKLELEAVPFDLRSIIDDVLSLFSEKSRHKGLELAVFVSDKVPDIVMGDPGRFRQIITNLVGNSVKFTEQGHIFVKVHLADNRKSIMNGKHDTFLNGESDEVFHISGDYHFKTLSGCEAADERNSWDNFKHLIADEEYGLDSSRETMAACESSEQVTLRVCVEDTGIGIPFSAQDGIFMPFVQADSSTSRNYGGTGIGLSISKCLVELMGGQINFISRPQVGSTFSFTAVCEAFKKSSVTNKKKNLEDLPSSFRGMKVIVVDGKPVRAAVTRYHLKRLGILVKVANRISKAVALCGKSGSLKSGMFQPDIIMVEKDTWITGEDGIFNTWKHNGRTIKMPKMILLATNISNAEFDKAKFTGFTDTVIMKPLRASMVAACLQQVLGMGKKRQLGKDMPNGFLHSLLYGKKILVVDDNGVNRRVAAGALKKFGADVKCAESGKVALEMLQLPHNFDACFMDIQMPEMDGFEATSRIRMMESKANEEMNGSEWHVPILAMTADVILATYDKCVKCGMDGYVSKPFEEENLYQEVAKFFKSKTISDS

SEQ ID NO: 165271 - protein, 70 aa, Glycine max
  Coding DNA Sequence Number=SeqID_48493
  Gene Ontology: Mol. function=transferase activity, transferring glycosyl groups; Biological process=metabolic process
  Homolog annotation: Hit_ID=Q9LXV0; Match level="QueryCoverage=85%, HitCoverage=12%, E-value=3e-09, Identity=52%"; Hit description =Glucosyltransferase-like protein
MAIGGKSLETKCEDIVAKIELVMDETEKGDMMRKKVGDVRDMIRDVVKDENGYKGSSVRTMDEFLSTVES

SEQ ID NO: 165272 - protein, 127 aa, Glycine max
  Coding DNA Sequence Number=SeqID_48494
MMTSLPQRHTHRDGTPPSYDGSSFPALPPMMAPPVKPFRKYILYLVEKGIPESTILAYGRTILKAKIIIWNSLSIIHFVSSGETNPELKIGMFFHGEELSWRRREEQEKRGSELALDTRKRRGRGET

SEQ ID NO: 165273 - protein, 138 aa, Glycine max
  Coding DNA Sequence Number=SeqID_48495
MLTSLPLGVKVWVVDNITWDSLLDLGPKREGGKENYMEFSASDDGGGDEREERGPLLKLYVFEIILDNKGNATGGKSIGDKEPTKARQNLLTKWLRKRMKLVSFDLTLHSFDGQAILRDIFIWLPAPLYWSYVLRMKV

SEQ ID NO: 165274 - protein, 463 aa, Glycine max
  Coding DNA Sequence Number=SeqID_48496
  Gene Ontology: Mol. function=methyltransferase activity; Biological process=metabolic process
  Homolog annotation: Hit_ID=Q1SW51; Match level="QueryCoverage=80%, HitCoverage=84%, E-value=9e-68, Identity=36%"; Hit description =Generic methyltransferase
  Pfam annotation: Domain name=Methyltransf_11; Domain location=318 -413; Score=13.1; E_value=0.0028; Accession=PF08241.2; Description =Methyltransferase domain
  Pfam annotation: Domain name=Methyltransf_12; Domain location=318 -411; Score=14.8; E_value=0.022; Accession=PF08242.2; Description =Methyltransferase domain
  Pfam module annotation: Pfam domain module=Methyltransf _11::Methyltransf_12; Domain location=318-413::318-411
MGRSCFPKCKLARIMGWIQIILGGLVILVSLLSLTRFYSAGFFLHNEDICQHFYNLRDVSDGFDVKSFSDRVGEVIDMLEALQAKLESKVQEMEKNKGTMLDKKFLEDQIVSPLHSANVALRQIRVPKVDEGTNSTVKEDHLINFFIIEEIRKYITPKENRVGKINLYGADKVYNTIGHACVLYKKELEKYMDYDIGSYCDDDWNLAQKLMLNGCDPLPRRRCLTRASKEYQKPHPINESLWRLPDGRNVRWGNYQCRNFECLSSKNPKRGYSKCIGCFQMEKEKLKWVTNNNNNSLVVDFLISDVLAIKQGEVRIGLDYGIGTGTFAARMREQNVTIVSTALNLGAPFNEMIALRGLVPLYVTLNQRLPFFDNTMDLVHTTGFMDGWIDLLLLDFILYDWDRILRPGGLLWIDRFFCNRNDLDDYMYMFLQLRYKKHKWVISPKSKEEVYLSALLEKPPRAI

SEQ ID NO: 165275 - protein, 95 aa, Glycine max
  Coding DNA Sequence Number=SeqID_48497
MAHRSKLKVVKVVPNYSSKSPALESKSPSIVEEFRGMGVQGEVTRDSEGRGSQSEGELGMEINEEKALQRNLEFEDELDEKFGGGTQNREIGNEI

SEQ ID NO: 165276 - protein, 208 aa, Glycine max
  Coding DNA Sequence Number=SeqID_48498
  Gene Ontology: Mol. function=phosphotransferase activity, for other substituted phosphate groups; Cellular component=membrane; Biological process=phospholipid biosynthetic process
  Homolog annotation: Hit_ID=Q39810; Match level="QueryCoverage=88%, HitCoverage=46%, E-value=6e-96, Identity=89%"; Hit description =Aminoalcoholphosphotransferase
  Pfam annotation: Domain name=CDP-OH_P_transf; Domain location=38-171; Score=80.4; E_value=5.6e-21; Accession=PF01066.11; Description=CDP -alcohol phosphatidyltransferase
MITLMGFMFLLVSALLGYIYSPQLDTPPPRWVHFAHGLLLFLYQTFDAVDGKQARRTNSSSPLGELFDHGCDALACTFEALAFGSTAMCGRNTFWWWLISAITFYGATWEHYFTNTLILPVINGPTEGLMIIYICHFFTAIVGAEWWVQQFGKSLPFLNWLPYLAANVKLVDIPNMDLVYCLKRGFKKEFGENNKILFFPSSLRTLRN

SEQ ID NO: 165277 - protein, 118 aa, Glycine max
  Coding DNA Sequence Number=SeqID_48499
  Gene Ontology: Mol. function=phosphotransferase activity, for other substituted phosphate groups; Cellular component=membrane; Biological process=phospholipid biosynthetic process
  Homolog annotation: Hit_ID=Q39810; Match level="QueryCoverage=75%, HitCoverage=23%, E-value=5e-42, Identity=92%"; Hit description =Aminoalcoholphosphotransferase
AVVLNLFDGQHYLFVPYSVSNVYKVVKAKNGSMPLALAMLYPFVVLVGGVLVWDYLSPLDIMGRYPHLVVIGTGLTFGYLVGRMILAHLCDEPKGLKTGMCMMLDLAAVPHYKTLKTQ

SEQ ID NO: 165278 - protein, 291 aa, Glycine max
  Coding DNA Sequence Number=SeqID_48500
  Gene Ontology: Mol. function=DNA binding; Cellular component=nuclear origin of replication recognition complex; Biological process=DNA replication
  Homolog annotation: Hit_ID=Q6L3N4; Match level="QueryCoverage=96%, HitCoverage=97%, E-value=1e-87, Identity=57%"; Hit description =Probable origin recognition complex subunit 6, putative
  Pfam annotation: Domain name=ORC6_1; Domain location=3-152; Score =299.8; E_value=4.9e-87; Accession=PF05460.4; Description=Origin recognition complex subunit 6 (
MDVSELAKKLGLSDSKLLVRKAAELRRLCDVQFDSSVIGVGEVAKSLICLEIAATRLGVLFDRSSAVRLSGMSERAYIRSYNSLHNGLGVKMKLDVRELAIQFGCVRIIPFVRDGLKLYKDRFVSSLPASRRASADFTRPVFTAVAFYLCAKKHKLKVDKLKLIELCGTSESEFSSVSAVSVSATMKDLCHDVFGVAKEKKDPKEVQSNRDLLDVLPSKRKAEDGGYSSEDGPELSSYKKAKKMEKHDYEKWKSSVLSSNKQNKKAPCKRTRQTSLNFLKEPSDNQELEAI

SEQ ID NO: 165279 - protein, 139 aa, Glycine max
  Coding DNA Sequence Number=SeqID_48501
  Homolog annotation: Hit_ID=Q5EAE9; Match level="QueryCoverage=43%, HitCoverage=16%, E-value=2e-14, Identity=54%"; Hit description=RING -H2 finger protein ATL5C precursor
MASQTIEAKTRLHGWWCRSPKGKTSALTGREGSPAIVEMQARVSRGVCGLVVGRAFYVSSLLLLHGSRGHFLGRGSKAFPPKSSTTEQRSGMRVFESGPGEAGDSKVSTEAFVRLGWGKEKQQRSSNRVGGGRRHLEGH

SEQ ID NO: 165280 - protein, 92 aa, Glycine max
  Coding DNA Sequence Number=SeqID_48502
MLKLLAGFVTLQALGKKISCDRVSDGVGYYRGALAQGLCGCVRRGSELWALWDHRNDAGFDRLRWGTCFECVAVLVDTESVLDPDTAAKHNF

SEQ ID NO: 165281 - protein, 215 aa, Glycine max
  Coding DNA Sequence Number=SeqID_48503
  Homolog annotation: Hit_ID=Q9FLX1; Match level="QueryCoverage=93%, HitCoverage=95%, E-value=7e-08, Identity=26%"; Hit description =Arabidopsis thaliana genomic DNA, chromosome 5, P1 clone:MXC20
MEPPSSVPLASESFSYSWLSNCNKSPPTYSSYGGTSEEEFNFSVKKSCEEFNFNFDISVPHSPLVLVPADEIFSDGLLRPMFVDPSKVEFCNTPDPTQTKLSSSFSSRTFSQRAMEIHHGLLTKWRKSTRRTFVDFFRYVNQLRQRVGRSRKSIRVDDIDKTDWQVKCLTSPQKGSSPKPTIAATGIGDLHDHENSIYEAVLHCKRSIDQGYPKQ

SEQ ID NO: 165282 - protein, 673 aa, Glycine max
  Coding DNA Sequence Number=SeqID_48504
  Gene Ontology: Mol. function=protein binding; Cellular component =nucleus; Biological process=cell cycle
  Homolog annotation: Hit_ID=Q1SBK0; Match level="QueryCoverage=99%, HitCoverage=92%, E-value=0.0, Identity=81%"; Hit description=Cullin family
  Pfam annotation: Domain name=Cullin; Domain location=1-574; Score =744.5; E_value=6.8e-221; Accession=PF00888.12; Description=Cullin family
MVLLNFGERLYSGLVATMTAHLKEIARSIEATQEGSFLEEMNRKWNSHNKELQLIGDILMYMDRTYVPKNGKISVHELGLKLWRENVICSNQIRTRLLNTLLEMVCSERAGEVINRGLFRNITKMLMDLGPSVVYGEEFETHFLQVSAEFYQLESQKFIECCACGDYLKKAESCLKEEMDRVSHYLDPSTEKKITDVVAKEMIENHMLTLIHMENSGLVSMLCEDKYEDLGRMYNLFCRVTDGLAKILEVMTSHIRESGKKLVTDPERLKDPVEFVQRLLDEKHKYDKIINFAFNDDKLFQNAFKSSFEYFINLNPRSPEFISLFVDDKLRKGLEGVREDDAEIALDKAMMLFRYLREKDMFEKYYNLHMAKRLLSGKTVSDDAERSLIVRLKTECGYQFTSKLEGMLTDMKTSLETMQGFYASHPELSDSPTLTVQVLTSGFWPTQSTVICNLPAELSALCKKFRSYYLDTHTDGRLSWQTHMGTADIKATFGKVRKHELNVSTYQMCVLMLFNTADRLGYKEIEQATEIPASDLKRCLQSLALVKGRNVLRKEPMSKDVDEDDAFFVNDKFSSNLYRVKIGTVVAQNESEPEKLETRRQQVEEEGRRSQIEAVIVRIMKSRKKLDHSNLMAEVTEQFHANPTEVKKRIESLVDRDFMERDDNDRQLYRYLA

SEQ ID NO: 165283 - protein, 210 aa, Glycine max
  Coding DNA Sequence Number=SeqID_48505
  Gene Ontology: Mol. function=amino acid-polyamine transporter activity; Cellular component=integral to membrane; Biological process=amino acid transport
  Homolog annotation: Hit_ID=P0AAE5; Match level="QueryCoverage=62%, HitCoverage=28%, E-value=5e-43, Identity=68%"; Hit description =Putative arginine/ornithine antiporter
MAAVAGPAALLIGWLITGVGILFLSLAMLLLTRLRPELDGGIFTYARAGFGELTGFCSAWGYWLCAVIANVSYLVIVFSALSFFTDTPDRIVFGDGNTWQAMLGASVLLWLVHWLVLRGVQTAASINLLATLGKLVPLLLRGGGLRPRAAQKRCRACDAAGGAGRAAGLSAGNAAVAWRGAACGTGADAQSVDGRSDGTAAGSLGRCGDC

SEQ ID NO: 165284 - protein, 155 aa, Glycine max
  Coding DNA Sequence Number=SeqID_48506
  Homolog annotation: Hit_ID=Q5E4Q7; Match level="QueryCoverage=64%, HitCoverage=78%, E-value=7e-15, Identity=41%"; Hit description =Transporter
MYTVKCAIITGAFWRKVRNRTENRRSARVSDKELASAGYSDRICFNYSDFLSASCKKRWSFVDAIYGVMPIFGMVTRKSGHSLQASDDHLKELALQIISTQVSDEINIARLITLAEQQHISRFDIQLPYPLSAEQLDAIHLEYRKPLNLTQQNDL

SEQ ID NO: 165285 - protein, 205 aa, Glycine max
  Coding DNA Sequence Number=SeqID_48507
  Gene Ontology: Mol. function=triacylglycerol lipase activity; Biological process=lipid metabolic process
  Homolog annotation: Hit_ID=Q1SH82; Match level="QueryCoverage=67%, HitCoverage=43%, E-value=5e-55, Identity=55%"; Hit description =Lipase, class 3
  Pfam annotation: Domain name=Lipase_3; Domain location=90-185; Score =23.7; E_value=7e-06; Accession=PF01764.16; Description=Lipase (class 3)
LTVGKLGLCDLDLVNPTGIERVLTEKDLLADSYSDLEASILDEKEFLLLKDEDEDELDLKDIWEKEQYQEKTTTQVLIALYKHEDRHTYVVAFRGTEPFEADAWCTDLDISWYGIPGVGRMHGGFMKALGLQKNVGWPKEIERHSMGGALGILFGTILCLHNETLLLERFVYCNDLVPRLPYDDKEMMFKHFGTCLFFNRHYEFE

SEQ ID NO: 165286 - protein, 242 aa, Glycine max
  Coding DNA Sequence Number=SeqID_48508
  Homolog annotation: Hit_ID=O80516; Match level="QueryCoverage=26%, HitCoverage=24%, E-value=1e-14, Identity=62%"; Hit description =Expressed protein
MNQRLHVHYSNFPMACATAKLRGCDRGLLDTTVLHSFASQHMVHHLHGIYSFAMVQMVRNQQNQLHSFASRHKFLEDHLRMQHEGWVSDVRRHKDQISQMNGMLTSEEKKRSLEAAKADFAMGLKHTEAAMLKWILGGGGECLVLVLVLGVRFLKVLLFYNVSIIAKYDPKSDLLDHEFMLKGKWFQQKDMEKSFQDLLRKQEGDRSVWEYPFVFAGVNITFMLIQMLDLEAVTTDHYLSDG

SEQ ID NO: 165287 - protein, 141 aa, Glycine max
  Coding DNA Sequence Number=SeqID_48509
MAKFGTPSSVGMFATVGDADGVDVGTEDGTRASIEEGDGVDVSTGDGPLASIEDGNSLTSIKGRDGVGTTFENLISIDTIDGDEIDDDRLSLGGSSLNAYNFFFPLVPFLLESCDRGQDYQGLLLQHYLLNLTIQKYFQLQ

SEQ ID NO: 165288 - protein, 120 aa, Glycine max
  Coding DNA Sequence Number=SeqID_48510
MTPLDLAELRTRCWVAITRLKRKGHLYDTGDLAHTYKCGYDSFMQHIEGSSSHVQDLAKINRLREELRQSKEEIHQHLNQQQQQDNDQLDDQQQQYNDQLDDQQQNDDQQRHSTNEYLDY

SEQ ID NO: 165289 - protein, 166 aa, Glycine max
  Coding DNA Sequence Number=SeqID_48511
  Gene Ontology: Mol. function=nucleic acid binding
  Homolog annotation: Hit_ID=Q1SKA8; Match level="QueryCoverage=80%, HitCoverage=52%, E-value=2e-10, Identity=32%"; Hit description=Zinc finger, CCHC-type
  Pfam annotation: Domain name=zf-CCHC; Domain location=95-112; Score =14.5; E_value=0.004; Accession=PF00098.13; Description=Zinc knuckle
MSLATLFGKLQEHEMELMRLHQHEENDKKRKEITLRALSSSIQEESDKKDLTDIEEDDDFRFFVKRFNRYMRNKRNQRKSNINPKKKGEDSSLPPKCYECDQPEHMRFDYPVFKRRMEKSDKRNFKEKKAYITWEDNDTNSSSDSENKIINLGLMVKDYESGEEQS

SEQ ID NO: 165290 - protein, 125 aa, Glycine max
  Coding DNA Sequence Number=SeqID_48512
MTLHLLCTTFLTGWMDSTPSSVNALTRWIAVLKPWMHDLQGWTHISPNLRRMLALFDCHHQKGGDYGSNAFQDYFDDAKESRVKQVSRFKNNQDQDSSKESRLKIQESREDSIKISIKRVFRNIE

SEQ ID NO: 165291 - protein, 90 aa, Glycine max
  Coding DNA Sequence Number=SeqID_48513
MGLKMLKFTTMQLVDEKYVKGSTLIAHIKSTEGYTTTYRKAWLAKQKAIKVYWSSCHEPMICPDPDKKRNSKGRPVGASQTIQRKITPTV

SEQ ID NO: 165292 - protein, 101 aa, Glycine max
  Coding DNA Sequence Number=SeqID_48514
  Homolog annotation: Hit_ID=Q9AVH2; Match level="QueryCoverage=45%, HitCoverage=16%, E-value=3e-20, Identity=97%"; Hit description =Putative senescence-associated protein
STLEDPTSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 165293 - protein, 198 aa, Glycine max
  Coding DNA Sequence Number=SeqID_48515
  Gene Ontology: Mol. function=guanyl-nucleotide exchange factor activity; Cellular component=nucleoplasm; Biological process =nucleocytoplasmic transport
  Homolog annotation: Hit_ID=Q5RJU9; Match level="QueryCoverage=76%, HitCoverage=70%, E-value=4e-20, Identity=38%"; Hit description =Rangnrf-prov protein
  Pfam annotation: Domain name=Mog1; Domain location=8-151; Score=91.6; E_value=2.4e-24; Accession=PF04603.3; Description=Ran-interacting Mob1 protein
MPEDIVYQHPLFGGKIASTFPHRFQDVSNIRQVPDHQEVFADPSHDESLIFELLEFKPDVADNGSAAWFLQDLATEQDAEGSVVIEQSGVLEAPGLMYKNMPAVVITAVGQMAISKGRQGREAQNFVKVYLANLHLKGVDTDVLVTAYEPIVINPFSESADTVGAGVAVPAAQAGCMPMEEVFKLAVTSFRVHDWGLF

SEQ ID NO: 165294 - protein, 41 aa, Glycine max
  Coding DNA Sequence Number=SeqID_48516
MAEWSKAPDSSSGPRERAFGLCWIVAHFESIPLDPDGIYEK

SEQ ID NO: 165295 - protein, 260 aa, Glycine max
  Coding DNA Sequence Number=SeqID_48517
  Gene Ontology: Mol. function=binding; Cellular component =mitochondrial inner membrane; Biological process=transport
  Homolog annotation: Hit_ID=Q01GI9; Match level="QueryCoverage=70%, HitCoverage=22%, E-value=2e-18, Identity=34%"; Hit description=[C] KOG0764 Mitochondrial FAD carrier protein
  Pfam annotation: Domain name=Mito_carr; Domain location=72-156; Score= 29.4; E_value=7.1e-06; Accession=PF00153.17; Description =Mitochondrial carrier protein
MVIYREHFRELDMRWNLTDVLLEAISNRQVLSLYQGLGTKNLQSFISQFVYFYGYSYFKRLYLEKSGYKSIGTKANLVIAAAAGACTAIATQPLDTASSRMQTSEFGKSKGLLKTLTEGNWSDAFDGLSISLLLTSNPAIQYTVFDQLKQRALKNKQDNADKGTSPASLSAFMAFLLGAISKSIATCLTYPAIRKRSLLLPGCLSLHLKVAVTGGRSFNSLRITNVVGVPSEHFNRYMHLFKVETRLFWWLLFGPLPVAY

SEQ ID NO: 165296 - protein, 55 aa, Glycine max
  Coding DNA Sequence Number=SeqID_48518
MSEAKVKHALENFNFSALSTPRSYPEIQAPALSAGNRGKALVKVLANREHQLFKC

SEQ ID NO: 165297 - protein, 83 aa, Glycine max
  Coding DNA Sequence Number=SeqID_48519
MNEENEKGLGMNEVDEEKPGVHQHIDCSDAFNTSQKHRRKLGREVKDLKTIAQRIAFARCTKVTCRSQTPREGVLSAQLALIA

SEQ ID NO: 165298 - protein, 447 aa, Glycine max
  Coding DNA Sequence Number=SeqID_48520
  Homolog annotation: Hit_ID=Q1RWU1; Match level="QueryCoverage=38%, HitCoverage=49%, E-value=2e-13, Identity=29%"; Hit description =Resistance-like protein HAAS-2-related
MTFFHCEKSTSATVAVKVALWKEDLVKDEIVAAATVKAKFQRMSKMHSSPFPHLLSLTQYCFTPFTFSLPLLASSTPVVGAFDCVRHSLPLSSSRVPSFSSLMLPTTSECRQQAAAPVADDVDHVDHEADEFHDQAQEAVADDVVANAQERPELKLSSHRRKVEKFGMSVPEIEGIVVVTGLSPLIACSLDNGDKGLIYVFAERCHKKTSSFHLLAPHVDQVVDLLVDLLEVSSQEGREKTFQCHEACCTLFANKSVTHMHVVFLDAFHDLSQTGSYAWGAAALVHMYENLNDASKRSARQLAGYITLLECWIYEHFLIVFSSIVAKDYRERKPHVCRWKSMKALSVSAHHKQLDRLTSYVVSWIPYGDHPCIQRCALDYMEWFYFISHPFMSPKQLKDSPRHPLAVHDDTFIEPNPPQQPMDMPEPHAAALVDVDMPRHVLRFAKE

SEQ ID NO: 165299 - protein, 184 aa, Glycine max
  Coding DNA Sequence Number=SeqID_48521
  Subcellular localization annotation: CTP_CleavageSite=49; ConfidenceScore=5.69e-01
MIPLKTHPHSPFIFSVSKTNPLYFSLLPTSISLLSLKQPPPSLSSNLLRVSNVGVSVCRTEHHEEEEDKGVSLELHDLSPNGEVYQKTLQLVECSMFAALTGLVYFLSNSLAIENYFSCFFSLPIVISSMRWGVDAGRKTLVATTILLLVLSGPVKALTYLLKHGIVGFTMGTLWRIRVGMTNK

SEQ ID NO: 165300 - protein, 416 aa, Glycine max
  Coding DNA Sequence Number=SeqID_48522
  Homolog annotation: Hit_ID=Q9LI86; Match level="QueryCoverage=46%, HitCoverage=44%, E-value=6e-28, Identity=40%"; Hit description =Arabidopsis thaliana genomic DNA, chromosome 3, BAC clone:T5M7
MRERNKGVEDQAYTNDMDCYYYSTSELPCKKHPSSSSVGICAYCLKDRLVKLVCSDCGEQRLSSCSCSDEMVSSHRNSCTVEVGGVGRVSFLIENEKNNESTPVVLQHLNHNKANKEEEEDEVLGLRRSSSSCVEIKRHHHGGGGGFWKIGKLFRKKKEKGCGRSVVGFDERNNEMWMVDHQGGVSRSRSLCSFRGGGIFGSEDGGDSVLSGARSSISAARSSGVNMLESGRRSGYSEAEPRRSGFDGVERRDFLFDNNNYESGSDLKGGVKKGGGLMDGVGDGGGFYGGVNRRVFSLRESDFKGMDESSFIDLKLDYSSESKHEFSAAKMSNNMGGDTFSSFRGGNFMPHDGGGGSYGGLVGDGVLTNGGSCRITVNDRGIKRGRKSMKGWRWIFRYHSNWGSSRKRDEDFMFKA

SEQ ID NO: 165301 - protein, 75 aa, Glycine max
  Coding DNA Sequence Number=SeqID_48523
MEEFMAQVAWPGVQPSPLGGGEAPTAQESQPKVDPEPEASPEVKATPKETPKDTHAATPAEYTDYVTDMAAVQST

SEQ ID NO: 165302 - protein, 126 aa, Glycine max
  Coding DNA Sequence Number=SeqID_48524
  Gene Ontology: Mol. function=protein transporter activity; Cellular component=nuclear pore; Biological process=protein import into nucleus, docking
  Homolog annotation: Hit_ID=Q5VN12; Match level="QueryCoverage=49%, HitCoverage=5%, E-value=9e-17, Identity=66%"; Hit description =Putative Importin 9
  Pfam annotation: Domain name=IBN_N; Domain location=12-82; Score=2.3; E_value=0.049; Accession=PF03810.9; Description=Importin-beta N -terminal domain
MANAVDQDQQWLLNCLSATLDPNPEVRCFAEASLDQASRQPVLLKQFVKKHWQEGEDSFEPPVVSSNEKESIRRMLLLALDDPHKKICTAIGMAVASIAMHDWPELWPDLLPFLLNLINNQTNMNG

SEQ ID NO: 165303 - protein, 161 aa, Glycine max
  Coding DNA Sequence Number=SeqID_48525
MARLKDSKVKESGTTPQAMHKEVISVGNPSLEELDWAICEIWPEMRESKFISIFITNPYTNFALSILRLDHSEQNCTLEYRAWRQAPEDLGECRRTWCRYLSPGSKTMGVSKKNASGVNVLVISFPGALGNESGGIIGLLGSRGSSFPLPRGHLHQKNHRN

SEQ ID NO: 165304 - protein, 202 aa, Glycine max
  Coding DNA Sequence Number=SeqID_48526
  Homolog annotation: Hit_ID=O80607; Match level="QueryCoverage=66%, HitCoverage=46%, E-value=8e-37, Identity=55%"; Hit description =Predicted by genscan
  Subcellular localization annotation: CTP_CleavageSite=52; ConfidenceScore=5.44e-01
MRNHPAFQFLLGSSSKMQAFRRRISTATISTAKQFNALPSIIAGEFPATRRRWSSRKSRSGEDEWNEAWETAWLPDDLTPKTQAPWESDVNFPSSSSSSSAAAANDGDGDEETKAFVAEMNENWNERRKGSKEKEKKEENGALYSVENMKKDYRLKKQRMHAGLWMKEIEKLEEAKLGDSDVAGDDDIQRLLDSCSEYNSLS

SEQ ID NO: 165305 - protein, 414 aa, Glycine max
  Coding DNA Sequence Number=SeqID_48527
  Gene Ontology: Mol. function=protein transporter activity; Cellular component=nuclear pore; Biological process=protein import into nucleus, docking
  Homolog annotation: Hit_ID=Q5VN12; Match level="QueryCoverage=80%, HitCoverage=27%, E-value=4e-77, Identity=45%"; Hit description =Putative Importin 9
IYDPYIQTKALSIIYSCTSMLGTVSGVYKAETSSLIVPMLKPWMDQFSSILQIPVQSENPNDWSIKMEVLKCLNQFIQNFSTLFKSEFEVILGPLWSTFVSSLSVYEKASIEGTEDSHEGRYDSDGSEKNLDSFVIQLFEFMLTIVGSPRLGKVVVANIRELVYYTIAFLQMTQQQVLTWSVDANQFIADEEDATYSCRFSGVLLLEEVVNSFDGEGILAIIDGAKQWFTESQIRKAAGNASWWRIREATIFALSSLSEQLFETQETGFDTSSLKHLVEQIFTEDSLLDPLEYPFLYARIFTSIAKFSSLISNSLLEQFLYLAMKAITMDVPPPVKVGACRALTNLLPEAKKEIVQSQLLGLFSSLTNLLNHVLPDINPCHISSTIVASNRYLNTISRHQMKPCTWYLIHCLLQ

SEQ ID NO: 165306 - protein, 108 aa, Glycine max
  Coding DNA Sequence Number=SeqID_48528
  Pfam annotation: Domain name=Chromo; Domain location=49-95; Score =17.9; E_value=0.0075; Accession=PF00385.14; Description='chromo' (CHRromatin Organisation MOdifier
DWGSEDGNGRREGRGLDKTERDSLRGNMEVLHSPQTLPPMLTEELELAVQPEDILQWRTYVGGNMEVLVKWAHLPSCDNSWERASKVFPSLEDKVVLLGGGGIDRIAS

SEQ ID NO: 165307 - protein, 109 aa, Glycine max
  Coding DNA Sequence Number=SeqID_48529
  Gene Ontology: Mol. function=binding; Cellular component=nuclear pore; Biological process=protein import into nucleus, docking
  Homolog annotation: Hit_ID=Q5VN12; Match level="QueryCoverage=99%, HitCoverage=9%, E-value=2e-33, Identity=61%"; Hit description =Putative Importin 9
AIKSIPGCVHPLVSRILPSIGPILNKPQEQADGLVAGSLDLNAPADVVKAIYDVSFNAVINIILQSDDHSEIQNATECLSAFISEGRQQILAWGSDSGSTMRSLLDIAS

SEQ ID NO: 165308 - protein, 212 aa, Glycine max
  Coding DNA Sequence Number=SeqID_48530
  Gene Ontology: Cellular component=chloroplast thylakoid membrane
MGRVTITAHGPKPREASLLRQIPSARKKSEATNRHININIIGHSKQAIEKSNEHPEWLPDDWNMDFRTKKSGENMGHGYKVLDKASLSGASCSSPILQAFPILKKSYGDSMHKVLHVGPDSCFVLSSLLEEEDTEVWGIQPYELDDVGAKCKSLVCKGIVHVADLKFSLPHCAKSFSLDILSDALDYLSPRYLNKTLPKLVKVHSPVKLQFY

SEQ ID NO: 165309 - protein, 81 aa, Glycine max
  Coding DNA Sequence Number=SeqID_48531
MECLEGAWETLEGNMRCRFRGTIRFTATSLVLPDEPARTLQRTVEWTAPWISFVYFEANTVDTFALDDTIYFVKLPYFGQL

SEQ ID NO: 165310 - protein, 202 aa, Glycine max
  Coding DNA Sequence Number=SeqID_48532
  Homolog annotation: Hit_ID=Q1SKD7; Match level="QueryCoverage=94%, HitCoverage=51%, E-value=1e-11, Identity=25%"; Hit description =Ankyrin
MAPKKLSAKRSRRDAAAEGTSATPEFDSHRFQSTEHQQRFEAIKGWSFHRERCVQLREDEYTDFQEEIARRHWVSLVTPMAKFDPEPTEEGVRDMRSWMRGQWIPFDADALNQFLGDPLVLEEGQECEFIQRRNGAEGFDQEAIAQLLCTSRQDFTRTAVGRRVRIMRTSMTNLTQMWMTLLLSNVLPSDHNSDLPLPKCQL

SEQ ID NO: 165311 - protein, 98 aa, Glycine max
  Coding DNA Sequence Number=SeqID_48533
MIESFQQQQQMSVLELYVEKDVAGGSMFHAANSVTSCGHNVSHHESELPRNISNLHDDEDDDDDYLAFNSYVEESFDEGDSVDEISDTDDEVTDIVEP

SEQ ID NO: 165312 - protein, 112 aa, Glycine max
  Coding DNA Sequence Number=SeqID_48534
MHNCAYSAIPKFVLHALAVAAESNVRFCPNTTHAQSSNEAKKNPSETMEEIKKCYTLESMLITRNFSFRVLQVVSLAISWQKLNPYGGGDNSKVSMETRVTQKKKEREKEKF

SEQ ID NO: 165313 - protein, 165 aa, Glycine max
  Coding DNA Sequence Number=SeqID_48535
  Gene Ontology: Mol. function=glyceraldehyde-3-phosphate dehydrogenase (NADP+) (phosphorylating) activity; Cellular component=chloroplast; Biological process=reductive pentose-phosphate cycle
  Homolog annotation: Hit_ID=P12859; Match level="QueryCoverage=60%, HitCoverage=22%, E-value=1e-43, Identity=85%"; Hit description =Glyceraldehyde-3-phosphate dehydrogenase B, chloroplast precursor
  Pfam annotation: Domain name=Gp_dh_N; Domain location=1-104; Score =29.5; E_value=4e-12; Accession=PF00044.14; Description =Glyceraldehyde 3-phosphate dehydrogen
MLGTFKTDVKILDNETITVDGKPIKVVSSRDPLKLPWAELGIDIVIEGTRVFVDGPGAGKNIQAGAKKVIITAPAKGADIPIYIVGINEGDYTHETSNIVRGRCPWMLCSPQVMHLKSSDYMELETLCMLCEAGFLTLAMCYTAGIQLSLMLVLGFMLPVTPEIS

SEQ ID NO: 165314 - protein, 117 aa, Glycine max
  Coding DNA Sequence Number=SeqID_48536
MDKFDVAWPGAQPSPSRGGGASAAQEPEPEEPAAAVEGEVELTPPKPFYFDAGVHMAQEEETATTLILEPSPAPIPDDAIPSAPAPELEQPISQDSPAAQVLDLNEHAQEQPQEQDI

SEQ ID NO: 165315 - protein, 66 aa, Glycine max
  Coding DNA Sequence Number=SeqID_48537
MVDVAKVGSTISQVGLRVPFVKRTRGVTYKKNDFGAQHHGFCADPLGVLRVLLLLGDCPKLDTQPI

SEQ ID NO: 165316 - protein, 89 aa, Glycine max
  Coding DNA Sequence Number=SeqID_48538
MELIEEIRRTNRCKRKLKQLTLHRFVGLNSNKESIGVSRLWGFSQLHIQEDDTTAVVKGRSHWVKVGVICSCYSLRVCLDGGILNSEKF

SEQ ID NO: 165317 - protein, 167 aa, Glycine max
  Coding DNA Sequence Number=SeqID_48539
MDQVQGQAFSKVHGKIWDLAMIELAPTIEEFEGILGCPLGGRKPYLFSRFYPSMARIAKVVKISEQELDRVKQNKNGVAWIPRKHMEEKAETLANCKFGGSADFELLAKPILWLSEPFAKRNKLRLWRDWRELSLKRKLSCKALDEILSDCEPSCYGELNPQLVLST

SEQ ID NO: 165318 - protein, 87 aa, Glycine max
  Coding DNA Sequence Number=SeqID_48540
METEQHPPQQTELRCSTPVTTRSRGSLSVLIKDTKGYQGRGQKGLFLDPSSPRLASGSLGPWNYLLAKQPARLGDLKLAWASSLLQG

SEQ ID NO: 165319 - protein, 232 aa, Glycine max
  Coding DNA Sequence Number=SeqID_48541
  Gene Ontology: Mol. function=protein transporter activity; Cellular component=nuclear pore; Biological process=protein import into nucleus, docking
  Homolog annotation: Hit_ID=Q5VN12; Match level="QueryCoverage=78%, HitCoverage=15%, E-value=7e-41, Identity=48%"; Hit description =Putative Importin 9
MGAYQIKVTTSALALLLTSRHNELAKIYVQGHLIKSHEGITTRSKAKSAPDQWVMLPLPTKIVALLADALTEIQEQVLAADDEDSDWEEVQADGIENDKEFLYSVSTSSGKATDEQLEAMVKVFNEDQDDQYVDGLLSVADPLNQINLANYLVDFFVSFSQSDRQFLDHICKSLSQSQRSAIQLVGESVCSSERYSLSAAVFPLYVFGILVSRLSKHANGEVSLAELNSTVV

SEQ ID NO: 165320 - protein, 561 aa, Glycine max
  Coding DNA Sequence Number=SeqID_48542
  Gene Ontology: Mol. function=transcription regulator activity; Cellular component=nucleus; Biological process=regulation of transcription
  Homolog annotation: Hit_ID=Q9LRN3; Match level="QueryCoverage=65%, HitCoverage=95%, E-value=2e-90, Identity=52%"; Hit description =Similarity to helix-loop-helix DNA-binding protein
  Pfam annotation: Domain name=HLH; Domain location=287-338; Score =56.4; E_value=9.4e-14; Accession=PF00010.16; Description=Helix-loop -helix DNA-binding domain
MEKDHNYSVQTHISSFMFLASLKFFLMSDLFTLSYHHHHMLLFCSNFAEESYYSLQTPPPPPLSMPPSFNTLDYSLDQQQHHHLYAPNQHQQHLMMKFQQGSGDENNNIGSMVDYMPQTTTTLPPHGFYGTATSAATTSYDKLSFADVMQFADFGPKLALNQAKSCEESAIDPVYFLKFPVLNDKMEEDHQQNMMVNNDDPDGDEAENHHHLDERFNLVSVEGKDQGMMMREDEETTRVSDDNNNSVQIRFLGHEEPQQKNCAVQENKNGKKKRPRTVKTSEEVESQRMTHIAVERNRRKQMNEHLRVLRSLMPGSYVQRGDQASIIGGAIEFVRELEQLLQCLESQKRRRLLGEAQARQVGDPSLVAQQQQQPPFFPTLPIPNEQMKLVEMETGLREETAECKSCLADVEVKLLGFDAMIKILSRRRPGQLIKTIAALEDLQLIILHTNITTIEQTVLYSFNVKVASDSRFTAEDIASSVQQIFNFIHANTSMCCIRTRTTCDSYSCLYEIPILILHRRLDLLLSLSEGVTEQDDMASLSIIYFSLLKVSHCIKEKLWIR

SEQ ID NO: 165321 - protein, 83 aa, Glycine max
  Coding DNA Sequence Number=SeqID_48543
MDSVSALVYCNGNMIPTDEGILFECPTDPKVITISDGYVAYDCLELKHDADVGKMFFIYSEFSTKGSIELNATFKCSPYEILT

SEQ ID NO: 165322 - protein, 139 aa, Glycine max
  Coding DNA Sequence Number=SeqID_48544
  Homolog annotation: Hit_ID=Q1T159; Match level="QueryCoverage=57%, HitCoverage=67%, E-value=3e-07, Identity=40%"; Hit description=Beta tubulin
  Pfam annotation: Domain name=DUF1723; Domain location=50-99; Score =35.1; E_value=2.4e-07; Accession=PF08330.1; Description=Protein of unknown function (DUF1723)
MDHATNEERPELKLSSHERKIHKFGMSAIEIEDIVIATRLSPLIACFLDTSDMGLISAFVERRHKETSSFHLSIRQVTITLNDVTSLLHLPITCPFYTFDALHVDQAVDLLVELLEVNSQEARDETFQCHEAYVHLVRL

SEQ ID NO: 165323 - protein, 292 aa, Glycine max
  Coding DNA Sequence Number=SeqID_48545
  Gene Ontology: Mol. function=DNA binding
  Homolog annotation: Hit_ID=Q1S0F5; Match level="QueryCoverage=76%, HitCoverage=44%, E-value=2e-13, Identity=25%"; Hit description=IMP dehydrogenase/GMP reductase
MGVKYLEAVKRRLHATKQWFPDKIRGVEVLISKVFHSSKHGIKPSTLFYEKLGQWIDQVRRQAFRKTYGKIWDLTMIEVFVEVIASFTQYYDQPLRCFTFGDFQLVPTVEEFEGILGCSLGGRKSYLFSGFYPSMARVAKVVKISVQELERVKQNRNGVVGIPKKRLEEKAKALADQGEWTSFIDVLALLVFGVVLFPNVDGLMDLAAINAFLAYHHSKESSAVVVLVDAYDTFDQRCKKNNARIVCCTLALYVWLVFHIFHHESRHVCPLQGHYICAEKGKANWEQLMAGM

SEQ ID NO: 165324 - protein, 64 aa, Glycine max
  Coding DNA Sequence Number=SeqID_48546
MSVFRYSVNTEKNEECNYGGRGPIDVREYEIDDELAGDVPANVKEDVVDVFKKGTKTNIGDELL

SEQ ID NO: 165325 - protein, 118 aa, Glycine max
  Coding DNA Sequence Number=SeqID_48547
  Subcellular localization annotation: CTP_CleavageSite=75; ConfidenceScore=5.47e-01
MAIIHYSAASRCCMPSLHRASPSRSVLAPSIFFFRDAAPTLRLDVSVRSQPPGSDGFGEPINNKHASRDASVGLSASSSSSVIDFLTLCHRLKGMHGSVDEETTGVSQLTELETNPAR

SEQ ID NO: 165326 - protein, 54 aa, Glycine max
  Coding DNA Sequence Number=SeqID_48548
MGLSSHKELPLTYSRLHEMKERKGVGRRCEWNSTSPLVGMWGDMFLKRCQQVRV

SEQ ID NO: 165327 - protein, 177 aa, Glycine max
  Coding DNA Sequence Number=SeqID_48549
MNPRCTPLSSTWHVHDFLTIVTSGSCPLLVAPCKCSPRRKICACQIICVLSPFVEEDIVGKVLEYLYISLNYWNHIFVMSCGLLTASVVTAALISFGQGHAEDIIHQSIVYRTTNFSLLFVCAVRDNIMEPVKDEVSMISQTILCVTDDQCTWDFSFTLVLKQSISHASIFQMISLP

SEQ ID NO: 165328 - protein, 144 aa, Glycine max
  Coding DNA Sequence Number=SeqID_48550
  Gene Ontology: Mol. function=hydrolase activity; Cellular component =cytosol
  Homolog annotation: Hit_ID=Q8LQ52; Match level="QueryCoverage=71%, HitCoverage=20%, E-value=3e-31, Identity=65%"; Hit description=Metal- dependent phosphohydrolase HD domain-containing protein-like
MALMALIAGDVPGLNRERSVRHFFVCEICNFVLSLDGISKSIVGDITPSDGVPKAEKSRMELEALNKMCELLGGGMRAEEIKELWEEYENNSSVEANLVKDFDKVMDYFCSSRIVSFREVDIGSRKGDVLVVFIHFLLRGGSGK

SEQ ID NO: 165329 - protein, 71 aa, Glycine max
  Coding DNA Sequence Number=SeqID_48551
  Gene Ontology: Mol. function=catalytic activity; Biological process =metabolic process
MTQALCAVEYLRRMMDSNGCSPDWQGAVLRVPLHPHPIDVPRAQTTFLEEEDYQHEGRVAISKTRFWKLSE

SEQ ID NO: 165330 - protein, 173 aa, Glycine max
  Coding DNA Sequence Number=SeqID_48552
MELHHRGKTLRIKRTSMTTLTQIWMTLLLSNILPRIMPPRHPVDLEKSNRALGFPALITGLCQFYGCTAVGSGTVAVRGGPATASRRCAATTSTAATIPGVYLRSPVEDGTPDTRSQDLSPFPWPTPEQFGATVACPGDDLNFQTGAGPVGAHGDEDGAQKDDDMADVLDYFL

SEQ ID NO: 165331 - protein, 82 aa, Glycine max
  Coding DNA Sequence Number=SeqID_48553
MEDAPLAHHWVPRRATTGGQVATGSCSSPHNGVPETVANATYEVGATVATVVALLAVVEKVVGRSMGFVGTLHAIDEGPKQK

SEQ ID NO: 165332 - protein, 83 aa, Glycine max
  Coding DNA Sequence Number=SeqID_48554
MVVRQEVSVCHSAPTPPMNVVKVAMEPKAQELAAKYESAQYKVQCMKSTTVVVRLTMIVVKNGKAEEESTTIIVKWVTTTIVD

SEQ ID NO: 165333 - protein, 899 aa, Glycine max
  Coding DNA Sequence Number=SeqID_48555
  Gene Ontology: Mol. function=RNA-directed DNA polymerase activity; Biological process=RNA-dependent DNA replication
  Pfam annotation: Domain name=rve; Domain location=667-784; Score=7.7; E_value=0.0013; Accession=PF00665.16; Description=Integrase core domain
MDSSSAASKVGGFSASRTKGESLVRVSDESWMEGFKGEDGRVERVEDEVADGDTERVEGLFLRRGQRTGIGDFDFEEGGLTRSRSLWKLLGNGGEWETELLMLKPSTHAIKIIEDMCSSPYNNSRDKRIMKRGISQAQVPTTTPPLPTCDKCGIVHRPGEGAVDDELAATMDEINFGEASGKIRKCLGLNPCKIKDLDQKERQPTLQETMQLDTLPSQPEPSYKKRDANVVITRSNRIQEDSEEKEECSAMVPRKFPTKMKDSSITNLEPTDISFHLADRLVVYPRGAIKDVLVKVDNFIKSVDGFDALMEGVFSSIGMLDPLKKVLTNENLDWELNPKVEEILMDNKEAFGWSIHELKDLDPTICTHRINTKEWSLPKWLPQRKLNPNMMENTCNIVMENEHHEFIVVRKIIGDTRLVLNLENFQFMVKKSIVLGLKLSHVVIEVDLAKVEECLWALNILKQSLVSTPVVTTPDWSLPFKLMCDVSDTIVGAVLGQKKDRVFYTIYYAIRTHDDAQENYITTKKELLADAKPKLIRWILLLQEFDLEIKDKNGFKNLVANHLSRLDPLVMQPPDDGRIKETFPNESLLTMATVSKTTWYADIVNYLACRVFLDDINNQAKKKLMFEAKKYFWDDLYLFKIGGHLGPSRIAHKPLSRKMEMPQNNMLVVEMFDVGGIDFMGLFLKSFGNEYILVVVDYMSKWLVVVTLSTIDSWVAIKFLKKNIFTRFGTPRAIISDCGTQFCNKLFDGPLAKYGVIHKDWPLKLDDALWAYRTTFKTPMLIGNNRLMQLNELDEFKLTTYENAKIYEEKTKRWHDARIRQRTFQVGEKVLVYNSHLHLFLRQLKYRWSGPFELSKVFPYRVLEMKKKDGATFKINTLRVKAYYEVFQQVQNIVHLSNL

SEQ ID NO: 165334 - protein, 103 aa, Glycine max
  Coding DNA Sequence Number=SeqID_48556
MIDGSDETVVVGTNSEPFFMRRVLKEAPGNNVNDFKLLVFMTLGHFVNVCGSLSGDVGSRLHFVCLDKLEAGSVAAATTTIKYQFTTAAASIAHPFKPAISNF

SEQ ID NO: 165335 - protein, 350 aa, Glycine max
  Coding DNA Sequence Number=SeqID_48557
MKPRRRNPATTLIATTPPVPIPSPPPSGLGGDDKTRDGGGGAKLVVEGGDGGDDLGVEFEVGAVLEGGVDGSGAGGADDLGGGAFTGGGGELADGGDLVEFLGGGTAGGDGEFCGGEARGGVAAGEGGEFRGGDGEVLLGGGAGGCGGGAGGCGGGAGGCGGGAGDCGGCDGGGDVLLGGFGGTGADGDGGGGELGGTGGGAAGEDGGGEDGGDGGGDGGGTNGGGVPDMEGGGELGGGDGGEGGGFAGEGVVGGGEAGCCGEEVEEGVCCGGGVVTVDGGGLVVLAEGDVCGGGAAVEVDGDGDTADINKSKTLNEIFNSTYENLFEGVSCLRKARLLSLKSGTRLQGL

SEQ ID NO: 165336 - protein, 283 aa, Glycine max
  Coding DNA Sequence Number=SeqID_48558
  Gene Ontology: Mol. function=nucleic acid binding; Cellular component= nuclear pore; Biological process=DNA integration
MLVYVDDIIVTGNNPTTVKSLVINLNSEFALKDLGDLDLLSKTAMDEANSISSPMVGGCKLTKTGSEDFSDPTLYRSVVGALQNATITHPEISFFVNKVCQFMSQPTEQHWVAVKRILRYLKGTLHFGLKLEPNFSTKHYFVHAFCDAEWASDPDDRRSTSGVAVFLGPNLVSWWSKKQSVVARSSTEAEFRSLALATSEVTWIQSLLTELKVPHAPPVIFCDKMSIVSLAHNPFLHSPTKHIELDLFCVRDKVLSKQLQVVHVPAAALRADILTKALSPSNL

SEQ ID NO: 165337 - protein, 229 aa, Glycine max
  Coding DNA Sequence Number=SeqID_48559
  Homolog annotation: Hit_ID=Q1S7C5; Match level="QueryCoverage=46%, HitCoverage=9%, E-value=9e-14, Identity=35%"; Hit description =Integrase, catalytic region
  Subcellular localization annotation: CTP_CleavageSite=22; ConfidenceScore=5.16e-01
MASTNNNSSPPLVPPASRSPVSFSHAVTAKLTDSNYLLWRSQVQPVIIGHGLLDYILAPQIPQKFFIIEDRNNNILLSSSLENRSITAYLLHIQSLIDSLASIGDSISTSTHIDLILDGLTDDCRTICTILNNLRDPLSLDDVTSMLLDEESSIEKFRKKNLGSLNLVEGLNSNSAFEAQVHLTRGNTHSSSNYDYVYGNQGRGDGGCLYGRGGRGGARGRGHGRFADV

SEQ ID NO: 165338 - protein, 149 aa, Glycine max
  Coding DNA Sequence Number=SeqID_48560
MATIRRASTVSERLPLDNYKKLVSLPELPLTVKKVTAYNCISLKTDITQGLNILKILSLVVLSISSFRETIRFGRISEVNDQFGNITFKFELEVNKDSIKGCGIDRKKDVREEEARRTYTRKKQECPTGMRANSRCEILSMHPMNTQGH

SEQ ID NO: 165339 - protein, 353 aa, Glycine max
  Coding DNA Sequence Number=SeqID_48561
  Gene Ontology: Mol. function=transmembrane receptor activity; Cellular component=membrane; Biological process=defense response
  Homolog annotation: Hit_ID=Q2HUN2; Match level="QueryCoverage=59%, HitCoverage=20%, E-value=1e-34, Identity=41%"; Hit description=TIR; Disease resistance protein
  Pfam annotation: Domain name=LRR_1; Domain location=205-226; Score =6.1; E_value=20; Accession=PF00560.23; Description=Leucine Rich Repeat
  Pfam annotation: Domain name=LRR_1; Domain location=228-249; Score =4.3; E_value=45; Accession=PF00560.23; Description=Leucine Rich Repeat
  Pfam annotation: Domain name=LRR_1; Domain location=251-274; Score =6.4; E_value=18; Accession=PF00560.23; Description=Leucine Rich Repeat
  Pfam annotation: Domain name=LRR_1; Domain location=298-323; Score =5.0; E_value=34; Accession=PF00560.23; Description=Leucine Rich Repeat
  Pfam module annotation: Pfam domain module=LRR_1::LRR_1::LRR_1::LRR _1; Domain location=205-226::228-249::251-274::298-323
MKRKEKLAGKENQAARKEKKSLRGRKTRGIRQQEKKNQRINKKQSLPARGRKPMRQWRCLREEEGEDTEWQRCPPVQPRPVTAPATDTASHRSRTRMGVRCESDTGHADDEPRPCFIGQDIVQESEKYPGKRSRLWKHEEVLDVLKYNKGTNDVQGIILDLDKLIGDLYLSSDFLAKMANLRFLKIHKKCRCSLKSWPPNFCAEQLVELRMSFTDVKKLSDGVQNLMKLKSIDLSFSDKLVEITDLSKAEKLEKVSLACCYRLRQLHSSTLSLPKLAYLNQKYCRNIENLESNVHSKSVNELTLSHCLSLEKFSVTSYEIKVLSLSNTYEAPIPTPTPTSDTTRTRTRGHLKC

SEQ ID NO: 165340 - protein, 349 aa, Glycine max
  Coding DNA Sequence Number=SeqID_48562
  Gene Ontology: Mol. function=transmembrane receptor activity; Cellular component=membrane; Biological process=defense response
  Homolog annotation: Hit_ID=Q2HUN2; Match level="QueryCoverage=98%, HitCoverage=31%, E-value=7e-79, Identity=49%"; Hit description=TIR; Disease resistance protein
  Pfam annotation: Domain name=ABC_tran; Domain location=74-199; Score=- 63.3; E_value=0.07; Accession=PF00005.17; Description=ABC transporter
  Pfam annotation: Domain name=NB-ARC; Domain location=36-313; Score =98.3; E_value=2.3e-26; Accession=PF00931.13; Description=NB-ARC domain
  Pfam module annotation: Pfam domain module=ABC_tran::NB-ARC; Domain location=74-199::36-313
MYCKWKAALTEAANLSGWHSQNRTESELLKGIVRDVLKKLAPTYPNQSKRLVGIEKSYEEIESLLRIGSSEVITLGIWGMGGIGKTTLATALYHKLSYDFEGRCFLANVRKKSDKLEDLRNELFSTLLKENKRQLDGFDMSRLQYKSLFIVLDDVSTREQLEKLIEEYDFMGAESRVIVTTRDKHILSTNHKIYQVDKLNCDHSVELFCFIVFGEKKPKQGYEDLSRRVISYCEVVPLALKVLGASLRERNKEAWECELRKLEKFPDMKILNVLKLSYDGLDRPQKDIFLDIACFFKGEERYWVTGLLEAFDFFPTSGIKVLLDKALITISNANQIEMHDLIQEMGQDL

SEQ ID NO: 165341 - protein, 157 aa, Glycine max
  Coding DNA Sequence Number=SeqID_48563
MASSSSSSSSHVNIKSGPIDADVLWMQPKHVSEHVWNEEEDRKLHIRRVVPTYQGEEQIPEQIFPFLLQSGISVDGLPLIGPTNLDWADLCEELLGVRPHEDEIRGSVVKLSWLAHHFAQINNDDDVEQVRRFARAWILRFIGGVLFVDKSSNKVSL

SEQ ID NO: 165342 - protein, 182 aa, Glycine max
  Coding DNA Sequence Number=SeqID_48564
  Gene Ontology: Mol. function=dUTP diphosphatase activity; Cellular component=mitochondrion; Biological process=pyrimidine nucleotide metabolic process
  Homolog annotation: Hit_ID=Q6DAV9; Match level="QueryCoverage=83%, HitCoverage=98%, E-value=3e-70, Identity=85%"; Hit description =Deoxyuridine 5'-triphosphate nucleotidohydrolase
  Pfam annotation: Domain name=dUTPase; Domain location=46-180; Score =188.2; E_value=2e-53; Accession=PF00692.10; Description=dUTPase
MTRNRPFVVGFAAETQNVEEYARQKLARKKLDLICANDILDPRIGQDFPLPTYATPGSAGLDLRACLDSAVELAPGETTLLPTGLAIHIADASLAAVILPRSGLGHKHGVVLGNLVGLIDSDYQGQLMVSVWNRGQKHFTIEPGERIAQMVFVPVVQAEFNLVEEFDGSERGEGGFGHSGRH

SEQ ID NO: 165343 - protein, 181 aa, Glycine max
  Coding DNA Sequence Number=SeqID_48565
  Gene Ontology: Mol. function=sequence-specific DNA binding; Cellular component=intracellular; Biological process=response to DNA damage stimulus
  Homolog annotation: Hit_ID=Q8ZJP3; Match level="QueryCoverage=99%, HitCoverage=92%, E-value=8e-64, Identity=70%"; Hit description=DNA repair protein radC homolog
  Pfam annotation: Domain name=RadC; Domain location=60-181; Score =192.1; E_value=1.4e-54; Accession=PF04002.6; Description=RadC, DNA repair protein
GGGAVRRRAVGHFLAHRVARRARDAAGGAAAAPVRLALSPDVGRSSGFLQPKRPGGRQLYAAAGDCRAGAALLFQPFVAGKRHAQSADNQHRVIRHQEMFAGTISSVVVYPREIVREALKANAAALILAHNHPSGKAEPSHADRLITEQVVKACQLLEIRVLDHLVIGRGECVSFAERGWL

SEQ ID NO: 165344 - protein, 197 aa, Glycine max
  Coding DNA Sequence Number=SeqID_48566
  Gene Ontology: Mol. function=2 iron, 2 sulfur cluster binding; Cellular component=intracellular; Biological process=electron transport
  Homolog annotation: Hit_ID=Q7W971; Match level="QueryCoverage=98%, HitCoverage=53%, E-value=1e-97, Identity=86%"; Hit description=CDP-6- deoxy-L-threo-D-glycero-4-hexulose-3-dehy drase reductase
  Pfam annotation: Domain name=NAD_binding_1; Domain location=61-168; Score=117.0; E_value=5.5e-32; Accession=PF00175.11; Description =Oxidoreductase NAD-binding domain
MAGAPHTGSPLELHIRHLPGGVFTDHVFGAGDTQMKEREILRLEGPFGSFFLREDSDKPIILLASGTGFAPVKAIVEHMIHKNIRRPVALYWGGRRPRDLYMDALAQSWARDLPDFRYVPVVSNALEEDGWSGRDGFVHEAVLQDIPDMSGHQVYACGAPPMVDAARREFSAQCGLPPEEFYADAFTSEADLAKAAT

SEQ ID NO: 165345 - protein, 135 aa, Glycine max
  Coding DNA Sequence Number=SeqID_48567
MESHEDSTNGGFNHFSFFLRTLPEQSEEKLEESPEIARDVIIAARTYVSPLKVVNYELYNHTTISPFKDDELMLSPFKGDELILRPFKGDELMLSSFKDDELMEGEALTDSSECRPWGLPGLSASLSLCLSHMVV

SEQ ID NO: 165346 - protein, 375 aa, Glycine max
  Coding DNA Sequence Number=SeqID_48568
  Gene Ontology: Mol. function=protein serine/threonine kinase activity; Cellular component=integral to membrane; Biological process=protein amino acid phosphorylation
  Homolog annotation: Hit_ID=P43298; Match level="QueryCoverage=99%, HitCoverage=39%, E-value=1e-178, Identity=82%"; Hit description =Putative receptor protein kinase TMK1 precursor
  Pfam annotation: Domain name=APH; Domain location=24-203; Score=-8.6; E_value=0.023; Accession=PF01636.13; Description=Phosphotransferase enzyme family
  Pfam annotation: Domain name=Pkinase; Domain location=21-297; Score =166.2; E_value=8.3e-47; Accession=PF00069.15; Description=Protein kinase domain
  Pfam annotation: Domain name=Pkinase_Tyr; Domain location=21-297; Score=124.0; E_value=4.2e-34; Accession=PF07714.7; Description =Protein tyrosine kinase
  Pfam module annotation: Pfam domain module=APH::Pkinase::Pkinase_Tyr; Domain location=24-203::21-297::21-297
MGEAGNMVISIQVLRNVTDNFSEKNILGQGGFGTVYKGELHDGTKIAVKRMESGAISGKGATEFKSEIAVLTKVRHRHLVSLLGYCLDGNEKLLVYEYMPQGTLSKHLFNWMEEGLKPLEWNRRLTIALDVARAVEYLHSLAHQSFIHRDLKPSNILLGDDMRAKVSDFGLVRLAPEGKASVETRIAGTFGYLAPEYAVTGRVTTKVDVFSFGVILMELITGRRALDDTQPEDSMHLVTWFRRMYVNKDSFQKAIDHTIDLNEETLPRIHTVAELAGHCCAREPYQRPDAGHAVNVLSSLVELWKPSDQSSEDVYGIDLDMSLPQALKKWQAYEGRSQMESSSSSLLPPSLDNTHTSIPTRPNGFVESFTSADGR

SEQ ID NO: 165347 - protein, 274 aa, Glycine max
  Coding DNA Sequence Number=SeqID_48569
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q9LI83; Match level="QueryCoverage=94%, HitCoverage=21%, E-value=1e-119, Identity=74%"; Hit description =Putative phospholipid-transporting ATPase 10
ICYFFYKNITFGFTLFLYEVYASFSGQPAYNDWFLSLYNVFFSSLPVIALGVFDQDVSSRYCQRFPMLYQEGVQNVLFSWRRIFSWMLNGFISAIIIFFFCTKAMEIQAFDEKGRTAGRDILGATMYTCVVWVVNLQMAVSISYFTLIQHIFIWGSIALWYLFLLAYGALSPSFSGNAYKVFIETLAPSPSFWIVTLFVSISTLIPYFSYSAIQMRFFPMYHDMVQWIRYEGKTNDPEFVAMVRQGSLRPTTVGSTARLAAKDNDFRVSDTNHR

SEQ ID NO: 165348 - protein, 850 aa, Glycine max
  Coding DNA Sequence Number=SeqID_48570
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q9SX33; Match level="QueryCoverage=98%, HitCoverage=70%, E-value=0.0, Identity=73%"; Hit description =Putative phospholipid-transporting ATPase 9
  Pfam annotation: Domain name=E1-E2_ATPase; Domain location=34-313; Score=-124.7; E_value=0.025; Accession=PF00122.10; Description=E1-E2 ATPase
  Pfam annotation: Domain name=Hydrolase; Domain location=342-802; Score=29.4; E_value=1.3e-05; Accession=PF00702.16; Description =haloacid dehalogenase-like hydrolase
  Pfam module annotation: Pfam domain module=E1-E2_ATPase::Hydrolase; Domain location=34-313::342-802
FRRVANFYFLVTGILAFTKLAPYTAVSAILPLIIIVGATMIKEGIEDFQRKKQDIEVNSRRVKVHKGHGTFEYIEWKNLKVGHIVKIMKDEFFPADLLLLSSSYEDAFCYVETMNLDGETNLKLKQGLEVISSLHEDFHFGDFKATVKCEDPNANLYSFVGSMEYEEQQYPLSPLQLLLRDSKLRNTDYVFGAVIFTGHDTKVIQNSTDAPSKRSKVEKKMDRVIYFLFCILFLMAFVGSIFFGIATEDDLDNGLMKRWYLRPDDSTIFFDPKRAPAAAIFHFLTALMLYGFFIPISLYVSIEIVKVLQSIFINQDIHMYYEDADKPAHARTSNLNEELGQVDTILSDKTGTLTCNSMEFIKCSIAGVAYGRGVTEVERAMNRKNGYPLIDDTRSSPVRNAPIKGFNFSDERIMNGNWVNEPYANVIQNFFRLLAICHTAIPEVDEDTGNISYETESPDEAAFVIAAREIGFEFFKRTQTSLSMYELDPVSGDKTERMYKLLNILEFNSSRKRMSVIVKDEEGRIFLLCKGADSVMFERLAKDGREFEEKTMEHVHEYADAGLRTLILAFRELDENQYKEFDNKISQAKNSISEDRETLIEEVSDKIERNLILLGATAVEDKLQDGVPDCIDKLAQAGIKIWVLTGDKMETAINIGFSCSLLRQGMKQIIIHLETPDIKTLEKAGDKGAIVKASRESIRHQISEAAQQLTASRGTSQQAFALIIDGKSLTYALEDTMKNMFLDLAIRCASVICCRSSPKQKALVTRLVKSGTGKTTLAIGDGANDVGMLQEADIGIGISGVEGMQAVMSSDIAIAQFRYLERLLLVHGHWCYRRISSMVLLLLYPLLNIL

SEQ ID NO: 165349 - protein, 86 aa, Glycine max
  Coding DNA Sequence Number=SeqID_48571
MRAHNDPQLLDLEHERQREQKGWAPSLTNTSMISCSSTETYWAASLGSYDSSFTEKKRKRTTIAVGSYFWLGKEQKVQNITYNGKF

SEQ ID NO: 165350 - protein, 363 aa, Glycine max
  Coding DNA Sequence Number=SeqID_48572
MKLAKYRLKAQVEKDEGPSGEGQSPRVEKDEGPSNPCGVYPDLSSFTRSGVYPDLSSFTGSGVYPDLSSFTGSSGVYPDLSSFTGSSGVYPDLSSFTGSGVIQTFTLSTSWKPSRAKGCAIGLLMGDKVIYYLNNIVLGMPFQHGRIPTVTSNIGVGTMDCKKFITISSWWHEISARDYALLLFCKNLKFQSSNVNVLVELDTPVKNCLNIFGLERSDLNKSTGKSIPYLKLRELPDESFKILCPNIVEKQEELFKGLEQQLSGFASNVGKCKIGKNAVANQGVNNVVAKSESSDQQVTKDIEGFDVDMGGNEGAKIAVDVAHSLDGPHNELKASCLKDIVIDLLRGSGPKAKLKKAEILEHT

SEQ ID NO: 165351 - protein, 117 aa, Glycine max
  Coding DNA Sequence Number=SeqID_48573
  Subcellular localization annotation: CTP_CleavageSite=61; ConfidenceScore=5.41e-01
MAGPMTCRGTLWLSAPFVNQRQTNIVFYTLCQSWPTSPLTHSTPDSMQRLTSSAAPFCQPKASEPVDTQRPTLSSTPLSSKDGESDDMRGYLMVIHTFCQPEEGEPVDTRRFMSSSA

SEQ ID NO: 165352 - protein, 100 aa, Glycine max
  Coding DNA Sequence Number=SeqID_48574
MISNDQIIDNTEHHHRLYLSQSFSIEKKKRKRQRKNPAPSLKTVTLPVSKCKKPRKRLKTRRKVEKSKQEDKQQFTTGMTVKEYHITSLKFQDQVKVACL

SEQ ID NO: 165353 - protein, 73 aa, Glycine max
  Coding DNA Sequence Number=SeqID_48575
MVVTGDGELGWTLGWVDRSASGVHRSARPFCRRCAPVLNWPGRASGAVTLKKLECSKQAYALYTLAWDNTTGF

SEQ ID NO: 165354 - protein, 105 aa, Glycine max
  Coding DNA Sequence Number=SeqID_48576
MEIKDRSKGINNITLSTHMLEPSVHWMNKTIFYNLNNVIKMVINITALLNQTHNFHGIILNLYVKKPTFTCHLLNEKCPPSLPEEQSFLQGYKQNHLRIHPYHSR

SEQ ID NO: 165355 - protein, 223 aa, Glycine max
  Coding DNA Sequence Number=SeqID_48577
  Homolog annotation: Hit_ID=Q6AVG1; Match level="QueryCoverage=33%, HitCoverage=18%, E-value=7e-22, Identity=62%"; Hit description =Expressed protein
  Subcellular localization annotation: CTP_CleavageSite=81; ConfidenceScore=5.10e-01
MKSSNNQHPLNSVSKHFNLQLVRFLPYLLFLAFGVTIGIIISFYLKSFSLQHTQFLHSSSSQINAPPPNTMPPPIEKPEVSDSNLNQEGPEEFTPPSNVVHNTQESIQPSIVVHDTKKFIQPSNHVVHNMKEFIHPSNVVHDMSDEELLWRASMTPKIREYPFDRVAKVAFMFLVRGPVPLAIFWERFFKGHEGYYSIYVHSNPSYNGSDPESFSVFMEGEFL

SEQ ID NO: 165356 - protein, 126 aa, Glycine max
  Coding DNA Sequence Number=SeqID_48578
MDKNSRITKKVIKEEAIGYFSQEVSRTDWVDPKVLEIQFFLDENSIVDLLESPFNINKQGGHEGWVICSSGNDGRMCSQGQTKDIGKEVTRTSEQAYAYNDFLLMYLAFFKDLGIELPLTEFQRGY

SEQ ID NO: 165357 - protein, 85 aa, Glycine max
  Coding DNA Sequence Number=SeqID_48579
MDEDQWMYGNTMSEEVDMDYENEQECGVNEPHVDYDVLQWARSVAHENEFVAVIMRKKESVRRDIRSRTCGCPFKLRGTPLIRGE

SEQ ID NO: 165358 - protein, 167 aa, Glycine max
  Coding DNA Sequence Number=SeqID_48580
  Homolog annotation: Hit_ID=Q1RTB4; Match level="QueryCoverage=79%, HitCoverage=31%, E-value=3e-10, Identity=28%"; Hit description=IMP dehydrogenase/GMP reductase
MSNMEENHTNNVSTLTRNIRITVLLNNLQKAAMDVFFAFKTQGENPIPTILVDTFFSMEVYHEKKRGMLQCCNHMLYFPKDTILSCGEFSNVPLMGPRGCVAYTPAIMLQQLKWTQVVPKVEELGGLSFQYTSSDTNVDQAKVRTIWNNVRKKREKELGKPRVTASS

SEQ ID NO: 165359 - protein, 298 aa, Glycine max
  Coding DNA Sequence Number=SeqID_48581
  Subcellular localization annotation: CTP_CleavageSite=52; ConfidenceScore=5.05e-01
MESILAKLANKIERKHKRANSSNTSTSLQPQAIITHSKVKTFDPPQSKASPLAKSKVEASNKRINRQVIETDSSTSFTIFPRGDWMGLGRYKKCEGMGDLVNYGQWKKVLSLKNDCNFFGNVMTGLKTLVEQMTPAFEQIKFCEKTYGSSQPFDILKKKLSRLIVLIESSKRGVEKDAKFKSLKGEEEAKHFKDEGVQLEKYLNDFKSFIAKVVEDAKSSNVKIGEVEFELVRVKSFYDKLDKDFANIGIESFSNGNKQAQYLLKRNLSIDYAIMQSIVSEDETWKTFVGGRFVASEP

SEQ ID NO: 165360 - protein, 262 aa, Glycine max
  Coding DNA Sequence Number=SeqID_48582
  Gene Ontology: Mol. function=GPI anchor binding; Cellular component =membrane; Biological process=cell adhesion
  Homolog annotation: Hit_ID=Q1SJM1; Match level="QueryCoverage=47%, HitCoverage=49%, E-value=1e-40, Identity=65%"; Hit description=Beta -Ig-H3/fasciclin
  Pfam annotation: Domain name=Fasciclin; Domain location=53-184; Score= 21.5; E_value=5.9e-05; Accession=PF02469.12; Description=Fasciclin domain
  Subcellular localization annotation: CTP_CleavageSite=62; ConfidenceScore=5.13e-01
MEFSMIFIVSNIMLLFSSSFGKIASHPFLSPTPALAPTLDFLNLTELLSVVGPFHTFLGYLESTKVIDTFQNQANNTEEGITIFVPKDNDFNAIKKTTLSNLTSNRLKQVILFHALPHFYSVTEFIISPRPWVVGKDVNVKKEEEIKDTNNSSSEGTIENPTTSEDVKDNKRLRAIGVNTVGLQRMGLKENALFDSLAKLSHAATIVEAMPCHSAMTLGKNSSMRGEPFSPRRENPLDEPLFSQISFAWATPVSPGRRNRAL

SEQ ID NO: 165361 - protein, 159 aa, Glycine max
  Coding DNA Sequence Number=SeqID_48583
  Gene Ontology: Mol. function=protein kinase activity; Cellular component=integral to membrane; Biological process=protein amino acid phosphorylation
  Homolog annotation: Hit_ID=Q5ZBB1; Match level="QueryCoverage=91%, HitCoverage=18%, E-value=1e-34, Identity=53%"; Hit description=Dual -specific kinase DSK1-like
  Pfam annotation: Domain name=Pkinase_Tyr; Domain location=38-159; Score=-106.9; E_value=6.5e-06; Accession=PF07714.7; Description =Protein tyrosine kinase
MKGLHNLCAVCNNTRPKFECNRKRDFTFAELHAATQGFSPKNFLSEGGFGSVYKGRFYGKKIAVKQAKLICANHKGEKEFKSEVDALSKARHENVVKLLGSCTEGNHRLLVYEYVCNGSLDQRLSQHSRKPLCWQDGVKVAIGAAKGLLYLHKNKLIYT

SEQ ID NO: 165362 - protein, 514 aa, Glycine max
  Coding DNA Sequence Number=SeqID_48584
  Gene Ontology: Mol. function=protein kinase activity; Cellular component=integral to membrane; Biological process=protein amino acid phosphorylation
  Homolog annotation: Hit_ID=Q9C890; Match level="QueryCoverage=56%, HitCoverage=45%, E-value=1e-75, Identity=51%"; Hit description =Protein kinase, putative; 86372-89112
  Pfam annotation: Domain name=Pkinase; Domain location=135-397; Score =131.0; E_value=3.2e-36; Accession=PF00069.15; Description=Protein kinase domain
  Pfam annotation: Domain name=Pkinase_Tyr; Domain location=135-397; Score=118.6; E_value=1.8e-32; Accession=PF07714.7; Description =Protein tyrosine kinase
  Pfam module annotation: Pfam domain module=Pkinase::Pkinase_Tyr; Domain location=135-397::135-397
MKHFVRNLPCGMYRITSDNSIERLKDPKSAVSTKTFALRQENVSYKEMFPGSEEEERSLLISGVQRSPLLVSEACGMVVNTKRESFIQIKNKKQQGINHCFTFRRMKRRANYKRPNIGLKRDFSYAELHTATQGFSPKNFLSEGGFGSVYKGLLNGMKIAVKQHKYASFQGEKEFKSEVNVLSKARHENVVVLLGSCSEKNNRLLVYEYVCNGSLDQHLSEHSRSPLSWEDRINVAIGAAKGLLYLHKNNMIHRDVRPNNILITHDYHPLLGDFGLARNQNQDSIHSTEVVGTLGYLAPEYAELGKVSTKTDVYSFGVVLLQLITGMRTTDKRLGGRSLVGWARPLLRERNYPDLIDERIINSHDVHQLFWMVRIAEKCLSREPQRRLNMIQVVDALTDIVEGRTCDIILRDYSPARSDSTYSASDSDESEDEMQEPLRFESELLSHSSESIESNNISQMMHMIVRQPPSPPIQSISSSSSSSYKLHYESTSDGEAHNEGEIEISNSNWGLLNS

SEQ ID NO: 165363 - protein, 328 aa, Glycine max
  Coding DNA Sequence Number=SeqID_48585
  Gene Ontology: Mol. function=RNA-directed DNA polymerase activity; Cellular component=exocyst; Biological process=RNA-dependent DNA replication
  Homolog annotation: Hit_ID=Q1RV13; Match level="QueryCoverage=73%, HitCoverage=57%, E-value=5e-51, Identity=43%"; Hit description=IMP dehydrogenase/GMP reductase
MEFTPQRGLKQEDTLAGFVFNIVVECLTGLMREAQKKNLYDGFKVGRNNLEINILQYADDTVFFGTTSMENVRAIKVMLRSFELVSGLKINFAKSNFGAIGMFEQWLNSVASYLNSRALSIHFPYLGIPIGANPRRNEIWGDPIVKKCESKLSKWKQNISFGVRVYLIKSVLNSIPIYFFSFLRAPKKVVDRLVRLQRWFLWGEHSNQKIAWVNWGSVCLPKEKGGLSIKDLEGSWFKSESKWNIGCRSKVLFWEDRWKDDGIPLMENSNGGEFFCEIDMVAKFMEDIEGLIVQMQQQDVWRWEGDSSGGYTVGSAYRLLDRDLADEN

SEQ ID NO: 165364 - protein, 1088 aa, Glycine max
  Coding DNA Sequence Number=SeqID_48586
  Gene Ontology: Mol. function=nucleic acid binding; Cellular component= nucleus; Biological process=regulation of transcription, DNA-dependent
  Homolog annotation: Hit_ID=Q8LRK9; Match level="QueryCoverage=92%, HitCoverage=55%, E-value=0.0, Identity=52%"; Hit description=HAF1
  Pfam annotation: Domain name=ubiquitin; Domain location=333-402; Score=35.6; E_value=1.8e-07; Accession=PF00240.13; Description =Ubiquitin family
NDVDLEFPKFGFLHADASVDRKNDQQSKDSCHSAEPMKGDFVKNHFWKNHPFMLANFYPLDQQDWEDKILWGNSPMEPQKKLEDKDHNVLMCSSPVKVEPFGSWDSFGAKTNLISRSLFHPQLLRLESRSEVDSSSLADGREAEISEHNQSGQVKRFTKVISQNRDMMEGSWLDKIIWEELDQPMVKPKLIFDLQDDQMHFEVLDSKDGTHLRLHAGAMILTRSLQSISGDSSELPGHGSQYGWRHVANDKHYSNRKTSQQLKSNSKKRSAHGVKVFHSQPALKLQTMKLKLSNKDIANFHRPKALWYPHDNEVAVKEQGKLPTQGPMKIIIKSLGGKGSKLHVDAEETLSSVKAKASKKLDFKVSETVKIFYLGRELEDHKSLAAQNVQPNSLLHLVRTKIHLWPKAQRVPGENKSLRPPGAFKKKSDLSVKDGHVFLMEHCEERPLLLSNVGMGARLCTYYQKCSPDDQSGSLLRNTDNSLGHIISLDPADKSPFLGDLKPGCTQSSLETNMYRAPVFPHKVPLTDYLLVRSSKGKLSLRRIDKINVVGQQEPLMEVLSPGSKNLQNYMINRLLVHMCREFQAAEKRHMPPYIRVDEFLSQFPYQSEASFRKKIKEYANLQVCAYESMQAGLYRLKHLGITETHPTNISSAMSRLPDEAIALAAASHIERELQITPWNLSSNFVACTSQGKENIERMEITGVGDPSGRGMGFSYARAPPKAPVSSAMVKKKAAANRGGSTVTGTDADLRRLSMDAAREVLLKFNVPDEVIAKQTRWHRIAMIRKLSSEQATSGVKVDPTTISKYARGQRMSFLQLQQQTREKCQEIWDRQVQSLSAVNGDENESDLEGNSDLDSFAGDLENLLDAEECEEGEESTNDLKRDKGDGVKGLKMRRHPTLAQAEEEIEDDAAEAAELCRLLMDDDEADKKKKKKAKVIVGEARLVPKMQSKFSFDNAEQVKQITNTLQLDGTNHWKEDAITDLREPNSTLDRVKNEPQETDSNQCSSSRLGCISDPAVENNNQRIAKRKQREKKVSSEANGGSVSVEEEDSGVCGFAPMAVDAAAVSEGSCSIFHEVREPELNEDDEAA

SEQ ID NO: 165365 - protein, 282 aa, Glycine max
  Coding DNA Sequence Number=SeqID_48587
  Gene Ontology: Mol. function=RNA-directed DNA polymerase activity; Biological process=RNA-dependent DNA replication
SNGTAGLKSEQKRQPNNNERQQLNSGPNSHEASPTMLKGSGVKEIVGWEDKHNENDVTVASKLASSPRTCELLKEATINWDMAKNIGVNCCNQEGSLVCKMMSMEERDKGESQRMGNSEMDMLCLQETKKEVINKAVCQALGGDSDVKWELQPACNNAGGILCLWSEETFKLEKKLIGCGFIYLNGIWVADGRKVSIVNIYSPCNATLKRNLWEQVRRIRSANLGGLWCLLGDFNNIRRASERVGVCQRPQDENIMREFNERIAELEVEDVPCVGMAYQMAR

SEQ ID NO: 165366 - protein, 834 aa, Glycine max
  Coding DNA Sequence Number=SeqID_48588
  Gene Ontology: Mol. function=RNA-directed DNA polymerase activity; Cellular component=chromatin; Biological process=chromatin assembly or disassembly
  Pfam annotation: Domain name=RVP_2; Domain location=82-187; Score= -43.4; E_value=0.0024; Accession=PF08284.2; Description=Retroviral aspartyl protease
  Pfam module annotation: Pfam domain module=RVP_2::RVT_1; Domain location=82-187::172-358
MGWSVEATTPLHIKLGDGFKAKTEGECKRILIKIGQMQMNIDAMLFDLDGLDDVEEEDEEGEMSVMSLFGLVAAQSNSFETMKLRGKIQGVPILVLVDSGATHNFISHKLVKAMGWSVKATAPLHIKLGDGFKAKTQGECKRILIEIGQMQMNIDAMLFDLDGLDGKGKENLPCSALQSLLAKPKLGSEGFFMASKVQMGKMPNPENGKLSVFGAVFQEPRGLPPKRNQEHVIHLLEGQGPDDTWRMCVDYRALNKGHYEYLVMPFGMMNAPSTFQALMNAVFKPMLRKFVLVFFDDILVYSSTWTAHMSHLRTYGRDYGKLAKPLTEVTKKEGFKWGRNEQQAFDVLKEKVTTAPVLALLDFTQEFFIESDALGNGVDALSRMHDSMAFESMVHYPEWEGNKEVIDEVHRDAMLQKIIADLKEGLPTKPGLMQPLPIPSLVWEDLSMDFITRLPKSKGYETIFVVVDLVQVARDSLEVEHGISPANGGAFHASTNTTPFEIVYGRQPPIITRFLPGEVKVHAVQRDLTDRDKCLRQLKHHLVCTQTRMMSLADGHRQDRQFVIGEWVFLKLRPHVQQLVGARINPKLAPRGGEYQVESELPKELDCDPSAVWEPLTVLDTRTAIEEATWEDEALISRQFPGLSLVGKSVSQEGGSDRALKGDVGLGDQRVKPKESPEVPKRSMAMPLPVLCVEDGVTILRFSEIFGIHEPLRKGEKREHRHSIPREEDEEEFLKGFSQSLSLTKQVCVVHNDVSESNDVDLEFPKFGFLLADASVARKDDHQSKDSCHSAEPMKGDFAEDHSRKDHPFMLANFYPLDQQDWEDAPFLGQFSSS

SEQ ID NO: 165367 - protein, 115 aa, Glycine max
  Coding DNA Sequence Number=SeqID_48589
MWGIPFILEPNQALTCIMSSHSTSLEPKSRLTINLDPGKKRRRRRREKKENSPIKEWEKAKRKERKFPIKEWEKVKKEEEEGKKAPDQGSKEKQKKCAERSLDRTISEQYRIVTK

SEQ ID NO: 165368 - protein, 87 aa, Glycine max
  Coding DNA Sequence Number=SeqID_48590
METQHKLVGSKLLVKGLKNAREEATVFFGGSNPARLGELGGNLLPLFPIKRLKGAVLRIPQPLGYVFQLFWVKKIVSVKKIQAEVLP

SEQ ID NO: 165369 - protein, 86 aa, Glycine max
  Coding DNA Sequence Number=SeqID_48591
LCVRNSASSSSQLRLRGFACDAIIPRKGPVTRAMSKRLQEDWARATEEGPRVLMNLKAPHTPVSPSSIKHERKLGSEAINRTRSVH

SEQ ID NO: 165370 - protein, 93 aa, Glycine max
  Coding DNA Sequence Number=SeqID_48592
MRKDVDGQWVHKHDLPPPIPDEHTPFLPPQQDSSSFLLNDVLIELRYLRDFAGDRFDAMDSRITRLEDDMSFIRRCFDPPADPEKFLLHPTFI

SEQ ID NO: 165371 - protein, 171 aa, Glycine max
  Coding DNA Sequence Number=SeqID_48593
AIEGGKDYAFANLEELFLVPNIITPPKFKVLDFDKYKGTTCPKNHPKMYCRKMGAYTKDDELLIHSFQENLTGVCIMSSDRMQLQNMWRDLAAQVAPPMMEREMVIVMVDTLPVFYYENGGLTPSSFADMVFTNERIKMGLKRGKSDHHALINAKKLGQMKRVRMREKPML

SEQ ID NO: 165372 - protein, 95 aa, Glycine max
  Coding DNA Sequence Number=SeqID_48594
MELTCITEARNNAANTNANAKFGDFWMREEEGKESAWLSTRITPLSEVCRSEKLQLLLSQDLASLAKMMHLKYRRNMRLADKDMLSAHVSAMNSA

SEQ ID NO: 165373 - protein, 215 aa, Glycine max
  Coding DNA Sequence Number=SeqID_48595
  Gene Ontology: Mol. function=glutamyl-tRNA reductase activity; Biological process=tetrapyrrole biosynthetic process
  Homolog annotation: Hit_ID=Q6AVG1; Match level="QueryCoverage=97%, HitCoverage=53%, E-value=3e-60, Identity=50%"; Hit description =Expressed protein
  Pfam annotation: Domain name=DUF266; Domain location=1-93; Score =156.3; E_value=7.9e-44; Accession=PF03267.4; Description=Arabidopsis protein of unknown function, DUF266
MQIVEWGKFNMIEAERRLLANALLDFSNQRFILISESCIPLFNFSTIYSYLMNSTQSYVMAYDEDSLVGRGRYNPRMSPMVTLKQWRKGSQWFEMDRELALEVVSDKTYFPIFQEHCTRPCYADEHYLPTFVNIMFPEKNSNRSLTWVDWSKGGLHPTKYVRPEVTVAFLENLRNQKCEYNGQAYTNACFLFARKFLPTSLTRLMRFSPSVMHIQ

SEQ ID NO: 165374 - protein, 122 aa, Glycine max
  Coding DNA Sequence Number=SeqID_48596
  Gene Ontology: Mol. function=protein kinase activity; Cellular component=integral to membrane; Biological process=protein amino acid phosphorylation
  Homolog annotation: Hit_ID=Q2LJM2; Match level="QueryCoverage=90%, HitCoverage=17%, E-value=6e-35, Identity=66%"; Hit description =Putative receptor kinase
MEILTGKCPSFEVDGGCATAVELPRWVRSVVREEWTAEVFDLELMRYKDIEEEMVALLQIAMACTATVPDQRPRMSHVSKMIEELSGVHVSQSHDALDSVSESPSAPEDACTGRDGPASASQ

SEQ ID NO: 165375 - protein, 179 aa, Glycine max
  Coding DNA Sequence Number=SeqID_48597
  Gene Ontology: Mol. function=protein kinase activity; Cellular component=integral to membrane; Biological process=protein amino acid phosphorylation
  Homolog annotation: Hit_ID=Q2LJM2; Match level="QueryCoverage=79%, HitCoverage=22%, E-value=7e-46, Identity=63%"; Hit description =Putative receptor kinase
MGLMVLVIIVLGDVLVLALVSLILYCYFWRNYSVSLKEVKVETHSKSKAVYKRKVNSEGMVFLEGVRRFELEELLCASAEMLGKGVFGTAYKAVLDDGNVVAVKRLKEVSVGGKRELQQRMEVLGRLRHCNVVPLRAYYFAKDEKLLVSDYMPNGNLSWLLHGFYATRDFLFLVVPFDS

SEQ ID NO: 165376 - protein, 157 aa, Glycine max
  Coding DNA Sequence Number=SeqID_48598
  Gene Ontology: Mol. function=protein kinase activity; Cellular component=integral to membrane; Biological process=protein amino acid phosphorylation
  Homolog annotation: Hit_ID=Q2LJM2; Match level="QueryCoverage=99%, HitCoverage=20%, E-value=4e-42, Identity=60%"; Hit description =Putative receptor kinase
AVTGDVEVLKMRKVVDVGNAATESCRNLTGEVVVGEVKAVEVGEGSDGGGKLAGEFVVGEEEELESGEVGEGGNGTVETVAFKAEDAELGEEGEGEDGAGEVEVFEDEAGDAAAAAVVVVVVVEAAGDAVPGAGVGGRGVPLREEFVGRVGGGFERH

SEQ ID NO: 165377 - protein, 142 aa, Glycine max
  Coding DNA Sequence Number=SeqID_48599
  Homolog annotation: Hit_ID=Q67W65; Match level="QueryCoverage=54%, HitCoverage=4%, E-value=7e-20, Identity=64%"; Hit description =Putative HAC13 protein
MVGLMVFFRLGHYANIPFSHHKTYSCCDVKAEDAVDYEDIDEEYDGPETEAANEEDYLLPKKEFFSAEASVCLESKASVFDDENYDEDSEKEQDFVNDDCKVDNIPLAGEQKESFVDASKEESSLEHELHVDSPQTEELDAD

SEQ ID NO: 165378 - protein, 115 aa, Glycine max
  Coding DNA Sequence Number=SeqID_48600
MEPTEDTLEAWKKDQKFQGKQRNEILICFLKLHPVHPTCRFGIFNWRKYPVINNIKQLESADLERNKKHAHKGGGDDDEDHDDEDDDSDDGNNKMKKGKWDANENEEEYKDGHKE

SEQ ID NO: 165379 - protein, 56 aa, Glycine max
  Coding DNA Sequence Number=SeqID_48601
  Homolog annotation: Hit_ID=Q67W65; Match level="QueryCoverage=70%, HitCoverage=2%, E-value=4e-11, Identity=72%"; Hit description =Putative HAC13 protein
MFGEIQMIDDEEEYEESGKGNRFLGFMFGNVDNSGDLDVDYLDEDRNDFASKPRFD

SEQ ID NO: 165380 - protein, 478 aa, Glycine max
  Coding DNA Sequence Number=SeqID_48602
  Gene Ontology: Mol. function=acyltransferase activity
  Homolog annotation: Hit_ID=Q1SBS4; Match level="QueryCoverage=98%, HitCoverage=100%, E-value=1e-171, Identity=65%"; Hit description =Anthocyanin acyltransferase
  Pfam annotation: Domain name=Transferase; Domain location=8-462; Score=20.1; E_value=6.3e-12; Accession=PF02458.6; Description =Transferase family
MSITPFTLKVLEQCKITLPPNETTTTSFLPLTFFDIPWLFFSPSQPLFFYEFPHPTSHFTATIVPKLKQSLSHTLQHYYHFVGTFFPSSDLTKPPLICIDDMSVALTIAESNGDFFHFCSNYPRDLKDFHLLVPKLASSFSLEGKEELILVLAIQITLFPNVGLCIGHAFHHVVADGRTFHNFFNTWASYCCSFGSASSAFPLKSLPLYDRSVIIDVKGLEEVFLKEWRKRRLVHDIAIGREPNLEDVSGMVRATFLMSATEMEKIKCFIINFCKEKNQTQPVHLSPYVLTCAFVWVCLLKNQQCLNERVKHEDPTYFGFIAGGITRLDYLGPKTYLGNCVGFGRASVKIKELLGQDGIVVAARAIGSTIKKLDSSLFDGAEKWILDWEVFHGSEQHVHAKWSPKLKLYELDFGWGRPKKIEEISIGYTRVVSLIQSRDVECGIEIGLALPKSKMDTFFILFTKGLSVLPCDPLINFS

SEQ ID NO: 165381 - protein, 144 aa, Glycine max
  Coding DNA Sequence Number=SeqID_48603
  Homolog annotation: Hit_ID=Q9C6W3; Match level="QueryCoverage=36%, HitCoverage=5%, E-value=3e-07, Identity=61%"; Hit description =Epsilon-adaptin, putative
MKLLHVLKLNKLNKLTSLFVVESLMVAGKDTLLLLIHSKVAVCCCRNILSDSSSSHTFKGGAETLVGRELAIAMGSNNHDNSKEFLELIKSTCESRSKAEEDRIVLHGIEALKRRINEAGNNVLVANCLLIFKIYKLKTKNHLK

SEQ ID NO: 165382 - protein, 540 aa, Glycine max
  Coding DNA Sequence Number=SeqID_48604
  Gene Ontology: Mol. function=transporter activity; Cellular component= membrane; Biological process=oligopeptide transport
  Homolog annotation: Hit_ID=Q1SJN9; Match level="QueryCoverage=99%, HitCoverage=100%, E-value=0.0, Identity=75%"; Hit description=TGF -beta receptor, type I/II extracellular region
  Pfam annotation: Domain name=MFS_1; Domain location=17-485; Score =37.3; E_value=5.2e-08; Accession=PF07690.6; Description=Major Facilitator Superfamily
  Pfam annotation: Domain name=PTR2; Domain location=79-469; Score =177.9; E_value=2.5e-50; Accession=PF00854.12; Description=POT family
  Pfam module annotation: Pfam domain module=MFS_1::PTR2; Domain location=17-485::79-469
MADGQRQQRLSKSCILLIAIAGIERFAFKGVASNLVTYLTDVVNLSNSSAAKMVNSWVGFTSIMPLLVAPIADAYWRKYSTIMVSSFLYFVGLAALTTTALARSWHHKNRSMSSSFLSLSLYLISLGQGGYNPSLQAFGADQLGEEEELPCSKEDKSCNKKTLFFQWWYFGVCSGSLLGVTVMSYIQDTFGWVLGFAIPAISMILSILIFSGGSPIYLYKEHDVLQAKKPLRNIFQAVKASALRCFHCEITLPNDKTEVVELELQEKPLCPEKLESLKDLNKDPKGGMYLLANAKVMVRLLPIWTMLLMFAVIFQQPATFFTKQGMTMKRNIGAGFKIPPATLQSAITLSIILLMPLYDKIFIPITQVITRQERGISVMQRMGIGMVLSIIAMIIAALVEMRRLEIGSQMRSAGSQSETVPLSIFWLLPQYILLGISDIFTVVGMQEFFYGEVPRHMRTMGIALYTSVFGVGSFVSALLITLVEVYTSSKGIPSWFCDDMVEARLDSYYWLLAWLSTVSLLLYALLCRYYPKKSDSDNEY

SEQ ID NO: 165383 - protein, 73 aa, Glycine max
  Coding DNA Sequence Number=SeqID_48605
MVTRDIHHSRHPIPQFYSHTVLILGLTLPLSLSCLHGLTQHMDDDWEDTPHVGKGHGALTNYGYGSTLVNNAK

SEQ ID NO: 165384 - protein, 59 aa, Glycine max
  Coding DNA Sequence Number=SeqID_48606
KQPIAAPPKKNQQEDEGAGAWSRMKKTNTQGGRAKAAYGRLLAFSLASSTFVVAATKSD

SEQ ID NO: 165385 - protein, 185 aa, Glycine max
  Coding DNA Sequence Number=SeqID_48607
  Homolog annotation: Hit_ID=Q8H6Q8; Match level="QueryCoverage=88%, HitCoverage=6%, E-value=4e-17, Identity=31%"; Hit description=CTV.20
MQPRHYGSNLNQPKKFSAPFDPTGYIYWDYIDVWTNVFWHQNNKFKHSWLIYFKNNTVYNFPNWFLQWWNFFGPTSQIYLEQVQQGFEQFNRMFNNQESRIPADLMYGKTESSKQFPPLQGHAFVKWWTQFDTSKAAPDQVKNWFQAHPKFVKPTDPKTSLFLNQKSRLAAFLASSKSKESLAKN

SEQ ID NO: 165386 - protein, 159 aa, Glycine max
  Coding DNA Sequence Number=SeqID_48608
MEEKKTESEQNEDESQQNKKRIECLGFENLQVEERRTHEEWTKNGEEGGKSSRNCSRKRFRSITKASRLGFSSRKHVFSPKTAEMHSIGEKWGGGCHPAPPSELGCFLLKQPSFQNVLEGARFKNLKTAIYTPILISSPAFFVIYEKVMEALRKHIGNV

SEQ ID NO: 165387 - protein, 112 aa, Glycine max
  Coding DNA Sequence Number=SeqID_48609
MRNHRTIIKRERGSFIAKFVAFSLVGVLATAGDEEGVDDGIEDGPRASTEDRDGVDAASVEGGDGVAATSGGLTSIDTEDTDEVNDGRLSRGGNSLTTYRFFFVVLPFPLES

SEQ ID NO: 165388 - protein, 237 aa, Glycine max
  Coding DNA Sequence Number=SeqID_48610
  Gene Ontology: Mol. function=protein serine/threonine kinase activity; Cellular component=integral to membrane; Biological process=protein amino acid phosphorylation
  Homolog annotation: Hit_ID=Q8S7A6; Match level="QueryCoverage=94%, HitCoverage=20%, E-value=6e-48, Identity=47%"; Hit description =Putative receptor protein kinase
  Pfam annotation: Domain name=Pkinase; Domain location=4-217; Score= -75.7; E_value=0.00047; Accession=PF00069.15; Description=Protein kinase domain
  Pfam annotation: Domain name=Pkinase_Tyr; Domain location=1-170; Score=-148.6; E_value=0.0024; Accession=PF07714.7; Description =Protein tyrosine kinase
  Pfam module annotation: Pfam domain module=Pkinase::Pkinase_Tyr; Domain location=4-217::1-170
MCPRTLSANCKGPRTLNLDQRLNIMIDVASTLHYLHHECEQSIIHCDLKPRNVLNDDMIAHVSDFCIARLLSTINGTTSKQTSIIGIKGTIGYAPPEYGMGSEVSMNSDMYSFEVLLLEMLTGRRPTDQIFEDGPNMHNFVENSYPDNLFHILDPSLVPKPEEATIQEENSQNLTPTVANYLVSLLKIGLACSVESPKERMNVVDVTRELRKIRKAFLTGKINGILLNSLHITREQM

SEQ ID NO: 165389 - protein, 76 aa, Glycine max
  Coding DNA Sequence Number=SeqID_48611
MGQSNPTHLLLYAKNLGLAQVTVGWQYNVFFEFLWLKIFKDNEELIASELVLPNTIVFTNHSYNATSNDTLVVCNF

SEQ ID NO: 165390 - protein, 79 aa, Glycine max
  Coding DNA Sequence Number=SeqID_48612
MAIVSSPWSWSHCQGHTEMTWPHIDFYEFCEDGHTQFTMSKCGISPRISPRSWEKSSLKAPVATKEHGDHNGGPFGLGL

SEQ ID NO: 165391 - protein, 56 aa, Glycine max
  Coding DNA Sequence Number=SeqID_48613
MAAVGGAGFDDEGMSSVLALFLDAIYKKGIQTTTKIKVVQIRKCRNELRLAYGSSA

SEQ ID NO: 165392 - protein, 70 aa, Glycine max
  Coding DNA Sequence Number=SeqID_48614
MNKRSNKRGSAREKEARVLTFAEDNVAREGVRGRRKMAAAAQRKNSGGYERVCGDDEGDNVKAKLTERGE

SEQ ID NO: 165393 - protein, 100 aa, Glycine max
  Coding DNA Sequence Number=SeqID_48615
  Subcellular localization annotation: CTP_CleavageSite=48; ConfidenceScore=5.21e-01
MEAQLKHFRVKRFPTPPSLSHSHNLKKLFAVPRRSMLHNYMYSVKSTLAAALKKLTEKGIVMKKKAGDVGDMIRDVVKDEDGFKGSFVRAMDEFLSATEF

SEQ ID NO: 165394 - protein, 268 aa, Glycine max
  Coding DNA Sequence Number=SeqID_48616
  Gene Ontology: Mol. function=chitin binding; Cellular component =extracellular region; Biological process=chitin metabolic process
  Homolog annotation: Hit_ID=UPI000044A8F0; Match level="QueryCoverage =81%, HitCoverage=99%, E-value=7e-43, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Pfam annotation: Domain name=Cornifin; Domain location=8-254; Score= -50.9; E_value=0.087; Accession=PF02389.6; Description=Cornifin (SPRR) family
RATGPRLQRTTTSSPSEVCRPSPSEDYTSSPSEDYTSSPLEGYTPSPSEDYMSLPSEGYTPSPSEDYTSSSSEDYTSSSSESYTPSPSEEYTSSPLEGYTSSPLEGYMPSPSEDYTSSPSEGCMPSPSEDYTSSPSEGYTPSPSEDYMSLPSEGYTPSPSEDYTSSPSTGYTPSPSKGYTSSPSEDYTSSPSDGYMSSPSEDCTSSPSEDYMSSPSEGCTPLPSEDYTSSPSKALIMSLCQFYGVPVAPNKVIRPPINRTFIKKYCAP

SEQ ID NO: 165395 - protein, 97 aa, Glycine max
  Coding DNA Sequence Number=SeqID_48617
MDGVTLSEIKQGCTKSLNLFCLCFNARNHHVPLLCSLSPSLCPHHPPPPLFSFNHPHTPHIPKPTTIITTPHTSLHQKEKKGLSVGLTLGFPQGSLS

SEQ ID NO: 165396 - protein, 155 aa, Glycine max
  Coding DNA Sequence Number=SeqID_48618
MEVNSKQTSVENQQAIQEQPLKLIDSSRAHQAEPRNSINWNSPKEASVDYQQAIQEQSVELFDGGGADQSEPENSINWNSPKEASVDNEQAIQGQPVELIDSGEAHQGEPENSVNWNSPKEAFVDNQQAIQGQSVELIDGGGAHQDEPEYWSGDS

SEQ ID NO: 165397 - protein, 410 aa, Glycine max
  Coding DNA Sequence Number=SeqID_48619
  Gene Ontology: Mol. function=RNA-directed DNA polymerase activity; Cellular component=chromatin; Biological process=chromatin assembly or disassembly
  Pfam annotation: Domain name=rve; Domain location=127-255; Score =44.1; E_value=4.8e-10; Accession=PF00665.16; Description=Integrase core domain
  Pfam annotation: Domain name=zf-H2C2; Domain location=68-109; Score =10.3; E_value=0.016; Accession=PF09337.1; Description=His(2)-Cys(2) zinc finger
  Pfam module annotation: Pfam domain module=rve::zf-H2C2; Domain location=127-255::68-109
MVREGGGTWQLRWLGRKVGLTSGASSDSFCTAKYGSPNKNTRRKSYWKTETVLRKKGNEWNALLAEFHQSPTGGHMGVCKTLARLEDNFTWSTIREDTRTFIASCLDCQHTKYETQKLVGLLCPLPVPNRPWEDLSMDFIVGLPAYRGHTSILVVIVGKLPGMPRSIVSDRDPLFISKFWQELFSLSGTKLRMSLAYHPQSNGQTKVANCIVEQYLRAFVHRRHSSWGRFLLWAEWSYNTSCHSTTGISPFEITFDRKSPNFPQYIASTSKIEAVDEMLGQQEANSLAYIQCSILKPYFQASSASPEPVEMPPSAMENQPVISPLTFLTTKWILLSSGPKQMVLVQWLRLHPDEIAWEEWSELKVAYHLEDKVLLDGLGNDTTNTGGLQEARTTRPKRKSGPPAYLKDYA

SEQ ID NO: 165398 - protein, 124 aa, Glycine max
  Coding DNA Sequence Number=SeqID_48620
  Subcellular localization annotation: CTP_CleavageSite=68; ConfidenceScore=5.21e-01
MTWKQYVGLLAYRGPCSPRLASDSPGPSNNFRVKEPARLGELMTSGVSISSLGRVGSPQSDPFPINRRAMGAEKGFRHWVVKEIKRNKREEEERRGNEVEALSNRDCGQSLHHSLFGVLRATVG

SEQ ID NO: 165399 - protein, 381 aa, Glycine max
  Coding DNA Sequence Number=SeqID_48621
  Homolog annotation: Hit_ID=Q1S0F5; Match level="QueryCoverage=17%, HitCoverage=13%, E-value=2e-08, Identity=46%"; Hit description=IMP dehydrogenase/GMP reductase
MCSKKVKANWEELLAGMTEASISWFPRWKEGKAGVLCSCEGFPNIPLLGMRGCINYNHVLAIRQLGYPMRGAPSEEIIAPFIVRDKELRGSSNGVIGSYHKWLKSRTQGITWLPKLKGLSGKEAKIPEESKEVQALKAELKKTRVVKEKLKVPVTRVRKECDELKDINVTTVEALKQETKKARKEEWSKNKFQRALWGSSNELKLRKAEIDKSRMESMVLEDKLKICQRSKRSLTEQLSKIKENMLIIIDQYKEKVNLVASHRQMLEDEQAKRDRGSSRIDEDQVAVLDEETHQDQSNWVQRCSPSFELKNWRIIERLEISVSNPISNNESCESSDTEDPDVDFEQLVNQAEEEENEDWGLPPDLRRMCWTSGLRNFKKGG

SEQ ID NO: 165400 - protein, 250 aa, Glycine max
  Coding DNA Sequence Number=SeqID_48622
MTQEFGSMERHRMVICTFRHPETTSPMTCGDGKSDDMRGYHMVIRTFCHLETASPITCGDDKSDEMRGYRMVIRTFCHLETASPMTCGGTIWLSTPFVNQGQASPDGKSNDMRGYRMVIHTFCHLETASPKTCGDGKSDDMRGVPYGYLHLLSSRDGKSDDMWGYHMVIRTFCHPETAEIPYGHPHLSSTEANEFDDIKMMLSSGDIQAQRCTRFFSAGRGRSSAIARGNVVGSTGWDIDWPNDVPLERN

SEQ ID NO: 165401 - protein, 70 aa, Glycine max
  Coding DNA Sequence Number=SeqID_48623
MANLWHMMLGWIPGILDGCHAINPHSFGFLVHAHDLTVATARGGIRLAWLSDKRIRSHLQAFNVALSGLL

SEQ ID NO: 165402 - protein, 120 aa, Glycine max
  Coding DNA Sequence Number=SeqID_48624
MDQGWSPPYHFYVAPLRDIGKTQHRIASSLGIIGLIGMRLALGVLVDCVGRVFVPLGASHTSLKLIMVGIQFSKFLFMVAFHIGNAVLIEVDGEHRCASWSLEEHWNFLGVALAEGRSVC

SEQ ID NO: 165403 - protein, 791 aa, Glycine max
  Coding DNA Sequence Number=SeqID_48625
  Gene Ontology: Mol. function=catalytic activity; Cellular component =intracellular; Biological process=metabolic process
  Homolog annotation: Hit_ID=Q10PA0; Match level="QueryCoverage=77%, HitCoverage=77%, E-value=0.0, Identity=51%"; Hit description =Pentatricopeptide, putative, expressed
  Pfam annotation: Domain name=PPR; Domain location=200-234; Score =35.6; E_value=1.8e-07; Accession=PF01535.11; Description=PPR repeat
  Pfam annotation: Domain name=PPR; Domain location=268-302; Score =34.6; E_value=3.5e-07; Accession=PF01535.11; Description=PPR repeat
  Pfam annotation: Domain name=PPR; Domain location=303-337; Score=1.0; E_value=5.7; Accession=PF01535.11; Description=PPR repeat
  Pfam annotation: Domain name=PPR; Domain location=369-403; Score =36.7; E_value=8.3e-08; Accession=PF01535.11; Description=PPR repeat
  Pfam annotation: Domain name=PPR; Domain location=404-437; Score=6.1; E_value=1.4; Accession=PF01535.11; Description=PPR repeat
  Pfam annotation: Domain name=PPR; Domain location=440-474; Score =10.4; E_value=0.44; Accession=PF01535.11; Description=PPR repeat
  Pfam annotation: Domain name=PPR; Domain location=506-540; Score=4.6; E_value=2.1; Accession=PF01535.11; Description=PPR repeat
  Pfam annotation: Domain name=PPR; Domain location=99-133; Score=35.6; E_value=1.7e-07; Accession=PF01535.11; Description=PPR repeat
  Pfam module annotation: Pfam domain module=PPR::PPR::PPR::PPR::PPR::PP R::PPR::PPR; Domain location=200-234::268-302::303-337::369-403::404 -437::440-474::506-540::99-133
MNPFHPLTHQFPKLQALVSSIRKSLVSPQNPVLVLELLGKVLDQYPDIKTLKNVHSKVFNLSFHENPSLGIKLMRAYAARGEPGLARNVFDVIPERNVIFYNVMIRSYMNNHLYDDALLVFRDMVSGGFSPDHYTYPCVLKACSCSDNLRIGLQLHGAVFKVGLDLNLFVGNGLIALYGKCGCLPEARCVLDEMQSKDVVSWNSMVAGYAQNMQFDDALDICREMDGVRQKPDACTMASLLPAVTNTSSENVLYVEEMFMNLEKKSLVSWNVMISVYMKNSMPGKSVDLYLQMGKCEVEPDAITCASVLRACGDLSALLLGRRIHEYVERKKLCPNMLLENSLIDMYARCGCLEDAKRVFDRMKFRDVASWTSLISAYGMTGQGYNAVALFTEMQNSGQSPDSIAFVAILSACSHSGLLNEGKFYFKQMTDDYKITPIIEHFACLVDLLGRSGRVDEAYNIIKQMPMKPNERVWGALLSSCRVYSNMDIGILAADKLLQLAPEESGYYVLLSNIYAKAGRWTEVTAIRSLMKRRRIRKMPGISNVELNNQVHTFLAGDTYHPQSKEIYEELSVLVGKMKELGYVPKTDSALHDVEEEDKECHLAVHSEKLAIVFAILNTQESPIRITKNLRVCGDCHIAAKLISKIVQREIVIRDTNRFHHFKDAESTRSISVLIETSDLEATLLFFHHCRHTDTSPPISSPSPAKSSMFLAGAVLPQDCVDAGSEPDSVPNSVGGLGLERSRSFYFCSVSTMQNARNNSWCSRNVCRQTATRMHKNQLRLDDELGTKKQT

SEQ ID NO: 165404 - protein, 66 aa, Glycine max
  Coding DNA Sequence Number=SeqID_48626
MMDIPGREIEWLKSFKHIWRGCFSRGGNTCTWGHVTQFGTPLRLKLITMGGGELPVYDRVTSTLAA

SEQ ID NO: 165405 - protein, 533 aa, Glycine max
  Coding DNA Sequence Number=SeqID_48627
  Gene Ontology: Mol. function=membrane alanyl aminopeptidase activity; Cellular component=membrane; Biological process=proteolysis
  Homolog annotation: Hit_ID=Q7CHK4; Match level="QueryCoverage=97%, HitCoverage=57%, E-value=0.0, Identity=66%"; Hit description =Aminopeptidase N
VDSRGSHGQGAAIAVQQADGERDVVRRLDETGWGLLLDADRLAFLRQRHGAAARRGVVRQLDRHARRARLAVPVAEHRQITARVLARVDRFHGGDEVVAGHGLAVVAAEILVHAGAKARLAQQRVLHADDLGAFFVHRGGIEIADFLVAVGADRVGHRARILGELRRAQRHHVVDALDRAGAGGSGLVHVLRHHVGAELLVAEDRQAFFQAQLEPVAAGDAVAGPVVEIFVTNHGFNAEIVFIGGGFRFGQHVFGVEDVEAFILHRAHVEEIHRDDHKDIEVIFEAETLFVLLHAGFERGHRPVRAVQVAAIDKNFQRHVTAGTSGKAVTQHIEIAGDQRKQVAGFRERILPFHPVTPILVLTARQLVTVGQQVRIASRVGDQGGGEARQHVRAIEIPGDMPEAFGFTLGAERLAGFIQPFQRGVFIRMDFINDGQGKVVRQLADDQCALLFAVVRPRIAIHRQRQQGQRFTVQTQFSLLRAKAFYLTDGGDARGRRIKIKRQVDIGDGVIRRPVVVAIFNLRLLRHKSFSHR

SEQ ID NO: 165406 - protein, 431 aa, Glycine max
  Coding DNA Sequence Number=SeqID_48628
  Gene Ontology: Mol. function=DNA binding; Cellular component=nucleus; Biological process=regulation of transcription
  Homolog annotation: Hit_ID=Q8L8G0; Match level="QueryCoverage=34%, HitCoverage=25%, E-value=4e-36, Identity=52%"; Hit description=Nam -like protein 1
  Pfam annotation: Domain name=NAM; Domain location=3-136; Score=205.4; E_value=1.3e-58; Accession=PF02365.6; Description=No apical meristem (NAM) protein
MDDIVGYGFRPTDEELVKFYLKHKLLDDDPCVHFILDVDLCEVEPWDLPLLLADSAVRFNGREWFFFSPVDYKYSNSKRVNRTTKCGFWKPTGKDRGIRSKDTNNVIGTKKTLVYYQGRVSSGVKSNWVIHEYHAVTFHESQRTFVLCRLMKKPGKTTEGGTDALICDEGGPSRSMVSDYENQATTQGIPSGGTFTGMETTFQGMHLAEKYFSPTQQSPTGIEQEEPSFTNYPFNNAYFRNEDNFMQTPFETKEEDAFLNSIFVDENLVINEESMHAFVNSSTQSESLRRVYCESSDTDAEVVSERDDNIVDVSTMCNEYPNSDGYYSSERFESSHGAVQDSLCLLSTNHEANQETMESILQNNFWGMEQSYCDSTANKPLEINYTEISSSPSTRRRWINQYHPRPDYFTSQKTDEDLRHRGRFQTMQYRM

SEQ ID NO: 165407 - protein, 125 aa, Glycine max
  Coding DNA Sequence Number=SeqID_48629
  Gene Ontology: Mol. function=protein serine/threonine kinase activity; Cellular component=microtubule cytoskeleton; Biological process=protein amino acid phosphorylation
  Homolog annotation: Hit_ID=Q9M269; Match level="QueryCoverage=88%, HitCoverage=17%, E-value=5e-46, Identity=79%"; Hit description =Serine/threonine-protein kinase-like protein
  Pfam annotation: Domain name=Pkinase; Domain location=17-125; Score= -62.5; E_value=7.7e-05; Accession=PF00069.15; Description=Protein kinase domain
  Pfam annotation: Domain name=Pkinase_Tyr; Domain location=17-123; Score=-135.2; E_value=0.00036; Accession=PF07714.7; Description =Protein tyrosine kinase
  Pfam module annotation: Pfam domain module=Pkinase::Pkinase_Tyr; Domain location=17-125::17-123
MTTMMMEFGGPRVIGDYIVGPRIGSGSFAVVWRARNRSSGLEYAVKEIDKRQLSPKVRENLLKEISILSTIHHPNIIRLFEAIQTNDRIYLVLEYCAGGDLAAYIHRHGKVSEPVARHFMRQLGQ

SEQ ID NO: 165408 - protein, 122 aa, Glycine max
  Coding DNA Sequence Number=SeqID_48630
MFGRMLEKCIAKGKSRNLMDSLENMPNVTEKPKTGDKLPKCSIHSSDSDKYMSCIKRNNIIARLRADPKQRLSAVKVFNINMFSWMNLHNVAKSFFPFFSKVILFLRHHMLRIENKLLVLSI

SEQ ID NO: 165409 - protein, 102 aa, Glycine max
  Coding DNA Sequence Number=SeqID_48631
MIQVGDRLRRVCKYRRWPEWLAAQRAPQVALGIKVKQKGKGRKKVTKTACLSVNNLNSLLQFPIDFPSPLHAAQSATLTLYSIEAAHAVSSSYCSIGLRVYD

SEQ ID NO: 165410 - protein, 654 aa, Glycine max
  Coding DNA Sequence Number=SeqID_48632
  Gene Ontology: Mol. function=triacylglycerol lipase activity; Biological process=lipid metabolic process
  Homolog annotation: Hit_ID=Q2TNK2; Match level="QueryCoverage=66%, HitCoverage=78%, E-value=2e-31, Identity=25%"; Hit description =Phytoalexin-deficient 4-2 protein
  Pfam annotation: Domain name=Lipase_3; Domain location=58-273; Score =3.9; E_value=0.00025; Accession=PF01764.16; Description=Lipase (class 3)
  Subcellular localization annotation: CTP_CleavageSite=59; ConfidenceScore=5.25e-01
MALPQSFGCGLVQASFVTSSGLLNKVWSVISSRDKGIVSYSGNNGLFWKVSEDSGLTVVAFEVNPGFDLLSDFVSSSYLKKNNFNHFEFLCTKKNPDFSVNKSAVDLFSENLQRLDELKSKTRGFFGRDVEVVLLEPDWTILGKTELNFTKPSAYYYELLKSKLKSLCDGGAVCILIPILILVQIDSSPRLIVTGYGVGGPIASLFTLSLLGNKKKKDDKKKSSEKKKPPLCITFGSPLVGNNKFQEAISRSSTWSSCFLHVVSIKDPVPKRLNPQTSAYMPFGTFLFCSDINSTCFENPESVLEILVSSINDQNQGFQPKDYSNIVVNLHRKAIFKDVTPRGQDSTHSTNSLCASICLQLWEAGLTPDMQQQHLNIDINALVTKLEELENKFIYQKRVKFYPSKKLNVMKIEMSKLGWYKRYCKNHNIGYYDSFKRGITTSDLDAIQCQQSLRNYWIDMVEEAEMKPQTEGAAFCTRWLFGGTNYKRMVEPLDIADYYRSGGKDYVAKGRSRHYIVLEEWLEEEKKDTSDSNSTNKKNVESILTFDSCFWAHVEEAILSCKVLEDVQSSVTEKEEETGKLLEFEKYVYGLLTKYEVSSEIFLEHSSYMTWWNQYKAIKNKETSYNSALADFMSNPDYYNVQYAKGTYNFLPGA

SEQ ID NO: 165411 - protein, 227 aa, Glycine max
  Coding DNA Sequence Number=SeqID_48633
  Gene Ontology: Mol. function=nucleic acid binding; Biological process= DNA integration
MQNCKHGDVPVVKGDKFNKDQCPKNEIERAKMNNKPFGSALGNLMYAQVCTRLDIAFIVGVLGIYLSNPKNDHWIVSKKVMRYLQKTKEYMLVYRKVDNLEVVGYTNSYLDGFLDDRRSTSRYIFMMSGNNKTSRGSKHLELNYLTVIDLEKDGSIVVDHADRDSMLVDPLIKGLRPVVFKRHLENMGIDPYASGQHQNSSLGIMILKLGVVRITVSVIGTRIGVGT

SEQ ID NO: 165412 - protein, 39 aa, Glycine max
  Coding DNA Sequence Number=SeqID_48634
  Gene Ontology: Mol. function=4 iron, 4 sulfur cluster binding; Cellular component=chloroplast; Biological process=electron transport
  Homolog annotation: Hit_ID=O49856; Match level="QueryCoverage=85%, HitCoverage=23%, E-value=5e-13, Identity=100%"; Hit description =Ferredoxin-thioredoxin reductase catalytic chain, chloroplast precursor
MDEKTKECHCMLFLTPDNDFAGNEQTITLDEIKESTANM

SEQ ID NO: 165413 - protein, 492 aa, Glycine max
  Coding DNA Sequence Number=SeqID_48635
  Pfam annotation: Domain name=Transposase_23; Domain location=111-179; Score=-2.0; E_value=0.0019; Accession=PF03017.5; Description =TNP1ENSPM transposase
KYQDINGRSEHPGRVRGAGTGVTITQYFGPSSCRSTSSSNIIVEQLADIIGNLKEEWQRQAEQENIKREEVWMRRVEEEKQRTMDTFKGQIQEAIKLELSQIVSQHSAPLQPNDIQVLAARNSNKLVAVGKRCDSFGTIHNVPYADDVVRVSVVEVIFGDAEVPIPTSEIKFVKEALGSFVPWPTHLVKPILPEEAEKDVSSPLKTVEEEKAAEVIDPLGELVKNLFDIYQRPVEVSWDGAKFGINNVKDGFFITHADVSEIILGDKCLNISILQLWLMFIHDWSASIGYGPLYGFLEPQCIHNASSRRQECENYIGRWLKEAGKQIYIAPYLNQAHWQLVVLCPGDNVVVWFCSLKKKPDATIKGAVNSAMKSVTKTAEGKPPQHGPQWIEAKSHVQTGNYECGYYVMQWIWCIVSGGLKDDWIHWFSDRSPLTEETMTTLRHKWAAYFIQMKKWGHINQAVTFNRSYYKVQIIGQLCTYYNLNSHPQGLG

SEQ ID NO: 165414 - protein, 70 aa, Glycine max
  Coding DNA Sequence Number=SeqID_48636
MIPNAQPETKAMLVSEQSCIDVKLEEIRRRLFPLLDDSTSSWLNVVWPASESPLMEELSSMRYWNFRMRF

SEQ ID NO: 165415 - protein, 86 aa, Glycine max
  Coding DNA Sequence Number=SeqID_48637
  Subcellular localization annotation: CTP_CleavageSite=50; ConfidenceScore=5.27e-01
MKRPSNKHTQTNTDQGGYVLRRLKKLRTGTATTNRNNFLKLKGPGRERTKSEAAEKCEGRERNGAVACDVALRDWEGVVTWFHSPY

SEQ ID NO: 165416 - protein, 1473 aa, Glycine max
  Coding DNA Sequence Number=SeqID_48638
  Gene Ontology: Mol. function=RNA-directed DNA polymerase activity; Cellular component=chromatin; Biological process=chromatin assembly or disassembly
  Pfam annotation: Domain name=Chromo; Domain location=1381-1431; Score= 19.1; E_value=0.0055; Accession=PF00385.14; Description='chromo' (CHRromatin Organisation MOdifier
  Pfam annotation: Domain name=RVP; Domain location=343-448; Score= -5.2; E_value=0.013; Accession=PF00077.10; Description=Retroviral aspartyl protease
  Pfam annotation: Domain name=RVP_2; Domain location=329-462; Score= -40.1; E_value=0.0013; Accession=PF08284.2; Description=Retroviral aspartyl protease
  Pfam annotation: Domain name=RnaseH; Domain location=845-966; Score= -27.6; E_value=0.021; Accession=PF00075.14; Description=RNase H
  Pfam annotation: Domain name=rve; Domain location=1099-1255; Score =112.4; E_value=1.3e-30; Accession=PF00665.16; Description=Integrase core domain
  Pfam annotation: Domain name=zf-H2C2; Domain location=1040-1081; Score=7.8; E_value=0.033; Accession=PF09337.1; Description=His(2) -Cys(2) zinc finger
  Pfam module annotation: Pfam domain module=Chromo::RVP::RVP_2::RVT _1::Retrotrans_gag::RnaseH::rve::zf-H2C2; Domain location=1381 -1431::343-448::329-462::587-756::110-200::845-966::1099-1255::1040 -1081
MADHATRKTTTDRLEEAITRLSNSQSSLLDKHADLVDKYSELSGKVDTLLDHLHLRSPAREHHGTSSQFHQRNSVKLDVPRFDGRDPMGWIFKISQLFEYQNTPEEERITVASFYLDGAALSWYQWMFRNGFITSWSGFLQALESRFAPSFYDDPKGALFKLTQRGTVNEYLTEFERLANRVIGLPPPFLLSCFVSGLAQDIRREVLALQPISLPQAMALAKLQEDKIRDRRQAPPRGHNTPSPSYAPPSRKPHSTYVQRTPEEMALRREKGLCYNCEEKWSSTHRCKGRVLLFIADNPSLLPDEPNPEPPLLPEPIPACPLDLDTTSDFTSPHVSLHALSGLPSSETFRLVGIINHSSLTILIDSGSTHNFLQPRLAQFLHLKTENTNPLHVLVGNGSVLECNQVCRATSLLLQGHQFTVTFHLLPISGADAVLGIEWLRQFGPVITDYTAFSMKFTHMGRPIELHTDISTGPKPISAPQVKRLLQTGSASALFHLKMIPDQQPDPLLHLPHPIPAVEALLTQFHKLFRQPSSLPPPRSIVHHINLLPNTTPINVRPYRYPQFQKSEIEKQVLELLESGLIQPSMSPYSSPVLLVKKKDGTWRMCVDYRALNAVTVRDRFSIPTIDELLDESGGAAWFSKLDLRQGFHQILMHGPDVEKTAFRTHQGHYEYRVMPFGLCNAPSTFQAAMNTLLTPFLRKFAAVFFDDILIYSRTLASHLHHLELIFQTLLQSQYHLKKTKCLFAQKQIEYLGHVVSGQGVEPEPSKVQAMVQWPTPSSAKELRSFLGLTGFCRKFIKNYAMITAPLTSLCSKETFEWPSKAQSAFDRLKAAMTSAPVLALPDFDEPFIIETDASGAGMGVVLMQKGHPLAFFSKQFGPRMVHASTYVRELHAIVAAVRKWRQYLLGHPFTIFTDHKSLRELMSQVIQTPEQHYYLSKLLGFDYTIQYKVGSSNAVADALSRTTPSGEFLLLSVPHLDFMRDLCNTLHSSNEFQELFSKVRDNPGDFPDYRIHQGLILFKNRIWLNSDNPSIPSLMFEFHATPIGGHLGVTKTTHRLESNFFWSSLRKDTKRFVKECTTCQQTKSSTQRPAGLLQPLPPPTGVWEDISMDFITQLPSSHGYTTIMVVVDRYSKGVHLGALPSNHSAFKVASLFIDIVCKHHGFPRSIVSDRDPIFLSSFWRELFRLSGTRLRMSTAYHPQSDGQTEVMNRVLEQYLRSFVHAQPNTWYRYLTMAEWCYNTSIHSSSGMTPFEVIYGKPPPTLPHYLQGASTNEAVDSMLHSRQEIHRKLQQRLRKAQDAMKKVADEKRRDVNYSIGQWVYVKLRPFRQRSVAGQVSYKLKLPDEARIHPVFHCSLLREHHGTPPTQPDRWPLQFIAHKPVARPLCILDSKLDTSSSPPNQLVLVQWAGQPPEDTTWESWPEVRDLHHLEDKVVFTGEGIVSNHLNDITTGPETADTRPKRRTSRPSYLIDYET

SEQ ID NO: 165417 - protein, 607 aa, Glycine max
  Coding DNA Sequence Number=SeqID_48639
  Gene Ontology: Mol. function=ubiquitin-protein ligase activity; Cellular component=ubiquitin ligase complex; Biological process =protein ubiquitination
  Homolog annotation: Hit_ID=Q9FL17; Match level="QueryCoverage=90%, HitCoverage=91%, E-value=1e-106, Identity=44%"; Hit description =Arabidopsis thaliana genomic DNA, chromosome 5, P1 clone:MSN9
  Pfam annotation: Domain name=Arm; Domain location=319-359; Score =14.7; E_value=0.18; Accession=PF00514.13; Description=Armadillobeta -catenin-like repeat
  Pfam annotation: Domain name=Arm; Domain location=360-400; Score =24.3; E_value=0.00044; Accession=PF00514.13; Description =Armadillobeta-catenin-like repeat
  Pfam annotation: Domain name=Arm; Domain location=401-441; Score =31.5; E_value=3e-06; Accession=PF00514.13; Description=Armadillobeta- catenin-like repeat
  Pfam annotation: Domain name=Arm; Domain location=481-524; Score =15.1; E_value=0.16; Accession=PF00514.13; Description=Armadillobeta -catenin-like repeat
  Pfam annotation: Domain name=U-box; Domain location=57-129; Score =49.7; E_value=9.5e-12; Accession=PF04564.6; Description=U-box domain
  Pfam module annotation: Pfam domain module=Arm::Arm::Arm::Arm::U-box; Domain location=319-359::360-400::401-441::481-524::57-129
MEIQQSLKLTIHKKWPSSPKKPPKESEPITPTPNTPKLKWKKIFFQTKTKTQIQTPPEEFLCPISRSLMFDPVIVSSGHSYERSSVEACKNVNFTPQLPDGTTPDFSTLIPNLALKSAILKWCQSTHTPPPHPNNNPVQTLISSNPNLVHTINPSNTNLVHTNPNPSPEKISDQDLILNSLSENPPHPDNNNHLVQTLISSNANLVHPEKISDKDLILNSLNENPPVKNLCHHAETEVPIRPTHLYTSSEESIATTSASTPPLQFSTRPSCCYYSSPSSSELEPATIPEEEEIMTKLKNPQLNAIEEALISLRKLTRIREETRLQLCTPRLLSALRSLVLSKHVNVQVNALASVVNLSLEKSNKVKIVRSGMVPPLIEVLKFGSSEAQEHGAGALFSLALDDDNKTAIGVLGGLAPLLHMLRSESERTRHDSALALYHLSLVQSNRSKMVKLGSVPVLLNMVKSGHMTGRVLLILGNLGSGSDGRATMLDAGMVECLVGLLSGAESRSGSTRESCVSVMYALSHGGLRFKAVAKVAGVMEVMQKVEKVGTERARNKVRKILEIMRAKEVEEEDHVDWEELLDSGLPCRTRTRLGAGLDDSTPNSAQF

SEQ ID NO: 165418 - protein, 147 aa, Glycine max
  Coding DNA Sequence Number=SeqID_48640
MVEPLVIAEYYSCGVGGVVTKASTSNEEDICDLDCNWDWGFYWDWCSNVVDKDLASIAGYSSHIDQLLLSSNGLNDVEENEENLNTRSKNNEKNNSCYEACIDELHLSCQGESVSNHLNDITTGPETADTRPKRRTSRPSYLIDYET

SEQ ID NO: 165419 - protein, 121 aa, Glycine max
  Coding DNA Sequence Number=SeqID_48641
MAESMRSKSNLNRLEDAIAKLTTIQLSMSTKLDDLFQKLAVMESTQHSTISSLMHSPFPSPPVPPYRMNLEVPRFDGFDLVGWLFKINSFFDYHATPKNERLTIASFYMDGPALAWYQWMT

SEQ ID NO: 165420 - protein, 107 aa, Glycine max
  Coding DNA Sequence Number=SeqID_48642
  Subcellular localization annotation: CTP_CleavageSite=81; ConfidenceScore=5.24e-01
MTPSFSAGFVTFLKLNSDHCYHFFFLESLNPWVTMMVMIPYQATLLSSSLPCRSFRCLNLPCHSYVLVQPAHRKPKPTTTTATTDRGHFLGVGGAHDSNPHISQEEN

SEQ ID NO: 165421 - protein, 417 aa, Glycine max
  Coding DNA Sequence Number=SeqID_48643
  Homolog annotation: Hit_ID=Q84T58; Match level="QueryCoverage=94%, HitCoverage=92%, E-value=3e-75, Identity=41%"; Hit description =Expressed protein
MAEEEKHRLQEDTDKLFCSYIGASFSMFLAMLANNSVPALQGKVRSLSLRAAEAAEELRQMKSRRQEDSKANARVVEIFASHRNAWQAEEKRLLQQIDAAAEEIACLRGRVAELEDAAAHGERDVAERDEMIGFMSRRIEEEGLGGRERERYGKKSEEWFQKVEDMVGSTATSLEEEEEADVIYEEQHSQHFGNNNGFDSKFMASASKFWAEKASLCQDVQYESLESMYNTKHFVARESPWKVDGDSAGVSSKLKLLEQDLLNLEKIGKNDPSKVPSLIKKQAKRYQAISEKIDDLCRRIANDPCEPSLSTEFRTQTQTEFLLEAFRLQLGASETGQKLMALQTEIGKSHYIYRDELSETTLTTRRSFDSIRNNFKEIQRNLEIWLARIIGDLEGILAREGASRVREYYISRYPFVQ

SEQ ID NO: 165422 - protein, 131 aa, Glycine max
  Coding DNA Sequence Number=SeqID_48644
  Gene Ontology: Mol. function=RNA-directed DNA polymerase activity; Cellular component=chromatin; Biological process=chromatin assembly or disassembly
MTNLKPKLTFMPFLDIWLRRHYDCTHNFIQEHLVATLGLRAQPTQPLRVMVGNGDEIDCLEVCGDVLVQVQGHKFIVYFHVLPFCGADLVLGVQWLKSLGPVLMDYIDLTMKFMHHVESNGLRIIKKGGLN

SEQ ID NO: 165423 - protein, 78 aa, Glycine max
  Coding DNA Sequence Number=SeqID_48645
MGSYHGEWCWLGCESRWHRCGHGIGVDIGRGVDMGVSIDGDYTVEENRGRWLGTIIFNFRRLASSLEIIEASITAKKT

SEQ ID NO: 165424 - protein, 95 aa, Glycine max
  Coding DNA Sequence Number=SeqID_48646
MDTNHNPNPRVETLLLFVYMSYTLLLYDSAFYPWLPMVVSFSLKWRLQSSFFLLHFAAIDLQEANDSIDEEDSRPTSSTWTYITLLFFDSALETL

SEQ ID NO: 165425 - protein, 94 aa, Glycine max
  Coding DNA Sequence Number=SeqID_48647
MKLVDDEDVKDSQTFDVTEDQPHPYLSTPVTKFASSTQPNEPEFTAKLGLPNKELNPFSEDEDKVLRNQPREYDEEEVEPISPITTVPPHLSLQ

SEQ ID NO: 165426 - protein, 158 aa, Glycine max
  Coding DNA Sequence Number=SeqID_48648
  Homolog annotation: Hit_ID=Q1T2D5; Match level="QueryCoverage=71%, HitCoverage=7%, E-value=2e-07, Identity=36%"; Hit description=Chromo
MDFFRESINDHQDFHMSSIRWQPDNEVKRQIFARLGRNWKWFHTAAIPDPKASVSKVNGKEKFGKPSTGAVLTASFKVKKAKYATDVQSNCSKVPISIWSNIDQNRIWKEVNSVSNIVGWWELSGHELNVKEGTYAICLNHTPELLVIDPTNVIVTIT

SEQ ID NO: 165427 - protein, 194 aa, Glycine max
  Coding DNA Sequence Number=SeqID_48649
  Gene Ontology: Mol. function=chromatin binding; Cellular component =chromatin; Biological process=chromatin assembly or disassembly
  Homolog annotation: Hit_ID=Q1SAV4; Match level="QueryCoverage=56%, HitCoverage=39%, E-value=7e-16, Identity=33%"; Hit description =Integrase, catalytic region
  Pfam annotation: Domain name=zf-C3HC4; Domain location=147-185; Score= 30.8; E_value=4.9e-06; Accession=PF00097.15; Description=Zinc finger, C3HC4 type (RING finger)
MKHFVDNNPREASFHEGDWVMVKIFSYRQSLVTGTTHTKRAKCYYGPFKDMENRPVITPLAIISTYWEGPKDDPRLQVLVQWVGLHVDDTFGEDWASLKEIYHLEDKVIFNDSESDRQSKTHEAQNERPKRKITPPQCDSDNDSNTCTVCLEDREELRTLPECMHSFHMPCIDMWLSLHSSCPICRSNATPSPE

SEQ ID NO: 165428 - protein, 115 aa, Glycine max
  Coding DNA Sequence Number=SeqID_48650
MGKGEKRGSSKDKHEGEKKGVKGKHEGYGRPRVSKFFFLTFLDSLYKMDLWRIFQRWGRLASRGVGRKDQRQQKGLGDQGKSMSGQVEVFEAKYIAHSDTNSKALEDLYSNREEE

SEQ ID NO: 165429 - protein, 143 aa, Glycine max
  Coding DNA Sequence Number=SeqID_48651
MGVQNYKCNCMYGRTMNVIQINHRVKRGEGGFLVKQKGRGEVKDKKVNKCSSINHCPTGTNGLRVGLGDVDKGVVVIPETKASWCDDDRKGRWWLDGTRVVEPLKDVGLNNGSILGFKKSPFSNGLGLELLLNNHEDSIGKGL

SEQ ID NO: 165430 - protein, 193 aa, Glycine max
  Coding DNA Sequence Number=SeqID_48652
MDRARLVYDLVTKMDMDVRSFISGQISQMAQSNSSWLGFPVLITALCIARGVIPDSLTFESLNPAINLAYIRKNCWNPDDPTITFLGTRNARARGPSDASAPSSSAPSAPASTLAPPAPTPTPPTPSSTSAQSSDAMVPMLWPDQESILLLWGKETLEDTPVATPIEATKKGDDTADANYVTDMEAAQSTWDP

SEQ ID NO: 165431 - protein, 77 aa, Glycine max
  Coding DNA Sequence Number=SeqID_48653
MCPFPNTNAKEPISESTQAKQSHEVTFIQQEPLPPVQTPSLPLPPPSNVLEAIAYTLALPSQSPPTQPPPPPTQGQP

SEQ ID NO: 165432 - protein, 80 aa, Glycine max
  Coding DNA Sequence Number=SeqID_48654
  Homolog annotation: Hit_ID=Q75K33; Match level="QueryCoverage=59%, HitCoverage=15%, E-value=6e-08, Identity=56%"; Hit description =Expressed protein
GCAASGSIGKEDVAFVTLGALDYVPQTGFMFEVANGDNKVSDWKECLATLMEKADDSRWHDGSYRDGTTRAGVNKRLEMA

SEQ ID NO: 165433 - protein, 83 aa, Glycine max
  Coding DNA Sequence Number=SeqID_48655
MPNLMFMLPSLPFRIKLQAPKRKVAILKIVVSLNIKPETNVVQQDVTDNEDSWMLTNFIFTPLLIRLNQGIAVEDEENLNRQL

SEQ ID NO: 165434 - protein, 101 aa, Glycine max
  Coding DNA Sequence Number=SeqID_48656
  Gene Ontology: Mol. function=nucleic acid binding
  Homolog annotation: Hit_ID=Q1SDG1; Match level="QueryCoverage=76%, HitCoverage=6%, E-value=2e-15, Identity=46%"; Hit description =Integrase, catalytic region; Zinc finger, CCHC-type
MTRSIELCGLDDHESHPPWILMHDHLWDVVENKDYIPYDEQLNEIPRSQWTEQPKLKFWLNSKAQNVMLCALSKEKYTKAYSFRSAKQMWDTLAITYEGTS

SEQ ID NO: 165435 - protein, 542 aa, Glycine max
  Coding DNA Sequence Number=SeqID_48657
  Gene Ontology: Mol. function=protein binding; Cellular component =integral to membrane; Biological process=protein amino acid phosphorylation
  Homolog annotation: Hit_ID=Q949G9; Match level="QueryCoverage=98%, HitCoverage=82%, E-value=2e-48, Identity=27%"; Hit description =HcrVf1 protein
  Pfam annotation: Domain name=LRR_1; Domain location=128-153; Score =4.0; E_value=51; Accession=PF00560.23; Description=Leucine Rich Repeat
  Pfam annotation: Domain name=LRR_1; Domain location=156-179; Score =9.4; E_value=5; Accession=PF00560.23; Description=Leucine Rich Repeat
  Pfam annotation: Domain name=LRR_1; Domain location=185-207; Score =8.5; E_value=7.4; Accession=PF00560.23; Description=Leucine Rich Repeat
  Pfam annotation: Domain name=LRR_1; Domain location=210-231; Score =10.6; E_value=2.9; Accession=PF00560.23; Description=Leucine Rich Repeat
  Pfam annotation: Domain name=LRR_1; Domain location=233-256; Score =5.9; E_value=23; Accession=PF00560.23; Description=Leucine Rich Repeat
  Pfam annotation: Domain name=LRR_1; Domain location=258-283; Score =7.4; E_value=12; Accession=PF00560.23; Description=Leucine Rich Repeat
  Pfam annotation: Domain name=LRR_1; Domain location=287-310; Score =8.6; E_value=6.9; Accession=PF00560.23; Description=Leucine Rich Repeat
  Pfam annotation: Domain name=LRR_1; Domain location=30-52; Score=9.6; E_value=4.7; Accession=PF00560.23; Description=Leucine Rich Repeat
  Pfam annotation: Domain name=LRR_1; Domain location=313-335; Score =16.1; E_value=0.13; Accession=PF00560.23; Description=Leucine Rich Repeat
  Pfam annotation: Domain name=LRR_1; Domain location=338-360; Score =16.1; E_value=0.13; Accession=PF00560.23; Description=Leucine Rich Repeat
  Pfam annotation: Domain name=LRR_1; Domain location=362-384; Score =12.2; E_value=1.5; Accession=PF00560.23; Description=Leucine Rich Repeat
  Pfam annotation: Domain name=LRR_1; Domain location=391-413; Score =10.0; E_value=3.9; Accession=PF00560.23; Description=Leucine Rich Repeat
  Pfam annotation: Domain name=LRR_1; Domain location=415-438; Score =13.4; E_value=0.81; Accession=PF00560.23; Description=Leucine Rich Repeat
  Pfam annotation: Domain name=LRR_1; Domain location=440-463; Score =5.0; E_value=34; Accession=PF00560.23; Description=Leucine Rich Repeat
  Pfam annotation: Domain name=LRR_1; Domain location=464-486; Score =7.2; E_value=13; Accession=PF00560.23; Description=Leucine Rich Repeat
  Pfam annotation: Domain name=LRR_1; Domain location=488-511; Score =12.7; E_value=1.2; Accession=PF00560.23; Description=Leucine Rich Repeat
  Pfam annotation: Domain name=LRR_1; Domain location=513-536; Score =4.7; E_value=38; Accession=PF00560.23; Description=Leucine Rich Repeat
  Pfam annotation: Domain name=LRR_1; Domain location=54-76; Score =14.3; E_value=0.44; Accession=PF00560.23; Description=Leucine Rich Repeat
  Pfam annotation: Domain name=LRR_1; Domain location=6-28; Score=12.7; E_value=1.2; Accession=PF00560.23; Description=Leucine Rich Repeat
  Pfam annotation: Domain name=LRR_1; Domain location=78-101; Score =7.6; E_value=11; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1; Domain location =128-153::156-179::...
  Pfam module annotation: Domain location=185-207::210-231::233 -256::258-283::287-310::30-52::313-335::338-360::362-384::391 -413::415-438::440-463::464-486::488-511::513-536::54-76::6-28::78-101
MGSFTNLRYLNLSASSFGGSIPSDIGKLTHLLSLDLGKNYLHGQIPYQLGNLTHLQYLDLSDNDLDGELPYQLGNLSQLRYLDLAGGNSFSGAFPFQVGNLPLLHTLALGGNFDVKSKDAEWLTNLSSLTKLRLSSLHNLSSSHHWLQMISKLIPNLRELRLVGCSLSDTNIQSLFYSPSNFSTALTILDLYSNKLTSSTFQLLSNFSLNLQELYLGHNNIVLSSPLCPNFPALVILDLSYNNMTSSVFQGSFNFSSKLQNLYLYNCSLTDGSFLMSSSFIMSSSSSLVSLDLSSNQLKSSTIFYWLFNSTTNLHNLDLGYNMLEGPIPDGFGKVMNSLEVLHFSGNKLQGEIPTFFGNMCALQSLSLSYNKLNGEISSFFQNSSWCNRNIFKSLDLSNNQITGMLPKSIGFLSELEDLNLAGNSLEGDVTESHLSNFSKLKYLFLSESSLSLKFVPSWVPPFQLESLEIRSCKLGPTFPSWLKTQSSLYMLDISDNGINDSVPDWFWNKLQNMGLLNMSSNYLIGAIPNISLSFLSDRLYF

SEQ ID NO: 165436 - protein, 136 aa, Glycine max
  Coding DNA Sequence Number=SeqID_48658
MKAKILEDEIIMLRLLRSFSRISFHSNSSSSLNSSSRNLNFLNEQENQTHKVATKHNLFDKEVMNKATSSVPRPTPTIEQIKQDNSGKIMMQSYPTRALDLMAAEWRRIRVERRRHFKEKMSQEEAHHHRKPWIRA

SEQ ID NO: 165437 - protein, 165 aa, Glycine max
  Coding DNA Sequence Number=SeqID_48659
  Gene Ontology: Mol. function=RNA-directed DNA polymerase activity; Biological process=RNA-dependent DNA replication
  Homolog annotation: Hit_ID=Q8H6Q8; Match level="QueryCoverage=63%, HitCoverage=46%, E-value=9e-09, Identity=30%"; Hit description=CTV.20
MKIKPSTKRDFQKGDTHIEEQINNLLIETSEEETENTSSTSSEENLNLIQQDDQPSSTDDEEIQQINTLTREQDLLFTIINSIPDPQEKKVFLEKLRKFLETKPKPKDFITNNKFDVSNIFKRLENISAKPTTIQDLQTKINNLKKEVKELRQQQEIHQIILSHL

SEQ ID NO: 165438 - protein, 317 aa, Glycine max
  Coding DNA Sequence Number=SeqID_48660
  Gene Ontology: Mol. function=protein binding; Cellular component =integral to membrane; Biological process=xylan catabolic process
  Homolog annotation: Hit_ID=Q1T435; Match level="QueryCoverage=99%, HitCoverage=77%, E-value=1e-60, Identity=32%"; Hit description =Leucine-rich repeat; Leucine-rich repeat, cysteine-containing type
  Pfam annotation: Domain name=LRR_1; Domain location=119-141; Score =11.2; E_value=2.3; Accession=PF00560.23; Description=Leucine Rich Repeat
  Pfam annotation: Domain name=LRR_1; Domain location=143-165; Score =11.2; E_value=2.3; Accession=PF00560.23; Description=Leucine Rich Repeat
  Pfam annotation: Domain name=LRR_1; Domain location=168-190; Score =13.2; E_value=0.97; Accession=PF00560.23; Description=Leucine Rich Repeat
  Pfam annotation: Domain name=LRR_1; Domain location=192-214; Score =14.2; E_value=0.49; Accession=PF00560.23; Description=Leucine Rich Repeat
  Pfam annotation: Domain name=LRR_1; Domain location=271-293; Score =17.0; E_value=0.067; Accession=PF00560.23; Description=Leucine Rich Repeat
  Pfam annotation: Domain name=LRR_1; Domain location=295-317; Score =16.9; E_value=0.071; Accession=PF00560.23; Description=Leucine Rich Repeat
  Pfam annotation: Domain name=LRR_1; Domain location=45-63; Score=2.8; E_value=86; Accession=PF00560.23; Description=Leucine Rich Repeat
  Pfam annotation: Domain name=LRR_1; Domain location=71-92; Score =11.2; E_value=2.3; Accession=PF00560.23; Description=Leucine Rich Repeat
  Pfam annotation: Domain name=LRR_1; Domain location=95-117; Score =12.8; E_value=1.1; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=119-141::143 -165::168-190::192-214::271-293::295-317::45-63::71-92::95-117
MGLLNMSSNYLIGAIPNISLKLPLRPSILLNSNQFEGKIPSFLLQASELMLSENNFSDLFSFLCDQSTASNLATLDVSRNQINGQLPDCWKSVKQLLFLDLSSNKLSGKIPMSMGALVNMEALVLRNNGLMGELPSSLKNCSSLFMLDLSENMLSGPIPSWIGESMHQLIILNMRGNHLSGNLPIHLCYLNRIQLLDLSRNNLSRGIPSCLKNFTAMSEQSINSSDTMSRIYWYNNTYYEIYGSYSLEGYTLDITWMWKGVEQGFKNPELKLKSIDLSSNHLTGEIPKEVGYLLGLVSLNLSRNNLSGEIPSRIGNL

SEQ ID NO: 165439 - protein, 120 aa, Glycine max
  Coding DNA Sequence Number=SeqID_48661
  Gene Ontology: Mol. function=protein binding; Biological process =defense response to fungus
  Homolog annotation: Hit_ID=Q2R2E1; Match level="QueryCoverage=92%, HitCoverage=15%, E-value=1e-16, Identity=41%"; Hit description =Leucine Rich Repeat family protein
  Pfam annotation: Domain name=LRRNT_2; Domain location=33-75; Score =53.3; E_value=8.3e-13; Accession=PF08263.3; Description=Leucine rich repeat N-terminal domain
MERMRGIESVLWVSRVSILGFNYLPNSAEIKCIESERQALLNFKHGLIDDSGMLSTWRDDGNNRDCCKWKGIQCNNQTGHVEMLHLRGQDTQYLIGAINISSLIALENIEHLDLSYNYLE

SEQ ID NO: 165440 - protein, 694 aa, Glycine max
  Coding DNA Sequence Number=SeqID_48662
  Gene Ontology: Mol. function=nucleoside-triphosphatase activity; Cellular component=membrane; Biological process=cell division
  Homolog annotation: Hit_ID=Q1SK92; Match level="QueryCoverage=94%, HitCoverage=77%, E-value=0.0, Identity=63%"; Hit description=AAA ATPase, central region; DEAD/DEAH box helicase, N-terminal
  Pfam annotation: Domain name=AAA; Domain location=567-694; Score =105.2; E_value=1.9e-28; Accession=PF00004.19; Description=ATPase family associated with various cellular activities (AAA)
  Pfam annotation: Domain name=AAA_3; Domain location=567-693; Score= -9.2; E_value=0.0033; Accession=PF07726.2; Description=ATPase family associated with various
  Pfam annotation: Domain name=AAA_5; Domain location=567-694; Score =0.5; E_value=0.0016; Accession=PF07728.4; Description=ATPase family associated with various
  Pfam module annotation: Pfam domain module=AAA::AAA_3::AAA_5; Domain location=567-694::567-693::567-694
MEQKHVLLSALSVGVGVGVGLGLSSGQKWVGGNRDSDELSVEQIVQELKNLVVEGRDGNVTFEDFPYYLSERTQVLLTSAAYVHLKHLHFSKHTRNLPPASRAILLSGPAEPYQQMLAKALAHYFESKLLLLDITDFSVKLQNKFGCSRKEPSFKRSISEATLERMSGLFGSFSMLSSTGETRGILRQQSSASVSSNPPKLRRNASASYDISSTSSQCGPTFPASFQRTALNSKLPGQFVSSSVKMKAPLKHTSSLCFDEKLFVQSLYKLLVSITETGSIILYIRDVEKLILQSPRLYNLLQKMIKKLSGSVLILGSQILDSEDDCKEVDERLTVLFPYNIEIKAPEDETHLGCWKGQLEKDMKDIQFQDNRNHIAEVLAANDIDCDDLNSICHADTILLSNYIEEIVVSALSYHLMNTKDPEYRNGKLVISANSLSHGLSLFQEGKSSGNLKTNESNKENSGEDITGAKNEMKCDNQAPENKSETEKSIPITKKDGENPIPAKVEVPDNEFEKRIRPEVIPANEIGVTFADIGALDEIKESLQELVMLPLRRPDLFKGGLLKPCRGILLFGPPGTGKTMLAKAIANEAGASFINVSMSTITSKWFGEDEKNVRALFTLAAKVAPTIIFVDEVDSMLGQRTRVGEHEAMRKIKNEFMTHWDGLLTGPNEQILVLAATNRPFDLDEAIIRRFERR

SEQ ID NO: 165441 - protein, 111 aa, Glycine max
  Coding DNA Sequence Number=SeqID_48663
  Gene Ontology: Mol. function=transition metal ion binding; Cellular component=cytoplasm; Biological process=cytoskeleton organization and biogenesis
MQSGSQSEPFDVEMGDRLEDMIRDLGQEFFQQAHAPMYDTLQTDSKKNLYPRCNNSLTLLSAVLSLVNVKARYGWSDKSFSTLLQVVHDMLPNGNTLSKSYYQAKKLLCLM

SEQ ID NO: 165442 - protein, 47 aa, Glycine max
  Coding DNA Sequence Number=SeqID_48664
MSAANKNIHRTDEELVDHYLKHELLGNESKEHKVEILMFASLSLGTY

SEQ ID NO: 165443 - protein, 74 aa, Glycine max
  Coding DNA Sequence Number=SeqID_48665
MSPPPLEPHNHSMLSGWLPLQAQFSRMDASDELSGMSSRLAHMYSSSFFQILSRAQLPEWCAQLQEWCTQRMAR

SEQ ID NO: 165444 - protein, 63 aa, Glycine max
  Coding DNA Sequence Number=SeqID_48666
MRGVLAQATHRSKLALYEIDGYVYEKQAKRLTLSYSSCRSGRNIGKRESNKLVAKPSQEMNGV

SEQ ID NO: 165445 - protein, 553 aa, Glycine max
  Coding DNA Sequence Number=SeqID_48667
  Gene Ontology: Mol. function=DNA binding; Biological process =regulation of transcription, DNA-dependent
  Homolog annotation: Hit_ID=O82799; Match level="QueryCoverage=58%, HitCoverage=73%, E-value=5e-54, Identity=43%"; Hit description =Putative RAV-like B3 domain DNA binding protein
  Pfam annotation: Domain name=B3; Domain location=194-302; Score =116.0; E_value=1.1e-31; Accession=PF02362.12; Description=B3 DNA binding domain
MELMQEVKGYSDSREEEEEEEGAAEEESSRKHHYYPFSSSPSNLYLSSSSAPSISSNYTSTTTSAVARPLHHHHVINIPYQQNPWLGMNIVHHDHLIQSPESHNSSSGLGLLHQHQDAAGSNFIINNNQHHQHHHTTKQLDFMDLSLGSSKDEGNLPGSSSSVYAHHHAASGSSSVNGNNNLQQQQQPAEKEHMFDKVVTPSDVGKLNRLVIPKQHAEKYFPLDSSANEKGLLLNFEDRNGKLWRFRYSYWNSSQSYVMTKGWSRFVKEKKLDAGDIVSFQRGVGESYRHRLYIDWKRRRDHHHHHHHGPVDPSTTLFTPFFLPNQPHHLMSIRWGATDRLYSLPSPTPPRHHDHLQHQQPLNYNNNTMYHPFHHHGGGSGINGTTHHYNNYYHEMSSTTNTTTSGSGSVFYLRSTPPSMPLADHQTLNTRQQQQQQQQQQQQEGGGNVSLPPMIIDSVPVAHHLHHHHHQHQHQHQHHGGKSSGSSSPSTAGKRLRLFGVNMECASSTTSEDHPKCFSLLSSSSSMANSNSSLPPLQLLREDTLSSSAAAAA

SEQ ID NO: 165446 - protein, 68 aa, Glycine max
  Coding DNA Sequence Number=SeqID_48668
MLRNLTDCATMLPFDLRYVTELHGLPNDGCQVPRSGQTRVASQQMDGPRMKLGYDNLLTSDYFFSTMT

SEQ ID NO: 165447 - protein, 32 aa, Glycine max
  Coding DNA Sequence Number=SeqID_48669
MAVLRDVSLDRRRCLRMQHKFSAKMGEDNLIS

SEQ ID NO: 165448 - protein, 67 aa, Glycine max
  Coding DNA Sequence Number=SeqID_48670
  Gene Ontology: Mol. function=inorganic diphosphatase activity; Cellular component=cytoplasm; Biological process=phosphate metabolic process
  Homolog annotation: Hit_ID=Q2HTA8; Match level="QueryCoverage=80%, HitCoverage=27%, E-value=4e-17, Identity=75%"; Hit description =Inorganic pyrophosphatase
MSDENGEEPRENRPVPRLNERILSSLSRRSVAAHPWHDLEIGPGAPMIFNCVSSDTKKEYWLLHFLQ

SEQ ID NO: 165449 - protein, 80 aa, Glycine max
  Coding DNA Sequence Number=SeqID_48671
MEIPFVYFGIPIRLNPKKEATWEPILSRMRFISTQRNFLLGGEDRRKIPWVGHTKEAWELKIFRCLTEPSLETGGGDCYG

SEQ ID NO: 165450 - protein, 122 aa, Glycine max
  Coding DNA Sequence Number=SeqID_48672
MKMLLIPHDVAPCGAYRPWIFYISGFLCFLRSDCKRMEKEKDEWRRHFNDEDMTKSKGKDPLDGLGGPMTRARARKAKEALQQVLSILFEYKPQGEKSKGPIGNLGISLLGDQMVADLLAVG

SEQ ID NO: 165451 - protein, 330 aa, Glycine max
  Coding DNA Sequence Number=SeqID_48673
MERHHEKELRKLKADHDHLEARVRHPQGRTTRQHPFVDRIMEVDIPLGWKPLNLEQYDGTTDLDEHLDVFLTKENLYTNDNTILCRVFPTSLKMVALTWCSGLPPTYDKKMMNLSKNSWTDSLCKKTLVAWMSCANELKATSRWKRCPSEETRSNKLDKSAIREKEEAFNPEVPIKLPFSLPLMPRLYMTKYYRYNRSYDHNTEDCWALKDKIEELIQVGYLAQFVKRSNSHAMEARPGGHQEEHHRHHDVDKKRDKVEDRGRWRHHHQRRQQQPPQEQENEPTQQIKGVINTVADEFSYGRQLQGYQPKDFMVVSIIIAKFMVSKVLID

SEQ ID NO: 165452 - protein, 246 aa, Glycine max
  Coding DNA Sequence Number=SeqID_48674
  Gene Ontology: Mol. function=zinc ion binding; Cellular component =nucleus; Biological process=transcription
  Homolog annotation: Hit_ID=Q1SPG0; Match level="QueryCoverage=68%, HitCoverage=55%, E-value=3e-38, Identity=37%"; Hit description=Zinc finger, SWIM-type
MLGDYDVGHFEELWDEMIHKFELHDNKWMNDLYERRKMWATSHIRGHFFAGLRTTSRCEAFHNHLGNFVHSKIGFSIFVEQFQMCLTYFRFRETEADLESDYGSDKLQTRFHSLERSASEQFAKEMCFCMKMESFGMPCDHIVVLLVFLDFREVPKCLVLNRWTKKAKKSIIGRYVDSSTFWDSSPVSRHAHLHFLFTEMAEVAPRYEDDYNDVVNILVRQVMKLGKNMGTRVMQKIKTVRLCMIQ

SEQ ID NO: 165453 - protein, 203 aa, Glycine max
  Coding DNA Sequence Number=SeqID_48675
  Gene Ontology: Mol. function=metal ion binding; Biological process =metal ion transport
  Subcellular localization annotation: CTP_CleavageSite=63; ConfidenceScore=5.91e-01
MATLTLLSSLSLRSSSSSSSSSFTLSSSFSSPSSFAFFCSFPLRSATSSLKVQTIQKKKRVVKAVEEDTQQELNAADDSEQPSTSEAPPVVVPVSPSDTLTMFFQAEGTVSETAIPALTKALEETEGVTDLKVQLAEGLAILEVGTLMELKSLRMSPNSYHLKKQTTVQATGVASSLVETIQGSGFKLQTLNLSFEDEEVAVA

SEQ ID NO: 165454 - protein, 246 aa, Glycine max
  Coding DNA Sequence Number=SeqID_48676
  Gene Ontology: Mol. function=ribonuclease H activity; Biological process=RNA-dependent DNA replication
  Homolog annotation: Hit_ID=Q94LT0; Match level="QueryCoverage=96%, HitCoverage=95%, E-value=8e-62, Identity=50%"; Hit description =Putative RNase
  Pfam annotation: Domain name=RnaseH; Domain location=116-243; Score =27.6; E_value=1.6e-07; Accession=PF00075.14; Description=RNase H
VVAMAEEKDAFYVVRKGDVVGIYKSFSDIQPLLASSVSSDPVSIYKGYSLPQKTEEYLVSHGLKGAPYSISAADVNEGLFGRLVACPYQDPYSSGGRAFNVSSSSRNLQGAIQFDTGLSCTLHFDGASKGNPGPAGAGAILHDGSKVYRLREGVGIQTNNVAEYRSLILGLKHALKKGYKHIIVQGDSLLVCNQGLWKIKNQNMGTLCAEAKELKDKFLSFKISHIPREYNSEADAQANLAINLRG

SEQ ID NO: 165455 - protein, 155 aa, Glycine max
  Coding DNA Sequence Number=SeqID_48677
  Homolog annotation: Hit_ID=Q1SP02; Match level="QueryCoverage=53%, HitCoverage=18%, E-value=2e-11, Identity=44%"; Hit description=IMP dehydrogenase/GMP reductase
  Pfam annotation: Domain name=DUF1723; Domain location=91-140; Score =49.0; E_value=1.5e-11; Accession=PF08330.1; Description=Protein of unknown function (DUF1723)
MKLPSGEGPRHPHVGNGKLSLLLRMFLTWMTQLKRSSNNLKKQLLMPMECPELKLFSHGRKVQKFGRPAAEIKGLVVATRLSPLIACSLDTGDQGLTLAFVEMWHKETSNFHLPVGEVTITLDDVTSLLHLPITGAFHSFKTSCRRSGVGVSGVT

SEQ ID NO: 165456 - protein, 149 aa, Glycine max
  Coding DNA Sequence Number=SeqID_48678
  Gene Ontology: Mol. function=DNA binding; Biological process=DNA integration
MLHRLASCLGASCQQIPDQGKSTAQESNTREDLLSKLACTKKTGHLKTIIQGTLQTPTIDIEKIMAEEEEEPNWMTPYKNFLIWGVLPVDKNEAQRLKGKLFKRGLTASLLKCLNCQQADYVMRELHEEIYDLHTKGCSLATKVVCASY

SEQ ID NO: 165457 - protein, 152 aa, Glycine max
  Coding DNA Sequence Number=SeqID_48679
  Gene Ontology: Mol. function=endonuclease activity; Biological process=RNA-dependent DNA replication
  Homolog annotation: Hit_ID=Q1RY72; Match level="QueryCoverage=97%, HitCoverage=40%, E-value=1e-18, Identity=35%"; Hit description =Endonuclease/exonuclease/phosphatase
MDTCGDFFTWTNRQADNTIYSRIDRFLGNLDWLQMHIDSTLKILAPSVSDHALMFLSCKDQSSRLRGRFKYRNSLARLNGFHDEVKKNWNLGVHGNPMYKLWTKLSRLQSVLKNLSSPLNGLREKIDEARRNLQQAHEDLCRDRFNVDNINR

SEQ ID NO: 165458 - protein, 102 aa, Glycine max
  Coding DNA Sequence Number=SeqID_48680
MDMGDVDTQPTTSVHLALHCHYEWSNAHAFNRPDRDLRQQQPPPSWSKSPSGFLKININTAINKFANSLHFEGYPKPREAEAVGLLHGLIWSHQFGRQQIVF

SEQ ID NO: 165459 - protein, 102 aa, Glycine max
  Coding DNA Sequence Number=SeqID_48681
  Gene Ontology: Mol. function=RNA-directed DNA polymerase activity; Biological process=RNA-dependent DNA replication
MESMLQNDHLKVEGKWQLLCQLHVPPKVKHFIWHLRWDFLPTRQRLKTKGVPCTNLCSYCSTNFENAWHVMFGCKQVEHVWEASGLWSLSLIMFLVLKVSTN

SEQ ID NO: 165460 - protein, 660 aa, Glycine max
  Coding DNA Sequence Number=SeqID_48682
  Gene Ontology: Mol. function=transferase activity; Cellular component= membrane; Biological process=protein metabolic process
  Homolog annotation: Hit_ID=Q9LJP4; Match level="QueryCoverage=99%, HitCoverage=100%, E-value=0.0, Identity=69%"; Hit description =Glucosyltransferase-like protein
  Pfam annotation: Domain name=Glycos_transf_2; Domain location=201 -376; Score=8.4; E_value=0.00028; Accession=PF00535.16; Description =Glycosyl transferase
MAPNTEKSSNNDFTLLQVHDSDSPMFPEKQKATSRKQFTWFLLLKLHRVLTCLSWLTNGLKATFALVKKRVSLADMSDEGPKSRGRLYRFIKIFLALSIGGLAIEIIAHFNKWNLHNMIQPWEVQGLLQWCYVAWLSFREDYVAPLVLMVSKFCIVLFLIQSLDRLVLCLGCFWIKYKKLKPTFDADACDVEDPSNFPMVLVQIPMCNEREVYSQSIGAAAQLDWPKDRILIQVLDDSDDGNLQLLIKEEVASWKEKGVNIVYRHRLIRTGYKAGNLKSAMSCDYVKDYEFVAIFDADFQPNPDFLKLTIPHFKGKPDLGLVQARWSFVNKDENLLTRLQNINLCFHFEVEQQVNGYFLNFFGFNGTAGVWRIKALEESGGWLERTTVEDMDIAVRAHLNGWKFIFLNDVKVLCELPESYEAYKKQQHRWHSGPMQLFRLCLPAILTSKISVWKKANLIFLFFLLRKLILPFYSFTLFCIILPLTMFIPESELPLWVICYVPIIMSFLNILPSPKSVPFLVPYLLFENTMSVTKFNAMISGLFQLGSAYEWVVTKKTGRSSESDLLALAERESKSSNEEKILRRHSESGLELLGKLKQSEAPSKKKRNRLYRKELALALLLLTASARSLLSAHGVHFYFLLFQGLSFLIMGLDLIGEQVS

SEQ ID NO: 165461 - protein, 266 aa, Glycine max
  Coding DNA Sequence Number=SeqID_48683
  Gene Ontology: Mol. function=protein binding; Cellular component =integral to membrane; Biological process=xylan catabolic process
  Homolog annotation: Hit_ID=Q6JJ67; Match level="QueryCoverage=98%, HitCoverage=58%, E-value=5e-41, Identity=35%"; Hit description =Putative disease resistance protein
  Pfam annotation: Domain name=LRR_1; Domain location=109-128; Score =11.6; E_value=1.9; Accession=PF00560.23; Description=Leucine Rich Repeat
  Pfam annotation: Domain name=LRR_1; Domain location=12-34; Score =12.8; E_value=1.1; Accession=PF00560.23; Description=Leucine Rich Repeat
  Pfam annotation: Domain name=LRR_1; Domain location=188-210; Score =8.2; E_value=8.5; Accession=PF00560.23; Description=Leucine Rich Repeat
  Pfam annotation: Domain name=LRR_1; Domain location=36-58; Score =11.2; E_value=2.3; Accession=PF00560.23; Description=Leucine Rich Repeat
  Pfam annotation: Domain name=LRR_1; Domain location=60-82; Score =11.2; E_value=2.3; Accession=PF00560.23; Description=Leucine Rich Repeat
  Pfam annotation: Domain name=LRR_1; Domain location=85-107; Score =13.2; E_value=0.97; Accession=PF00560.23; Description=Leucine Rich Repeat
  Pfam module annotation: Pfam domain module=LRR_1::LRR_1::LRR_1::LRR _1::LRR_1::LRR_1; Domain location=109-128::12-34::188-210::36-58::60 -82::85-107
  Subcellular localization annotation: CTP_CleavageSite=67; ConfidenceScore=5.14e-01
GQLPDCWKSVKQLLFLDLSSNKLSGKIPMSMGALVNMEALVLRNNGLMGELPSSLKNCSSLFMLDLSENMLSGPIPSWIGESMHQLIILNMRGNHLSGNLPIHLCYLNRIQLLDLSRNNLSRGIPTCLKNWTAMSEQSINSSDTLSHIYWNNNTYFEIYGLYSFGGYTLDITWMWKGVERGFKNPELELKSIDLSSNNLMGEIPKEEDILKPLKPLVLKETLIFVANNLTKLVLGMEIRQQQSIKNHQSKGHYYCGVLGELPTSDF

SEQ ID NO: 165462 - protein, 230 aa, Glycine max
  Coding DNA Sequence Number=SeqID_48684
  Gene Ontology: Mol. function=protein binding; Cellular component =integral to membrane; Biological process=protein amino acid phosphorylation
  Homolog annotation: Hit_ID=Q1T435; Match level="QueryCoverage=87%, HitCoverage=20%, E-value=4e-36, Identity=42%"; Hit description =Leucine-rich repeat; Leucine-rich repeat, cysteine-containing type
  Pfam annotation: Domain name=LRR_1; Domain location=114-135; Score =15.1; E_value=0.25; Accession=PF00560.23; Description=Leucine Rich Repeat
  Pfam annotation: Domain name=LRR_1; Domain location=42-64; Score =13.0; E_value=1; Accession=PF00560.23; Description=Leucine Rich Repeat
  Pfam annotation: Domain name=LRR_1; Domain location=66-88; Score =16.9; E_value=0.071; Accession=PF00560.23; Description=Leucine Rich Repeat
  Pfam annotation: Domain name=LRR_1; Domain location=90-112; Score =17.9; E_value=0.037; Accession=PF00560.23; Description=Leucine Rich Repeat
  Pfam module annotation: Pfam domain module=LRR_1::LRR_1::LRR_1::LRR _1; Domain location=114-135::42-64::66-88::90-112
MTVQNRRRKSNSTDLKGTNSSSVDITWMWKGVEWGFKNPELELKSIDLSSNNLMGEIPKEVGYLLGLVSLNLSRNNLSGEIPSRIGNLRSLESLDLSRNHISRRIPSSLSEIDYLQKLDLSHNSLSGRIPSGRHFETFEASSFEGNIDLCGEQLNKTCPGDGDQTTEEHQEPPVKGDDSVFYEGLYISLGIGYFTGFWGLLGPLLLWPPWRIAYIRFLNRLTDYLYVCLL

SEQ ID NO: 165463 - protein, 485 aa, Glycine max
  Coding DNA Sequence Number=SeqID_48685
  Gene Ontology: Mol. function=protein binding; Cellular component =integral to membrane; Biological process=defense response to fungus
  Homolog annotation: Hit_ID=Q949G8; Match level="QueryCoverage=49%, HitCoverage=87%, E-value=2e-36, Identity=33%"; Hit description =HcrVf2 protein
  Pfam annotation: Domain name=LRRNT_2; Domain location=35-77; Score =43.2; E_value=8.9e-10; Accession=PF08263.3; Description=Leucine rich repeat N-terminal domain
  Pfam annotation: Domain name=LRR_1; Domain location=109-131; Score =12.8; E_value=1.1; Accession=PF00560.23; Description=Leucine Rich Repeat
  Pfam annotation: Domain name=LRR_1; Domain location=133-155; Score =11.2; E_value=2.3; Accession=PF00560.23; Description=Leucine Rich Repeat
  Pfam annotation: Domain name=LRR_1; Domain location=157-179; Score =11.2; E_value=2.3; Accession=PF00560.23; Description=Leucine Rich Repeat
  Pfam annotation: Domain name=LRR_1; Domain location=182-204; Score =12.3; E_value=1.4; Accession=PF00560.23; Description=Leucine Rich Repeat
  Pfam annotation: Domain name=LRR_1; Domain location=206-228; Score =13.4; E_value=0.82; Accession=PF00560.23; Description=Leucine Rich Repeat
  Pfam module annotation: Pfam domain module=LRRNT_2::LRR_1::LRR_1::LRR_ 1::LRR_1::LRR_1; Domain location=35-77::109-131::133-155::157 -179::182-204::206-228
MERMRGIESMLWVSRVNLCKDGFNYLPNSAEIKCIESERQALLNFKHGLIDDSGMLSTWRDDGNNRDCCKWKDIQCNNQTGHVEMLHLRDVSRNQIKGQLPDCWKSVKQLLFLDLSSNKLSGKIPMSMGALVNMEALVLRNNGLMGELPSSLKNCSSLFMLDLSENMLSGPIPSWIGESMHQLIILNMRGNHLSGNVPIHLCYLNRIQLLDLSRNNLSSGIPSCLKNFTAMSEQSINSSDTMSLARSRVRPLPKSLLLYPCAAAAMLMNSASGGDAPSRDFDTPTLDLVSTTLLHAIFEHGGYTCLSMATLAENGDIRTAEAACERAWHSVLSVWREAYSMACLLVTRHHYRNGEFRDTLRVLDLGIIMGGTLLRKDLDSAIEKISEQTRKSVRVSDLGNSEHRLVDRKLVLNFYTLLSGYAQKLNTRVPIGKGKEIKTVTMALCFMAIEGVQLTIPENALVEGKMAGNARWHRYANSYSIVGHI

SEQ ID NO: 165464 - protein, 666 aa, Glycine max
  Coding DNA Sequence Number=SeqID_48686
  Gene Ontology: Mol. function=zinc ion binding; Cellular component =membrane; Biological process=defense response
  Homolog annotation: Hit_ID=Q9FHX1; Match level="QueryCoverage=93%, HitCoverage=57%, E-value=0.0, Identity=74%"; Hit description=TMV resistance protein-like
  Pfam annotation: Domain name=RCC1; Domain location=325-374; Score =6.9; E_value=0.13; Accession=PF00415.9; Description=Regulator of chromosome condensation (RCC1)
  Pfam annotation: Domain name=RCC1; Domain location=377-429; Score =20.7; E_value=0.004; Accession=PF00415.9; Description=Regulator of chromosome condensation (RCC1)
  Pfam annotation: Domain name=RCC1; Domain location=432-481; Score =20.6; E_value=0.0042; Accession=PF00415.9; Description=Regulator of chromosome condensation (RCC1)
  Pfam annotation: Domain name=RCC1; Domain location=495-544; Score =23.6; E_value=0.00069; Accession=PF00415.9; Description=Regulator of chromosome condensation (RCC1)
  Pfam annotation: Domain name=RCC1; Domain location=547-596; Score =24.4; E_value=0.00041; Accession=PF00415.9; Description=Regulator of chromosome condensation (RCC1)
  Pfam annotation: Domain name=RCC1; Domain location=601-648; Score =19.1; E_value=0.0061; Accession=PF00415.9; Description=Regulator of chromosome condensation (RCC1)
  Pfam module annotation: Pfam domain module=RCC1::RCC1::RCC1::RCC1::RCC 1::RCC1; Domain location=325-374::377-429::432-481::495-544::547 -596::601-648
MGEGYCTQPYPCICKEAVSGFEPMTNRSPRHNFTAAPGLALKREILVLIALKKGAQLLKYGRKGKPKFCPFRLSHDESSLIWITSSGERNLKLSSVSRIIPGQRTAVFQRYLRPEKDYLSFSLIYSNGKRSLDLICRDKVEAEVWIAGLKALIASGQGGRSKIDGWSDGGLILNDSRDLTSNNPSVSLASTSRGICSPDISVTLPNTSPKSFRSDNTISERSHAPPDPTNMQVKGSASDVFRVSVSSAPSTSSHGSAPDDCDALGDVYIWGEVTCENVKVGADKNVNYVSPRADVLLPRPLESSVVLDVHHIACGVRHASLVTRQGEVFTWGEESGGCLGHGVGKNVVQPRLVEALTSTTVDFVACGEFHSCAVTMAGELYTWGDGTHNAGLLGHGSDVSHWIPKRIAGPLEGLQIAFVACGPWHTALVTSTGQLFTFGDGTFGVLGHGDRQNVSYPREVESLLGLRTIAVACGVWHTAAVVEVIATHSSTSISSGKLFTWGDGDKNRLGHGDKEARLKPTCVAALIDSNFHKIACGHSLTAGLTKSGRVFTMGSTVYGQLGNPQSDGKVPCLVGDKIARESIEEIACGAYHVAVLTSKNEVYTWGKGANGRLGHGDIEDRKTPALVEALKDRHVKYIACGSNYSAAICLHKWVSGAEQSQDRHVN

SEQ ID NO: 165465 - protein, 54 aa, Glycine max
  Coding DNA Sequence Number=SeqID_48687
MVFGLTIDSGFGGGLVCLGETGYLCPFGSFGGARSKKGRCEKKKGRSRNLYRMC

SEQ ID NO: 165466 - protein, 415 aa, Glycine max
  Coding DNA Sequence Number=SeqID_48688
  Gene Ontology: Mol. function=DNA binding; Cellular component=beta -galactosidase complex; Biological process=DNA integration
  Homolog annotation: Hit_ID=Q1SS72; Match level="QueryCoverage=96%, HitCoverage=28%, E-value=1e-126, Identity=56%"; Hit description =Integrase, catalytic region
MLLALAALRNWHLRQLDVNNAFLHGDLNEEVYMKPPPGLVMDKPNLVCRLQRSLYGLKQASRQWFTRLSSFLLSQGFRQSSVDHSLFLYSHNDNTITAILVYVDDIILAGDNLKSITHFTKLLDQTFSIKDLGILKFFLGLEVARSSHGIHLCQRKYVLDILSDSGMLGSRPASTPMDYSTRLSASLGTPLSETTASSYKCLIGRLIYLTNTRPDITHAVQQLILRYLKSSPGSGIFFVAHGDLTLKAFNDSDWAGCRDTRRSITGFVVYLGESLISWRSKKQSTVSRSSSEAEYRALASTTCELQWLSYLIHDFRVLFLQPATLFCDNQSAIQIASNPVFHERIKQIEIDCHIVRDKVNAGLLKLLPVSSSMQIADIFTKPLTPAVFQGLCCKLGMENIHFQFEGGGLSRSSLS

SEQ ID NO: 165467 - protein, 51 aa, Glycine max
  Coding DNA Sequence Number=SeqID_48689
MPNLIFMLPSLLFRIKLQAPKRKVAILKIVVSLNIKPETNVVQQDVTDKLK

SEQ ID NO: 165468 - protein, 374 aa, Glycine max
  Coding DNA Sequence Number=SeqID_48690
  Gene Ontology: Mol. function=methyltransferase activity; Cellular component=nucleus; Biological process=fatty acid biosynthetic process
  Homolog annotation: Hit_ID=Q1T1A3; Match level="QueryCoverage=99%, HitCoverage=100%, E-value=1e-148, Identity=68%"; Hit description=SAM dependent carboxyl methyltransferase
  Pfam annotation: Domain name=Methyltransf_7; Domain location=36-373; Score=583.6; E_value=1.9e-172; Accession=PF03492.6; Description=SAM dependent carboxyl methyltransferase
MKVAQVLHMNGGVGHASYGNNSLVQEKVICLTKPIREEAITSLYCNTVPRSLAVADLGCSSGPNTLLVVSEFIKIVEKLYRELNHKSPEYKVFLNDLPGNDFSNIFKSLDSFKEKLCDEMESGIGPCYFSGVPGSFYGRVFPNQSLHFVHSSYSLQWLSKVPEGVDNNRGNVYIGSTSPTNVARAYYEQFQRDFSLFLKCRAEELVKGGRMVLTFLGRRSDDPSSKDGGYIWELMATALNDMVLQKFLFRNHKEEQLDTFNIPLYTPSPSEVKLEVLKEGSFAINRLEVSEVNWNAFDDWNALEFESERSDTLSDGGYNVAQCMRAVVEPMLVSHFDEAIIEEVFSRYQQILADRMSKEKTKFTNVTILLTLKA

SEQ ID NO: 165469 - protein, 585 aa, Glycine max
  Coding DNA Sequence Number=SeqID_48691
  Gene Ontology: Mol. function=DNA binding; Cellular component=beta -galactosidase complex; Biological process=DNA integration
  Homolog annotation: Hit_ID=Q1SFD6; Match level="QueryCoverage=99%, HitCoverage=44%, E-value=1e-107, Identity=36%"; Hit description =Integrase, catalytic region
  Pfam annotation: Domain name=rve; Domain location=490-585; Score= -5.5; E_value=0.017; Accession=PF00665.16; Description=Integrase core domain
  Pfam annotation: Domain name=zf-CCHC; Domain location=229-246; Score =4.8; E_value=0.16; Accession=PF00098.13; Description=Zinc knuckle
  Pfam annotation: Domain name=zf-CCHC; Domain location=265-282; Score =12.3; E_value=0.0092; Accession=PF00098.13; Description=Zinc knuckle
  Pfam module annotation: Pfam domain module=Retrotrans_gag::rve::zf -CCHC::zf-CCHC; Domain location=77-174::490-585::229-246::265-282
MNESLLNTESYLYLHPSENPAVALVSPPLDSSNYHSWSRSMMTALSAKNKVEFVNEKAPEPLKSDRTYGAWSRCNNMVVSWLVHSVSIPIRQSILWMDKAEEIWNDLKSRYAQGDLLRVSELQQEASSIKQGSLSVTEYFTKLRVIWCTCLVLTTIAQRKQEDRAMQFLRGLNEQYENIRSHVLLMDPIPTIPKIFSYMAQQERQLGNNPLSSFNLEPKEVSSINAVKIVCEFCGCTGHNESICYKKHALPPNHDGKGRGYSTRKTCIYCGKLGHTIDVCYKKHGYPPGFKFNNGKAIANNIVAAEGKATDDQILSQESQEPVRFSSEQYKALLALIQQPSAEKSASIKPQVASISSCTNNDPAAFTFNLISISKLVPFTNYKLIFSSNICILQDTNTKVRIGTAEVSRGLYQFIPEAPKTHTICSTITHPKCRILPVNLWHYRMGHPSPERLQAMQSYYPFLNNNKNFICNTCHYAKHKRLPFPSSTSHASNKFELLHIDIWGPCSKTSMHGHRYFLTIIDDFSRYTWIHLMHTKAETRKIIIDFTAYIETQFDSKIKILRSDNGTEFLMNDFYARKGIIHQTT

SEQ ID NO: 165470 - protein, 58 aa, Glycine max
  Coding DNA Sequence Number=SeqID_48692
MEGILNLGGRGGCRVREERRRLGVPGGEEDELSCVEKYARMSTRVEFLSMILKGTDVT

SEQ ID NO: 165471 - protein, 306 aa, Glycine max
  Coding DNA Sequence Number=SeqID_48693
  Gene Ontology: Mol. function=protein binding; Cellular component =integral to membrane; Biological process=protein amino acid phosphorylation
  Homolog annotation: Hit_ID=Q1T435; Match level="QueryCoverage=84%, HitCoverage=81%, E-value=1e-37, Identity=39%"; Hit description =Leucine-rich repeat; Leucine-rich repeat, cysteine-containing type
  Pfam annotation: Domain name=LRRNT_2; Domain location=49-91; Score =51.6; E_value=2.6e-12; Accession=PF08263.3; Description=Leucine rich repeat N-terminal domain
  Pfam annotation: Domain name=LRR_1; Domain location=124-147; Score =6.0; E_value=22; Accession=PF00560.23; Description=Leucine Rich Repeat
  Pfam annotation: Domain name=LRR_1; Domain location=149-171; Score =16.6; E_value=0.093; Accession=PF00560.23; Description=Leucine Rich Repeat
  Pfam annotation: Domain name=LRR_1; Domain location=173-196; Score =6.1; E_value=20; Accession=PF00560.23; Description=Leucine Rich Repeat
  Pfam annotation: Domain name=LRR_1; Domain location=198-220; Score =14.3; E_value=0.44; Accession=PF00560.23; Description=Leucine Rich Repeat
  Pfam annotation: Domain name=LRR_1; Domain location=222-245; Score =9.5; E_value=4.8; Accession=PF00560.23; Description=Leucine Rich Repeat
  Pfam annotation: Domain name=LRR_1; Domain location=272-301; Score =4.2; E_value=47; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1; Domain location=49-91::124-147::149-171::173 -196::198-220::222-245::272-301
MAFGLTIDSGFGGGLACLGETGYLCPFGSFGVSILGFNSLPNSAEIKCIQTERQALLNFKHGLIDGYGILSTWSDDDSNRDCCKWKGIQCNNQTGHVEMLHLRGQDTQYLRGAINISSLIALENIEHLDLSSNSFPWSHIPEHMGSFTNLRYLNLSHCFFIGIIPSDIGKLTHLLSLDLGKNLYLYGQIPYQLGNLTHLQYLDLSDNDLDGELPYQLGNLSQLRYLDLAGGNSFSGALPIQIGNLCLLHTLGLGGNFDVKSKDAEWLTNLSSLTKLRLSSLHNLSSSHHWLQMISKLIPNLRELRL

SEQ ID NO: 165472 - protein, 157 aa, Glycine max
  Coding DNA Sequence Number=SeqID_48694
MMMGGDLHDNINKFNQLVNQFLNVNDKLSNEEQTLLLLTSLPRSFKALVQMLFVERSTLNLDEVITAIKENERMMRTENIDDEHHAIAMENLKKLRDMNKDGANSQANVIKSVEDEDDVLDTLKIDGEFAHFKLGNGEKMKAEGIGSVRMKLHDGVI

SEQ ID NO: 165473 - protein, 166 aa, Glycine max
  Coding DNA Sequence Number=SeqID_48695
QYQRCSKETNDQRSTKSDPSYWEYVDALHFVQNSNSSVKHSASSSEQAIPRRTMPMLDQFYPCIHHSIENFVDVKVDDSWSLVYNQLLKELAKWPDEYINLLGGINKFEELKSLEAMKGAYDRQIKQRGYIIKGDGHFSYRKMKTPSFLMSSLCKSLYKSLIASVQ

SEQ ID NO: 165474 - protein, 90 aa, Glycine max
  Coding DNA Sequence Number=SeqID_48696
MEADNSGDTIKITQRWRRKKVRCGEIYRMHEGEKREPEEQRGREGYLLIVLGIALAKLLDLDTRNHHHSPWYFWKRKSKGNCVSNKGERK

SEQ ID NO: 165475 - protein, 366 aa, Glycine max
  Coding DNA Sequence Number=SeqID_48697
  Gene Ontology: Mol. function=RNA-directed DNA polymerase activity; Cellular component=nucleus; Biological process=RNA-dependent DNA replication
MDVNKTPGIDGYGVGFFKDAWSIVGSDVREAILDFFLRNRLHKGFNSSVVALIPKHKEAKMIKDFRPISCCSTAYKIISKVLTNRLSKVIDTLVGKNQAAFVPGQQLHDHVLLAFELLRGYERKHGTPKCMLQIDIQKAYDTVHWDALEHILRELGFPDQFIKWIMIAVRSVTYVFNIIGRFTRRLEARRGIRQGDPISPLLFILVMEYLNRILSQLDKIPNFNYHSKCEKMKITNLCFADDLLLFSRGDIGSVQIMLDKFNTFLRSMGLHVNPSKCNIYCGSVDINVKKQLLFISGFKEGKMPFRYLGIPLSSKKLNIKHYQVLIDKIVGRITHWSAGLLSYAATFLGSLQLLGKKSAVRRLMVV

SEQ ID NO: 165476 - protein, 351 aa, Glycine max
  Coding DNA Sequence Number=SeqID_48698
  Gene Ontology: Mol. function=methyltransferase activity; Cellular component=nucleus; Biological process=fatty acid biosynthetic process
  Homolog annotation: Hit_ID=Q1T1A3; Match level="QueryCoverage=99%, HitCoverage=100%, E-value=1e-134, Identity=65%"; Hit description=SAM dependent carboxyl methyltransferase
  Pfam annotation: Domain name=Methyltransf_7; Domain location=36-350; Score=484.4; E_value=1.3e-142; Accession=PF03492.6; Description=SAM dependent carboxyl methyltransferase
MKVAQVLHMNGGVGNASYANNSLVQEKVICLTKPIREEAITSLYCNTVPRSLAVADLGCSSGPNTLLFVSEFIKIVEKLCRELNHKSPEYKVFLNDLPGNDFNNIFKSLDSFKEKLCDEMESGIGFSQIKVFILSIRWLSKVPEGVDNNRGNVYIGSTSPTNVARAYYEQFQRDFSLFLKCRAEELVKGGRMVLTFLGRRSDDPSSKDGGYIWELMATALNDMVLQGIIKEEQLDTFNIPQYTPSPSEVELEVLKEGSFASNRLEVSEVNWNAFDDWNTLEFESERSDTLSDGGYNVAQCMRAVAEPMLVSHFGEAIIEEVFSRYQQILTDRMSKEQTKFINVTVLLTRKA

SEQ ID NO: 165477 - protein, 159 aa, Glycine max
  Coding DNA Sequence Number=SeqID_48699
  Homolog annotation: Hit_ID=UPI00006BB294; Match level="QueryCoverage =69%, HitCoverage=45%, E-value=8e-09, Identity=35%"; Hit description =N-acetylmannosamine-6-phosphate 2-epimerase
MKKKKVEAVGVSLSEAYALSNECKIWQQRGSLRVDLEFNKLWTIDAFVLGFGKAHQGTNLGFDEPLEIRDSPRADLGFDKPLEKRDLPWANLRFDEPLEMRDSPRADLRFDEPLEKRESPRADLGFDEPLEKADIGFDEPLEKLDSPRADLGFDEPLEK

SEQ ID NO: 165478 - protein, 54 aa, Glycine max
  Coding DNA Sequence Number=SeqID_48700
MAFGLTIDSGFGGGLACLGETGYLCPFGSFGGARSKKGRCKKKKGRSRKGFDPS

SEQ ID NO: 165479 - protein, 85 aa, Glycine max
  Coding DNA Sequence Number=SeqID_48701
MDKCCPVLRMIASTGAELQVVRLVKPLNLDKGCPGYFYQVSGVDMLLVLQVHSLHRCLSSPTLPWAWAAVTPGFVPLLRVLMNLP

SEQ ID NO: 165480 - protein, 34 aa, Glycine max
  Coding DNA Sequence Number=SeqID_48702
MQHNVARGLLITNDAQAGQVSPLLDNMERVLSGD

SEQ ID NO: 165481 - protein, 52 aa, Glycine max
  Coding DNA Sequence Number=SeqID_48703
MAGNKYVRNVVKAKEICSAQRLWSCYSKKACACRLNPTAGALNNKPPRSSFS

SEQ ID NO: 165482 - protein, 172 aa, Glycine max
  Coding DNA Sequence Number=SeqID_48704
MRKKGFDFEMNDESMMHKPLLITKLGYAAFLCQGTPFLPSKFPARVDYHRDVSLTSQTIFRIKIREKHANHSCTKFVTSAARNDHHLSYDDDLPQEPFLLTLIKDVIWGLRYIFVFLVEQPGQFKYIEWPSFSSTLRTAILTLILVAMLIVALSSVDSALSYLLALALRKRP

SEQ ID NO: 165483 - protein, 110 aa, Glycine max
  Coding DNA Sequence Number=SeqID_48705
MSIGFNDEICAISELGYNNNNNKNSRNNFNKGPGHRIPQHTAVPILGKELSRQQEEQLLQRYLGFNLNEAELKLSPTRGICELSFGFKYVVTIMLFGLSLVQQEGSEDKA

SEQ ID NO: 165484 - protein, 55 aa, Glycine max
  Coding DNA Sequence Number=SeqID_48706
  Pfam annotation: Domain name=LRRNT_2; Domain location=21-55; Score =14.7; E_value=0.025; Accession=PF08263.3; Description=Leucine rich repeat N-terminal domain
MKSVSILGFNSLPNSAEIKCIETERQALLNFKHGLIDDYGILSTWRDDDSNRDCC

SEQ ID NO: 165485 - protein, 73 aa, Glycine max
  Coding DNA Sequence Number=SeqID_48707
TSGLTPVMLAQPGGSSGALSELILAEHIIDNSSASRIFHALSHDLLRSADGSLSQRIGLASGSKSALPPNLPN

SEQ ID NO: 165486 - protein, 59 aa, Glycine max
  Coding DNA Sequence Number=SeqID_48708
MGLATKIEYEKETKIVVFKKHKVEKGVSSRENDGLVRISTTSSWITRFNNVCIIFPAEN

SEQ ID NO: 165487 - protein, 153 aa, Glycine max
  Coding DNA Sequence Number=SeqID_48709
MLMVSMTMLVVATNGDDNDSSDRGGISGSDGSHDDSSGVNHGDGVGSIGGCGDSNNVGGVGGDGGGGGGNISSGCNNNVSGGGNGGGGGGDRSGGNNNYGGGVVVVRTMLVVIMKTLVVVVVAVMKVALLKKTTFYDNETTTIPKNRLRMSLR

SEQ ID NO: 165488 - protein, 197 aa, Glycine max
  Coding DNA Sequence Number=SeqID_48710
MVGVPVIRIPLRSHPIDVPRAQTLFLEEDVTLYMERSSISKIAISGVYGGEDGGKCLRLTLVYFTDNLFVDTTTKPSLPSASSPPGSPTWPLTSTPAPSSSHATASTLGTEPHLRAISAAEVVPLSEGDIDGGDVDACGRWCEKVLVVLKGGGVVESCDNDGVEECGVVSSSEDEFVRERDRQRDSLVELNNFKSIP

SEQ ID NO: 165489 - protein, 308 aa, Glycine max
  Coding DNA Sequence Number=SeqID_48711
  Homolog annotation: Hit_ID=Q3Y4G8; Match level="QueryCoverage=21%, HitCoverage=26%, E-value=1e-20, Identity=78%"; Hit description=MADS -box protein
  Pfam annotation: Domain name=K-box; Domain location=99-199; Score =56.1; E_value=1.1e-13; Accession=PF01486.8; Description=K-box region
MPHLDTRLCMLLCVIPLVGDLIEEEEERKPVDEKDNGPTDYWKEKKVAGKCRDDLVLSLQVLGDYQSLLTPPQSVLAAAKAMLFVSGITIGSAYFDCLNMTEMPVDCSGNYHEYLKLKARFESLQRTQRNLLGEDLGPLNTKDLEQLEHQLDSSLKQVRSTKVMWSLNDVHWNSSLSDTSSPSTISSKGNNSLSNTSSLSVIPARGEIALSVNVSLSGNLLQIINTTNNVKNTIFPHSSPQTLTQTLNPPPHPPPMAIDDHHKPPLLAAEPPHGVEAFDRSGIFKTQLVDSVENGALDPPFAVSSSKP

SEQ ID NO: 165490 - protein, 133 aa, Glycine max
  Coding DNA Sequence Number=SeqID_48712
  Homolog annotation: Hit_ID=Q1T435; Match level="QueryCoverage=61%, HitCoverage=7%, E-value=6e-07, Identity=43%"; Hit description =Leucine-rich repeat; Leucine-rich repeat, cysteine-containing type
MSEQSINSSDTMSRIYWYNNTYFEIYGLYSFGGYTLDITWMWKGVEQGFKNPELKLKSIDFSSNNLTGEIPKEEDILKPLKPLVLKETLIFVVNNLTKLVLGMEIRQQQSIKNQQSKGHYYCGVLGELPTSDF

SEQ ID NO: 165491 - protein, 971 aa, Glycine max
  Coding DNA Sequence Number=SeqID_48713
  Gene Ontology: Mol. function=RNA-directed DNA polymerase activity; Cellular component=chromatin; Biological process=chromatin assembly or disassembly
  Pfam annotation: Domain name=Chromo; Domain location=877-922; Score =20.7; E_value=0.0035; Accession=PF00385.14; Description='chromo' (CHRromatin Organisation MOdifier
  Pfam annotation: Domain name=rve; Domain location=571-727; Score =98.1; E_value=2.6e-26; Accession=PF00665.16; Description=Integrase core domain
  Pfam annotation: Domain name=zf-H2C2; Domain location=512-553; Score =12.5; E_value=0.008; Accession=PF09337.1; Description=His(2)-Cys(2) zinc finger
  Pfam module annotation: Pfam domain module=Chromo::RVT_1::rve::zf -H2C2; Domain location=877-922::77-244::571-727::512-553
MDAALSSLSSLQFRRLSRKNRDGLYYHITLLSSVDTTTQDLPPSIHTLLAKYDTLFQPPQTLPPTRDTDHHIHLLPQAPLVNVRPYRYPITKNRRLSLRALNALTVRDWFPIPTIDELLDKLGGARYFSKLDLLQGYHQIRMHPPDIPKTAFRTHHGHYEFKVMPFGLCNAPSSFQATMNAIFRPYLRQFLIVFFDDILIYNNSLDDHVHHLELTFQEQVEYLGHLVSHHGVEPLPSKVDAIQQWLILRTTKALKSFLGLAGFYRRFIKGYATIAAPLVKATTSDTLRWTADTQASFENLKHALSSAPVLALPDFTLPFMVETDAFGVGMGVVLSQQGHPIAYFSKPFSAKLLCSSTYVRELFAITAAIKKWRQYLLGHHFIIVTDHRSLKELLTQVIQTLEQHTYLARLLGYDYEIQYRSGAHNQAADALSWLPENTTSLWVLSVPCLTFFEELQQQLQTQPEYVRKRHDITEQPSNHPAFSISSNMILHKGRIWLPEGFHLIPTLIAEYHVTPTGGHAGIAKTIARVLENFSWPKLREDVTQFVTNYAECQCTDYETKCLAELLCPLPVPFRPWEDLSLDVITGLSAYHGHTVILVIMDRFSKGVHLGTLPTAHTALAVASLFVDIVVKLHGTPRSLVSDRDPLFISRFWQELFRCSGTQLRMSTAYHPQSDGQTEVLNRIIEQYLRSFVHRQPSTWGKYLPWAEWSHNTSWNSATGTTPYELTFGKKPFNFPEYIAGSSAVDAVDTLLQDRDETFQLVRRKLLKAQSRMKEQSDRRRRDVSYNSDDWVWLKLRPHRQTSATGPLSPAGKLARRYYGPFKVIEAIGKVAYRLQLPPETKIHDVFHCSLLKPFHGQLEATSPVPLPDQFHNDQPIITPAAIVDYRKTPSEAWEVLVQWHGLSPDDTSWEDWSTLCHDYHLEDKVISQGPWDDKDNTDHRAGVQIEHSAEVQIKEKPKRRVMRPAYLRDYA

SEQ ID NO: 165492 - protein, 92 aa, Glycine max
  Coding DNA Sequence Number=SeqID_48714
MEISSGLWPNQDKSGFAFSLPLSFLLSVIFTFPQYFNDTRPLEPKRLKALRVEAKLHGESKVIQRCFDDNNDDDKGDDKKIKDQSKINSSES

SEQ ID NO: 165493 - protein, 166 aa, Glycine max
  Coding DNA Sequence Number=SeqID_48715
  Subcellular localization annotation: CTP_CleavageSite=92; ConfidenceScore=5.06e-01
TTPCPLDVVASYNKPLMNPLMLYKSLDRLPFSNYGDLLTSGLIFSSPLETSTTTNAKSSMDASSLLLSTSSSVLGEFSKNSEGIITTNFGVLQEHGNDYQIPLLRDNMQGTFGNHDDNNVLVKIPNVNVVPRVGDQQLETVRSIGFPFNIGDAWKPNMLWDASSLS

SEQ ID NO: 165494 - protein, 158 aa, Glycine max
  Coding DNA Sequence Number=SeqID_48716
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=9e-16, Identity=31%"; Hit description= UPI00006A17C9 related cluster
MQPSEGEGIQPSEVEDVSPFEGEGMQPSEAEGVQPSKGMGTQPSEGEDVQPFQDEDMWSFEGKDAWPSEGVSPLKARMCSPLKVKACSPLKARACSPLKARRSSPLKVRVCSPLKVRACSPLKARTCSPLKVRACSPLKARTCTPLKARTCSPLKVRT

SEQ ID NO: 165495 - protein, 72 aa, Glycine max
  Coding DNA Sequence Number=SeqID_48717
MTTLVSACQRARLPLADESLKMLTSQEKVSMITLVPACQSDLGSPNDEVRITVRHLLMLPDSRVTIVGWGGR

SEQ ID NO: 165496 - protein, 97 aa, Glycine max
  Coding DNA Sequence Number=SeqID_48718
MTLLLSNILPSDHNVDLPLRKYHLRSCPQDTRWTRRSPTGPWGFQLWLRASVSPTGCPSPPARSSHRDIGIVPARHPVDSKKSNMVLGFPALITGRC

SEQ ID NO: 165497 - protein, 157 aa, Glycine max
  Coding DNA Sequence Number=SeqID_48719
MEDGRRTVVVAEVDSTKVVAMVVEEDVKREYQICGVGRKGKYNRHRRKSPSATASGGDRSLKGRTIRNSASGGCEGFNLMTLGVIIPGVEILTTHFDPIRSQSAYKLLKIALSSNANRNVKNAISYGKRVLEAAKTSMVLQQIFKACYQQFGAISPS

SEQ ID NO: 165498 - protein, 117 aa, Glycine max
  Coding DNA Sequence Number=SeqID_48720
MKATHDFVVGEETMHVKIRIRIRNGGGGREGLDVEVEGPVKLTRDYMNHVVSRMERKVKSEMEASTVALVRNAAVGQRWPKGSNDGEDGGDDSCMHMQWLITQRTDRRPISPTAYLA

SEQ ID NO: 165499 - protein, 132 aa, Glycine max
  Coding DNA Sequence Number=SeqID_48721
MSVEEGLLLASVTLNGPRSMQQLPERKNPISQGGGVVKSSSFLASLHDDREEYFVAKIRSDRGDGGLSVELQKPSIRVKRALLSMLDDVKGKGWLPKPSSSDCAIEFSNKNNSNTNNKVSRLALAAKASRRF

SEQ ID NO: 165500 - protein, 96 aa, Glycine max
  Coding DNA Sequence Number=SeqID_48722
  Gene Ontology: Mol. function=RNA polymerase II transcription factor activity; Cellular component=DNA-directed RNA polymerase II, core complex; Biological process=regulation of transcription, DNA -dependent
  Homolog annotation: Hit_ID=Q2HU21; Match level="QueryCoverage=90%, HitCoverage=77%, E-value=3e-44, Identity=90%"; Hit description=DNA -directed RNA polymerase, subunit C11/M/9
  Pfam annotation: Domain name=RNA_POL_M_15KD; Domain location=4-58; Score=76.4; E_value=8.8e-20; Accession=PF02150.7; Description=RNA polymerases M15 Kd subunit
MSAMKFCRECNNILYPKEDRDQKVLLFACRNCDHQEVADNFCVYRNEIHHSVGERTQVLQDVAADPTLPRTKSVRCSQCNHGEAVFFQFAILVLRI

SEQ ID NO: 165501 - protein, 94 aa, Glycine max
  Coding DNA Sequence Number=SeqID_48723
  Gene Ontology: Mol. function=protein binding; Biological process =insulin receptor signaling pathway
  Homolog annotation: Hit_ID=Q2HU19; Match level="QueryCoverage=93%, HitCoverage=6%, E-value=4e-43, Identity=92%"; Hit description =Bromodomain; WD40-like
MSAGYDGRTIVWDIWEGMPIRTYEISRFKLVDGKFSSDGTSIILSDDVGQLYILSTGQGESQKDAKYDQFFLGDYRPLIQDTHGNVLDQHWYEV

SEQ ID NO: 165502 - protein, 1070 aa, Glycine max
  Coding DNA Sequence Number=SeqID_48724
  Homolog annotation: Hit_ID=Q2HU19; Match level="QueryCoverage=99%, HitCoverage=78%, E-value=0.0, Identity=67%"; Hit description =Bromodomain; WD40-like
  Pfam annotation: Domain name=Bromodomain; Domain location=967-1058; Score=4.0; E_value=0.00089; Accession=PF00439.15; Description =Bromodomain
MIPYPEPYQSEFQQRRLGALGLEWRPSSLRLAVGPDFSLDPDYHMLPLADLDLLTEPLPEFIDAMEWEPEVEVFSDDTDSEYNVTEGFFSKGEKGGSSSNASGDSGCSTDNSEGEDTCMDSIRRSKRKKQKAETEVMTSSGRRVKRRNLDERDGNTFGSSRSRKGKSVQKTSRRKSSKSKSSRPQRAAARNALHLFSKITGTPTDGEEDSLVGDFSGSESTLQESNIDSDESGGTLQNEQLNYSKGKEVSYYESEDTKSHELTETHVNSMNKRLVLKLPNRDISKSTNEFGYQAELVGSSSKTAQEATDFNGNRPSSKDSGYCSGSTSYPAVEKTDQAKLGQVTDHVDLLGKIRWGMVRARSSKPLRVGEAMPSDTDPYSGKCPNHLDEKENVSSGHEKEDKNFSALTPEVTPELEIHKDDYRVDSLTEINGKKENAISGHEKEDKNFSALTPELTPELEIQKDDYKVDSLTEINENCAGTTSQPFNLTEDGGEITASSNCRDKNESLISAYVIPQDIVTASIGYSEVDQLPEPNIGFACVSTKLRSKRGSRDPESPSKLETKSSVLKNSACSTNDNKNLNNVVVDDSNNTRVASNHGENGSQEVDPQIRQNSTSQDLPEPHSHRDKMYKAVYRRSRSHRAVTNLADSSGQGESNSNGRNSNFNAAANFSNGTYEAIHTNGSLELEPTSSDPNYERNNLKVLQGPGNCIVKSPQNVSTSGGQLTEEERCSNSKLTVGLRSTRNRRSSYNIRETSPVNKRKSLQSATRGSWLLLSTHEEGCRYIPQQGDEVVYLRQGHQEYINYCRKRESGPWVSLKGHIRAVEYCRVQSLEYSHLPGSGDSCCKMNLLFVDPNSSVVGKSFKLTLPEVTSFPDFLVERIRFDTAMQRNWTRRDKCRVWWKNEDNSSGNWWDGRILCVKAKSSEFPDSPWESCTVRYKSDLTETHLHSPWELFDADTEWEQPHIDDDMRNKLQSALTKLQQSGNTVQDRYGVHELKKISNKSKFINRFPVPISIELIQSRLENNYYRSLEALKHDVTILLSNATTFLEKDAVLSAKIKRLSEWFTRTLSSL

SEQ ID NO: 165503 - protein, 312 aa, Glycine max
  Coding DNA Sequence Number=SeqID_48725
  Gene Ontology: Mol. function=helicase activity; Cellular component =mitochondrion; Biological process=metabolic process
  Homolog annotation: Hit_ID=Q1T4I9; Match level="QueryCoverage=78%, HitCoverage=74%, E-value=4e-46, Identity=35%"; Hit description =Pentatricopeptide repeat
  Pfam annotation: Domain name=PPR; Domain location=107-141; Score =47.4; E_value=4.7e-11; Accession=PF01535.11; Description=PPR repeat
  Pfam annotation: Domain name=PPR; Domain location=142-176; Score =40.7; E_value=4.9e-09; Accession=PF01535.11; Description=PPR repeat
  Pfam annotation: Domain name=PPR; Domain location=177-211; Score =48.7; E_value=1.9e-11; Accession=PF01535.11; Description=PPR repeat
  Pfam annotation: Domain name=PPR; Domain location=2-36; Score=33.8; E_ value=6.1e-07; Accession=PF01535.11; Description=PPR repeat
  Pfam annotation: Domain name=PPR; Domain location=212-246; Score =45.8; E_value=1.5e-10; Accession=PF01535.11; Description=PPR repeat
  Pfam annotation: Domain name=PPR; Domain location=37-71; Score=39.5; E_value=1.2e-08; Accession=PF01535.11; Description=PPR repeat
  Pfam annotation: Domain name=PPR; Domain location=72-106; Score=44.9; E_value=2.8e-10; Accession=PF01535.11; Description=PPR repeat
  Pfam module annotation: Pfam domain module=PPR::PPR::PPR::PPR::PPR::PP R::PPR; Domain location=107-141::142-176::177-211::2-36::212-246::37 -71::72-106
MYTYNVIIRNVVSQGDLEKGLGFMRKMEKEGISPNVVTYNTLIDASCKKKKVKEAMALLRVMAVRGVTANLISYNSMINGLCGEGRMGEAGEFVEEMREKWLVPDEVTYNTLVNGFCRKGNLHQGFVLLSEMVGKGLSPNVVTYTTLINYMCKVGYLNRAVEIFHQIRGSGLRPNERTYSTLIDGFCHKGLMNEAYKVLSEMIVSGFSPSVVTYNTLVCGYCFLGKVEEAVGILRGMVERGLPLDVAINRGHVCAFFWNSDHLRIKLQSSDFFRGTKFRALLFLSLHSSSSTFKLLSMASYGGELLLDSSST

SEQ ID NO: 165504 - protein, 268 aa, Glycine max
  Coding DNA Sequence Number=SeqID_48726
  Homolog annotation: Hit_ID=UPI0000447263; Match level="QueryCoverage =28%, HitCoverage=16%, E-value=2e-18, Identity=76%"; Hit description =PREDICTED: similar to germinal histone H4 gene
MTVIALIKALARERMNDELSQVLLNILRSCKLNDAKVAKVLLEVNFKEVLSETSTICLAASRINDYLYKPTRDLLAYFAFTYMLSRKHRRSINNIHSGDSLPPSVLSVGNNIRNNILEEDLEDIMSFLVDKTTDSLNISSPSQMRNCRFGDTWMLSRSTFLKPSLPFHDTTSSLMLKGGNVFQSAYCVFGKLECCCNGVEGVCFWGFDVGGVWKVMLCVQIQCIEVDVHPQICVVVEVAVCGGGRWCLWLEVGMIVEEDRLEVVATEE

SEQ ID NO: 165505 - protein, 403 aa, Glycine max
  Coding DNA Sequence Number=SeqID_48727
  Gene Ontology: Mol. function=molecular_function; Cellular component =cellular_component; Biological process=regulation of transcription, DNA-dependent
  Homolog annotation: Hit_ID=Q2HU18; Match level="QueryCoverage=85%, HitCoverage=72%, E-value=1e-139, Identity=72%"; Hit description=WD40- like
  Pfam annotation: Domain name=WD40; Domain location=235-273; Score =42.1; E_value=1.9e-09; Accession=PF00400.22; Description=WD domain, G-beta repeat
  Pfam annotation: Domain name=WD40; Domain location=277-315; Score =36.9; E_value=6.8e-08; Accession=PF00400.22; Description=WD domain, G-beta repeat
  Pfam annotation: Domain name=WD40; Domain location=319-369; Score =11.8; E_value=1.5; Accession=PF00400.22; Description=WD domain, G -beta repeat
  Pfam module annotation: Pfam domain module=WD40::WD40::WD40; Domain location=235-273::277-315::319-369
MEGWSMALQKYAPSGNAPSVNIKHLSFSSKVPKKAELDEANPNHNMDVDIDLREIYFLIMHFLSAGPCHKTYIQFWNELLEHQLLPRRYHAWYSRTGACSGDKDDDGLSFPLNYNMLVERYSHIEKDHLVKLLKQLLLNTASPSLGMNLGNAPNAADVPTLLGSGSFSLLSYDRDKMKEVKRPPPHMRWPHMKANQVHGLSLREIGGGFPRHHRAPSIRAACYALAKPSTMVQKMQNIKRLRGHRNAVYCAIFDRSGRYVVTGSDDRLVKIWSMETAYCLASCRGHDGDITDLAVSSNNALVASSSNDCVIRVWRLPDGLPISVLRGHTGAVTAIAFSPRLNALYQLLSKSGRFVGFTASCSFVCAVAKQAFATFRVAGQGSVTFAVPGKSPATFHLPSPSLL

SEQ ID NO: 165506 - protein, 76 aa, Glycine max
  Coding DNA Sequence Number=SeqID_48728
MKPHHDLEFKLTLMGYDKWGNVLSYRIEPASIVEVIDNKGDHYNMMFENIEEYKELLCQLEPSSKEEYDDLPEDIS

SEQ ID NO: 165507 - protein, 427 aa, Glycine max
  Coding DNA Sequence Number=SeqID_48729
  Gene Ontology: Mol. function=RNA-directed DNA polymerase activity; Biological process=RNA-dependent DNA replication
MTNQKNIEASIKNLEVQVGQLAKQLSEHGSGSFSTNTQVNLKDQCKKNDEVVTNEEVEEKVQLQINIPFSKALEQMPTYAKFMKELLRKKRIILEDKTVELEADSLLDLGASNNLMPLSLIKQIGGVEIKPTWMALQLANRTIKHPYGIIEEVLVKVNKFLFQVDILVMDMDEGSEVPLVLVGPFMKTANVVIDVNDGKLYVRVQDDEGHLNPTMKEVVKKEVVKLLEARMIYPISDRSWNEKNELILTQTDIGWRMCVDYGKLNKATKKDHFPLPFMDQMLERLACQAFYYFLDGYSVYNQIPVKPEDQGKTTFTCPFSVFAYRKMPFGLCNAHATFQQCMLAIFVDLVEKSIEVFIDDFFVFGSSFDSFLSKLDTVLKQCMETNLVLNWEKCHFMVTEGIVLSHKIFVGGIEVDKAKVEVIEKLP

SEQ ID NO: 165508 - protein, 118 aa, Glycine max
  Coding DNA Sequence Number=SeqID_48730
  Gene Ontology: Mol. function=DNA binding; Biological process=DNA integration
  Homolog annotation: Hit_ID=Q1SQ35; Match level="QueryCoverage=80%, HitCoverage=91%, E-value=3e-35, Identity=71%"; Hit description=Pol -related
MGCYKHRKLQFQELEELRFHACEKSKLYKQKVKIYHDKKLLKRNFQPGQQVLLFNSRLRLFPGKLKSKWSRPFIINEVKPYGVVVLEDPTTKRTWTTNGSRIKHCLGGHTNEHLILTS

SEQ ID NO: 165509 - protein, 86 aa, Glycine max
  Coding DNA Sequence Number=SeqID_48731
MPMLLCKNHEEALKEFLARLRWLWLVVVYIISSDDTCRESDAKGKDSTMVFTSKAITSSFDFGLESFHNLVMDYEALTPTQTSDTT

SEQ ID NO: 165510 - protein, 133 aa, Glycine max
  Coding DNA Sequence Number=SeqID_48732
MTIIMENAREPQKTGNFHKHINMSVSDLNLPARTKEMIKNTKWSRKLWAQQVMGLEGSSWQGTLVELQVHHMPTGVRRGHGYDVLGEMPISGYSTFSASFYFFLSSSLDFILCGEESTTVPLSHCFSIVSTSA

SEQ ID NO: 165511 - protein, 318 aa, Glycine max
  Coding DNA Sequence Number=SeqID_48733
MASNPSRVQKKSKSSIRKQGELSQAALNRMDTWFTDENKKTDFKMIYTVKNMKETLYPELVKVFYTCARADKEGNLHSTINGVEIIIDAEVWKEVAGLDMGGVYKFKVSVDGYSKMQMYRAMLLDLARTMRNYIGVGGLTIEDRMLVYLIIYILAPRSNNHAQMNWILLIEDIMLKSHRLVDYEFPYVVLASRFIDYFNIDVSNEIVDFTKASNKITERHLKKLGMRFVDYEWIMAREPSATTKMDQTGEEEETQQEPAHQWNPFECLMTQKMDAILHLHQKHQANVHNSLENITTRLKNIETRLSLSNLLNPDEDEA

SEQ ID NO: 165512 - protein, 352 aa, Glycine max
  Coding DNA Sequence Number=SeqID_48734
  Homolog annotation: Hit_ID=Q1RSC2; Match level="QueryCoverage=19%, HitCoverage=12%, E-value=1e-08, Identity=56%"; Hit description =Pentatricopeptide repeat
MKKKKKEMTTHKQRGNNGEGWRRGSRGLTTTSATEKMIWNLEPELERHRLRPRSTDLESISSNLRDYRPWRRYVACDRRWRRIRYAIVAYEVGDLEAVAGRVRRRTQAKQNSRGGGGEGVEEEVVLLKPNTAGVGPGLTVALSTSQKPVMGGLWWRGTGIRDSDWAAVRAQRSLRRNNCREKDLPNSLENSPETPPVIQLNQIFGSFVKLNCYPTAIPISKPCYTSILINGLEREIAVEWCFNDKLLDLVFILACFRVLCFAGWRSNSYEASIPDTTRSRDTYRGQLANMITYSSILDAFCKNDHPKAIGLFKKTKDQGVQNRLCTHPRYLWMDCAKWKTSECKNDFSGSTD

SEQ ID NO: 165513 - protein, 86 aa, Glycine max
  Coding DNA Sequence Number=SeqID_48735
MEVGKIAAKFGGGSEKEAFHQIDLRFMLLRGTQILREDMEDVSNPTSGATHGSSNKKSFKTKFMQEQKDRMKDAPPECPAGVLFPK

SEQ ID NO: 165514 - protein, 224 aa, Glycine max
  Coding DNA Sequence Number=SeqID_48736
  Homolog annotation: Hit_ID=Q40538; Match level="QueryCoverage=16%, HitCoverage=64%, E-value=2e-07, Identity=86%"; Hit description =Nicotiana tabacum (clone 5) activating factor DNA sequence
MEESNRENNKDHISQSRGSALDGSALGGEEHIGEWRNPIGKMTKITFPSQEGSALGGEEHIGEWRNPIGKITNITFPTDPLDWDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 165515 - protein, 510 aa, Glycine max
  Coding DNA Sequence Number=SeqID_48737
  Gene Ontology: Mol. function=transcription factor activity; Cellular component=nucleus; Biological process=regulation of transcription, DNA-dependent
  Homolog annotation: Hit_ID=Q9FR97; Match level="QueryCoverage=93%, HitCoverage=87%, E-value=3e-77, Identity=38%"; Hit description=MYB65
  Pfam annotation: Domain name=Myb_DNA-bind_2; Domain location=37-90; Score=-2.9; E_value=0.021; Accession=PF08914.1; Description=Rap1 Myb domain
  Pfam annotation: Domain name=Myb_DNA-binding; Domain location=35-82; Score=51.3; E_value=3.3e-12; Accession=PF00249.21; Description=Myb -like DNA-binding domain
  Pfam annotation: Domain name=Myb_DNA-binding; Domain location=88-133; Score=40.7; E_value=4.9e-09; Accession=PF00249.21; Description=Myb -like DNA-binding domain
  Pfam module annotation: Pfam domain module=Myb_DNA-bind_2::Myb_DNA -binding::Myb_DNA-binding; Domain location=37-90::35-82::88-133
MSQMTNEINYNVHCNDQTGSQLNDEGNGVGMVLKKGPWTAAEDVLLVNYVQKHGEGNWNAVQKYSGLSRCGKSCRLRWANHLRPNLKKGAFTAEEERMIAELHAKMGNKWARMAAHLHGRTDNEIKNYWNTRMKRRQRAGLPLYPPEVLLQAFQERKHGQGTGEISNGDGGHHDFLKKNNYEIHDAIFDSLKENQGILPFLPDLPAISANSFLPNCLGSPPYCNFLPSTLPNHDHFQESTMSFIGSSELNSNEFYPFDRIKDNNSDKISESFGLYSPLDRGASSHGSICYSHSLSNGNSSTSKLISEAAKSELPSLQIPETEFGCWGTSPPPPLNESLDVFIHSPQPPNALDSGSSPLNSGLLDALLYQANTLGCSKNNSSDKSLNSSIATPGDRAESSALNMYETEWEDYADPLSPFGATSILNEHPVVSTNGNSWDDWELFQTFSGNNERLQSVDQVWAPKSGNQSMSLLNLTLPDVLITSDWHELYSDHDSMNQAVMTEASDDISGQ

SEQ ID NO: 165516 - protein, 89 aa, Glycine max
  Coding DNA Sequence Number=SeqID_48738
MAQRRMNSDSYGRVTVGFLYERVKGILTLSPTLLGALAKTLGAPKQRPSMIGLERISKSKNPRSYPNSLDLQFFNPIRTNDPNQSRFFN

SEQ ID NO: 165517 - protein, 335 aa, Glycine max
  Coding DNA Sequence Number=SeqID_48739
  Gene Ontology: Mol. function=metal ion binding; Cellular component =integral to membrane; Biological process=ubiquitin cycle
  Homolog annotation: Hit_ID=Q8H740; Match level="QueryCoverage=73%, HitCoverage=83%, E-value=3e-57, Identity=51%"; Hit description=RING -H2 protein
  Pfam annotation: Domain name=PHD; Domain location=121-166; Score= -1.3; E_value=0.077; Accession=PF00628.19; Description=PHD-finger
  Pfam annotation: Domain name=zf-C3HC4; Domain location=122-163; Score= 26.9; E_value=7e-05; Accession=PF00097.15; Description=Zinc finger, C3HC4 type (RING finger)
  Pfam module annotation: Pfam domain module=PHD::zf-C3HC4; Domain location=121-166::122-163
  Subcellular localization annotation: CTP_CleavageSite=77; ConfidenceScore=5.63e-01
MASTSDSVPSFTAVGYTRTDATSPPNNHHLSSLSHVTLITVTVLAVAVTVSLALYFLLRYRNSNRFRFLRRVSPSTSAAAFSSSGNRILPETTSSSSVFDLLPTFTFSSITRRADAAGGGDCAVCLSKFEQNDLLRLLPLCCHAFHAECIDTWLRSKLTCPLCRSTVAASESDLAMVFRSSSVAGSDSFRLEIGNISSRREGDITAVAGETRGRSYSVGAFEYLIDEEAEVEVEVAFGLADRRIVSGEKNDGAPVVAPADSLAGEVGRGGGSRNGNGWLKDYVDRLSNTVSFRSSGSFFTGSSRRSDVVLGGDYDVEASRFGDEIGEMFRWLSGV

SEQ ID NO: 165518 - protein, 120 aa, Glycine max
  Coding DNA Sequence Number=SeqID_48740
MAGPMTCGGTIWSRTFFTFCHLEMAGPMTCGGTIWSRTFFHLLSSRDGGSDDMRGNLMHAETNIIFCTFGHPGIASQVAGGDTLWSSAPFIDRGKRIRQYQDDVGRSINGISYLKKGGLN

SEQ ID NO: 165519 - protein, 130 aa, Glycine max
  Coding DNA Sequence Number=SeqID_48741
MVGWELKITIFNKALLAKWKWNLFHNKGSLSDLKSTCGGDQDPWFDNLVELMAGNGAKTKFWKHSWMEKSGLSGKGLVEEFYAILDQARVSGEGVDEWLWKRDGEGISHSEGGIFTVGCLFMKGHYEQTS

SEQ ID NO: 165520 - protein, 177 aa, Glycine max
  Coding DNA Sequence Number=SeqID_48742
  Gene Ontology: Mol. function=RNA-directed DNA polymerase activity; Biological process=RNA-dependent DNA replication
MQNLFLPQGVCDAIDRISRQFIWGSPPSHWVDWNTISLPRSNGGLGIRPTREASVALHGKHVWSVIHDPTKLWVQIQKDKYLKGDWIFHHRDYAGCFYTWTSIKKLAMILQPGFSYRIGQGFVSMCHGMLKLNTNGSSRDNLGIPGIGGIIRDSNGSWVKTNLCAELLAILKGLQMA

SEQ ID NO: 165521 - protein, 163 aa, Glycine max
  Coding DNA Sequence Number=SeqID_48743
  Gene Ontology: Mol. function=DNA binding; Biological process=DNA integration
  Homolog annotation: Hit_ID=Q1SKC8; Match level="QueryCoverage=53%, HitCoverage=20%, E-value=2e-23, Identity=58%"; Hit description =Integrase, catalytic region
MNTYESSKIYKQKIKAYHDKKLQRQNFQPGQQVLLFNSKLGLFLGNLKSKWLGPFVIKEVRTHGVEELVDPTAGTLEKRWIVNGQCLKIYKWRPIRNINKHWCRKQWMLGLRHASGETGTKRDTLAKRAGTNLLSLTSGLARMSNLDEKGVVWDELAKHDTAH

SEQ ID NO: 165522 - protein, 128 aa, Glycine max
  Coding DNA Sequence Number=SeqID_48744
  Gene Ontology: Mol. function=ATPase activity, coupled to transmembrane movement of substances; Cellular component=integral to membrane; Biological process=transport
  Homolog annotation: Hit_ID=Q1SEN8; Match level="QueryCoverage=99%, HitCoverage=58%, E-value=1e-45, Identity=58%"; Hit description =Cyclic peptide transporter
MAANGVSRSSSFTPDLSKAKSTTASIVGFMDKKSKMDPIDESSSTLDRVEGEIELQHVSFKYPFRPNIKISQDLNLAIHVGKMVALVGESGSGKSTMNALLQRFCNPDSRQMTLDGMEIRELQFKWLR

SEQ ID NO: 165523 - protein, 65 aa, Glycine max
  Coding DNA Sequence Number=SeqID_48745
MTIYRKRPFGVGEARSGELELAQAYKVPENVHFAPFLVPFVFGSNNQTLILSDPSTLRYNRCQTP

SEQ ID NO: 165524 - protein, 108 aa, Glycine max
  Coding DNA Sequence Number=SeqID_48746
MSYRMSRHHASEHADYIWEYEQIKQVNNTRELLTQFGATSPTSGGYQAREEIHQNSVSSSIFGQDVLDIVSDIVDPAASMLLATSVFSGRMSWTLYPTSWILQLQFFI

SEQ ID NO: 165525 - protein, 150 aa, Glycine max
  Coding DNA Sequence Number=SeqID_48747
MTNEKVENIGKGKYGVIYKGRDRVSNETIALKKIQRGCYPNANVSDSSSGDAAMVEKHGYTLNWSLEDAQLYKRILMDRVAMGVCMILYLFWHKKTSMLLPTWKTFMRIPEAIRWLWCAGFTKLMRLSWRVSYFISLTFEYKHFMEEFLS

SEQ ID NO: 165526 - protein, 66 aa, Glycine max
  Coding DNA Sequence Number=SeqID_48748
MDDVALSCSNVRIWGRSSKMWDVRIFRIRVLGRDVLDCADISKIAIVTNVGKGGKRFGMVDFPSSP

SEQ ID NO: 165527 - protein, 151 aa, Glycine max
  Coding DNA Sequence Number=SeqID_48749
  Subcellular localization annotation: CTP_CleavageSite=35; ConfidenceScore=5.15e-01
MSWIPLFRKILLLLIKSLSTAALPTRNPHLLFETRASRAMASDGRSFFPLLGLSEDIGEREEIGIAVDLKKLLVDLSLLPSRGSSRMPIGTGKWKARPDTLNPFCLVLFKLLLAPALSIADARTNISLTAPSRAVRAPSAVRFYAYPLFKD

SEQ ID NO: 165528 - protein, 215 aa, Glycine max
  Coding DNA Sequence Number=SeqID_48750
MERKIEFRLRNESERFELYRLRDRDRRDSSKTERRADLPIILSPFPKGKCRHQRGPVQCLPFYLSPPHSLGLSVKVGKKALTLNSNSSSGKQITVTSESFGLNSESEPKRELKERASSYPLKSLHSLILSRREGWHKSCEFSCCVYAYSDNRFIGHWMRANRKEESHKGKTIPHRRNGNTPLTSKLKLRTFEFPGDKQIGVELDPLHLLLVIMGP

SEQ ID NO: 165529 - protein, 183 aa, Glycine max
  Coding DNA Sequence Number=SeqID_48751
MTTLTQTWMTLLLSNILPSDHNSDLPLPKCMPPIRHPLDPDKSNRALGFPALITSLCQSFRVPITPSKAPDAPPPPPQADPVGSFDTERYLRHLVRQQAANHRAHVQTHDCLYQLSLSLQSQGFPPFPCPTPDQFRAEVAWPGDWPEAQAREAPAEAPGDADKARMDEEITDLLDFLGGSGAT

SEQ ID NO: 165530 - protein, 123 aa, Glycine max
  Coding DNA Sequence Number=SeqID_48752
MQALTSHVEKLFDKSLKKSMYIWIKWRVKVNRQVTPRRDDHERGWSQYQEDDYEEEQQMRTIPNQSNQRSYSKGKKVKLAALEITNYALVWWDQMKKETLRMFCNNLGRDENNYEETITILEK

SEQ ID NO: 165531 - protein, 70 aa, Glycine max
  Coding DNA Sequence Number=SeqID_48753
MLLIIPSTSLVPIPNIYVFIRTSMRCYCSKGYLQETVMAHGFIKGTKVFTMVMHGGSLVASGAGFSQQWW

SEQ ID NO: 165532 - protein, 83 aa, Glycine max
  Coding DNA Sequence Number=SeqID_48754
MSLRGDAISQAGANKAVRPPTGLGMRRPFLRKETGEIKSYAIDRPFRSDFESIVLYFFLILAARPTEVLKAFEAYTSLLHDKK

SEQ ID NO: 165533 - protein, 64 aa, Glycine max
  Coding DNA Sequence Number=SeqID_48755
MKREMLDSTGNDGSTTPNHKLFTTVLYYTVTGPHDMNGCLRKRPKASKGRLLSSQDTDYRDPNF

SEQ ID NO: 165534 - protein, 116 aa, Glycine max
  Coding DNA Sequence Number=SeqID_48756
MAGNNPYGLVGIIRIKVQSTCWVKDFFVAKCYGLNAELLTLLVRMGVHPKVFPDRMHTYRLSSARAEECPHEFVEVSTQPEQKTDSGEESKIGHWIRLRSEKASGIGTDVVRPVAY

SEQ ID NO: 165535 - protein, 184 aa, Glycine max
  Coding DNA Sequence Number=SeqID_48757
MSMEAHFKKLLAYEHELIQQSHAKDIEKKRKAIALKASFSKEDHKKDSSDDEDVENLNLIVKKFGKFLKRKWKPTTPSYALNVRAHQAELSVYLKKHIVVKKGKKDGKPKKSYIAWENNASISSNSSSEEEIANVCLMDDSTDDSSTIEEIEVDSEFEEVKEAFNEMNEEAQKPIVLTISLEAI

SEQ ID NO: 165536 - protein, 125 aa, Glycine max
  Coding DNA Sequence Number=SeqID_48758
MVISRLSANPIMDPSLKSIKGSLYSEWEESKEFSDCVVLNSLTREKGDTKEFMRLVLPSFGKGRREAQKEFRRLVLGEFFLAKGEENEKDEWHKFSRFRKPENFRKLLVQRRRRSSKRLKACKGL

SEQ ID NO: 165537 - protein, 101 aa, Glycine max
  Coding DNA Sequence Number=SeqID_48759
MNNQVHQDDKKKAKYVWQLHEKVKQEIEKRTQQYAKQKINDNAYKLDLPSEYQVSATFNVTGISLFGVNHEFDSRKNHFEKEEKDGKHDRSNNLKEPWQGI

SEQ ID NO: 165538 - protein, 51 aa, Glycine max
  Coding DNA Sequence Number=SeqID_48760
MGCLLENLEHKDEYPKKNPGNNGMKKKGKWQWQPKVTTIAESRDLTIEYEI

SEQ ID NO: 165539 - protein, 345 aa, Glycine max
  Coding DNA Sequence Number=SeqID_48761
  Gene Ontology: Mol. function=heat shock protein binding; Cellular component=integral to membrane; Biological process=protein folding
  Homolog annotation: Hit_ID=Q0WT48; Match level="QueryCoverage=99%, HitCoverage=49%, E-value=1e-151, Identity=78%"; Hit description =Putative DnaJ protein
  Pfam annotation: Domain name=DnaJ; Domain location=99-161; Score =88.8; E_value=1.7e-23; Accession=PF00226.21; Description=DnaJ domain
MAASEENSALFPIFILTIMAIPIVPYTITKLCRAASKKSKSIHCHCSECSRSGKYHKSIFKRISNVSTCSNFTLLLLWVVMIVLVYYIKTMSREIEIFDPFNILGLEPGAAESEIKKKYRRLSIQYHPDKNPDPEAHKYFVEYIAKAYQALTDPIARENYEKYGHPDGRQGFQMGIALPQFLLNIDGASGGILLLWIVGVCILLPLVIAVVYLSRSSKYTGNYVMHQTLSTYYYLMKPSLAPSKVMDVFIKAAEYMEIPVRRTDDEPLQKLFMLVRSELNLDLKNIKQEQAKFWKQHPALVKTELLVQAQLTRELAALSPSLQSDFRRILETAPRLLEELIKVTN

SEQ ID NO: 165540 - protein, 325 aa, Glycine max
  Coding DNA Sequence Number=SeqID_48762
MAMDFNNQEMAEGDEFVEPPSVDECCPMLGVVTSTSVSELQVDVACQAPSLDKYWLPTFVKLFMMDMSLVCQSALTTGRNICLLLQPCAAHTQYSCIRVIRRVGTYWSSGLAWVGERRGVKWSGRTSSYKMSSFLSDSTIEDTSRGASDSELSSSEREGTTFHYCRGAYPGYCDTPPLCFWGVRRGSGSGDVRASPCVRCSRSVGSLSSTPSVTGYEWVRDDVLKYKFSFTSAVSVAMLQRQVKLANLEDSYNLVIQACESDVFLFLRATPSHMVLATGVVADGMPLMFNRDKEPCFLFYWQSDPTSDPFTALDGKVPNLVLVYV

SEQ ID NO: 165541 - protein, 431 aa, Glycine max
  Coding DNA Sequence Number=SeqID_48763
  Homolog annotation: Hit_ID=Q9M5V7; Match level="QueryCoverage=25%, HitCoverage=99%, E-value=7e-42, Identity=83%"; Hit description =Disease resistance-like protein
  Pfam annotation: Domain name=NACHT; Domain location=3-144; Score= -19.4; E_value=0.0019; Accession=PF05729.3; Description=NACHT domain
  Pfam annotation: Domain name=NB-ARC; Domain location=1-240; Score= -112.5; E_value=0.0041; Accession=PF00931.13; Description=NB-ARC domain
  Pfam annotation: Domain name=zf-CCHC; Domain location=368-385; Score =11.5; E_value=0.013; Accession=PF00098.13; Description=Zinc knuckle
  Pfam module annotation: Pfam domain module=NACHT::NB-ARC::zf-CCHC; Domain location=3-144::1-240::368-385
MGGIGKTILAEKVFIKLRSEYDDCLFLANEREQSRKHGIISLKEKVFSELLGNVVKIDTPNSLPNDIVRIGRMKVLIVLDDVNDSNHLEKLLRTLDNFGSDSRIIVTTRDKQILEANKADEIYLLREFSFNQALELFNLNAFNQCHDQREYDNLSKAMSSKNGSHGRLWDPDDIHEEMKNDKVHRLQHSVVSPLIPPKNLTQEYADMDKENPAYAAWEYQDQSLLVWLQSSLSEAILSKVVGCVHAHQVWENIDNHFHAKTKEKSRYLHMELRNTRKGEHSIGEFLTRIKTIVDSLLAIGQTISIQEQIDVILEGGGDRSGYGYRGDKNYGNNDNRNYGNNENKNFENGDHKNYGNAGNYGNTDRYKIQCQVCYKFGHNAIDCYHKFNPNYVAHQYNQDQSWNQHKNYSYQRSNSKDQDNNSQSQQNAQAP

SEQ ID NO: 165542 - protein, 400 aa, Glycine max
  Coding DNA Sequence Number=SeqID_48764
  Gene Ontology: Mol. function=acyl-CoA binding
  Homolog annotation: Hit_ID=Q015I1; Match level="QueryCoverage=83%, HitCoverage=73%, E-value=2e-24, Identity=39%"; Hit description=[I] KOG0817 Acyl-CoA-binding protein
MSPSSEHHGGNHRFPGEEINGFGNGQAEMSAPSTASSSAVRCIVDSIPSKEREKLRRILVASAKGFSIGAGLKGGLALFAILARLTRKKPPRKGIVVSNGEAIVAALKETLRYGLFLGTFAGTFVSTDEVIGALAVLWTRNGGGDWDFVLWLFRTAKWRALVAGAVAGLSMLLTGLEDQHTSLAIYILMRAAVLASRCGIKSKRFGKICKPLTWKHGDIFLMSCDFINIALSDLMASYSLRLLDDVDPGCFVQFMDKACLPYTILAKGLFGTARSSLFLSVYCASAWILKRCNIPMVAMGTFPTGLALAIEKKSRRIEISLYCLARAIESFFTCIADAGYLPQSRRIKRADVVVFSLSTAIIMHCYAEEREVFRSKYLNVLDWVFGVPPPPCETPRCKDG

SEQ ID NO: 165543 - protein, 102 aa, Glycine max
  Coding DNA Sequence Number=SeqID_48765
MRCSKNHHFLVNHALGKCKDHACKLWKHNACSWWNKSMLNEGMMCPLRCHEEMHDAIKEQARRYHPLRQYTVAIGTISDNASLKVENSRRGFTVIKQVGDPA

SEQ ID NO: 165544 - protein, 431 aa, Glycine max
  Coding DNA Sequence Number=SeqID_48766
MGLNQAHVFKERFIKSRSSMEVTNLQKLGQKMDPVTSLLCLYQHMIEINDLQKNQGLVTSMKECTLRCPYQTRARARVMSEVEEVQDQMKADMEAMKDQMAAMKDQMAAMMEVVLSMKKIMEGNAAVVTTTSVAIEVDPTHLSGLNQVNHPASDMVGQGGKLLRSMGGPHFVQVQNKHSFPQYGLPPNYTPLNVAHTPNEDDNNSASMPIESQHPQYDHAHVSQPIGETHEASRDHNLVDSEPCLEYFTEGQAFCGVPLPKSLEGPQYLPQPQPLPFVMGIVPLAMVEREKFNHIEERLRAIEGGGGHAFADMAELCLVPDVIIPPKFKVLDFDKYKGTTCPKNHLKIYNKKMGSYSKNEKLLMHFFQENLTGATVTWYANLEPSRVHSWKDLMVSFIRQYQYNSDMASNRMQLHNLCKKKHESFKEYAQR

SEQ ID NO: 165545 - protein, 45 aa, Glycine max
  Coding DNA Sequence Number=SeqID_48767
IEKLQLNNADLGDEGAKAIAEMLKENSSLRVLTEHLKFCSIPKKN

SEQ ID NO: 165546 - protein, 176 aa, Glycine max
  Coding DNA Sequence Number=SeqID_48768
  Gene Ontology: Mol. function=actin binding; Biological process=actin cytoskeleton organization and biogenesis
  Homolog annotation: Hit_ID=Q9SDN6; Match level="QueryCoverage=37%, HitCoverage=7%, E-value=1e-24, Identity=83%"; Hit description=FH protein NFH1
MAPTKEEESKLKEFQDESPFKLGLAEKFLKVVLDIPFAFKRVDAMLYIAKFDSELEYLKKSFETLEIDLSVSKELNVGNIFSLFGTIQEDFLFSYIYCVLNGNLLDKKRIEEDNPDNHIHASDRMKLMHHVGFVDTEDMNLTSGKRKFSSMVGYSSSKLAEARKDVESVGYYIDAG

SEQ ID NO: 165547 - protein, 105 aa, Glycine max
  Coding DNA Sequence Number=SeqID_48769
MGRVPPAMVEWGKFDHIEDRLRVIEGGGDYAFTDMTELCLVPDVVIPPNFKVSDFDKYKGTNLEPSRVHSWKYLMVSFISYRTCARRSMSHSKNTPKGGGIWQLK

SEQ ID NO: 165548 - protein, 96 aa, Glycine max
  Coding DNA Sequence Number=SeqID_48770
  Gene Ontology: Mol. function=zinc ion binding; Cellular component =integral to membrane
  Homolog annotation: Hit_ID=Q9M2V1; Match level="QueryCoverage=72%, HitCoverage=17%, E-value=9e-15, Identity=61%"; Hit description=RING finger-like protein
MKPLQGTTQMLIRGIDMWQSMFEVLDVAVSLAKVADVDRNLGDEKLATDGFQEAIDLLESLTLKSEASGLEQRRQSVIDFLRSQLPDKQEQAEATV

SEQ ID NO: 165549 - protein, 85 aa, Glycine max
  Coding DNA Sequence Number=SeqID_48771
MACWHPKVIQVLHGYFLGMVRDRIPLLRAIGYLEWSSVGTIAWIAEGDGHEADDSPYDIGLDNSLSVSHAGEWCEVMKKDWKGWL

SEQ ID NO: 165550 - protein, 170 aa, Glycine max
  Coding DNA Sequence Number=SeqID_48772
  Gene Ontology: Mol. function=electron carrier activity; Cellular component=membrane; Biological process=electron transport
  Homolog annotation: Hit_ID=Q2HWC7; Match level="QueryCoverage=97%, HitCoverage=96%, E-value=6e-45, Identity=54%"; Hit description=Blue (Type 1) copper domain
  Pfam annotation: Domain name=Cu_bind_like; Domain location=40-122; Score=55.1; E_value=2.3e-13; Accession=PF02298.8; Description =Plastocyanin-like domain
MENWRGARLMVVASVVAIGWLSLVVMGSPVLHKVGGSKGWINHDVNYTEWAAQEHVYVGDWLIFKFDRRYFNVLEVNKTSYENCIDRDFIKNITRGGRDVVQMTEARTYYYLSDGGYCFHGMKVAVQVQEYQDPALAMVAPAPSPVVSGSSVFTCIWIIVANVVLFVNLM

SEQ ID NO: 165551 - protein, 274 aa, Glycine max
  Coding DNA Sequence Number=SeqID_48773
  Homolog annotation: Hit_ID=Q1ST75; Match level="QueryCoverage=99%, HitCoverage=99%, E-value=2e-95, Identity=60%"; Hit description=Hus1 -like protein
  Pfam annotation: Domain name=Hus1; Domain location=1-273; Score= -97.3; E_value=0.0021; Accession=PF04005.3; Description=Hus1-like protein
MKFKAFVTDNGVQLLERRFLPALERTGKSCHLFLTRDHAMFLHLLNGDGVQCLAQFRKEALFHDYRISSQNDDRIAFALDLSLLLRALRSAVAVASSASASSAPTRLEIKLVKKLPPNSTQPMPYLTLETRGYKSAVIQDIPISKPLSRAQVTELQSALDTAQDLPQTLVQVGDVVNVFISKHGDLSVQVSTTLISLGAEFRRLVVIGEKTNAPAEDQNLSAQTRSSRSISRGDGQYVQGSCLTVIFQFFVPGSRQTDKSISLHCRLPVLDPGS

SEQ ID NO: 165552 - protein, 71 aa, Glycine max
  Coding DNA Sequence Number=SeqID_48774
  Subcellular localization annotation: CTP_CleavageSite=7; ConfidenceScore=5.13e-01
MAISTLSACLGQACLHFPALSFTFQNYPNVKRALFVEPVYHAKRLRRAKRAASHLEFASWALLCFSPPIIH

SEQ ID NO: 165553 - protein, 44 aa, Glycine max
  Coding DNA Sequence Number=SeqID_48775
MEYCSADSVDKSDELLNLAFGVLTPEFLNSLKTSGIPNHKLRIK

SEQ ID NO: 165554 - protein, 430 aa, Glycine max
  Coding DNA Sequence Number=SeqID_48776
  Gene Ontology: Mol. function=ubiquitin-protein ligase activity; Cellular component=ubiquitin ligase complex; Biological process =protein ubiquitination
  Homolog annotation: Hit_ID=Q9LF41; Match level="QueryCoverage=99%, HitCoverage=44%, E-value=0.0, Identity=79%"; Hit description =Ubiquitin-fusion degradation protein-like
  Pfam annotation: Domain name=U-box; Domain location=333-407; Score =156.0; E_value=9.7e-44; Accession=PF04564.6; Description=U-box domain
MPLPPTCPMEFSTMPEHFVEDAMELLIFASRIPKALDGVVLDEFMNFIIMFMASPEFIKNPYLRAKMVEVLNCWMPRRSGSTATATLFEGHQLSLEYLVRNLLKLYVDIEFTGSHTQFYDKFNIRHNIAELLEYLWQVPSHRNAWRQIAKEEEKGVYLNFLNFLINDSIYLLDESLNKILELKELEAEMSNTVEWERRPVQERQERTRLFHSQENIIRIDMKLANEDVSMLAFTSEQITAPFLLPEMVERVASMLNYFLLQLVGPQRKSLSLKDPEKYEFRPKHLLKQLFSAGADVLHRIGEDGRIIQEFIQLGAKAKVAASEAMDTEATLGEIPDEFLDPIQYTLMKDPVILPSSRITVDRPVIQRHLLSDSTDPFNRSHLTADMLIPDDELKARIEEFVRSQEMKKHLSLQSTKATIQTTNGETMLID

SEQ ID NO: 165555 - protein, 101 aa, Glycine max
  Coding DNA Sequence Number=SeqID_48777
MAVRGKCRHNIDDENQCATILLDGCMTILEHLENERVRMVGDPPLISSALIDANFVVERNQFYHLRMDTDDDINNGKEVVVQREEEEDTIIGVCRNNVNRV

SEQ ID NO: 165556 - protein, 266 aa, Glycine max
  Coding DNA Sequence Number=SeqID_48778
  Gene Ontology: Mol. function=zinc ion binding; Cellular component =integral to membrane
  Homolog annotation: Hit_ID=Q10Q37; Match level="QueryCoverage=86%, HitCoverage=87%, E-value=3e-73, Identity=60%"; Hit description=RING zinc finger protein, putative, expressed
  Pfam annotation: Domain name=zf-C3HC4; Domain location=44-98; Score =6.1; E_value=0.037; Accession=PF00097.15; Description=Zinc finger, C3HC4 type (RING finger)
MWNFASNCIAGTVGLKNDSKPTHSASECSDDENSVIGREEGLECPICWESFNIVENVPYVLWCGHTLCKNCILGLQWAVVKFPTLPVQLPLFISCPWCNLLSFRLVYRGNLKFPRKNYFLLWMVESMNGDRGKSHSPFCGDNQQHSIKDNLTMGSQVSHGNLRRGLVRHPETSSSNQYHGNTGNHLNTERFHVYLRKSLIFFVQLTAKFPLVIIFLLIVLYAIPASAAILALKSDTLFKKCMSHTYWADIKEFGKGIVALVWMTVT

SEQ ID NO: 165557 - protein, 646 aa, Glycine max
  Coding DNA Sequence Number=SeqID_48779
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q01H71; Match level="QueryCoverage=58%, HitCoverage=79%, E-value=5e-77, Identity=40%"; Hit description =Homology to unknown gene
  Subcellular localization annotation: CTP_CleavageSite=66; ConfidenceScore=5.45e-01
MVVTKQGLFHQKMVAPIAVSSPKSTLLQNPIYFGDLSSSFVGGSLKCLCFNLKPRPQRRELTNLVVASATPSVTNSNASGRFYFNFTGFPFPLGPFLNRRSIRTEAVKGCIWLFEQEQALGFSSVSTNIRMTVIKLKSGGLWIHAPIAPTDECIQLIKELGAPVEYIVLPTFAYEHKVFVGPFSRKFPRAQVWVAPRQWSWPLNLPLEFFGIFRAKTLKDENLSVPWAGEIEQKILSSPEVGIGPYVEVAFYHKPSKTLLVTDAVIFVPRQPPECISKESLLASAKNGLAVKLLSKGKKVPDEPVVDDKRNRQKGWKRMVLQILFLGPSNLLEPNASFDQMSQKLIVSPIVKTLVFSKVPEKVREWVDSILRDWRFKRIIPAHFAAPINASRSDFRAAFAFLDEFLGESNAAWPSLSLLFSSIMGKAASYFPPDDMRTLSSLDQFLVSVGAVKKTVSGRKRFLESNQKRPTLDGVAFNQVSREETLCLKTSFIEGEVRDAIWECDSSKSPDPDGFNFKFIKAFWEVMKHDIMRFLHEFHANSRLTKGCNPSFVTLIPKFDDPEQLEDFRPISLVGCMYKILTKILSWRIKPVLARVIDDCQSAFLEGRQLLHSVLVVNETLDEVKRIVKQCILFKVDYGKAYDSVS

SEQ ID NO: 165558 - protein, 604 aa, Glycine max
  Coding DNA Sequence Number=SeqID_48780
  Homolog annotation: Hit_ID=Q10Q34; Match level="QueryCoverage=94%, HitCoverage=94%, E-value=1e-26, Identity=33%"; Hit description =Expressed protein
  Pfam annotation: Domain name=CaM_binding; Domain location=479-592; Score=127.6; E_value=3.5e-35; Accession=PF07839.2; Description=Plant calmodulin-binding domain
MANESGELPVTPEVTESPGVEIRGHSDGKASSGTSVEKVVPNYLRASTGSCHDFCKYGRKHAFDSKERCSIPNRATRKQLHHSSEGSVGGTMMSFARLSASVDSTKPTKMSTVKLKQSVDSKTWISDTSETYKRELPTKSFDSQKETGNEVLVNRNKSSLAKVKPSLLPKSHTSPSARQEISSIKEVRSPSNSTSIKVGTPSKSTSRKVEAPPKSTANKMEAPLKSTSNKVGNPSKSTSKVKASSKRTTNMVKTSSQLSSLKGKEMKLSEKHVNSLNSSSVRRKQISSMNSSEGVGGQRYSKIKTEKEVTSSNSKAASKKLMAPSKALLTPRPSLIRVASINSRKHKSLKIASHLKNQRSARKVEHEEHNNNEVEEKTLYVIKMGSENKTSLSDQNASYDDESYLPQLSSPKSSVSSISKSLSQEDQEESEYTTSEFEQDSFSGNHETECIENEETLAAEKKGKPKKGGVVYSKDNDNQMIKLKFRRGKVVENQTEISSPRRLKFRRARVPREKANVNSNVRKSFERNVACDNSNDATTGPEKVVLRHQDMQEKKDAQGLLNNVIEETASKLVEARKSKVKALVGAFETVISLHEKKPSADTVS

SEQ ID NO: 165559 - protein, 142 aa, Glycine max
  Coding DNA Sequence Number=SeqID_48781
  Homolog annotation: Hit_ID=Q1SS44; Match level="QueryCoverage=73%, HitCoverage=45%, E-value=4e-19, Identity=46%"; Hit description =Cyclin-like F-box
MTVVSKLSSLSMRGTNPKLLSDDIIVDPIDLDSEQGTDHPGCFRFSVGCDNTILREVVEEVRMVWNVVLRGWRGVFTMMEHVGKVGFVPDGEGWFSQELPMSGCCSGAVVVDLKVGMCEADGENVNQIRVNEVSVGILSIVD

SEQ ID NO: 165560 - protein, 60 aa, Glycine max
  Coding DNA Sequence Number=SeqID_48782
MTEKLLRAEMKVARHSLLGRAVLEQGSKTWAGPKTISIVGCTGSIGTQGVALAPTYPQVR

SEQ ID NO: 165561 - protein, 183 aa, Glycine max
  Coding DNA Sequence Number=SeqID_48783
MSPQDLKNDWIRLHNPATLSSEGSIKIAVSLNFAVQKYQQNKKIKYRERLEREMAKNILSTSNPILLPSSSPSSSSSSFVKPIHVCSNPIIKSTSKRELTLCKATPHSPIVVTKRGLSISFITSFVLSLAGKKNANAAILEADDDEELLEKVKRDRKKRLEKQGVISSSKQETGLRVCTLKRL

SEQ ID NO: 165562 - protein, 102 aa, Glycine max
  Coding DNA Sequence Number=SeqID_48784
  Homolog annotation: Hit_ID=Q8VY01; Match level="QueryCoverage=49%, HitCoverage=13%, E-value=5e-07, Identity=44%"; Hit description =Putative serine carboxypeptidase II
MVTNNIIRCGDDDANRKRKRPYSKNHINEGVVCEDTECLKPIVVHIARENLVFLQQWFTKFPEHSKIGFFITRENYGGHHYAQTKSKFNLKGIAMSSREGKI

SEQ ID NO: 165563 - protein, 61 aa, Glycine max
  Coding DNA Sequence Number=SeqID_48785
MGQFGPQKAQNNTHSKQQKCRERETGLEEEDPRNVRNSTKACKRKVLYTSGHALSSNNLGE

SEQ ID NO: 165564 - protein, 135 aa, Glycine max
  Coding DNA Sequence Number=SeqID_48786
  Gene Ontology: Mol. function=oxidoreductase activity; Cellular component=intracellular; Biological process=metabolic process
  Homolog annotation: Hit_ID=Q9D7B1; Match level="QueryCoverage=70%, HitCoverage=19%, E-value=7e-25, Identity=60%"; Hit description=tRNA -dihydrouridine synthase 2-like
MEYRNKLVLAPMVRVGTLPFRLLAAQYGADITYSEEIIYHRMLKCDHQINELIGSTDFVEKGTKNVVFRTCDEEKDTVVFQIGTSNALRALATAQLVQTKDQADVLMMPKDHMRLKALFKTKQLKIFKIDDQDSL

SEQ ID NO: 165565 - protein, 147 aa, Glycine max
  Coding DNA Sequence Number=SeqID_48787
MNDTIIWDASANGAYSTELAYKWITEAYFTRNNLLDVESLVWQLPLPENVKLCPSHNDFLVHRFVSFDHSCNKCGSSNETTWIVSKLEQFGVHFNSLYPMMIPWWMFLLAPSRACRPWIFFINRVLCFLKINGNKMEKDESRTSSPP

SEQ ID NO: 165566 - protein, 115 aa, Glycine max
  Coding DNA Sequence Number=SeqID_48788
MTISLKILKQHVQGSSTAITWLKSWRDPLTSVKIKLRVENGGHLPKLDGKRVQEHLVKLGRRRKIWSPFSPEALAKWDNWPRLWLLKTTLILGQPLRCSPRAQPCLIWLLALFQN

SEQ ID NO: 165567 - protein, 147 aa, Glycine max
  Coding DNA Sequence Number=SeqID_48789
  Subcellular localization annotation: CTP_CleavageSite=65; ConfidenceScore=5.17e-01
MHSNQNQFIHQFSQKDKSVSLQYHQNQVKLFHMLQNKHTNKSQKRSTESEHPPHLSNGETRESVRATTSPDEESERLAAPPTGESGGSAASPAGESGGAVVSPYGESEMIIRGGDGGAASSSGKEDGFTTGDCGSAGTSSTRAGVGS

SEQ ID NO: 165568 - protein, 277 aa, Glycine max
  Coding DNA Sequence Number=SeqID_48790
  Gene Ontology: Mol. function=DNA binding; Biological process =regulation of transcription, DNA-dependent
  Homolog annotation: Hit_ID=Q1SCZ2; Match level="QueryCoverage=82%, HitCoverage=46%, E-value=4e-37, Identity=35%"; Hit description =Transcriptional factor B3
  Pfam annotation: Domain name=B3; Domain location=15-110; Score=34.3; E_value=4.1e-07; Accession=PF02362.12; Description=B3 DNA binding domain
MTSSHNKHPLPTAVHFFKIILRTSLAHGILKLPKDFTTKYGDSMSNLVFLNPPDGIEWKICWTKLDGKIWFEKGWKEYATYYSLDHGHLLLFQYQGTSHFDVHIFDNSAIEVDYPSSPGTRDGKERHVEISDDSVEILDAQFSCQKTRVKSTVPSPQPSKEMKFGPTTNVERSPRVNLHQHVQTGKEEGKGIFNTECPKVEQLTSTTLKKATTFRLVMKPSFINGEYLLIQSFAFKVQRDQVSPFHKPIQLEWERFQNEVKEDILKRNLGTKNTEKG

SEQ ID NO: 165569 - protein, 784 aa, Glycine max
  Coding DNA Sequence Number=SeqID_48791
  Gene Ontology: Mol. function=nucleoside-triphosphatase activity; Cellular component=mitochondrion; Biological process=protein metabolic process
  Homolog annotation: Hit_ID=Q4LDR0; Match level="QueryCoverage=100%, HitCoverage=80%, E-value=0.0, Identity=83%"; Hit description=Heat shock protein
  Pfam annotation: Domain name=AAA; Domain location=283-477; Score =53.4; E_value=7.5e-13; Accession=PF00004.19; Description=ATPase family associated with various cellular activities (AAA)
  Pfam annotation: Domain name=AAA_2; Domain location=682-784; Score =187.2; E_value=4e-53; Accession=PF07724.4; Description=ATPase family associated with various
  Pfam annotation: Domain name=AAA_5; Domain location=283-423; Score =5.9; E_value=0.00064; Accession=PF07728.4; Description=ATPase family associated with various
  Pfam annotation: Domain name=Clp_N; Domain location=176-227; Score =43.3; E_value=8.5e-10; Accession=PF02861.11; Description=Clp amino terminal domain
  Pfam annotation: Domain name=Clp_N; Domain location=99-151; Score =65.6; E_value=1.6e-16; Accession=PF02861.11; Description=Clp amino terminal domain
  Pfam module annotation: Pfam domain module=AAA::AAA_2::AAA_5::Clp _N::Clp_N; Domain location=283-477::682-784::283-423::176-227::99-151
  Subcellular localization annotation: CTP_CleavageSite=74; ConfidenceScore=5.79e-01
MASATSFLGLGLRPSVPICANRNNGIRFSQFQVSFGFRENSTSLKTLNSTPLKKREAFSNGSSRTRRNPLFSVRCTVSSSGKITQQEFTEMAWQAIISAPEVAKENKHQIVETEHLMKALLEQKNGLARRIFSKVGVDNTRLLEATDKHIQRQPKVVGESAGSMLGRDLEALIQRARDFKKEYGDSFVSVEHFVLGFAQDKRFGKILFRDFQISQQALKSAIESIRGRQSVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESDGQTILFIDEIHTVVGAGASNGAMDAGNLLKPMLGRGELRCIGATTLDEYRKYIEKDPALERRFQQVYVDQPSVEDTISILRGLRERYELHHGVRISDSALVDAAILSDRYISGRFLPDKAIDLVDEAAAKLKMEITSKPTALDEINRSVLKLEMERLSLMNDTDKASKDRLNRLETELSLLKEKQDELTGQWEHEKSVMTNLQSIKEEIDRVNLEIQQAEREYDLNRAAELKYGSLNSLQRQLESAEKELHEYMNSGKSMLREEVTGNDIADIVSKWTGIPISKLQQSDREKLLYLEEELHKRVVGQDPAVKAVAEAIQRSRAGLSDPHRPIASFMFMGPTGVGKTELAKALASYLFNTEEALVRIDMSEYMEKHTVSRLIGAPPGYVGYEEGGQLTETVRRRPYAVILFDEIEKAHSDVFNVFLQILDDGR

SEQ ID NO: 165570 - protein, 127 aa, Glycine max
  Coding DNA Sequence Number=SeqID_48792
MAISGYMLIPVKAIASSIITCWVAKAQVNKIWKIIDNVNGSAIGRFKMVLFDSQLFMCQHFNSIWCSEFMNEEYEKCFEIVNIMLKITRTSKEILNTVNAKDHTYGEVSKSFAHEVKGHASTLLAFG

SEQ ID NO: 165571 - protein, 111 aa, Glycine max
  Coding DNA Sequence Number=SeqID_48793
  Gene Ontology: Mol. function=DNA binding; Biological process=DNA integration
  Homolog annotation: Hit_ID=Q0ZCD2; Match level="QueryCoverage=85%, HitCoverage=13%, E-value=2e-26, Identity=58%"; Hit description =Integrase
MSPYRVVFGKVCHLLVEIEHRAYWAVKGCNMAFDEAGMERKIQFQELKEIRLEAYGNSKIYKERVKRFHNSMIHRKEFHIDQKVFLFNSRLKLIYGFMLDVNHGCNCGSDR

SEQ ID NO: 165572 - protein, 204 aa, Glycine max
  Coding DNA Sequence Number=SeqID_48794
  Gene Ontology: Mol. function=transferase activity, transferring hexosyl groups; Cellular component=integral to membrane; Biological process=carbohydrate biosynthetic process
  Homolog annotation: Hit_ID=Q10Q30; Match level="QueryCoverage=97%, HitCoverage=34%, E-value=3e-84, Identity=68%"; Hit description =Glycosyl transferase family 8 protein, expressed
  Pfam annotation: Domain name=Glyco_transf_8; Domain location=1-177; Score=135.0; E_value=2.1e-37; Accession=PF01501.10; Description =Glycosyl transferase family 8
MQNYVELFQLFPNLDKVVFLDDDVVVQRDLSPLWEIDMNGKVNGAVETCRGDDQWVMSKHFRNYFNFSHPLVAQHLDPDECAWAYGMNVFDLRAWRTTNIRETYHTWLKENLRSNLTMWKLGTLPPALIAFKGHVHPIGPSWHMLGLGYQNKTDIESVRKAAVIHFNGQSKPWLQIGFDHLRPFWNKYVNYTNDFVRNCHILDS

SEQ ID NO: 165573 - protein, 84 aa, Glycine max
  Coding DNA Sequence Number=SeqID_48795
MASRFTSISNIVASRIHWKLKCRIMRLWVVTNFNNPSTETSLEMLLVDEKGDIIGHVVEKDNIKETRKNCKLGKLIDIMLQDLE

SEQ ID NO: 165574 - protein, 178 aa, Glycine max
  Coding DNA Sequence Number=SeqID_48796
  Gene Ontology: Mol. function=RNA-directed DNA polymerase activity; Cellular component=chromatin; Biological process=chromatin assembly or disassembly
MTLLETTQHSPSSSSTDPHYVSPSLNPHRMKLELPRFDGSGPLGWIFKITQFFDYHSMPDHERLPIASFYMEGLALAWYQWMTRNQQISSWPDLLQALEARFASSHYEDPTRTLFKLTQCGSLNDYLLDFEMLVNRIVGLAPPFLLSCFISGLSLEIRCEVQALQPPTLVQAVALACL

SEQ ID NO: 165575 - protein, 199 aa, Glycine max
  Coding DNA Sequence Number=SeqID_48797
  Homolog annotation: Hit_ID=Q2QN55; Match level="QueryCoverage=30%, HitCoverage=14%, E-value=1e-15, Identity=59%"; Hit description =Glycosyl transferase family 8 protein, expressed
  Subcellular localization annotation: CTP_CleavageSite=39; ConfidenceScore=5.09e-01
MQKHVTICHRKESTQQGTNFSNACQKASSSSSSLIQSSSAGNKSSEYEDKGQQKSKDEDGVEEGSIGNVASCDLDLHQVNKPIVARYRDASHARREVKLHRRLCCRTTTRSLPPTTTLQPPETIFITHVPTIIRSAMFLLQGGSPPTPHWRFQPIGLSDFTPKDSTFFSLLKFLFNGSTTTTTVREKQRHTQQRERKKE

SEQ ID NO: 165576 - protein, 480 aa, Glycine max
  Coding DNA Sequence Number=SeqID_48798
  Gene Ontology: Mol. function=oxidoreductase activity, acting on the CH-OH group of donors, NAD or NADP as acceptor; Cellular component =glycerol-3-phosphate dehydrogenase complex; Biological process =electron transport
  Homolog annotation: Hit_ID=Q96558; Match level="QueryCoverage=99%, HitCoverage=100%, E-value=0.0, Identity=94%"; Hit description=UDP -glucose 6-dehydrogenase
  Pfam annotation: Domain name=UDPG_MGDP_dh; Domain location=209-306; Score=187.0; E_value=4.6e-53; Accession=PF00984.10; Description=UDP -glucoseGDP-mannose dehydrogenase family, central domain
  Pfam annotation: Domain name=UDPG_MGDP_dh_C; Domain location=328-452; Score=179.3; E_value=9.8e-51; Accession=PF03720.5; Description=UDP -glucoseGDP-mannose dehydrogenase family, UDP binding domain
  Pfam annotation: Domain name=UDPG_MGDP_dh_N; Domain location=2-200; Score=344.0; E_value=2.5e-100; Accession=PF03721.5; Description=UDP -glucoseGDP-mannose dehydrogenase family, NAD binding domain
  Pfam module annotation: Pfam domain module=UDPG_MGDP_dh::UDPG_MGDP_dh_ C::UDPG_MGDP_dh_N; Domain location=209-306::328-452::2-200
MVKICCIGAGYVGGPTMAVIALKCPSIEVAVVDISKSRIAAWNSDQLPIYEPGLDGVVKQCRGKNLFFSTDVEKHVYEADIVFVSVNTPTKTRGLGAGKAADLTYWESAARMIADVSKSDKIVVEKSTVPVKTAEAIEKILTHNGKGIKFQILSNPEFLAEGTAIQDLFNPDRVLIGGRETPEGQKAIQTLKDVYAHWVPEGRILTTNLWSAELSKLAANAFLAQRISSVNAMSALCEATGANVTQVSYAVGTDTRIGPKFLNSSVGFGGSCFQKDILNLVYICECNGLPEVAEYWKQVIKINDYQKSRFVNRVVSSMFNTVATKKIAILGFAFKKDTGDTRETPAIDVCKGLLGDKARLSIYDPQVTEDQIQRDLWMNKFDWDHPIHLQPTSPTTEKKVSVVWDAYEATKDADGVCILTEWDEFKTLDYQKVYDNMRKPAFVFDGRNIVDVEKLRDIGFIVYSIGKPLDPWLKDMPAVA

SEQ ID NO: 165577 - protein, 734 aa, Glycine max
  Coding DNA Sequence Number=SeqID_48799
  Gene Ontology: Mol. function=transferase activity, transferring glycosyl groups; Cellular component=chloroplast; Biological process =carbohydrate metabolic process
  Homolog annotation: Hit_ID=P53536; Match level="QueryCoverage=96%, HitCoverage=73%, E-value=0.0, Identity=83%"; Hit description=Alpha-1, 4 glucan phosphorylase L isozyme, chloroplast precursor
  Pfam annotation: Domain name=Phosphorylase; Domain location=104-734; Score=845.6; E_value=2.6e-251; Accession=PF00343.10; Description =Carbohydrate phosphorylase
MEIHEATTSLSSFSPDASSIASSIKYHAEFTPLFSPENFDLPQAFLATAQSVRDALIINWNATYDYYEKLNVKQAYYLSMEFLQGRALLNAIGNLELTGPHAEALSKLGHKLENVAYQEPDAALGNGGLGRLASCFLDSLATLNYPAWGYGLRYKYGLFKQRITKDGQEEVADDWLEMGNPWEIIRNDVSYPVKFYGKVVSGSDGKKHWIGGEDIKAVAHDVPIPGYKTKTTINLRLWSTKAASEEFDLSAFNAGRHTEASEALANAEKICYILYPGDESIEGKILRLKQQYTLCSASLQDIIARFERRSGTNVNWEEFPEKVAVQMNDTHPTLCIPELMRILIDVKGLSWKDAWNITQRTVAYTNHTVLPEALEKWSLDLMQKLLPRHIEIIEMIDEELIRTIIAEYGTENSDLLEKKLKEMRILENVELPAEFADIVVKSKEAIDIPSEELQSSEQAEVEERKDDEVEAVAKKNGTDESSIEDEKEELPEPVPEPPKLVRMANLCVVGGHAVNGVAEIHSEIVKDEVFNAFYKLWPEKFQNKTNGVTPRRWIRFCNPDLSKIITEWIGTEDWVLNTGKLAELRKFVDNEDLQVQWREAKRSNKVKVAAFIREKTGYSVSPDAMFDIQVKRIHEYKRQLLNIFGIVYRYKKMKEMSAAERKANFVPRVCIFGGKAFATYVQAKRIVKFITDVGATVNHDPEIGDLLKVVFVPDYNVSVAEMLIPASELSQHIR

SEQ ID NO: 165578 - protein, 288 aa, Glycine max
  Coding DNA Sequence Number=SeqID_48800
  Gene Ontology: Mol. function=transferase activity, transferring hexosyl groups; Biological process=metabolic process
  Homolog annotation: Hit_ID=Q1RXK7; Match level="QueryCoverage=84%, HitCoverage=79%, E-value=2e-56, Identity=57%"; Hit description=UDP -glucuronosyl/UDP-glucosyltransferase
MTAPYTFRDQVDGLFKNLRMSYSATRKPYVVLTPFPFPFPFQDGHGDADVARDIISLCETIREHLLLPFCDLLARLKDSATKSLVPPVTCLVSDCAMTFTIQAAEELSLPIVLIQPASACSLLSDESCVDWIPGLKNFRLKDLPDFIRTTQIKITMVECFIESANNVHRASAVIINTSDELESDVLNAHTSMVPSLYPIGPFPSFLNQSPQKNHLASLGSNLWKEDTGVPMLCWPFYVDQPTNCGSVCNEWDIGIEIDTNELMVGEKGKKMRQKVMELKKRAEEDVHT

SEQ ID NO: 165579 - protein, 94 aa, Glycine max
  Coding DNA Sequence Number=SeqID_48801
  Gene Ontology: Mol. function=transition metal ion binding; Cellular component=chloroplast; Biological process=iron ion homeostasis
  Homolog annotation: Hit_ID=Q94IC4; Match level="QueryCoverage=71%, HitCoverage=22%, E-value=1e-19, Identity=91%"; Hit description =Ferritin-2, chloroplast precursor
MPCMLDEVVLLSCARNIHLSCSHVADRNNDPQLADFIESEFLYEQVKSIKKIAEYVTQLRLVGKGHGMQISSSSSQKVCGTLIKGFFMMKIYNL

SEQ ID NO: 165580 - protein, 95 aa, Glycine max
  Coding DNA Sequence Number=SeqID_48802
  Subcellular localization annotation: CTP_CleavageSite=70; ConfidenceScore=5.83e-01
MALASTNTDQSTTTTASKKPSKKSENLNPNVPHHRSPSSKSPALQSSKSSTSNPIAQSTQNNIRQKKFVVAKKKKNQKGTQNDAFSCKCKHNGGA

SEQ ID NO: 165581 - protein, 100 aa, Glycine max
  Coding DNA Sequence Number=SeqID_48803
  Gene Ontology: Mol. function=protein serine/threonine kinase activity; Cellular component=intracellular; Biological process =protein amino acid phosphorylation
  Homolog annotation: Hit_ID=O65765; Match level="QueryCoverage=100%, HitCoverage=27%, E-value=2e-31, Identity=73%"; Hit description =Protein kinase
MEKYEVVNEEIGIGRDAVVRLMRCKETKDLVAVKYIPREDRIIDEKVAREIINLRSLRHPNIVRFKEVALTPTHLAIVMEYAAGGELYNRVCNGRIREDE

SEQ ID NO: 165582 - protein, 66 aa, Glycine max
  Coding DNA Sequence Number=SeqID_48804
MILSLEDKLAIGVSLSEACALSENHALSEALNPLSELGESGGESEKHLRAQRIITIAQRDICLFLR

SEQ ID NO: 165583 - protein, 194 aa, Glycine max
  Coding DNA Sequence Number=SeqID_48805
  Gene Ontology: Mol. function=nucleic acid binding; Biological process= transport
  Homolog annotation: Hit_ID=Q8H6Q8; Match level="QueryCoverage=82%, HitCoverage=43%, E-value=2e-16, Identity=38%"; Hit description=CTV.20
MVVTAYQTSHECPEETIVDILVAGFSGQLKGWWDNYLTNEEKSKIYSAIKTDPNGKVITNDDNEEISYAVNTLIFTIAQHFIGDPSLWNDRSAKLLSNLKCRTLVDFRWYRDTFLTKVYTREDSQQPFWKEKFLAGLPRSLGDKVRDKIRSQSINEDISYDICCNLPFGGRATQGLMGASSKEGRRAESPPTFI

SEQ ID NO: 165584 - protein, 119 aa, Glycine max
  Coding DNA Sequence Number=SeqID_48806
HAQGQTDILIARFPDPNYGVKMGSSQCGFSMENNDGLWWLMVDASSRSFIKRLLAHSSHLLKDPNGKIMVKCLVKLQTKFREDPTVNEGWAAFLPRQLHVAFSRSFIKRLPLEASSWLL

SEQ ID NO: 165585 - protein, 110 aa, Glycine max
  Coding DNA Sequence Number=SeqID_48807
MECPGTRSSRILVKMEVKEPWQGLWLPLHYEVVFGHWACGKQAGLVADLGMAFVDDWTHFDPFIGEDQIRKGYTTNYLPFSGISEARLEFSISVGVELLTSSVGVYATLG

SEQ ID NO: 165586 - protein, 118 aa, Glycine max
  Coding DNA Sequence Number=SeqID_48808
  Gene Ontology: Mol. function=sulfate porter activity; Cellular component=integral to membrane; Biological process=sulfate transport
  Homolog annotation: Hit_ID=P53393; Match level="QueryCoverage=90%, HitCoverage=29%, E-value=8e-18, Identity=70%"; Hit description=Low affinity sulfate transporter 3
  Pfam annotation: Domain name=Sulfate_transp; Domain location=1-116; Score=-126.9; E_value=0.0036; Accession=PF00916.10; Description =Sulfate transporter family
MAGADKNGVKIVKHVKGGLNPSSIHQLDFNNPYIGEVAKIGLVVAVVALTVTILASVILSALPGLIDLSEAYKIWKVDKIDFLACAGAFFGVLFASVEIGLLAAVIIATSISSHSLLK

SEQ ID NO: 165587 - protein, 69 aa, Glycine max
  Coding DNA Sequence Number=SeqID_48809
  Subcellular localization annotation: CTP_CleavageSite=54; ConfidenceScore=5.44e-01
MSDVVLKIATVRSWTSVLLTSRPNFRKIQRVLQRPRAKREISVLSVAIVFSQAQCTTGAKLNVVNSEPI

SEQ ID NO: 165588 - protein, 33 aa, Glycine max
  Coding DNA Sequence Number=SeqID_48810
KFSSTVLRKGIDSPIPTEENRPFDRETRKLRSL

SEQ ID NO: 165589 - protein, 169 aa, Glycine max
  Coding DNA Sequence Number=SeqID_48811
MEDSPASPENGIYTPSKTSTLSTHPYIKRLEVSPNIVHPHVGLLLGFAGKRVETRGYMDLMTTFSQGKLSKSFTIRYLPVDADTSSFALISRKTLNKLGAIVSTPHLTMKFPTLTSEIVTIKIDQKQARQCYAKILKVALYPPIREPTMSHITVTKDSQVMTVDEGSQN

SEQ ID NO: 165590 - protein, 69 aa, Glycine max
  Coding DNA Sequence Number=SeqID_48812
MDECERIVERPRGMFYRGPMMGAKCSYQNQEPWHIGMDVVEWGPELHTLAWRGALTGGGPTKQRTSMPK

SEQ ID NO: 165591 - protein, 95 aa, Glycine max
  Coding DNA Sequence Number=SeqID_48813
MGGSDYGGSIEQLIMDREVILIGSSLSEDTRRGASDSESSSFERVRVSRRTDGAFLTLKEGRGSVDGDVRVSLRVRCSLSVRSLSSTQPATAISG

SEQ ID NO: 165592 - protein, 88 aa, Glycine max
  Coding DNA Sequence Number=SeqID_48814
  Gene Ontology: Mol. function=DNA binding; Cellular component=nucleus; Biological process=regulation of transcription, DNA-dependent
  Homolog annotation: Hit_ID=Q84PP4; Match level="QueryCoverage=98%, HitCoverage=26%, E-value=4e-44, Identity=89%"; Hit description =Transcription factor MYB102
  Pfam annotation: Domain name=Myb_DNA-binding; Domain location=14-61; Score=53.2; E_value=8.6e-13; Accession=PF00249.21; Description=Myb -like DNA-binding domain
MGRSPCCDEIGLKKGPWTPEEDQKLIDHIQKYGHASWRALPKLAGLNRCGKSCRLRWTNYLRPDIKRGKFSQEEEQTILDLHAVLGNK

SEQ ID NO: 165593 - protein, 73 aa, Glycine max
  Coding DNA Sequence Number=SeqID_48815
  Gene Ontology: Mol. function=nucleic acid binding
MEMSNLASKLSLNKLDLGDDLFTHLVLISLLVHIRQFKASYNTQKEKWSLKELISHRVQEEERLWRDKTENDH

SEQ ID NO: 165594 - protein, 70 aa, Glycine max
  Coding DNA Sequence Number=SeqID_48816
MVQILWFFGAEAKKIESDTTKKSSRRELPQHHDEEAEATKKERQNERERERERERVRYPIKERESEKLKI

SEQ ID NO: 165595 - protein, 51 aa, Glycine max
  Coding DNA Sequence Number=SeqID_48817
MRDEYFPPKEDAILQNEMPTNLYIFVIGATDNENSHKKVSLIGATLHPFSA

SEQ ID NO: 165596 - protein, 32 aa, Glycine max
  Coding DNA Sequence Number=SeqID_48818
MDPRPIKIPHPLDIRIAKNYSHDYGESKDSRR

SEQ ID NO: 165597 - protein, 351 aa, Glycine max
  Coding DNA Sequence Number=SeqID_48819
  Gene Ontology: Mol. function=microtubule binding; Cellular component =nuclear outer membrane; Biological process=mitotic spindle assembly
  Homolog annotation: Hit_ID=Q38942; Match level="QueryCoverage=85%, HitCoverage=81%, E-value=1e-94, Identity=57%"; Hit description=Rae1 -like protein At1g80670
  Pfam annotation: Domain name=WD40; Domain location=102-138; Score =24.1; E_value=0.00051; Accession=PF00400.22; Description=WD domain, G-beta repeat
  Pfam annotation: Domain name=WD40; Domain location=13-51; Score=24.6; E_value=0.00034; Accession=PF00400.22; Description=WD domain, G-beta repeat
  Pfam annotation: Domain name=WD40; Domain location=198-233; Score =3.0; E_value=16; Accession=PF00400.22; Description=WD domain, G-beta repeat
  Pfam annotation: Domain name=WD40; Domain location=239-292; Score =0.7; E_value=31; Accession=PF00400.22; Description=WD domain, G-beta repeat
  Pfam annotation: Domain name=WD40; Domain location=60-98; Score=24.7; E_value=0.00034; Accession=PF00400.22; Description=WD domain, G-beta repeat
  Pfam module annotation: Pfam domain module=WD40::WD40::WD40::WD40::WD4 0; Domain location=102-138::13-51::198-233::239-292::60-98
  Subcellular localization annotation: CTP_CleavageSite=74; ConfidenceScore=5.41e-01
MSTFGAAANTNPNKSYEVAQPPSDSISSLCFSPKANFLVATSWDNQVRCWEITRNGTVVNSTPKASISHEQPVLCSAWKDDGTTVFSGGCDKQVKMWPLTSGGQPMTVAMHDAPVKDIAWIPEMNLLASGSWDKTLKKGFSKGRGLGTKRDYYMEDIFLKNSMFGNEVYDCLFGNTVTLAMKTSRILVMLKYWDTRQSNPVHTQQLPDRCYAITVKHPLMVVGTADRNLIVFNLQSPQTEYKRIVSPLKYQTRSVAAFPDQQGFLVGSIEGRVGVHHTFATAGSDGAFNFWDKDSKQRLKKLLILCFIVGPIWGEWGTWSLFCLLSLNGKWKDESLYPIWMVVFLFGFLKP

SEQ ID NO: 165598 - protein, 84 aa, Glycine max
  Coding DNA Sequence Number=SeqID_48820
MWMEISELTSSDMCIFNRHCEDFLVSRRKESDGKHKSSFIGIEGSFVKDNGDHDVANEKKGDFDGCALLPFPFSTAPTQVFHFH

SEQ ID NO: 165599 - protein, 72 aa, Glycine max
  Coding DNA Sequence Number=SeqID_48821
MELIENMIASDHAILRDRTHIPTKRSLLELSSQIALLAQNKLLSEQLETLTETLNQEDLVGDIFMMLEDTIN

SEQ ID NO: 165600 - protein, 150 aa, Glycine max
  Coding DNA Sequence Number=SeqID_48822
MALQLGLKIDGLPVTDIIIGYQIPVDADDVVIAQHAKAHIMMLIGSCLMADTSGARSWAWDRMKYITPKIDHLSMEKFLWTRYDKPEIRLLINDVEYYPVHHQHQSYAEPNVPLVDVPRFMSQHHPSQAQYQSVGFSVYASQGCQQSFNQ

SEQ ID NO: 165601 - protein, 355 aa, Glycine max
  Coding DNA Sequence Number=SeqID_48823
  Gene Ontology: Mol. function=unfolded protein binding; Cellular component=mitochondrion; Biological process=protein folding
  Homolog annotation: Hit_ID=Q43638; Match level="QueryCoverage=80%, HitCoverage=33%, E-value=3e-93, Identity=65%"; Hit description=Heat -shock protein precursor
  Pfam annotation: Domain name=HATPase_c; Domain location=131-347; Score=33.8; E_value=6.1e-07; Accession=PF02518.16; Description =Histidine kinase-, DNA gyrase B-, and HSP90-like ATPase
  Subcellular localization annotation: CTP_CleavageSite=67; ConfidenceScore=5.72e-01
MAPVPSRTVATASLASLLPSSPFARASLLRSAFLPPQIGRDRKCFSPAAGLRWTQRRQGRRDGLAVRCEAAVAEKDEATGEKFEYQAEGKPYFIKYEFHVLPKAELSMADGGTWWRVSRLLDLIVHSLYSHKEVFLRELVSNASDALDKLRFLSVTEPSLLGDAGDLEIHIKSDPDNGTITITDTGIGMTKEELIDCLGTIAQSGTSKFLKALKENKDLGADNGLIGQFGVGFYSAFLVAGRVVVSTKSPRSDKQYMWEAEADSSSYVIKEETDPEKFLRRVKAPKFFFTGQEDDKYEFSEPSRIQGLVKNYSQFVSFPIYTWQEKSRTVEEWHESYLCVVIRSHSLDSNVVNGG

SEQ ID NO: 165602 - protein, 309 aa, Glycine max
  Coding DNA Sequence Number=SeqID_48824
  Gene Ontology: Mol. function=unfolded protein binding; Cellular component=mitochondrion; Biological process=protein folding
  Homolog annotation: Hit_ID=Q6ZCV7; Match level="QueryCoverage=87%, HitCoverage=34%, E-value=1e-129, Identity=84%"; Hit description =Putative heat-shock protein
  Pfam annotation: Domain name=HSP90; Domain location=2-308; Score =133.1; E_value=7.9e-37; Accession=PF00183.9; Description=Hsp90 protein
MSYLCFSAFALYFAEFPHLPKKEEQGALNSSLCSKFILQFPRYLSFVRGVVDSDDLPLNVSREILQESRIVRIMRKRLVRKAFDMIQDLAESENKEDYKKFWENFGRFIKLGCIEDTANHKRITPLLRFYTSKSEEELKSLDDYVENMGENQKAIFYLATDSLKSAKTAPFLEKLVQKDIEVLYLVEPIDEVAIQNLQTYKENKFVDISKEDLELGDEDEVKERENKQEYNLLCDWIKQQLGDKVAKVQISKRLSSSPCVLVSGKFGWSANMERLMKAQALGDTASLEFMRGRRILEINTDHPIIKDLS

SEQ ID NO: 165603 - protein, 69 aa, Glycine max
  Coding DNA Sequence Number=SeqID_48825
MASFSVEEFIGNGILKELLQKLLEEGWDDDALGIRSYLHDRGLMQYADKMEDCGKALSELINLSTTDLS

SEQ ID NO: 165604 - protein, 100 aa, Glycine max
  Coding DNA Sequence Number=SeqID_48826
ARRSRSFSRTDVEGRHVSLSATRLFRVEGVCLMSEVVVLTSRRWRVLPGVKSGNPDECGSYRSERLVKPPSLDRCCPGYTFVKLFGVDIFLALQARSNMS

SEQ ID NO: 165605 - protein, 147 aa, Glycine max
  Coding DNA Sequence Number=SeqID_48827
  Gene Ontology: Mol. function=nucleic acid binding; Biological process= DNA integration
  Homolog annotation: Hit_ID=Q1RSN0; Match level="QueryCoverage=70%, HitCoverage=15%, E-value=5e-23, Identity=48%"; Hit description=Zinc finger, CCHC-type
MWDTLAVTYKGTSQVKRYKLSLLTRKYELFSMEEGEDIQSMFRRFQIIPNELRFLGRTYDNYDYINKILRSLSRKWRPQVTTLKALKNLKSMSLEELVDTLKVHEQELQQDEELKKEKSLALNSQKIKKVSSSREQASRSLLKTLKA

SEQ ID NO: 165606 - protein, 62 aa, Glycine max
  Coding DNA Sequence Number=SeqID_48828
MIETRECECELEPCLQMEALSGSMRRWSQQGSRGTKLTKTQEDVHILNSELHRNGNRDEDEG

SEQ ID NO: 165607 - protein, 662 aa, Glycine max
  Coding DNA Sequence Number=SeqID_48829
  Gene Ontology: Mol. function=nucleic acid binding; Biological process= DNA integration
  Homolog annotation: Hit_ID=Q1T035; Match level="QueryCoverage=28%, HitCoverage=22%, E-value=6e-23, Identity=33%"; Hit description =Integrase, catalytic region
MEYAQAPKDYEDLIISKHNLWVECEEHKRSVKFLNEKLLKNEELKGQPQDVVKLNEEIGTLKSTLAKFVNGTENLDKLLRYSQCPSDRSSNEYEGKIYVHDEDTIICYFYDVFNSRKQMPIMVPGQWLLMSHDRRKFYVPMPDSLSWWNRHIQREPKRKNNRNGGYDVSFNKDECIIQNRDRSQLFWRESKRKNNWNGLKYNLVSISQLCDSGCDVSYNKDEHIVQNRDGSLLFSIKRKGNLYKIKLGELSDQKVNLQTAKGQPHKRITKDNGTFLGFSETFKAFKVYNSRTLVVEEAIHVKYNKNEHNKNLSKLNDSFANLRLDDGIEEKVSSSQSLEDGVSTQHLDDPQEESREPTGRILRKNHPESQIIGDPKDRLQIRSSSLRSQGHTGFISEVELKHIDDAMQDDKWKLVELLKGNKVIGEKWVFCNKLDKNDKVVRNKARLVAKGYSQQEGKEDFRLTSFCDVDYVGDKVERKSTTGRCHFIGGKLVALICKKQELTHSRDHSNHGDNPDNESSIHIEHFFDIQELEKVGLNKTLLFCGARHFFNEPQTTYLELIRMFNRKTKFRSNKVIVSKVLEVQIPVSSDSIPDGSLILSQSKYIGDLLQKTKMTKTQPISSPMVANCKLTKARPDCFSDPTLYRSVVGALQLWKQCFPRLF

SEQ ID NO: 165608 - protein, 369 aa, Glycine max
  Coding DNA Sequence Number=SeqID_48830
  Gene Ontology: Mol. function=pectinesterase activity; Cellular component=cell wall; Biological process=cell wall modification
  Homolog annotation: Hit_ID=Q9FKF3; Match level="QueryCoverage=95%, HitCoverage=97%, E-value=1e-116, Identity=57%"; Hit description =Pectin methylesterase-like protein
  Pfam annotation: Domain name=DUF1565; Domain location=73-289; Score= -104.3; E_value=0.032; Accession=PF07602.2; Description=Protein of unknown function (DUF1565)
  Pfam annotation: Domain name=Pectinesterase; Domain location=69-358; Score=174.1; E_value=3.6e-49; Accession=PF01095.10; Description =Pectinesterase
  Pfam module annotation: Pfam domain module=DUF1565::Pectinesterase; Domain location=73-289::69-358
MASKTICTTIQVTLIVAFLTTQVVFSDDNVPIPANKEQLGTWFSTNVGPLDQRKSTIDPALVAAEEGAKVVKVMQDGSGEFKTITDAINSVPNGNTKRVIVFIGAGNYNEKIKIERTKPFVTLYGVPEKMPNLTFGGTAQQYGTVDSATLIVESDYFVAANIMISNTAPRPDPKTPGGQAVALRISGDKAAFYNCKMFGFQDTICDDRNKHFFKDCLIQGTMDYIFGSGKSLYMSTELRTLGDNGITVIVAQARKSETEDNAYSFVHCDVTGTGTGTFLGRAWMSHPRVVFAYSTMSGIVNKLGWSNNNHPEHDKTVRFGEYQNTGPGADPKGRAPITKQLSETEVKPYITLAMIEGSKWLLPPPTPKV

SEQ ID NO: 165609 - protein, 66 aa, Glycine max
  Coding DNA Sequence Number=SeqID_48831
MEDESSEATILESFDIGEEVEETQMPEDPTTPVLAVDTSPPTTPVLQLTYEEDGQTQDTQNQSQEF

SEQ ID NO: 165610 - protein, 264 aa, Glycine max
  Coding DNA Sequence Number=SeqID_48832
  Gene Ontology: Mol. function=nucleoside-triphosphatase activity; Cellular component=chloroplast
  Homolog annotation: Hit_ID=Q2PMM5; Match level="QueryCoverage=98%, HitCoverage=11%, E-value=1e-139, Identity=95%"; Hit description =Protein ycf2
QRYGNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGCDMVPKGELDSSNKISFLNKNPFWGLFHLFHDRNSGRYTLHHDFESEEIFQEMADLFTLSITEPDL

SEQ ID NO: 165611 - protein, 54 aa, Glycine max
  Coding DNA Sequence Number=SeqID_48833
QMKIFMESINRGIWSAMVNGYTMPTHVVDNKTIEKPYESCSQEEINKGEYDSRQ

SEQ ID NO: 165612 - protein, 54 aa, Glycine max
  Coding DNA Sequence Number=SeqID_48834
MSCVVIKKSPRVLGQCVVTSKQRQWSKVGSLVQLMLRGTKQLQLHKAPEAEAEA

SEQ ID NO: 165613 - protein, 155 aa, Glycine max
  Coding DNA Sequence Number=SeqID_48835
  Gene Ontology: Mol. function=protein binding; Biological process=two -component signal transduction system (phosphorelay)
  Homolog annotation: Hit_ID=Q94KS0; Match level="QueryCoverage=89%, HitCoverage=92%, E-value=3e-43, Identity=61%"; Hit description =Histidine-containing phosphotransfer protein
  Pfam annotation: Domain name=Hpt; Domain location=45-130; Score=60.7; E_value=4.8e-15; Accession=PF01627.13; Description=Hpt domain
MDGIVQLQRQLVDYTASLFHEGFLDDQFNQLQQLQDESNPDFVVEVVTLFFEDAERLLNELTKTLGQPSIDFKRLDAHVHQLKGSSSSIGAQRIHRVCISFRNSCEEQNVEGCLKNLQQVKQEYSLVKSKLETLFRMEQQILAAVDHGCEIGFII

SEQ ID NO: 165614 - protein, 533 aa, Glycine max
  Coding DNA Sequence Number=SeqID_48836
  Gene Ontology: Mol. function=RNA-directed DNA polymerase activity; Cellular component=chromatin; Biological process=RNA-dependent DNA replication
  Pfam annotation: Domain name=Chromo; Domain location=454-510; Score =16.5; E_value=0.011; Accession=PF00385.14; Description='chromo' (CHRromatin Organisation MOdifier
MSTESRRSDSAMHRPHFQVMMNDLFNLFLCKFIAVFFDDILVYSPPLRKHSRHLEVVFDSLSQGQFYLRRSKCIFAQNSIHYLGHIVSSQGVVPDPVKIQVMVNRPTSGSQSELHELFGLTRFYRKFIKGYVVVISPLTTLLWKDNFQWHCKTQLAFDKLKRLMTEALVLATSDFMILFILETNASCFAIGTVLLQNSHPIKFFSKTLCPPLLTSSTYVWELHAITTMAIQTSKQQIYLVKLLGYDYTIQYKAGSVSHMPANKVRDEKADRPPPTFTNTFFNLGGAYFGALPSHYTTHKIVILFFDIIGKLHGFPQSLIPDRDPLFISSFWRELFRLSDTKLRMSSSYHPQMDEQTKAMDTILATQTALHNTLQRRLAKAQVVMKLQADLLRRDVQFFVGDWVTLARSHTASSYQPLPVFTRSFTCHCLNHTKDPSRSIKFLSPPMTIDNHLIIEPLSILDWKWDMATAPPTKLALVQWVGLPPEDTTWEDLCASYNLEDKVDFQEGGDDSNTTLITRPKKTQKRSTYLSDYA

SEQ ID NO: 165615 - protein, 155 aa, Glycine max
  Coding DNA Sequence Number=SeqID_48837
  Gene Ontology: Mol. function=3-dehydroquinate dehydratase activity; Cellular component=cytoplasm; Biological process=aromatic amino acid family biosynthetic process, shikimate pathway
  Homolog annotation: Hit_ID=Q30D00; Match level="QueryCoverage=89%, HitCoverage=30%, E-value=2e-31, Identity=47%"; Hit description =Putative 3-dehydroquinate dehydratase/shikimate dehydrogenase
  Pfam annotation: Domain name=DHquinase_I; Domain location=24-155; Score=-27.5; E_value=1.6e-05; Accession=PF01487.6; Description=Type I 3-dehydroquinase
MVCKLLFQWEAGIRSGVRRNSTPICASTTAEWVEEKVFEMVKAKELGADLVEARLDFLKDFHPAQHHQSLINNRGESDGDESQRQDALRQAIELGSEFVDDDRAKGKKPESVKIIVSSHNLERTPSVEEIGNLAARIQASGADVVKIATTAFDNT

SEQ ID NO: 165616 - protein, 326 aa, Glycine max
  Coding DNA Sequence Number=SeqID_48838
  Gene Ontology: Mol. function=heat shock protein binding; Cellular component=integral to membrane; Biological process=protein folding
  Homolog annotation: Hit_ID=Q1EPG9; Match level="QueryCoverage=70%, HitCoverage=20%, E-value=7e-33, Identity=39%"; Hit description=Heat shock protein DnaJ N-terminal domain-containing protein
  Pfam annotation: Domain name=DnaJ; Domain location=60-123; Score =68.1; E_value=2.8e-17; Accession=PF00226.21; Description=DnaJ domain
MECNKDEGLRARQIAGARTQRGEFVEALKFATKAKNIPQIITVCEVHIPAQKNLSGSEMDWYAILQIERLADEATLKKQYWKLALLLHPDIDKNKFVGEEAAFMLIGEANGVLSDQTKCTLYDIKFGAAATGAAPKTSHHYSNGNAFDAKHNANATNNQKSSGSCHFSNGNVFAAKYDAKASVHQKNSYPNSTGFNNQAGQMIFWTSCQHCNAKYQFLIRFVNAYLLCQQWCLTISVCFSKYPERGSNAWSPKTSLEKYWWKTSKDGYVPASRDMMPQTSKNVGSKRARQATPDSGEILQARNGEDMKELMHGDLPRKSNMFQINV

SEQ ID NO: 165617 - protein, 564 aa, Glycine max
  Coding DNA Sequence Number=SeqID_48839
  Homolog annotation: Hit_ID=Q6ZD98; Match level="QueryCoverage=27%, HitCoverage=56%, E-value=4e-36, Identity=51%"; Hit description =Putative vesicle-associated membrane protein-associated protein
  Pfam annotation: Domain name=Motile_Sperm; Domain location=14-139; Score=112.5; E_value=1.2e-30; Accession=PF00635.16; Description=MSP (Major sperm protein) domain
VDLGFGIIMSEAPLLQIEPKELEFIFELKKQSSCSVQLTNNTDHYVAFKVKTTSPKKYSVRPNVGVLAPKATCEFIALLRISLVIVGWMVMGEVTMQAQREAPEDMVCKDKFLIQSTKVHAETTSEDVTSSLFVKDGSKYIEENKLKVTLISPPNSPDLSPINGDFKNGLDHEKVQIYSKDEIQSPEPMIRGHFTNVHQYRVADCLHLSCFHKFPSFLVLSSLMLLVVFVHVLKNPDMVHEVLELEEDMELRQEYYMGHTMKHVGDPKEEAGLKVSKNELNMLKDVEELKPQKKLEVEVSEDLDLNKVKNAEEWKPEKAAELKVSKVLDLNKVKNAEELKPEKAAELKVSKVLDLNKVKNAEELKPEKAAELKVSKVLDLNKVKNIEEQKPEKAADLNMSKVLDLNPVDDVKELKPETETVLKMSKDLELKIVKSVEELKPEKETELKISKDMELETVKNVEELKPENETELKMSKDWEWRTVKNVEELKPEKEAELIVSKSIEEVKLLKAIEEMKLKLDGLESKLNEADLINKGPRKVQVGFPLLYVCMVALICVFLGYRLHS

SEQ ID NO: 165618 - protein, 318 aa, Glycine max
  Coding DNA Sequence Number=SeqID_48840
  Gene Ontology: Mol. function=heat shock protein binding; Cellular component=integral to membrane; Biological process=protein folding
  Homolog annotation: Hit_ID=Q5Z5F4; Match level="QueryCoverage=99%, HitCoverage=35%, E-value=2e-38, Identity=34%"; Hit description =Putative DNAJ heat shock N-terminal domain-containing protein
  Pfam annotation: Domain name=DnaJ; Domain location=67-128; Score =94.1; E_value=4.4e-25; Accession=PF00226.21; Description=DnaJ domain
MEFNKDEAVRARQVAEARMQRGEFVEALKFATKAKKLCADVVNITHVITICEVHNAAKKKLSATDLDWYAILQIEGLADEAAIKKQYRRLALLLHPDKNKFAGAEAAFKLVGQAKGVLSDQAKRSLFDKNFGASVRGAAVKSTGSKKQVRQKTFWTCCQHCNAKYQYSIPFLNATLRCQQCLKSFKAGAIPFVVQKESPVHGPPKPASESTGGNPLGRDHAGTFGRSNPVPMKKCAAGVGVHCEGEKSKDGYVPASRGMDPQTSKNVGSKRVWQSAPDSGESFKAGNGDEMKDAYVQENAVDPSRLNAGRSSRKKQHF

SEQ ID NO: 165619 - protein, 571 aa, Glycine max
  Coding DNA Sequence Number=SeqID_48841
  Gene Ontology: Mol. function=motor activity; Cellular component =myosin complex; Biological process=negative regulation of actin filament polymerization
  Homolog annotation: Hit_ID=Q234R7; Match level="QueryCoverage=78%, HitCoverage=10%, E-value=2e-14, Identity=20%"; Hit description=Viral A-type inclusion protein repeat containing protein
  Pfam annotation: Domain name=DUF593; Domain location=161-234; Score= -31.0; E_value=0.07; Accession=PF04576.6; Description=Protein of unknown function, DUF593
  Pfam annotation: Domain name=Filament; Domain location=210-495; Score= -181.5; E_value=0.074; Accession=PF00038.11; Description=Intermediate filament protein
  Pfam annotation: Domain name=M; Domain location=203-223; Score=5.0; E_ value=28; Accession=PF02370.7; Description=M protein repeat
  Pfam annotation: Domain name=M; Domain location=277-297; Score=12.9; E_value=1.1; Accession=PF02370.7; Description=M protein repeat
  Pfam annotation: Domain name=M; Domain location=424-444; Score=8.9; E_ value=8.4; Accession=PF02370.7; Description=M protein repeat
  Pfam module annotation: Pfam domain module=DUF593::Filament::M::M::M; Domain location=161-234::210-495::203-223::277-297::424-444
MAKKKVSQSHDPKESQNVKQPLPMATPTDGSSELQIQNLKNLNAVLLKETTQRRQQIHSLQSALQQSAVTYDTNLAFDVQNAVVSVFFKNQLEEMNLRFDTLVGEKDYEVAVLKRQLNDLAARLENETSSLVKERDGLVRETKRLEECFDRERKLRDEAETARSEGEKVLSRKQRDIAELETERDFAVKSSQESLSFIETLREEIEAVTRDKSEIQSRNNALENKIGYLENELKRLNQSTKKDEEITRAKILELEGNLGLALQKEEEMKVEISALLKEKKEVEKSVETLTEEKDGVRKALNVLQKELEDKQHELDEAVRVRSEIEEVKGNLENEIVELLGKVDELKESWEKSEEENKELVSQVKHYRNAVDEAVLEKESIKKVFDGEKKKVENLQLQIAGIEKVVAKSNAELGQVRSERDKLVEKEKKLEGKVSVLRKENESLQGMLAEARKESKDLNAKVEVWCSNSNKALALLKTTAAALVYQHKERGGEEVASNGNHVEEIQPYAQELDAIKKAFKSKDEMVDDMKQQLVSLNKSVAEAHKSKSLWTMISSATTIFAAVLAAYVARGR

SEQ ID NO: 165620 - protein, 501 aa, Glycine max
  Coding DNA Sequence Number=SeqID_48842
  Gene Ontology: Mol. function=protein kinase binding; Cellular component=nucleus; Biological process=regulation of progression through cell cycle
  Homolog annotation: Hit_ID=Q94L33; Match level="QueryCoverage=70%, HitCoverage=79%, E-value=1e-132, Identity=69%"; Hit description=Ania- 6a type cyclin
  Pfam annotation: Domain name=Cyclin_N; Domain location=68-213; Score=- 0.0; E_value=0.00015; Accession=PF00134.13; Description=Cyclin, N -terminal domain
MTHQLSYVMTIDQGLNPKKDPRREASNSSLTRGPPPPATSAPTDVFNFHDQNCALSYVRVKDKGMIYTAIDTFYLTDEQLAISPSRKDGIDEATETSLRIYGCDLIQESGILLRLPQAVMATGQVLFHRFYCKKSFARFNVKKVAASCVWLASKLEENPRKARQVIIVFHRMECRREDFPMEHLDLYSKKYVDLKMELSRTERHILKEMGFICHVEHPHKFISNYLATLETPPELRQEAWNLANDSLNSKEPGLSCLRTTLCVRFKSEVVACGVVYAAARRFQVPLPENPPWWKAFDGEKSGIDEVCRVLAHLYSLPKAQYIPVCKDGDFTFSNKSSESKSQSTPKVMPTLSIFIDVPQNSPPADTDNSVPKGTQGEANIESNGSKGAIVKVAIDKLKDSKRSDDESKGMSTEGEARDEPILKSKADRKIEAIERRADRDRDRERYRDRERDRDRDRDRTKSRDRDRGRDSDKEREREEAERGKLKDRDHRSRERAKDSGV

SEQ ID NO: 165621 - protein, 504 aa, Glycine max
  Coding DNA Sequence Number=SeqID_48843
  Homolog annotation: Hit_ID=Q42947; Match level="QueryCoverage=37%, HitCoverage=34%, E-value=1e-38, Identity=45%"; Hit description =Dehydroquinate dehydratase/shikimate dehydrogenase precursor
  Pfam annotation: Domain name=Shikimate_DH; Domain location=421-504; Score=14.9; E_value=1.8e-05; Accession=PF01488.10; Description =Shikimate  quinate 5-dehydrogenase
  Pfam annotation: Domain name=Shikimate_dh_N; Domain location=325-399; Score=52.6; E_value=1.3e-12; Accession=PF08501.1; Description =Shikimate dehydrogenase substrate bin
  Pfam module annotation: Pfam domain module=Shikimate_DH::Shikimate_dh_ N; Domain location=421-504::325-399
MVALDGEGNLRAISITLKQFPVANYNFQCRCGRSGEVEKFCNMRLNEVMGTTPINKDHNPVVRDLVVDAEGFRRRQFGQSVKTYLGLVIGVLFEQGYDRRIAEAFVPTRGQLLQRKAFSRRGETREKLDEGFVGKGNGDLEWQGQSNSLSSWSLVKAIACGNDGVNLNSKAWSIAAQDVRKPFLDIHWYQERMGPSIPWDLGHRSERPLTSYEDWMKWLTEEVAAIWVKKGGSVVRRQGVFSLREAVDCLEAVSGSLAGSVVRHGGSREEATDTYGITENDNRIESGESKLVATALLMLWATTIKELLDLYNFRQIGVGTKVHGAVGNPISDSKSPHLYNATFKSVGFDGVYLPLLVDNVSDFLNTYSSPDFVGYNYTIPPKENGLRCCDEIDPIAKILRKDYTRFQFIHRSLLQLFADSNRRSISGCSPLCGKLFVVMGAGGAGKAIAYGGKEKGARVVVANRIYAKAKELVTKVGGEAITISELESFHTKGLVLVLHILKLP

SEQ ID NO: 165622 - protein, 212 aa, Glycine max
  Coding DNA Sequence Number=SeqID_48844
  Homolog annotation: Hit_ID=Q75J22; Match level="QueryCoverage=97%, HitCoverage=68%, E-value=2e-49, Identity=50%"; Hit description =Expressed protein
MVVGKNLQWRCHLTTLTLSRAWECSPGKEFAWNLLSLFTTSGMLFLEVSLLAFLLQGNSTSGLEALTRTFGISGIIVGFDILLKWLPYSSREVELVGYPQAAAYPCLWFHTVHFYDSIVYLPLFAARPAYYKYVTIMFILNAIALFACGITGNGAAFGFWLYHFTVVCYHAAYLPLLYITFLADFFQEEDLHLENVYYSEMKDAGFFEADWN

SEQ ID NO: 165623 - protein, 72 aa, Glycine max
  Coding DNA Sequence Number=SeqID_48845
WLVGACTLSATLARLARISKFRLSAHLFAQWMDSSGALTGISPRLENMHNSSFFQILSRTQPKECCAQRMAR

SEQ ID NO: 165624 - protein, 199 aa, Glycine max
  Coding DNA Sequence Number=SeqID_48846
SRKYVALQICDDEDVETMLESFQQQDQMSVMELYIEKDVTGGSMFHSANSLTSCGNNLSNNEAQPLRNMSNLHGDEDDDDDDNYLVSKSYVEESLDEDDSIDGISDTDDEVTHDSTPKNCSPSRRYNFLYKKIGVQGIQNPFWNDALHYNNINWSHPDEEDICGLEMPSSFNVGQELYVGMDFDSKDAVKNAVKQYVMK

SEQ ID NO: 165625 - protein, 289 aa, Glycine max
  Coding DNA Sequence Number=SeqID_48847
  Homolog annotation: Hit_ID=Q1LCF4; Match level="QueryCoverage=19%, HitCoverage=9%, E-value=6e-23, Identity=89%"; Hit description =Amidohydrolase 3
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRFPAAPVRPRPAQRRRAARGGLHQDHAQPAGRRDHPRRAGQPDRTAAGQAQRHHPVRHIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 165626 - protein, 126 aa, Glycine max
  Coding DNA Sequence Number=SeqID_48848
MKQKGKRKKDREGRHVIVKKYKSFVKSKHIFWKQGTDAKSLFSGITEIRMDEFIELMKEHNLETITMPKTGCLSAHLAVAMTNFARCFQIIIVTRALWSDMGVRPRDRHLDTQICYTPDIKIGFPR

SEQ ID NO: 165627 - protein, 177 aa, Glycine max
  Coding DNA Sequence Number=SeqID_48849
DKSSRALGFPALITGHCQSFGVPVTPTKVIRPPITKAFIEKYCTPRQAQGDAPQAADAPPPPHQADPAGSLGMERYLYTWFASRRPTTGGRCRYMSVSTGSASVNRGRVSLLLHALLHSSLGLRSHGPEINPRPRQGRSPQDPLVRQREIFGVMALNYFVTVFATCHFIRSFHLPCG

SEQ ID NO: 165628 - protein, 99 aa, Glycine max
  Coding DNA Sequence Number=SeqID_48850
  Subcellular localization annotation: CTP_CleavageSite=32; ConfidenceScore=5.01e-01
MVPSSLVLSQTQVDVPSTCITKDVPSNVLRQRSQAVKPLKLCEWGYKRILRREKGDTKEFRRLVLCSFGKGRRETQKEFRRLVLGEFFLAKGEENEKDE

SEQ ID NO: 165629 - protein, 50 aa, Glycine max
  Coding DNA Sequence Number=SeqID_48851
  Subcellular localization annotation: CTP_CleavageSite=36; ConfidenceScore=5.23e-01
MPLCTGLVGGGAVLSAGGKYSGPFSPQPVRLNSVMRTASVRKAFFIIKLP

SEQ ID NO: 165630 - protein, 86 aa, Glycine max
  Coding DNA Sequence Number=SeqID_48852
MNEERMKNGEKRRRAMKNFHRIAYGSVTEPKCIAKGLEPFETAPPPLFIEKGRFSEILRKYYGSCGSLQKLFFKNVEELAAQLLPP

SEQ ID NO: 165631 - protein, 169 aa, Glycine max
  Coding DNA Sequence Number=SeqID_48853
MGKLDHLEERLRAIEGGEDYAFANLEELFLVPNIITPPKFKVLDFDKYKGTTCPKNHLKMYYWKMGAYAKDEELLIHSFQESLTGVAVTWMQLQNMCKKGAQIFQKNTSKGGETWQLKWHFNDGEKMMTMIVDTLPVFYYEKMVGYTPSSFDDMVFTDERIKVGLKRQI

SEQ ID NO: 165632 - protein, 79 aa, Glycine max
  Coding DNA Sequence Number=SeqID_48854
MSVEKYRSGLFNDRCREMFDRQHRTDDVNLSRSRSFDTGYGGLDDATSGEGSQGRHHKDYLDKSEIGSQGTQREGDPLE

SEQ ID NO: 165633 - protein, 101 aa, Glycine max
  Coding DNA Sequence Number=SeqID_48855
MGSKIYPEVHENPRAFFRNSSPILLEPPANGSGDWSLPRKDCIRYCSLGAFTTLSTVRSGNEGKCKNEYLCYKFEVEFYFKMEGMIKAKKARKALNQMVTT

SEQ ID NO: 165634 - protein, 187 aa, Glycine max
  Coding DNA Sequence Number=SeqID_48856
  Gene Ontology: Mol. function=protein serine/threonine kinase activity; Cellular component=membrane; Biological process=protein amino acid phosphorylation
  Homolog annotation: Hit_ID=Q1T6P5; Match level="QueryCoverage=99%, HitCoverage=23%, E-value=5e-50, Identity=51%"; Hit description=EGF -like, subtype 2; S-locus glycoprotein; Curculin-like (Mannose- binding) lectin; ...
  Homolog annotation: Hit description=Apple-like; Serine/threonine protein kinase, active site
  Pfam annotation: Domain name=B_lectin; Domain location=69-181; Score =148.2; E_value=2.2e-41; Accession=PF01453.15; Description=D-mannose binding lectin
MEIFSFLIFIVSYMLVPSLKISAATLSVSQYVTDGETLVSNSGVFELGFFSPGKSTKRYLGIWYKNITSDRAVWVANRENPINDSSGILTFSTTGNLELRQNDSVVWSTNYKKQAQNPVAELLDTGNFVVRNEGDTDPETYSWQSFDYPSDTLLPGMKLGWDLRTGLERKLTSWKSPDDPSAGDFSW

SEQ ID NO: 165635 - protein, 65 aa, Glycine max
  Coding DNA Sequence Number=SeqID_48857
MEQVSIGHHNWGEFYRLFAAKLPPWLVGFVVDLGMAFVDNWVVGKEKGCYWLSNDIVGLLGNLAV

SEQ ID NO: 165636 - protein, 218 aa, Glycine max
  Coding DNA Sequence Number=SeqID_48858
  Gene Ontology: Mol. function=chitin binding; Cellular component =extracellular region; Biological process=chitin metabolic process
  Homolog annotation: Hit_ID=UPI000044A8F0; Match level="QueryCoverage =75%, HitCoverage=99%, E-value=2e-22, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VLVPIFFRGLHVLAIRGVQVITIRGLHVLAFRGLHILTFIGLHALTFRGLHVLAFIGLHALTFRGLDVLAFRGLHVLTIRGLHVLTFRGLHALAIRGLHVLTIRGLHVLTFRGLHVLTIRGLHVLTFRGLDVLAFRGLHALAIRGLYVLTFRGLHALALRRRHALTFRGLHALKHHRTTLPRLQKAIGPELQRAARPRILRATHPHFQWAPYPHLKII

SEQ ID NO: 165637 - protein, 92 aa, Glycine max
  Coding DNA Sequence Number=SeqID_48859
  Subcellular localization annotation: CTP_CleavageSite=65; ConfidenceScore=5.22e-01
MARSVFASCPYFRDLSGGTKRLLVIIPKVVISLLMVSRVPSGVANCRNLPFGERVMRDSQVRLPRKENARSLHQRLFEENVGKTGKGVVYEL

SEQ ID NO: 165638 - protein, 193 aa, Glycine max
  Coding DNA Sequence Number=SeqID_48860
  Gene Ontology: Mol. function=DNA binding
  Homolog annotation: Hit_ID=Q1S0F5; Match level="QueryCoverage=84%, HitCoverage=41%, E-value=2e-17, Identity=32%"; Hit description=IMP dehydrogenase/GMP reductase
DLRMLDRRKEAIPFFWVLSFYGENSRSGIPRKFLEEKAETLASQREWVTFIDVLALLVLETILFPNVDGLVDLAAIDAFLAYHHNKESPIIAILADAYDTFNLRCEKSSARIVCCMPGLYWKEGGAGALCSCEGFPNVPLIGMKGRINYNPVLAIRQLRYLMSGAPLEETIAPFIARGFDEANTKMLQRIRKA

SEQ ID NO: 165639 - protein, 119 aa, Glycine max
  Coding DNA Sequence Number=SeqID_48861
  Gene Ontology: Mol. function=NAD(P)+ transhydrogenase (AB-specific) activity; Cellular component=1-2nm peptidoglycan-based cell wall; Biological process=electron transport
  Homolog annotation: Hit_ID=Q2NZU2; Match level="QueryCoverage=98%, HitCoverage=23%, E-value=4e-51, Identity=85%"; Hit description =Pyridine nucleotide transhydrogenase subunit beta
  Pfam annotation: Domain name=PNTB; Domain location=1-112; Score= -273.1; E_value=0.00014; Accession=PF02233.7; Description=NAD(P) transhydrogenase beta subunit
MPGHMNVLLAEAGVPYDLIADMDDINPEFANTDVVLVIGANDVVNPVARTDPASPIYGMPVLDVVNARNVVVIKRGKGTGFAGIENALFYADNTRMLYGDGAEAAASLVSELKALDGGH

SEQ ID NO: 165640 - protein, 100 aa, Glycine max
  Coding DNA Sequence Number=SeqID_48862
  Subcellular localization annotation: CTP_CleavageSite=61; ConfidenceScore=5.61e-01
MSLPSAVHASSTFESGAPRSYCVALFANSPFSTFCRSPMNVIAKHCSCVLHLRVWSPAKLLRSAVPQFSILHFFSEPHECHCLALFMHPPPKEFGAMLHD

SEQ ID NO: 165641 - protein, 102 aa, Glycine max
  Coding DNA Sequence Number=SeqID_48863
MKVADIIKTTFPKTDNAKRFMRLVEEHSQTANKSLAETLMSTLTTMKFDDSHTIHDHVIEMTNIIEETELKNQGSHSVHYVSHQGNQGAGKKIVKKHDKGRE

SEQ ID NO: 165642 - protein, 263 aa, Glycine max
  Coding DNA Sequence Number=SeqID_48864
  Gene Ontology: Mol. function=RNA-directed DNA polymerase activity; Biological process=RNA-dependent DNA replication
MTYSAPLIHTIQQEVEPIFQAENVVAFDKMEELQERFDGMQREVEALRGRDLFGKDACELCLVPNVTIPHKFKVPDFEKYKGNSCPRSHLVMYARKMSMYTDNHKLLIHFFQDSLTGAALKWYMNLDSASIRTFNDLGEAFIRQYKYNLDMAPDRDQLRAMTQKEKETFKEYAQRWREVAAQIVPPLEEREMTKIFLKTLSQFYYEKMVASAPTDFTEMVNMGVRLEEGVREGRLTGESAPAASNAKKFGGHFAKKKIKRWEW

SEQ ID NO: 165643 - protein, 99 aa, Glycine max
  Coding DNA Sequence Number=SeqID_48865
MWSLTNCKSSKVQLNNPTTGRCGFLSWWAFEQHGKQCAYLMPGFYKDTSVHWSLVWVHCSWRDINTSRIIGCCCQGIIGLMHYVCQNLDSTKRKDAPHR

SEQ ID NO: 165644 - protein, 110 aa, Glycine max
  Coding DNA Sequence Number=SeqID_48866
  Gene Ontology: Mol. function=oxidoreductase activity; Cellular component=fatty acid synthase complex; Biological process=metabolic process
  Homolog annotation: Hit_ID=Q1T231; Match level="QueryCoverage=94%, HitCoverage=64%, E-value=2e-32, Identity=69%"; Hit description=MaoC -like dehydratase
  Pfam annotation: Domain name=MaoC_dehydratas; Domain location=24-109; Score=-10.2; E_value=0.0088; Accession=PF01575.9; Description=MaoC like domain
MLVRNLHCHKVHSLSLRCFTSGTPNVLKPGDVLRKARVYTDEDVLQYSKVSCDSNPLHTDSAAAKDVGFEGPLVHGMLVASLFPHIISSHFVSFILTLSLNFDMPPMEMR

SEQ ID NO: 165645 - protein, 101 aa, Glycine max
  Coding DNA Sequence Number=SeqID_48867
  Homolog annotation: Hit_ID=Q0GPE6; Match level="QueryCoverage=71%, HitCoverage=31%, E-value=2e-07, Identity=47%"; Hit description=BZIP transcription factor bZIP9
MTSFPLLFKLHPMDDLLKFIPKTVDNVWKEIVTVATTHDVVSTNIVNANASEAPAMTLEDFLTKVGAVKEEDIRGVLPHKIRPRKTHPQDQTPIAAENAAL

SEQ ID NO: 165646 - protein, 237 aa, Glycine max
  Coding DNA Sequence Number=SeqID_48868
  Gene Ontology: Mol. function=chitinase activity; Cellular component =vacuole; Biological process=cell wall catabolic process
  Homolog annotation: Hit_ID=Q9LSP9; Match level="QueryCoverage=77%, HitCoverage=55%, E-value=1e-87, Identity=76%"; Hit description=Basic chitinase
  Pfam annotation: Domain name=Glyco_hydro_19; Domain location=7-220; Score=132.5; E_value=1.2e-36; Accession=PF00182.9; Description =Chitinase class I
MEAKAPLIPPLKNLFLLIRCCSNVGGCEWTIISEAFGEDSEGEEGGYGVATGGPLAWGLCYSKELSPDKFYCDDYYKLTYPCTPGAAYYGRGAIPLYWNYNYGKAGEALKVDLLNHPEYIEQNATLAFQAALWQWMTPPEKHLPSPHDVFVGNWKPTKNDTLSKRVPGFGATINLLYGDQTCGQGSDNEAMNNIISHYLYYLDLLGVGREEAGPNEVLSCAEQAAFKPSGSPSSATN

SEQ ID NO: 165647 - protein, 553 aa, Glycine max
  Coding DNA Sequence Number=SeqID_48869
  Gene Ontology: Mol. function=calcium ion binding; Cellular component =nucleus; Biological process=regulation of transcription, DNA -dependent
  Homolog annotation: Hit_ID=Q1T0C7; Match level="QueryCoverage=98%, HitCoverage=63%, E-value=0.0, Identity=63%"; Hit description=IQ calmodulin-binding region; CG-1
  Pfam annotation: Domain name=CG-1; Domain location=1-118; Score =211.3; E_value=2.2e-60; Accession=PF03859.7; Description=CG-1 domain
MEEAKSRWLRPNEIHAILCNHKYFKINAKPVNLPKSGTIVLFDRKMLRNFRKDGHNWKKKTDGKTVKEAHEHLKVGNEERIHVYYAHGQDKPTFVRRCYWLLDKSLEHIVLVHYRDTQELQLQGSPATPVNSNSSSVSDSAASWIPSDDLDSGVNSAYAVELNDSLTAKSHEQRLHEINTLEWDDLVVSNANTSTTSNGGNVPYSFQQNQSLLNGSFGNVSSDPSAEIPSFGNLTQLVSGSDSAPYSFPESADLLKSSPLSSGGVDTLGTLVNEGLQSQDSFGTWMNIMSDTPCSIDESALEATTSSVHVPYSSLVADNKQSSLPEQVFNLTEVSPVWASSTEKTKVLVGVYRCWVSPHSPGLVTLYLSFDGHKPISQVVNFEYRTPILHEPTALIEEKYNWDEFRLQMRLAHLLFASDKSLNIFSSKVSTNALKEARRFSFKTSYISKSWQHLMKSIDDKTIPFSQVKDALFETSLKNKLKEWLLERIILGSKSTEYDAQGQAAIHLCAMLGYNWAISLFTWSGLSLDFRDKFGWTALHWAAYYGMYGTWIS

SEQ ID NO: 165648 - protein, 154 aa, Glycine max
  Coding DNA Sequence Number=SeqID_48870
  Gene Ontology: Mol. function=nucleotide binding; Cellular component =endoplasmic reticulum; Biological process=small GTPase mediated signal transduction
  Homolog annotation: Hit_ID=O04834; Match level="QueryCoverage=68%, HitCoverage=54%, E-value=5e-52, Identity=92%"; Hit description=GTP -binding protein SAR1A
  Pfam annotation: Domain name=Arf; Domain location=12-153; Score=89.0; E_value=1.5e-23; Accession=PF00025.11; Description=ADP-ribosylation factor family
MVLIYWLVMAYDFFTDPINSAPLLPCYLVHHGVPDFLMSITQLSAWFLVDAVVYLVDAFDKERFAESKKELDALLSDESLANVPFLVLGNKIDIPYAASEDELRYHLGLTNFTTGKGKINLTDSNLRPLEVFMCSIVRKMGYGEGFQWLSQYIK

SEQ ID NO: 165649 - protein, 113 aa, Glycine max
  Coding DNA Sequence Number=SeqID_48871
  Gene Ontology: Cellular component=integral to membrane
  Homolog annotation: Hit_ID=Q00UZ0; Match level="QueryCoverage=63%, HitCoverage=7%, E-value=1e-12, Identity=51%"; Hit description=[G] KOG2175 Protein predicted to be involved in carbohydrate metabolism
MQRSEELGLFVFDEEDNENILSHCISPDDIYRKQEDTIISWRDPEYAAELALSFQEPGGCSYIWDNICNVQRSMHFNTLNSEAFHSVNSESRELPAVELSTLPLILKINCGYC

SEQ ID NO: 165650 - protein, 272 aa, Glycine max
  Coding DNA Sequence Number=SeqID_48872
  Gene Ontology: Mol. function=protein binding; Cellular component =integral to membrane; Biological process=response to DNA damage stimulus
  Homolog annotation: Hit_ID=Q5SP90; Match level="QueryCoverage=89%, HitCoverage=31%, E-value=3e-40, Identity=37%"; Hit description=SMEK homolog 1
  Pfam annotation: Domain name=DUF625; Domain location=18-204; Score =290.7; E_value=2.7e-84; Accession=PF04802.5; Description=Protein of unknown function (DUF625)
MVVESGNTDQSWLVELILSYQDFFRKLMEVFRVCEDLENMDGLHLIFKIIKGIVLLNSTQIFERIFSDEFMMDIVGALEYDPEVPHVQHHRKFLKEYVIYKEVYLGSDYLFYFGREARWQDVVLARVLDEATVANLNSIIHANNAIVVSLLKDDSTFIQELFARLKSPTTSPESKKNMVRFLHEFCSLSKSLQMVQQLRLFWDLMNEGIFDIVTDVLQSQDKKLVLTGTDILILFVNLDPNLLQSYVVRQEGITLLGLLVSFCMQMRPHLSR

SEQ ID NO: 165651 - protein, 162 aa, Glycine max
  Coding DNA Sequence Number=SeqID_48873
MAPGSMDLVVDYQFRFQFHPSWETSILPWLPHAKPRWGKGREVVDTWSTEYYSFGKKTCGNNYNHEQELTITILLGKINVNGPRTMLRLPQRKNPIPQGGGVLIKSSSFLYGRDTDDQNGLIVILRARRRDDDKELPIMITVKHYFCCRVLLSWCLCCGKDS

SEQ ID NO: 165652 - protein, 516 aa, Glycine max
  Coding DNA Sequence Number=SeqID_48874
  Gene Ontology: Cellular component=cytoskeleton
  Homolog annotation: Hit_ID=Q00UZ0; Match level="QueryCoverage=50%, HitCoverage=21%, E-value=8e-25, Identity=30%"; Hit description=[G] KOG2175 Protein predicted to be involved in carbohydrate metabolism
MTRNLDIGVNQVRGMTTDFGDDMHCQFLEILRCLLDSCSLSGAQKDTIIDIFYEKHLGQLIEVITASCPSENVAHANSKSIDRGLVKYQSGTKPEILSNICDLLCFCVLHHPYRIKCNFLLNKVIDKILLLTRRREKYLVVGAVRFVRTILSCHLFPSINFYMSCIFVSSRLLEFLSCKIVLSLIELYIFVILELIAVNFIEKDEHLVDHFVRSDFLKPIVDAFVANGNRYNLLNSAVLELFEYISKENLKLLLKYLVDSFWDQLVKFEYLVSIHSLKVKYEQCLDNDGTKGTAIMIDLRRRLDERALDKEEEDYFNDSDEEDTTSASISHNQKVQQQQPVLSNGVAASYSKLSPRPGGLVDYDDDEDEDYRPPPKRPEASEEDEGIMESLRQKRKLPSENPELAKKLSKNSKSKDSVFASLCSTLSQTVLPGKKPSVNVHTGPCREDNKEESNVSRNFCENSNATAEVNHVEKETAAYRNFSDGLYGTSDNGQLGGEEHTLVSPKSSPEMAVNGS

SEQ ID NO: 165653 - protein, 116 aa, Glycine max
  Coding DNA Sequence Number=SeqID_48875
  Homolog annotation: Hit_ID=Q1SDS1; Match level="QueryCoverage=67%, HitCoverage=15%, E-value=4e-07, Identity=35%"; Hit description=IMP dehydrogenase/GMP reductase
MGTRGSISYNPVLAIRQLGYPMRGEPQEEELAPVISQGFNKTNRETLQKICKAWEVVEKKDKELRGSNNGPIGGYRRWLKAHVQGSDWLPSLRSHGAKHASYNREVQRRVKPVFDP

SEQ ID NO: 165654 - protein, 131 aa, Glycine max
  Coding DNA Sequence Number=SeqID_48876
ITDIVVPRKLLSERNVIVYYTEFDEFNSIDIAIAKEFYAKLYDLEDKSPKQVRVRGHLVKFALLRPDPQELAAKLCIPGRGFELNADGQPLKILRKNMTTLAYTWSILSFSNLIPTSHTSDVTLDRAKLIY

SEQ ID NO: 165655 - protein, 87 aa, Glycine max
  Coding DNA Sequence Number=SeqID_48877
GTSFVVQVKGTSTWVVVIENKRGYISCGSVQVEGHLIQQEDTLKAQNAAQEATKDAGVAEADMDTDYVADVTAAQGTWDLWPTPTQD

SEQ ID NO: 165656 - protein, 63 aa, Glycine max
  Coding DNA Sequence Number=SeqID_48878
  Subcellular localization annotation: CTP_CleavageSite=21; ConfidenceScore=5.17e-01
MRAKGSLLGHFSAPGPTRKLKSEETSSSGQARLLLEEASSSPGRVFTLKFVKLFERNEMLEVN

SEQ ID NO: 165657 - protein, 123 aa, Glycine max
  Coding DNA Sequence Number=SeqID_48879
YIMNSIITVLYFNGRVYEDNDGVIFEGSKKAIQIKRGISFNALKKELEIRFLVSGKYVALQICDDEDVETMIESFQQKQQMLVLELYVEKDVAGGSMFHAANSVTSCGRNVSHHESKLPRITS

SEQ ID NO: 165658 - protein, 189 aa, Glycine max
  Coding DNA Sequence Number=SeqID_48880
MQRYPSGYPYKTISVNPDSRSQVASEDTQVVIRTKRFLLILTREVRWQAEIPKWASEPVDTQRQTLSSVPLSSRDGEFNDMRRNPSGYSYKTISVNPDPRSQVAETVSPMICADTQVVIQTNQLLLISTREVRWQAEVPQVVIRTNVLLLILTCEVRWQAEIPQVVIRTHSSATPTCDKSGSMRRRPIR

SEQ ID NO: 165659 - protein, 273 aa, Glycine max
  Coding DNA Sequence Number=SeqID_48881
  Gene Ontology: Mol. function=two-component sensor activity; Cellular component=membrane; Biological process=two-component signal transduction system (phosphorelay)
  Homolog annotation: Hit_ID=UPI00005F91F6; Match level="QueryCoverage =95%, HitCoverage=41%, E-value=8e-74, Identity=55%"; Hit description =COG2202: FOG: PAS/PAC domain
  Pfam annotation: Domain name=GGDEF; Domain location=191-273; Score= -18.5; E_value=1.2e-05; Accession=PF00990.12; Description=GGDEF domain
  Pfam annotation: Domain name=PAS; Domain location=77-181; Score=21.5; E_value=0.003; Accession=PF00989.14; Description=PAS domain
  Pfam annotation: Domain name=PAS_4; Domain location=83-186; Score =51.6; E_value=2.7e-12; Accession=PF08448.1; Description=PAS fold
  Pfam module annotation: Pfam domain module=GGDEF::PAS::PAS_4; Domain location=191-273::77-181::83-186
LTVALNRLPNGKPDHFISVIVDISERKAAEADLFALQHELEERVETRTRELNVVVKKLNEEIETRVLAEYQLSAEKERLRAITDNMPALISQIDGNERYLFANSAYKTWFGLEESSLRGMTVRDFMGESVYRIAKPMIERALAGEMVSFENELQTRQGLLMIHTTLVPCEAQGFYILAMDITELKRLQQRLEYDATHDMLTGLTNRRAFLRRLSGTLQACCHQRQMALLFIDLDGFKTLNDSYGHDFGDAIPKTFSSLLSSCAGERHSVSRVA

SEQ ID NO: 165660 - protein, 77 aa, Glycine max
  Coding DNA Sequence Number=SeqID_48882
MENWRRALRNNFAGLQTRWWRMHEQRQAMTFMGLPPGNDIHGAPLKSGEWRIGEKRYAITSRGSRLVGGGCMNSDRQ

SEQ ID NO: 165661 - protein, 101 aa, Glycine max
  Coding DNA Sequence Number=SeqID_48883
  Subcellular localization annotation: CTP_CleavageSite=65; ConfidenceScore=5.18e-01
MAKIQCPKEGKTYSNIYKDKRAHTLPMGSKSTLRLVRNLGPSLGSLAQSTWSLLSNALAGPRHVRRYMEKNEETTMEEKVKLKINGGLRSTYLKLLCSDTT

SEQ ID NO: 165662 - protein, 75 aa, Glycine max
  Coding DNA Sequence Number=SeqID_48884
MALTSMVDSGAGPYKKLLNACHCNSAMPWNTVAQQTPQTKKNNNAIGKGKEVLDEEEEQQQKRKKVKHCLGAQML

SEQ ID NO: 165663 - protein, 280 aa, Glycine max
  Coding DNA Sequence Number=SeqID_48885
MSKEIDMNVENEEDAGVKVEHVDCIDAFNTSQAWEGNGQHEKTRRDFRRGHSSGDCCGVGRMSLESGFKCFKGRRVNMKINYEMLYPWAKQEVVKQKSIYSDWATFAFGKEKLFLPTNGDDDSIIIEPCMTWEPACANWQRSDRAFIFSKLGIRLPLTMLEKRVLQKWLDFLPKKRRLTKPLPLLLLQKPPSMLLYIQVDFEDGLLAGSTRIDGQSPIEEMGNNWNPMDFVNPHKMRAACSGMWLSLIWEEVPDFNAMMEQVKVVANDVAFGAIGPSRKW

SEQ ID NO: 165664 - protein, 85 aa, Glycine max
  Coding DNA Sequence Number=SeqID_48886
MKKGVATCTQHYCWGTQQIVKWRNCPSSIILPEEVFFRKLFGKPFSGNFPEKLLPEEEFVTSGSTHKLLPEERHPECFRKKVLLE

SEQ ID NO: 165665 - protein, 80 aa, Glycine max
  Coding DNA Sequence Number=SeqID_48887
MAMEPFDIYSINGNIDPRKKNMLWLGGGSNVEAMSFKIVLIMPNNQELSKFQRFKNQESSFKNNQDQDSRIKRRLNQDKY

SEQ ID NO: 165666 - protein, 330 aa, Glycine max
  Coding DNA Sequence Number=SeqID_48888
  Gene Ontology: Mol. function=peroxidase activity; Cellular component =vacuole; Biological process=response to oxidative stress
  Homolog annotation: Hit_ID=Q1SAT8; Match level="QueryCoverage=93%, HitCoverage=93%, E-value=1e-125, Identity=69%"; Hit description=Haem peroxidase, plant/fungal/bacterial
  Pfam annotation: Domain name=peroxidase; Domain location=41-290; Score=358.2; E_value=1.3e-104; Accession=PF00141.13; Description =Peroxidase
MTYTNPTMFPLFLSLSFFPLIQAQLTTNYYQKTCPKFYDIVRKAVTDKQLSTPTTAGATLRLFFHDCMVGGCDASVLVTSDSFNKAERDAAVNLPLSGDGFDAVARAKGALELECPGIASCADTLAAAAHNLVIAAGGPAFELRLGRKDSLESKATDPENQFPLPTMSMSEVIKIFTSKGFSVQEMVALVGAHTIGLSHCNQFSQRLFKFNKSSDIDPAYNPEYAAGLKKLCENYTKDPSMSAFNDVITPTKFDNMYYKNLRKGMGLLATDSAMFGDSRTRPFVDTYAEDENKFFQDFARAMEKLSVLHVKTGTKGEVRSRCDSFNTLSY

SEQ ID NO: 165667 - protein, 102 aa, Glycine max
  Coding DNA Sequence Number=SeqID_48889
MTRSKRIQKSSDKKKGSFPEAANDVLTKKDQAPKKFEVPSNGNPMPKKEGDEKKEIFKYPQCSTVVLRKLPPKMKDPNKFTIPCLIGGWYIYHDRGNHHGHS

SEQ ID NO: 165668 - protein, 99 aa, Glycine max
  Coding DNA Sequence Number=SeqID_48890
MCSNLYNNLGDKRIMKRGINQVDKDDCQIECGKAYASSKMKIETLMRAQAQVSITTPPFPTYDRCTIVHRPGEYTANDELAKTRDENNFIGGRNNSYNQ

SEQ ID NO: 165669 - protein, 58 aa, Glycine max
  Coding DNA Sequence Number=SeqID_48891
MGDEDKRKVPTILHTKRCKIKKETQGGKMTQTMRRVAVWTMSKPTSMMEACLWGFYGG

SEQ ID NO: 165670 - protein, 1615 aa, Glycine max
  Coding DNA Sequence Number=SeqID_48892
  Gene Ontology: Mol. function=nucleic acid binding; Cellular component= beta-galactosidase complex; Biological process=DNA integration
  Homolog annotation: Hit_ID=Q1SRN1; Match level="QueryCoverage=87%, HitCoverage=99%, E-value=0.0, Identity=50%"; Hit description =Integrase, catalytic region
  Pfam annotation: Domain name=rve; Domain location=586-748; Score =163.7; E_value=4.6e-46; Accession=PF00665.16; Description=Integrase core domain
  Pfam module annotation: Pfam domain module=RVT_2::Retrotrans _gag::rve; Domain location=963-1219::99-194::586-748
MKRLRSGETKERRNSSSSMEEPPLMADDEHQNVNSLADLPATTKAATKSGLTHSLTIKLDEKNFLLWSQQIPLQFASIEDCALGINSDEYQQWLIKDQTLFTWLLSTLSDGVLPRVLSCRHAHEVWDKIHKYFNSVLKSRARQLRSELKNTKKLSRSVNEYLLRIKSIVNSLVAVGDMVSEQEQVDSILEGLPEEFNSFVMMVYSRFDTPTVEDVEALLLLQEAQFEKFKQELTSPSVSANVAHTETNASDSNSEHESQELGTEHYNVNANRGRGRGKGRGRGRGKGQAQNQGKVKCQICAKPNHDAINCWYRYDPQAMNQNSRGGYQVGPSNRPQNFNPYMRPTAHLAMPQPYAMPNMDQFSNGAWYPDSGASHHLTYNPNNLSYSSPYTGQDQVVMGNGQGVSIHSLGQSQFHSPNEPNVKLTLKDLLHVPNISKNLLSVSKFAQDNNVIFEFHPYHCFVKYQDSKQVLLEGTVGADGLYQFKPFKFLTNSGAASNSDSSSMSSSSQFSVFNNPVNCNNTVSVMQNGNVFQMWHLRLGHAHTSAVKNILNLCNIPFSNKTATLPCTFCCMGKSHRLHSPLSNTVYTKPFEVIHYDLWGPAPFVSYYGYSYYITFVDTYTKFTWIYFLKAKSDALKAFTQFKALIQNQFQASIKAIQSDWGGEFRAFTTLLNELGIQHRLTCPHTSHQNGTVERKHRHIVEMGLTLLSHAALPLKFWDHSFTQAVYLINRLPSSAIPLFQSPYHALHQSQPDYSQIKVFGCLCFPHLRPYNNHKLQYRSSPCVYLGVSPQHKGHKCLDATGRIYISKDVIFHESQFPYLSLFASSSSNSHMSHTYPAQILFPSVNTNTNLHPETSSAPDTDPPDPVSPLPGSVSPSSSTPLTISQINSLISQPISTTSPSVPTPPADPVPAIRPASQNISHHNAHPMITRAKTGNLKPKVFVAALEPKSVKSALNDPAWLQAMQAEYKALMDNQTWTLVPLPQHRKAIGCKWIFRVKENPDGTVNKFKARLVAKGFLQTAGFDFTETFSPVIKPITIRIILTLAVTFKWSVQQIDVNNAFLNGILQEEVYMTQPAGFEASDKSLVCKLHKSLYGLKQAPRAWYDRLTQALLQLGFVKSKCDPSLLIHTQNGACTYVLIYVDDILITGSASHLISDLIHKLNMKFALKQLGQIDYFLGIEVHHLPSGALLLNQTKYIRDLLCKAHMEDSAPIGSPMVSSCRLSKYGSDTMTDPTLYRSIVGALQYATLTRPDIAFSVNKVCQFMAHPLESHWKAVKRILRYLNGTLSHGLLLTPSPTSPPFSLRAYSDADWATDQDDRRSTSGSCIYFGPNLISWGSKKQQLVARSSTEAEYRSMANTTADLLWIQSLLRELQVPFLTPTLLCDNLSAVSLSHNPILHSKTKHIKLDIHFVREKVLSKQLNILHVPAQDQLADPLTKPLSPSQHTAIRTKLKIGLLAKYTQKKLDQRDGKERDKSVKGIHYQHPVQCGRATSSARKPYGRSVIIVSAQPPRPTPDITFTNANFEGVSQIENDLVIIFAVIMGFNVQCILVNHGSLAEGMYWKAFVGLKVPKDLMRSCAGVLLGAFVSTTHLKVKFLLEDGLVSTISINQEIARKS

SEQ ID NO: 165671 - protein, 196 aa, Glycine max
  Coding DNA Sequence Number=SeqID_48893
  Gene Ontology: Mol. function=DNA binding; Biological process =transposition, DNA-mediated
  Homolog annotation: Hit_ID=Q10CY9; Match level="QueryCoverage=65%, HitCoverage=17%, E-value=8e-12, Identity=29%"; Hit description =Expressed protein
MESSNVKNKSSGKRKMSSEDTRSYFAWNLEMERVLADVLRDQRNLGNKGDGNWKAVAYSTAAQILSKRFGVHFMADNVKNRFKLWRTWYGIVSDILSQSGFDWDSTKYMITVENEIAWNEYVKSHEEAKRFRFKVIPNWDDIVDLCAKDRATGLRAENALDADDIMSKETNEEEAIHSVSFDLEGSSSATRKTFAQ

SEQ ID NO: 165672 - protein, 252 aa, Glycine max
  Coding DNA Sequence Number=SeqID_48894
  Homolog annotation: Hit_ID=Q2HUH8; Match level="QueryCoverage=67%, HitCoverage=48%, E-value=3e-15, Identity=30%"; Hit description =Histidine triad (HIT) protein; Homeodomain-like
MYRPPQSSENFQNPPQYVMCPPPPPTSENSQNPPQYIMYPPPPHMWYMHLSSNVEPPTSGSSQNPQIYSQPSTPTNSNTCYRPSLSNIVLPSNKIESPVGVDEVDQTSKQYWERIKNAYNNDNVRQSGQFCERSWTQLKSRWNRIHPPVQKFNGCYKQADKHRRNGSSEKDVLADAHMIYSQDTEFMSKYSKRTKVSTSGNYSSSSNPETPIEVKEYDTLSPMSRPIGPKAAKRKSKGKECPNTLDLSGIEC

SEQ ID NO: 165673 - protein, 119 aa, Glycine max
  Coding DNA Sequence Number=SeqID_48895
MLTDKRKEDRSKALDLKTVFSDFCGQSLIFLLKTEEKETDIERNKDENQKTRNELKVLDLETYPLKNEERTKNGGKPPRIAYGNLSEALRKHLALDFLHGNNFFHPKQLKCIAKGIRDP

SEQ ID NO: 165674 - protein, 32 aa, Glycine max
  Coding DNA Sequence Number=SeqID_48896
MAWVTGDPLGFISEFTAQTNKFILITICFKRK

SEQ ID NO: 165675 - protein, 124 aa, Glycine max
  Coding DNA Sequence Number=SeqID_48897
  Subcellular localization annotation: CTP_CleavageSite=75; ConfidenceScore=5.26e-01
MATTPPVLLKNGIPGLPGHPTFFWSWVASGGSNPARLGELRSPGRAGRQPPPPFSYKKAEGGCSKDPSAPWLCISAVLGEKNCFREENPSRGASVTLPRCFRKQIREGFRPFFIVLHPFFILQR

SEQ ID NO: 165676 - protein, 158 aa, Glycine max
  Coding DNA Sequence Number=SeqID_48898
PPRVDRLVVHVDLAIGKADSPHKKKLRTYLGIVTRYKVDVTYENWKQAEFDIPEASGGRTKKKILQIVREWWTQFKSDLTLKWALAADKDSLDDTVCEKYDTSKEKWAQFCQSHRDPSWEGYEYLEEKLMAKKTKKKLEEAAQSEITKVVIDPPSPIK

SEQ ID NO: 165677 - protein, 649 aa, Glycine max
  Coding DNA Sequence Number=SeqID_48899
  Gene Ontology: Mol. function=histone-lysine N-methyltransferase activity; Cellular component=nucleus; Biological process=chromatin modification
  Homolog annotation: Hit_ID=Q9FF80; Match level="QueryCoverage=97%, HitCoverage=98%, E-value=0.0, Identity=51%"; Hit description=Histone- lysine N-methyltransferase, H3 lysine-9 specific SUVH1 (EC 2.1.1.43) (Histone H3-K9 ...
  Homolog annotation: Hit description=methyltransferase 1) (H3-K9 -HMTase 1) (Suppressor of variegation 3-9 homolog protein 1) (Su(var)3-9 homolog protein 1)
  Pfam annotation: Domain name=Pre-SET; Domain location=365-465; Score =124.8; E_value=2.4e-34; Accession=PF05033.6; Description=Pre-SET motif
  Pfam annotation: Domain name=SET; Domain location=467-625; Score =166.5; E_value=6.7e-47; Accession=PF00856.18; Description=SET domain
  Pfam annotation: Domain name=YDG_SRA; Domain location=198-338; Score =150.6; E_value=4e-42; Accession=PF02182.8; Description=YDGSRA domain
  Pfam module annotation: Pfam domain module=Pre-SET::SET::YDG_SRA; Domain location=365-465::467-625::198-338
MEEGLGQNSVPPHGPIDKSKILDIKPLRSLIPIYSMSSQAPPAGQYPSGFSPFFPFGAPQQTPTGVTTRGAATPAPLRAYKNPLGAGDSSSTMNGFNGQDTSGKKKRGSPSRHTKSSVNKPKKSQEPPADLSGLVGISPAQREDGSREVVNIVLMAYDALRRRLCQLEEAKELSSGSIKRADLKACNTLMTRGIRTNMRKRIGAVPGIEIGDIFYFRMELCIVGLHAPSMGGIDALHIRGEFEEETLAVCIVSSGEYDDDAEDSDVIIYTGQGGNFFMNKDKHTTDQKLQRGNLALDRSSRQHNEVRVIRGMRDDSWIEKAKGGGGVFKYKLVRIPGQSSAFAVWKSIQKWKSGSPSRTGLILADLSNGAEGIPVSLVNEVNNVKAPTFFNYFHSLRHPKSFSLMQPSHGCTCIKACVPGDLNCSCIRRNEGDFPYTGNGILVSRKPLVHECGPTCQCFPNCKNRVSQTGLKHPMEVFRTKDRGWGLRSLDPIRAGTFICEYAGEVVGRGKVSQLVKEGDEYVFDTTRIYDQFKWNYEPRLLEEIGSNDSTEDYAMPYPLIITAKNIGNVARFMNHSCSPNVFWQPVVYEENNQSYLHVAFFALRHIPPMTELTYDYGLAQSDHAEGSSAAKGRKKCLCGSSKCRGSFG

SEQ ID NO: 165678 - protein, 68 aa, Glycine max
  Coding DNA Sequence Number=SeqID_48900
  Subcellular localization annotation: CTP_CleavageSite=42; ConfidenceScore=5.62e-01
MIKLKSQFIFALSAQSRKPSFSFVFLTLSPPPHTVVSHQTCNCTAEPANELGFVTITIKDGSGHGYPV

SEQ ID NO: 165679 - protein, 158 aa, Glycine max
  Coding DNA Sequence Number=SeqID_48901
  Subcellular localization annotation: CTP_CleavageSite=71; ConfidenceScore=5.33e-01
PMASTLSTPSSDATSIVAPVIGSQYELYARSMPPSVVGQIGLPNMTPFIPPSRRSIMTKEPQPEVTIADLMNMKKMVEELTIDFIERFIKAGSHCSVQFPEVECAAMATRNMHSRLKEKLVAQEYGDLSQLASKANQIEQFIHEKELQGLTKDEDLIG

SEQ ID NO: 165680 - protein, 91 aa, Glycine max
  Coding DNA Sequence Number=SeqID_48902
  Gene Ontology: Mol. function=RNA binding; Cellular component=nucleus; Biological process=mRNA processing
  Homolog annotation: Hit_ID=Q69VQ7; Match level="QueryCoverage=65%, HitCoverage=20%, E-value=6e-10, Identity=58%"; Hit description =Putative THO complex 3
MGLWKYYLTHLFDLLTLSWPIQLVVIASQLIQYFAVGSAYSLVSLWDISEMLYMRTFTKLDSSTGCKINLVENKTTENQMHIKQQLLLLHV

SEQ ID NO: 165681 - protein, 1227 aa, Glycine max
  Coding DNA Sequence Number=SeqID_48903
  Gene Ontology: Mol. function=RNA-directed DNA polymerase activity; Cellular component=chromatin; Biological process=chromatin assembly or disassembly
  Pfam annotation: Domain name=Chromo; Domain location=1131-1182; Score= 28.7; E_value=2e-05; Accession=PF00385.14; Description='chromo' (CHRromatin Organisation MOdifier
  Pfam annotation: Domain name=RVP_2; Domain location=320-444; Score= -26.5; E_value=0.00012; Accession=PF08284.2; Description=Retroviral aspartyl protease
  Pfam annotation: Domain name=rve; Domain location=872-995; Score =14.0; E_value=0.00041; Accession=PF00665.16; Description=Integrase core domain
  Pfam module annotation: Pfam domain module=Chromo::RVP_2::RVT _1::Retrotrans_gag::rve; Domain location=1131-1182::320-444::514 -790::100-190::872-995
MPDPAHNACPPNCLEEALLRLTQQQLHLTSKIDELLTHVTPAFSPTPPPPPFPHRHPAPAPNHKMKLEVPRFDGTEPLGWIFKINQFFEYHGTSDHDRLTIAGFYMEGRAIAWFQWMTSNDQFTSWPVFLQALQTRFAPSQYEDPTGSLFKLTQRGLVANYLSEFEDLANRVIGLLAPFLLSYFVFGLALDIRREEEKLHDPRMSLQSRPMNPSPSPPPVISSPRLSPLQPLLSSPSRPSQAPIVRCLTPEELASRRKRGLCFSCDEKFHRGHRYAPRVHLLIVEDDDPPDPDPSKIDGTNSAPVPPDGPDPYPAQIIFNSLLGHVAPETLRLVVTLARHAILLLIDGGSTHNFIQQAFVTQLGLPCRATTPLRVMVGNGQHLDCSYLCEAVTIDIQATLFTVDLHVLPIAGANVVLGVQWLKSLGLVLTYYNTLRMQFFHDGQLIELWGNHAATTPTTTTTHLSPELQALLIQFDALFQPPQGLQPVRDTDHHIHLIPQATSVNQGLIQPNTSLFSSPMLLVKKHDGSWRFCVDYRALNVLTIKDRFPIPIIDELLDELGGARCFSKLDLLQGYHQIRMHAANIPKTTFRTHHGHYEFKVMPFGLCNAPSSFQVEYLGHMVSHQRVEPVALKITAIHQCPQPRSIKALRSFLGLEGFYRRFIRGYATIAAPLVKVTAIDPFHWTLQAQLAFDNLKHALSTVPVLALPDFKLPFTVETDASGVGMGASSSLHVCLRALCHHLDGQEMATIPHRPPLHHYHRPSQLEGAFNPNYPNSRTTYEPMTFLILSMPCLTFIEELCRQLSDHQEYQLLSQWIRAYPNDHQGYSISQDLEAMLALLKPLSAYLKIFIGRGYAMMLLNLSPSAWMCPLPVPSRPWEDLSLDFIAGLPPFHGNTVLLVVVDRFSKGIHLGILPASHTALTVASLFVDIVVKLHGIPRSLSNGQTEVLNKVIEQYLRAFVHRRPKMWGKLLPWVEWSHNTSWNAGSSTTPFEITFGRKPFNFPEYIAGTSKIAVVEESISDREITFQAIRKKLIKAQERMKLYADKKRREVTYECGEWGSPATIGKLAKRFYRPFQIMERIGPVAYRLQLLENARIHPVFHCSMLKPFKGSSENIKPAKLPPNFADDQPLLSPLAILGRRRTSSESNSPWEVLVQWQGLSPDDTSWEDWSQLCRDFHLEDKVTLQRLRDDTGATKEMTQAMNIKAEKEVLDLESSRHLEPITKPHPN

SEQ ID NO: 165682 - protein, 280 aa, Glycine max
  Coding DNA Sequence Number=SeqID_48904
MAGDGGYLGRETSTWHTSRKKHEMTYFSRLGLMYITLTIQAYRGTQTQGAYLSLWDVHSSSKYHVCESDKDVLQLTNDCKGFEIVEIYVKHVIDVPIIGEEFVNEGGSDFVTIDDSDSGGEGDVQRKGVGDVSDANAQGECDHVVVADVEGEGDVVVVHGEGDTNSFEDEDYVAEENSNNEYTSMEDSDYEENWDWTIVLDTDLFGETKPPFSHPPPGTTIIILRPMWLPVIAPLGSQASHATLPISQTSFGRSTCHNVSESTPQTMYQSPRKKTCLDVE

SEQ ID NO: 165683 - protein, 301 aa, Glycine max
  Coding DNA Sequence Number=SeqID_48905
  Gene Ontology: Mol. function=RNA-directed DNA polymerase activity; Cellular component=chromatin; Biological process=chromatin assembly or disassembly
MANLESHPHSPTSSSAIPHTAFPSNPYCIKLEVSHFDGSDPLVWIFKITQFFEYQSTPNHERLTIASFYMDNHALTWFQWMASNSQLYDNPTGALFKLTQRDTVNTYLPKFKALTNQIIGLPPPFLLSCFISYLVSKIHRECKRYNPSALVQASRLSPEELGTHRKRCLCFNYDEKVHRGHKCASKVFLLIAKDDDDGQEDHQHVDHVPNPQEVIAPTPTQISLHTLSDHLAPKTLYLLGQIAYQQVIILIDGGSTHNFVQEHLVHTLGLPTQPTTPLWVMVGNGHQLDCHLLNEAVTMHV

SEQ ID NO: 165684 - protein, 100 aa, Glycine max
  Coding DNA Sequence Number=SeqID_48906
  Homolog annotation: Hit_ID=Q1SW20; Match level="QueryCoverage=88%, HitCoverage=9%, E-value=3e-19, Identity=59%"; Hit description =Disease resistance protein; AAA ATPase
MVCQNHQLHKVNIKDELESIQAFLKDVNRRVVADEANTNNGIRTWVMKVRKESVRIEDVIDAYLRVIHVVKDQPPGCLALICKITSLIRTLISLHQTTRD

SEQ ID NO: 165685 - protein, 65 aa, Glycine max
  Coding DNA Sequence Number=SeqID_48907
  Homolog annotation: Hit_ID=Q1SP37; Match level="QueryCoverage=75%, HitCoverage=15%, E-value=4e-08, Identity=62%"; Hit description =Bacterial adhesion
MDFSPLQKCIDVIRILAYGSSTDSVNDYVQIGEIITLLCLDKFVRRGYLSRLGNACEDHPKATRS

SEQ ID NO: 165686 - protein, 349 aa, Glycine max
  Coding DNA Sequence Number=SeqID_48908
  Gene Ontology: Mol. function=protein binding; Cellular component =membrane; Biological process=defense response
  Homolog annotation: Hit_ID=Q1SW19; Match level="QueryCoverage=89%, HitCoverage=38%, E-value=1e-72, Identity=44%"; Hit description =Disease resistance protein
MVNHWQWVQYKIWKLFSNKPNLALVAIGGLLSTKSIVVGACGHWWSLSTKSKTESEWKKISQNVMILNFELWSIGLLNDLTKILSLGYDDLPYYLKPCILYFGIYPKDYSIHHKRLTRQWIAERSLVQDSIVGCEGKFKSFQVHDVLHGVIIAKAKDLNFFHFVHEGDESAASGITRRLSMDTRSNNVPRISNRNHIHTIHAFGEGGFLEPFMMGQLSSKSCLKVLELEGTSLNYAPSNLRNLVHLSRNYQAEFSVLGFTIGVLVKKGIKNLTSLEVLTHVELDDRGINLIQEMRMLNMLRKLGLRRVRREYGNVICALAVEMTHQESLNITAIKIIKLESLCKLMRVL

SEQ ID NO: 165687 - protein, 118 aa, Glycine max
  Coding DNA Sequence Number=SeqID_48909
MHLFHIPNHVTLFCQHFNDPLDDEPFVKIKCSFAIGVAAIASFGYQKDMDDQRVRKQDLPPTVPDERTPSPPPQRDSSSSLLHDALTELWDLWAFLGDRFDAMDSCITRQEDDMSFIR

SEQ ID NO: 165688 - protein, 526 aa, Glycine max
  Coding DNA Sequence Number=SeqID_48910
  Gene Ontology: Mol. function=kinase activity; Cellular component =nucleus; Biological process=regulation of progression through cell cycle
  Homolog annotation: Hit_ID=Q39879; Match level="QueryCoverage=87%, HitCoverage=92%, E-value=1e-147, Identity=63%"; Hit description =Mitotic cyclin a2-type
  Pfam annotation: Domain name=Cyclin_C; Domain location=361-488; Score= 143.3; E_value=6.6e-40; Accession=PF02984.9; Description=Cyclin, C -terminal domain
  Pfam annotation: Domain name=Cyclin_N; Domain location=245-359; Score= 175.8; E_value=1.1e-49; Accession=PF00134.13; Description=Cyclin, N -terminal domain
  Pfam module annotation: Pfam domain module=Cyclin_C::Cyclin_N; Domain location=361-488::245-359
  Subcellular localization annotation: CTP_CleavageSite=72; ConfidenceScore=5.84e-01
MSSTTQNRRSSFTSSTASSLAKAKRLPSSVSLWSSSGKAKRVTTQNVAVKRAPLANLTNQRNASSSSSSSLCARNKVQGGSIKVSKTKKEAPARTSITKSTISWNKLPELKSVNSSSVVIPRANSLPRRKDAAPTVASFAVPVHSSIDVSPSKIDGRSVSMDETMSCDSIESPDEVEYMDNRDVSDVHSIQREITSNLNISDTKEPEGDVCSREIIVELEERVDKIVNIDNIYSDTQLCATYVCDIYKHLRESEEKKRASPDFMDRIQKDINVGMRAILVDWLVEVAEEYRLVPETLYLTVNYLDRYLSGNAMNRQSKYEEICAPQVEEFCYITDNTYLKEEVLQMESAVLNYLKFEMTAPTVKCFLRRFVRAAAHDVQEIPSLQLEYLTNFIAELSLLEYSMLSYPPSLIAASVIFLARFILFPSKKPWNSTLQHYTLYRPSDLCACVKDLHRLCCSSHDSNLPAIRDKYSQHKFAYFLLILHLCTVQMCSQEAHPSFNTSRSFPDQLNKGIQRQSNNWDAHAKF

SEQ ID NO: 165689 - protein, 170 aa, Glycine max
  Coding DNA Sequence Number=SeqID_48911
  Gene Ontology: Mol. function=RNA-directed DNA polymerase activity; Cellular component=chromatin; Biological process=chromatin assembly or disassembly
  Pfam annotation: Domain name=zf-H2C2; Domain location=23-64; Score =27.6; E_value=4.4e-05; Accession=PF09337.1; Description=His(2) -Cys(2) zinc finger
MKGGRIWLPQGSPFIPTLLMDFHSSPTGGHMGIAKTLTRISENFSWSGIKKDVKHFVVVCVDCQHTKYETKKTVGLLCPLPILFWPWENLSLDFTMGLPAYHDYTTIPMVMDCFSKGIHLGMLPPHHTSHTVVLLFMDIVKKLHGMPISLILDRDPLFISQLWQELFRLS

SEQ ID NO: 165690 - protein, 91 aa, Glycine max
  Coding DNA Sequence Number=SeqID_48912
MDMRRHLEEITHIKLIDHLGKYPGKYQLIMLEKVPEVSWWDDLPLGSLLQACGGNLLHLLLPTTPYAIQKYLVIKVISGLQRLSFLPQSFI

SEQ ID NO: 165691 - protein, 383 aa, Glycine max
  Coding DNA Sequence Number=SeqID_48913
  Gene Ontology: Mol. function=DNA binding; Cellular component=nucleus; Biological process=regulation of transcription, DNA-dependent
  Homolog annotation: Hit_ID=Q6Q789; Match level="QueryCoverage=76%, HitCoverage=85%, E-value=5e-69, Identity=50%"; Hit description=Myb transcription factor
  Pfam annotation: Domain name=Myb_DNA-binding; Domain location=45-92; Score=46.1; E_value=1.2e-10; Accession=PF00249.21; Description=Myb -like DNA-binding domain
  Pfam annotation: Domain name=Myb_DNA-binding; Domain location=98-165; Score=22.0; E_value=0.0022; Accession=PF00249.21; Description=Myb -like DNA-binding domain
  Pfam module annotation: Pfam domain module=Myb_DNA-binding::Myb_DNA -binding; Domain location=45-92::98-165
  Subcellular localization annotation: CTP_CleavageSite=56; ConfidenceScore=5.47e-01
MRNPSLPTLATTKTKVKNNSNKSTNNNNNIGTNYSPCCNNVGLKRGPWTPEEDEVLANYINKEGEGRWRTLPKRAGLLRCGKSCRLRWMNYLRPSVKRGHIAPDEEDLILRLHRLLGNRYTYHLPFKGLGLTDQLFPQKLGWSLIAGRIPGRTDNEIKNYWNTHLSKKLINQGIDPRTHKPLNPPSIAVPSSSTTSTIPPSKPPPVIITNNNINPFHHDLTNMFNQGVHLNHLGQHHQPPPLSNPCDNHNPVPAAATDDVSAMGFMDNNNEDCNNDGININYYSDDVFSSFLNSLINDDAFEAQQQQHHVQTEIPTPSERSINPLPCDDRVDDHHLGSITTASASQGYDDELGVLWESPLVSATFSQHVNDHITKRVHDHHNQ

SEQ ID NO: 165692 - protein, 94 aa, Glycine max
  Coding DNA Sequence Number=SeqID_48914
MQILTDAHPFCGVLVDMDAGMAEAGAAHGELEEGGPSGGGNGGQGWEGLGAEVANKVSVRNNPPWCLPSKKEKERNENLVVPPSQWPTMADCED

SEQ ID NO: 165693 - protein, 85 aa, Glycine max
  Coding DNA Sequence Number=SeqID_48915
MSLKNLVVRLGVHDKTNHTLISQVTLTRISKRHREEEEEIVTSNSLSKCETNLSLQEHYFANPNDVFGCMREKRKISARDISSTM

SEQ ID NO: 165694 - protein, 233 aa, Glycine max
  Coding DNA Sequence Number=SeqID_48916
  Subcellular localization annotation: CTP_CleavageSite=52; ConfidenceScore=5.26e-01
MPNSHPDTNIIPPNLNPTHNSSITYTHGNTLPHNLIPFPPQNSTNSDQSFLLVSLGKEEWRFSFSFDCRRSFQKLFHFENSWLLEPSLNAIVEERQVKVAFESQINLCRREMKILKEETNKEEKNHFAIAKDKLNNLIAQEEAYWKQREKMAEEETSTLTNITDAYGKDYGQLINLQKLEGFGGLGFRHSYGFNLAMPWCSKLNTFPMENSWTSLSRTIQVILGVASMLRRLW

SEQ ID NO: 165695 - protein, 105 aa, Glycine max
  Coding DNA Sequence Number=SeqID_48917
  Gene Ontology: Cellular component=nucleus; Biological process=red or far red light signaling pathway
  Homolog annotation: Hit_ID=Q8LEA8; Match level="QueryCoverage=60%, HitCoverage=25%, E-value=9e-09, Identity=54%"; Hit description =Phytochrome A-associated F-box protein
  Subcellular localization annotation: CTP_CleavageSite=31; ConfidenceScore=5.39e-01
MDGNLDSSVTIICSSATSTAASTPTTGATTCSSERRKINVECAFCTCQPTWDLQAAFCPRRDFGYHLDEEVLKMKKAQKKTVQADEEEERLLEDKDDNMRNDQQS

SEQ ID NO: 165696 - protein, 92 aa, Glycine max
  Coding DNA Sequence Number=SeqID_48918
MKEIRRRVMYMPGPRDGALWGGNADTGGQKNWASGARGHEACSGGGIWKNKVCLNGGLSLRTSVVGAVSSLNLQLIKHLHRHLYASQCTKYI

SEQ ID NO: 165697 - protein, 97 aa, Glycine max
  Coding DNA Sequence Number=SeqID_48919
VEGRSPEYEKPRDLRSNPFQGVGNELSYERASSPSFLSKAHLGGEAPPSMAYSLLQRLLRMPRNTRLKPYTTGMTKIQGPDEGNTYSNIYKDKRAHT

SEQ ID NO: 165698 - protein, 300 aa, Glycine max
  Coding DNA Sequence Number=SeqID_48920
  Gene Ontology: Mol. function=nucleic acid binding; Cellular component= ribonucleoprotein complex; Biological process=rRNA processing
  Homolog annotation: Hit_ID=UPI0000162ACD; Match level="QueryCoverage =99%, HitCoverage=31%, E-value=4e-81, Identity=56%"; Hit description =RNA binding / nucleic acid binding
  Pfam annotation: Domain name=RRM_1; Domain location=1-61; Score=44.2; E_value=4.3e-10; Accession=PF00076.12; Description=RNA recognition motif. (a.k.a. RRM, R
EEELEEHFSRFGSVSQVHLVVDKDTKRSKGIAYILYTAPDIAARAQEELDNSIFQGRLLHVMQALQRHSDNQENNVLKDQRSKTLKQQREEKRKADEASGDTRAWNSLFMRPDTFRNHWSLDPTLLAIFSHGVVENIARKYGVNKGDLLDREADDLAVRIALGETQVISETKKAFKNAGVNVEALEELANNKTDGLKRSNHVLLVKNLPYGSTENELAKMFGKFGSLDKIILPPTKTLALWIGELCLQQSSIGNIIAVTVTLFNDIYVKLSYLEMIFQVVFLEPAEARAAFRGLAYKRYK

SEQ ID NO: 165699 - protein, 103 aa, Glycine max
  Coding DNA Sequence Number=SeqID_48921
  Gene Ontology: Mol. function=transferase activity
  Homolog annotation: Hit_ID=Q1SUM5; Match level="QueryCoverage=66%, HitCoverage=63%, E-value=9e-09, Identity=42%"; Hit description =Polynucleotidyl transferase, Ribonuclease H fold
MDATIFKEQDLYGADINIRRDQGNFISTKTVLAKGNIEPKEVEAWSLLQALKWLSELQFHIFILEIHCKAIMDCLNLNHKGLSDFYYLIQSCNTVLHCYPNSK

SEQ ID NO: 165700 - protein, 150 aa, Glycine max
  Coding DNA Sequence Number=SeqID_48922
  Homolog annotation: Hit_ID=Q1SGQ5; Match level="QueryCoverage=23%, HitCoverage=5%, E-value=4e-11, Identity=85%"; Hit description =Protein kinase
MVEMTTSSKTSGWEALRMWRHEPPNMKGITTHRLCSQGDDHTESDLGARAERARGEDVHAERKKCEGFGTVEELAVGEAMVGGGVDNGSGGFREQRVATKEKDKGGSGYGSVGKREAEQRLEAVEGSGIAVEDKIRERERENEGRVCIRL

SEQ ID NO: 165701 - protein, 148 aa, Glycine max
  Coding DNA Sequence Number=SeqID_48923
MEATKEQMATMMEAMMSMKKIMEANAVAIAATNVVAKVNPMPPSGLNQMNHPTSTMVGKDLRGTGGPHLVRKTSMPSYHMACLATIRHPMWRTLPMRMSITPLLYSFKANNLNLIMHMSLDPWGRHMKCPTTIYLTLSLASDMPLKGK

SEQ ID NO: 165702 - protein, 252 aa, Glycine max
  Coding DNA Sequence Number=SeqID_48924
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=99%, E-value=1e-31, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTGPLHESISCFLIRVDPWVLVPITFRGLHVLASRGLHVLVFRGLHVLAIRGLHVLAFRGLHALTIRGLHVLAFVGLHALTFRGLHVLTFRGLHILAFRGQHVLAFTFRGLHALTIRGLYVLTFVGLHAFTFRGLHVLTFRELHVLTSRGLHVLTFRGLHVLAFRGPHALTFRGLHVLTFRGLHVLTFRGLHVLAFKGSYTFAFVGLQALTFRGVYVLTFKGLRVLTFRGVYVLAFSGLHALTFKGRHVLNF

SEQ ID NO: 165703 - protein, 69 aa, Glycine max
  Coding DNA Sequence Number=SeqID_48925
MSTTSSTASTEMKNGIMRRPLIMQFIAAFNNDKPSIILNGHQTIMSLYISDTMEPFMKYESDNTETKCI

SEQ ID NO: 165704 - protein, 135 aa, Glycine max
  Coding DNA Sequence Number=SeqID_48926
  Subcellular localization annotation: CTP_CleavageSite=32; ConfidenceScore=5.27e-01
PRAVKPAAAGDCQSGSAQGAANRRRPLYPRALAAKIATSWYLRLIPSGFGTGRGSVRAKHGPQPASMRAAPAFRERLSDFEATNTGTAIRRENGSLPAVIARRRCACAGLQITCRRSPDEALAATRGASSRYQAS

SEQ ID NO: 165705 - protein, 176 aa, Glycine max
  Coding DNA Sequence Number=SeqID_48927
  Homolog annotation: Hit_ID=Q1S0W6; Match level="QueryCoverage=56%, HitCoverage=20%, E-value=3e-34, Identity=69%"; Hit description=EGF -like
MLPVLVLLLFVVLLIWAKGFQFLRLGILAVQGLAFGSILIRLRAKLRCSSLGAFGAHVSSRNSGGRRSRRNSSESSGTFGGRRWKQKEKLKVTRQKPFKLRTEHRGKLKEEELVKKVQEMMAEEEKMRIPIAQGIPWTTDEPECLLKPTVKESTRPIDLKLHSDIRAIDRAEFDQQ

SEQ ID NO: 165706 - protein, 95 aa, Glycine max
  Coding DNA Sequence Number=SeqID_48928
MVRMAMWVGENISQRGVEIEEGVRVRNMRRHRKRVKTKKCNEVTDFAFVSETCLMFPSRAKCTTLVSSTIETASKCTDRSMATAFAIIVADFVGL

SEQ ID NO: 165707 - protein, 291 aa, Glycine max
  Coding DNA Sequence Number=SeqID_48929
  Gene Ontology: Mol. function=acetyl-CoA carboxylase activity; Cellular component=acetyl-CoA carboxylase complex; Biological process=fatty acid biosynthetic process
  Homolog annotation: Hit_ID=Q1S0W5; Match level="QueryCoverage=85%, HitCoverage=91%, E-value=2e-64, Identity=57%"; Hit description =Biotin/lipoyl attachment
  Pfam annotation: Domain name=Biotin_lipoyl; Domain location=200-270; Score=99.6; E_value=9.3e-27; Accession=PF00364.12; Description =Biotin-requiring enzyme
  Subcellular localization annotation: CTP_CleavageSite=85; ConfidenceScore=5.92e-01
MASFSVPCPKCPTTSSSPPLGLKSLNVSFQRVLSLKPSLSFGSLSAESAASRIQCLNRKQFSVLKATKVENSNSAPVMVNGPNVASSKEKEVHNGKLSGGTIPDDASIIAFMSQVSDLVKLVDSRDIVELQLKQSDCELMIRKKEALQPPPVIAPTSPPMHYATVPSPPPPPAAAPASSAPPKAVPALPSPAKAGTSSHPTLKCPMAGTFYRSPAPGEPAFVKVGDKVQKGQVICIIEAMKLMNEIEADQSGTIAEVLAEDGKPVSVDTFHEYQKGPYFELDVKSPLLEQH

SEQ ID NO: 165708 - protein, 688 aa, Glycine max
  Coding DNA Sequence Number=SeqID_48930
  Gene Ontology: Mol. function=steroid hormone receptor activity; Cellular component=nucleus; Biological process=regulation of transcription, DNA-dependent
  Homolog annotation: Hit_ID=Q01EI2; Match level="QueryCoverage=62%, HitCoverage=30%, E-value=1e-47, Identity=28%"; Hit description=[BDL] KOG1020 Sister chromatid cohesion protein SCC2/Nipped-B
MVAQLLESILFIIDAVLPMLGKLPPSIVGELEQDLKQMIVRHSFLTVVHACIKCLCSVSKMSGKGAAVVEQLIQFFFKCLDTQAVDNKQKVGRSLFCLGLLIRYGNQLLASSSSKLIDVGRSVRLFMKYLSVEDFVVKVRSLQALGFVLIAKPEYMLENDVGKILEETLSSASDTRIKIQGLQNMFEYLLEAESQMGTDKNDENVAGYSVGAGHSVPVAAGAGDTNICGGIVQLYWDNILGRCLDFSEQVRQSALKIVEVVLRQGLVHPITCVPYLIALETDPLESNSKLAHHLLMNMNDKYPAFFESRLGDGLQMSFMFMQSICGSSENVDHKIQSKIPTSGKGKPEAGSLAQAKLGVSRIYKLIRGNRVSRNKFLSSIVRKFDNPRWNKLVIAFLIYCTEVLALLPFISPDEPLYLIYAINRVVQVRAGPLEANFKAWSSSISRHNSPYGNGMYQQGPDEPTVTSQVMSLDLNGTFQQNVDVQPNSNDMRTLDLNGSNHQLPDYPLSYMGSSEAKLHSAGYTDPFSFSNDDLEKVQADCLSAIALQLLLKLKRHLKIMYSLDDARCQAYSPTEQPKPGEVISRQNIAFNIGDSQFSLPTSPQELIQRYQEFKHALREDTVDYSHYTANIKRKRPTATPRRVQVRKPVYVAGGYDDGDDDGDYTGGSEMHKISFSGRRSSLRNSRQY

SEQ ID NO: 165709 - protein, 102 aa, Glycine max
  Coding DNA Sequence Number=SeqID_48931
MSLPSAVHVSSIIKRGASGDWEICSSVVFRIGSFAKHVKKEGVETRIVITERAGWTKSVSYLCFPLISDERYLAPFVAQYVKSRDMPKIKRKQAYAIRENSV

SEQ ID NO: 165710 - protein, 859 aa, Glycine max
  Coding DNA Sequence Number=SeqID_48932
  Gene Ontology: Mol. function=zinc ion binding; Cellular component =nucleus; Biological process=cell cycle
  Homolog annotation: Hit_ID=Q1S0W0; Match level="QueryCoverage=93%, HitCoverage=68%, E-value=0.0, Identity=67%"; Hit description=PHD -finger, putative
  Pfam annotation: Domain name=PHD; Domain location=685-732; Score =30.9; E_value=4.6e-06; Accession=PF00628.19; Description=PHD-finger
  Subcellular localization annotation: CTP_CleavageSite=45; ConfidenceScore=5.23e-01
MSFPATSGASAAALSSSGHRGIGLSNTVHSELAACLPLPSLPVFCGASDQDLRLVDSPARLNRVDVLAQSAKIAELLRHTDVSYLNLRGEAKGVPYIYVEPLELHDEVIRCNPEAFEYSTAGPVKEQIYGSAVSEKRKPESSFPIQRETQKDYNATHSRQLDNFSTNDISSLSSKKSKIKKKGGDGISVAPDSAELQGAYIERFREFLEDLCNKSEFNSDDRDEAEWLPLPLTDLRLLVNEITSIREKKLLHLVPVEVLVRLLKVLDHQIHRAEGLSIEECDNSDSELVSSVLIALESIHAALAVMAHTDMPKQLYKEEIIERILEFSRHQIMDVMCACDPSYRALHRPSENTAFEVDDYEDNDAEFGSASKKRRTSKTSKLKKSVSSRVSTAVNTILQKLCTILGLLKDLLLIERLSDSCILQLVKTSITTFLVDNIQLLQLKAISLLSAVLILLLYSSVIVIFHAHMMIFYLYTQHRTYVMDEVVQLLWKLPYSKRALRSYHIREEEQRQIQMVTALLIQLIHCSANLPDALRKASNGNAVLEASVDASYPIKCHEAATEACCLFWSRVLQRFASVKTHDASELKSIIENLVTDLLTTLNLPEYPASAPILEVDHVWVLCVLLLQNAGPKSKDVSARSLAIDILGTIAARLKRDALVCSQEKFWILQDLLNQDAAAQHHPKDTCCVCLGGRVENLFICHGCQRLFHADCLGIKEHEVSSRNWSCQTCICHKKLLVLQSCCNSQQKNDVKKNCNTDSEVSKQEIVQQLLLNYLQDVTSADDLHLFICWFYLCLWYKDDSNCQQKSSYYLARMKSKIIILLQHPWLPLLRVSSCTRFRPPSPRSSTIPTTYTGDNMSNQ

SEQ ID NO: 165711 - protein, 267 aa, Glycine max
  Coding DNA Sequence Number=SeqID_48933
  Gene Ontology: Mol. function=transposase activity; Biological process= transposition, DNA-mediated
  Homolog annotation: Hit_ID=Q75HL4; Match level="QueryCoverage=94%, HitCoverage=39%, E-value=3e-11, Identity=23%"; Hit description =Expressed protein
MERVLADVLRDQRNLGNKGDGGWKRSALNAVATVLSTSFNVNVTSDNIKNRIKLWRSWYGIVSDILGQSGFDWDGTKHMITVENENAWNEYCTSHKSAKPFRYKVLQNWDDIVDLCAKDRATGHGAETAMDADEAMSRETNEVEFMGLGATAIDLEEPSSNTKGKRQGSTSSGTHPHKRKMGEKEGIAASLDKMTNSFNRMVEKMDGKVDDEDIQEVLCEAALIPDLNRQQWAKAIKWLADDPKQLAIVKALPIHQKTDYVLTHLGE

SEQ ID NO: 165712 - protein, 53 aa, Glycine max
  Coding DNA Sequence Number=SeqID_48934
MDNLKGSLSAFFLKTWVKVFGGRFCVGRLIVQLCTMTYNLTFSNLEAYKNLMR

SEQ ID NO: 165713 - protein, 164 aa, Glycine max
  Coding DNA Sequence Number=SeqID_48935
  Homolog annotation: Hit_ID=Q9S7G7; Match level="QueryCoverage=21%, HitCoverage=4%, E-value=4e-12, Identity=86%"; Hit description=Myb -related protein 3R-1
MADTISTFSIIDMEKKRASQEHKLLIKQLERNRKEDEKEKEKESMHNELQREPLLNVGGLEFYVIAPNLLASGAKDAECFKDRIDVQCLHRWQKFLNPKLVKGPWSKERDTCAEHACTTESSGRALSTRCMLSTITRDSYLPRWRLALCGLLGLSCSDSLSKTL

SEQ ID NO: 165714 - protein, 46 aa, Glycine max
  Coding DNA Sequence Number=SeqID_48936
MCGGSRNVVVTVLMEESNRLLLKLVDEINDKLNEETKDLKLMPKFV

SEQ ID NO: 165715 - protein, 87 aa, Glycine max
  Coding DNA Sequence Number=SeqID_48937
MECHIQGTLFYVKSMPCSDQLARTSGEFGLKSVGNRQSNWRVPWSDAAATSQALFQCRLGCRNFFQRKGSCNCHWRVGCKLQLPLAI

SEQ ID NO: 165716 - protein, 525 aa, Glycine max
  Coding DNA Sequence Number=SeqID_48938
  Gene Ontology: Mol. function=protein binding; Cellular component =nucleus; Biological process=multicellular organismal development
  Homolog annotation: Hit_ID=Q1SXD6; Match level="QueryCoverage=88%, HitCoverage=99%, E-value=0.0, Identity=74%"; Hit description=WD40 -like
  Pfam annotation: Domain name=NLE; Domain location=14-82; Score=119.3; E_value=1.1e-32; Accession=PF08154.2; Description=NLE (NUC135) domain
  Pfam annotation: Domain name=WD40; Domain location=141-178; Score =17.6; E_value=0.044; Accession=PF00400.22; Description=WD domain, G -beta repeat
  Pfam annotation: Domain name=WD40; Domain location=181-223; Score =39.2; E_value=1.4e-08; Accession=PF00400.22; Description=WD domain, G-beta repeat
  Pfam annotation: Domain name=WD40; Domain location=236-274; Score =32.5; E_value=1.5e-06; Accession=PF00400.22; Description=WD domain, G-beta repeat
  Pfam annotation: Domain name=WD40; Domain location=295-332; Score =29.8; E_value=9.7e-06; Accession=PF00400.22; Description=WD domain, G-beta repeat
  Pfam annotation: Domain name=WD40; Domain location=336-374; Score =17.8; E_value=0.04; Accession=PF00400.22; Description=WD domain, G -beta repeat
  Pfam annotation: Domain name=WD40; Domain location=381-420; Score =31.9; E_value=2.2e-06; Accession=PF00400.22; Description=WD domain, G-beta repeat
  Pfam annotation: Domain name=WD40; Domain location=424-461; Score =9.5; E_value=2.8; Accession=PF00400.22; Description=WD domain, G -beta repeat
  Pfam module annotation: Pfam domain module=NLE::WD40::WD40::WD40::WD40 ::WD40::WD40::WD40; Domain location=14-82::141-178::181-223::236 -274::295-332::336-374::381-420::424-461
MNMNEESGEGSARRVQVRFVTKLGEPYKVPTTAIAIPADLARLGLSSLVNALLQSNDADHQPEPFDFLIDGEFVRMSLEQFLLAKGISAHQCVYISEANKCYACYGDSVKWDDAVEWGVLVKEVAAVERILEIEYARAVAPRKEEDPSLHDDWVSAVDGSSSRFFLTGCYDGLGRVWKGAGLCTHILEGHSDAITSISIINPKGEETVTVATASKDRTLRLWKLNAGDHVNNPMRVRAYKILRGHKSSVQCVAVQTAGEMVCSASWDCTINLWQTNDFNAEDDLVSKKRKIGAQGEAFTTLVGHTQCVSAVVWPQRESIYSASWDHSIRKWDVETGKNLTDLFCGKVLNCLDIGGEGSTLIAAGGSDPVIRIWDPRKPGTSAPVFQFSSHMSWVSACKWHDQSWFHLLSASYDGKVMLWDLRTAWPLSVIESHSDKVLSADWWKSNSVISGGADSKLCISSEIPAQLPSVLSVVNKVLFCVANGYGLSIIFGMLDPNTNCAADAGQKAALLILFFSEILTAHPML

SEQ ID NO: 165717 - protein, 129 aa, Glycine max
  Coding DNA Sequence Number=SeqID_48939
MELGRDHNGAFVRAKTVATSGSPNPREAKAWALLQALKWIPQLDLTEIVIEFESDYKTVVDVLHTRFKGASEFFILYMKTVNQLSFYPSIGWAVKISEKKRIRRAAFCPASAAQLVLGSSIPKMIDTAS

SEQ ID NO: 165718 - protein, 87 aa, Glycine max
  Coding DNA Sequence Number=SeqID_48940
MSCSDQLGRTSGEFGLSEQIAHAAGDTASPAMAVQQHVSQGQIANGNGDLPCPRIASMASGAVVCFTPYTWFVSSSPLHITRDFSIL

SEQ ID NO: 165719 - protein, 70 aa, Glycine max
  Coding DNA Sequence Number=SeqID_48941
  Pfam annotation: Domain name=DUF292; Domain location=10-70; Score= -42.2; E_value=0.063; Accession=PF03398.5; Description=Eukaryotic protein of unknown function, DUF292
MHIKKAIKRARCRLRLLKNKRQAIARQLRKDLAKLIQSGHEETAFNRICLLMPHTHLLTTACVTIFFETD

SEQ ID NO: 165720 - protein, 59 aa, Glycine max
  Coding DNA Sequence Number=SeqID_48942
MRKKGYFPVEQLGRNYKCRLILLTWCFRCMWMLGPCAYSIADGEAKPVEGELSKSLLEN

SEQ ID NO: 165721 - protein, 96 aa, Glycine max
  Coding DNA Sequence Number=SeqID_48943
MAMGGSGTGIVSPIPYPDSSTYPHTCTRYPTDFKWRGGFGFGVGMGLVIPYPYPTFGYPGKPEPVPIPDQLEYYPSKSGRIRAGTHEYGFSCHVYL

SEQ ID NO: 165722 - protein, 187 aa, Glycine max
  Coding DNA Sequence Number=SeqID_48944
  Gene Ontology: Mol. function=oxidoreductase activity; Cellular component=mitochondrial outer membrane translocase complex; Biological process=aromatic compound metabolic process
  Homolog annotation: Hit_ID=Q2QWN2; Match level="QueryCoverage=89%, HitCoverage=44%, E-value=4e-44, Identity=48%"; Hit description =Flavin-containing monooxygenase, putative
MVYVGMSLLKYFKIEKVDKLMLLMSKLKYGDMSNYGLIRPKDGPFFLKKKGGTTPTIDVGCVSRIKKGEVKVFPAISSIKEDKLIEFEDGQNGQFDVIIFATGYNSTVLKWLKDYRGLFNENGMPKPDFPNHWKGENGIYCAGFSRRGLDGIAFDAKRIAADIKKTVNIKNLPSEEDNFASFKLLEK

SEQ ID NO: 165723 - protein, 196 aa, Glycine max
  Coding DNA Sequence Number=SeqID_48945
  Gene Ontology: Mol. function=transition metal ion binding; Biological process=electron transport
MCKCPTCGVSRYKVKDDESCDDATTKNNRPAKMACFDDHLQPPSLVVHQAKVMMIAVPRQPGNDIDMYLTSLIEDLRKLWEENESVPKPLARKEDYDWVKDIVSIFGKTQKKPSSETNIWNKKSIYFDLPYWSNLDSHDCHVLMQQLLAIAIQNILPDKVRVAITSLCFVFNAICSKVINPRQSDDLENEATIVLC

SEQ ID NO: 165724 - protein, 167 aa, Glycine max
  Coding DNA Sequence Number=SeqID_48946
  Gene Ontology: Mol. function=protein binding; Biological process =vesicle docking during exocytosis
  Homolog annotation: Hit_ID=Q1RVB0; Match level="QueryCoverage=98%, HitCoverage=23%, E-value=1e-71, Identity=84%"; Hit description=Sec1 -like protein
MQGFITNNERALVELFGDKENNSKAVACLNVMATRIAILFASLREFPFVRFRVAKSLDATTMTTFHDLIPAKLVASVWDCLMKYKKTIPNFPQTKTCELLIIDTTIDEIAPVIHEWTYDAMCRDLSNMEGNKYVHEKSTVFLMFLARSMVHLSEKRFSWTIMILYGS

SEQ ID NO: 165725 - protein, 76 aa, Glycine max
  Coding DNA Sequence Number=SeqID_48947
MAAELEQQTVELSSLVTRPANDKSSDSRLFDELAELDVVACNSMIMGLAKCGEAHGGIGAFPQNVVTKGLAKSIYN

SEQ ID NO: 165726 - protein, 133 aa, Glycine max
  Coding DNA Sequence Number=SeqID_48948
MDRSWMNESRLSPAYEEGVEQFLQFASERSRPDENGKFFCPCIYCVIDMQNGSQSRQESFQQAHVPMYDTLQTDSKKSLYPRCGVSRYKVKDDEACSSDENSKGPPMKVLWYLPIIPRFKRLFANGDDAKDLT

SEQ ID NO: 165727 - protein, 54 aa, Glycine max
  Coding DNA Sequence Number=SeqID_48949
MATYEWQHVSQLVPPIRMAIPAQSAFVPLLAMAVHMDIADGSGDTCLPPLAMGD

SEQ ID NO: 165728 - protein, 284 aa, Glycine max
  Coding DNA Sequence Number=SeqID_48950
  Gene Ontology: Mol. function=protein serine/threonine kinase activity; Cellular component=integral to membrane; Biological process=multicellular organismal development
  Homolog annotation: Hit_ID=Q5N7J0; Match level="QueryCoverage=83%, HitCoverage=51%, E-value=7e-58, Identity=67%"; Hit description =Putative dual-specific kinase DSK1
  Pfam annotation: Domain name=Pkinase; Domain location=70-275; Score= -8.4; E_value=4.6e-08; Accession=PF00069.15; Description=Protein kinase domain
  Pfam annotation: Domain name=Pkinase_Tyr; Domain location=70-276; Score=-67.5; E_value=2.5e-08; Accession=PF07714.7; Description =Protein tyrosine kinase
  Pfam module annotation: Pfam domain module=Pkinase::Pkinase_Tyr; Domain location=70-275::70-276
SFNCHAGLNIKGECRLITSQIDQKQNQSGFLPKHSDAPLLCTGCGTRTELSIKESMKFSYSDIQNATNDFSKDNLLGEGGYGHVYKGVLKDGQQIAAKWHQRYAIAVGTAKGLRFLHEECRGGPIIHRDMRPSNILLTHDFVPMLGDFGLAKWKTGDDTLQTRIMGTLGYLAPEYAEDGIVSVGTDVYSYGIILLQLISGRQVGNSNNPEQQQQQSLRQWAEPMIKNLALHELIDTHLGESYDTHELYLMAKAAYFCVQRKPEMRPSMGEVVYWILTFTSFLFG

SEQ ID NO: 165729 - protein, 74 aa, Glycine max
  Coding DNA Sequence Number=SeqID_48951
MEFEKAADPELPGHLLLEQYRAQLVSAVRTTLDTSSSPSLLEAGLHLATKSIVEYQQENIGRKWLKKAERKRIL

SEQ ID NO: 165730 - protein, 199 aa, Glycine max
  Coding DNA Sequence Number=SeqID_48952
  Subcellular localization annotation: CTP_CleavageSite=3; ConfidenceScore=5.29e-01
MAFAMMQSGSSDDSSRSVKRGDIVWVRVHFPHKWRPALVLSSRDNLGVQVTFSFSENDAVSPSPTFFVESEVVPFEEALPSLISRRNLDAPPLHSALRLLGLRVLSGLRCHCITGRAQAQQQPAREFDTVGVLGFVLDAAVSPWVEPAHFAHAVRVVAQVHAFRSYCSVKHRKMYKQNKKAVILAVNMILHSNSKRWRF

SEQ ID NO: 165731 - protein, 85 aa, Glycine max
  Coding DNA Sequence Number=SeqID_48953
  Homolog annotation: Hit_ID=Q1SW19; Match level="QueryCoverage=75%, HitCoverage=6%, E-value=1e-11, Identity=53%"; Hit description =Disease resistance protein
MTNDYKGNMIDDPIILFIFQNNALNKFSWHIKKVKNFKVNQGFDARGYLLEMSDFDYCKRFKTRQGVKSVKPGKADDGGGSGARH

SEQ ID NO: 165732 - protein, 234 aa, Glycine max
  Coding DNA Sequence Number=SeqID_48954
  Gene Ontology: Mol. function=4 iron, 4 sulfur cluster binding; Cellular component=integral to membrane; Biological process=electron transport
  Homolog annotation: Hit_ID=Q19KB4; Match level="QueryCoverage=85%, HitCoverage=47%, E-value=1e-121, Identity=99%"; Hit description=PSI P700 apoprotein A2
  Pfam annotation: Domain name=PsaA_PsaB; Domain location=1-220; Score=- 130.6; E_value=0.00023; Accession=PF00223.9; Description=Photosystem I psaApsaB protein
PGDFLVHHAIALGLHTTTLILVKGALDARGSKLMPDKKDFGYSFPSDGPGRGGTCDISAWDAFYLAVFWMLNTIGWVTFYWHWKHITLWQGNVSQFNESSTYLMGWLRDYLWLNSSQLINGYNPFGMNSLSVWAWMFLFGHLVWATGFMFLISWRGYWQELIETLAWAHERTPLANLIRWRDKPVALSIVQARLVGLAHFSVDRELIIETLDYPDTYFVKWFMHVYCPVQQDPV

SEQ ID NO: 165733 - protein, 340 aa, Glycine max
  Coding DNA Sequence Number=SeqID_48955
MLGWILGMLDGCQANKSMFLHRTSAICLCSWLVRAFFDGVFSRVNVECVTREFFDNAHDLTAYNLIVATTKEGMRFARFSDRRIRGNLQALYIALSDLLLVCHDSDNFSRQGRELHFEDFGHHKVGNDNRDDHRVILVDGVVAFEIIVNEGYKRKNSRRLDVNNVDIEIFDGMETMLLGLVHLPALVRVGAHVFVGDASISLYPFFCLPFYLVYDLFFCDGPHCALRGPTVFGVVTMVVVVPTMLSSIQTSIDCLLKDGGPIFRQGAATLPGSSPWRSSISVMRAWSCQSGSLSVMVVVRVGLEFYGGVSLLSSGRVLAICAGGIRDKGSNMVNSLKAKA

SEQ ID NO: 165734 - protein, 190 aa, Glycine max
  Coding DNA Sequence Number=SeqID_48956
  Gene Ontology: Mol. function=DNA binding; Cellular component =mitochondrion; Biological process=DNA integration
MTEKVALTLITSARCLMPYFQSHQIIVMMDHPIKQVLRKPGLGSEEDIILERANNITLEWALKFNFRGASNNQVASEALIASLKLEKEVGARKLRCYGDLQLVQGQVANRYQAKEAVLLRYYHALKTLVNDFDCFEMYHIPMESNTMAYLLSKLASTKKTGHLKTIIQDALQAPTRETKEVMVEKVEELD

SEQ ID NO: 165735 - protein, 354 aa, Glycine max
  Coding DNA Sequence Number=SeqID_48957
MGDFEWRPLVKQLGIASEDMPSPLTITPESSGEEGGQARVDPPRSSEADDDEVVKVTLDVLPSTTTKRKCNEGARGSGQHKKSRAPFSLRALKEATELMSSSIMFASLVVPVAVPVSTPFSLVLLLSVGVATTSVSSPPPSALPPSAPTVMPSTMPSSSLRPSVSLDCVYTSQEANSIRGTKLDRCCEGLPSTDFCYLGGKWAKTYTEALNKIESLEVDVIKWKATVRTVLQPERPKVATATVALVEAVRNHLASKVEHTTEEKEKLIVIVAKSAKVIADLEARLKELELNEVMEQHEKGFFKAIKQARFFIEGLNLGLFDPFRDVKDDELLDEEEIDVGEEDINEEENDGTNV

SEQ ID NO: 165736 - protein, 139 aa, Glycine max
  Coding DNA Sequence Number=SeqID_48958
MGTCKKELRCSMMGGNLRSLPKRLLQLYNNLISQIIITTITITIPATTITMMVAITTIMIVVVAVTIIGKDSSGDKSGDYVASDVDSHGCNHSIVGGGGGSNDDNNHVGGDSGSHGSGHDNCGRNCYDGGRGDDKFEMF

SEQ ID NO: 165737 - protein, 80 aa, Glycine max
  Coding DNA Sequence Number=SeqID_48959
MYFYTKLPNPLSLSSEELIMVEEARQAAEKAYDMAKVDEGVNRAVAASNRAANAARVAAVKAVQKQNYHVNSESFSIPVV

SEQ ID NO: 165738 - protein, 86 aa, Glycine max
  Coding DNA Sequence Number=SeqID_48960
MNAGGRGSSFITTVVGIKCTYINLEQIDVKVDRHQVPRSPTSDFLSAQKPGCSASSIYVPILWLMGRTDVYILMPRLLPYQFVDLE

SEQ ID NO: 165739 - protein, 197 aa, Glycine max
  Coding DNA Sequence Number=SeqID_48961
  Gene Ontology: Mol. function=RNA-directed DNA polymerase activity; Cellular component=intracellular; Biological process=RNA-dependent DNA replication
MVRKANGKWHMCTKYTNLNKAYPKGVYPLPSIDKLVDDASGFQLLSFLDAYSGLMDQVFKHQIGRNVKVYMNDMVVKTYCMAQDVANLEEVFGEIHKFDMRLNPEKCTFKANPDKCMAILEMQSPTNVPSKTHRKMKPFFKLLRKIKPFSSDKACEQAFLAFKKVIATPQVLNQPKPGSPLLLYLSMVEETISSTLI

SEQ ID NO: 165740 - protein, 119 aa, Glycine max
  Coding DNA Sequence Number=SeqID_48962
MGKGYLQKGIMKLKLSSVEGSNLDKFDGHRPNKPPQPGQALSGLWLTGMRGSDSRGSVRQPMVEREVVPIEDSSSEEVPHEVSDNGSSPFERLISFDNVGEGSYELHTGIESPTALTED

SEQ ID NO: 165741 - protein, 110 aa, Glycine max
  Coding DNA Sequence Number=SeqID_48963
MKLTKGGPWVCRASRDLTRDAFILGLVRLTKDKPWIRQDSPRVDHGFYKPWRFDKTHPGRTLGLTSLGDSTRDAFILDLARFTRMDLGFDEPLKIQQDSPRADFAFDEPL

SEQ ID NO: 165742 - protein, 199 aa, Glycine max
  Coding DNA Sequence Number=SeqID_48964
  Gene Ontology: Mol. function=caspase activity; Biological process =proteolysis
  Homolog annotation: Hit_ID=Q7XJE6; Match level="QueryCoverage=56%, HitCoverage=30%, E-value=4e-31, Identity=62%"; Hit description =Metacaspase 1
MDMSIVSAQSIKRKHHRSDKSDRSKRKKDEGRTREHDDGRFWKAELVDEEVLHAFGVVDATLELVAGEAVGDADDDGLLAAVGVGRGRRGAVGGGRRRVGGSRGLRREGAWVADEGDGVAEGAADGSRAKWQLQRGAAVGAVHQHVAVHRWVKETVKGATRMYSGKYDSKMGLTLVMAYGVTFGHFSGVETAFYMLSGN

SEQ ID NO: 165743 - protein, 94 aa, Glycine max
  Coding DNA Sequence Number=SeqID_48965
MFLQKAVASGGSNQGCLGELGGKLLPYFPIYRGKSEGERGSTLLVSEIHIKLVTKIVSVKKIQVEGFPWVISRRFSTVLHRSSFVLRRSSVFNR

SEQ ID NO: 165744 - protein, 488 aa, Glycine max
  Coding DNA Sequence Number=SeqID_48966
  Gene Ontology: Mol. function=UDP-N-acetylglucosamine 2-epimerase activity; Biological process=UDP-N-acetylglucosamine metabolic process
  Homolog annotation: Hit_ID=Q8ZAE3; Match level="QueryCoverage=65%, HitCoverage=85%, E-value=1e-156, Identity=83%"; Hit description=UDP -N-acetylglucosamine 2-epimerase
  Pfam annotation: Domain name=3HCDH_N; Domain location=326-437; Score=- 109.9; E_value=0.038; Accession=PF02737.8; Description=3-hydroxyacyl -CoA dehydrogenase, NAD binding domain
  Pfam annotation: Domain name=Epimerase_2; Domain location=1-330; Score=566.3; E_value=3e-167; Accession=PF02350.9; Description=UDP-N -acetylglucosamine 2-epimerase
  Pfam annotation: Domain name=NAD_binding_2; Domain location=326-488; Score=-80.3; E_value=0.036; Accession=PF03446.5; Description=NAD binding domain of 6-phosphogluconate dehydrogenase
  Pfam annotation: Domain name=UDPG_MGDP_dh_N; Domain location=327-488; Score=198.0; E_value=2.3e-56; Accession=PF03721.5; Description=UDP -glucoseGDP-mannose dehydrogenase family, NAD binding domain
  Pfam module annotation: Pfam domain module=3HCDH_N::Epimerase_2::NAD _binding_2::UDPG_MGDP_dh_N; Domain location=326-437::1-330::326 -488::327-488
MLDQVLRLFEITPNYDLNIMKPGQGLTEITCRILEGLKGVLEDFKPDVVLVHGDTTTTLATSLAAFYQRIPVGHVEAGLRTGNLYSPWPEEANRKLTGHLAMYHFAPTENSRQNLLRELLPDNRIFVTGNTVIDALFWVRDRVMSDAALRAGLAQRYPFLDADKKLILVTGHRRESFGGGFERICSALAEIARNHPEVQVVYPVHLNPNVSEPVNRILKGIDNVMLIEPQDYLPFVYLMTQAYMILTDSGGIQEEAPSLGKPVLVMRDTTERPEAIDAGTVRLVGTDVTKIVEAVTRLLTDESEYHAMSRAHNPYGDGHACDTMSFDTISVIGLGYIGLPTAAAFASRKKKVVGVDVNQHAVDTINRGAIHIVEPDLDKVVKDAVDGGFLRAVTKPLAADAFLIAVPTPFKGDHEPDLAYVEAAAKSLAPVLKKGDLVILESTSPVGATEQMADWLAQARSDLSFPQQAGEAADVNIAYCPERVLPGQ

SEQ ID NO: 165745 - protein, 225 aa, Glycine max
  Coding DNA Sequence Number=SeqID_48967
  Gene Ontology: Mol. function=RNA-directed DNA polymerase activity; Biological process=RNA-dependent DNA replication
MVEREKFDHIEERLRAIEGGRDYAFANMAKLCLVPDVVIPPKFKVPYFYKYKGTTCLKNHLKMYSRKMGAYFKNEKLLTHFFQESLTGAAITWQYQHNSNMSPDRMKLQNMCMKKHESFKVYAQGWRDLAAQVAPSMMEREMITMIVDTLPVFYYEKMVGYMPSSFENLVFTGERIQVGLRRGKFDYAASMNSGDRRPRENGGNKKKGETHVVAAVPTWPNFPLA

SEQ ID NO: 165746 - protein, 117 aa, Glycine max
  Coding DNA Sequence Number=SeqID_48968
  Gene Ontology: Mol. function=transferase activity, transferring glycosyl groups; Cellular component=cytoplasm; Biological process =nucleoside metabolic process
  Homolog annotation: Hit_ID=Q9FKS0; Match level="QueryCoverage=98%, HitCoverage=25%, E-value=2e-26, Identity=52%"; Hit description =Uridine kinase-like protein
  Subcellular localization annotation: CTP_CleavageSite=60; ConfidenceScore=5.09e-01
MMSEETTSIDYVMEAASRSHFSALRLDGQVPSSATAPSSTLDSTLTLNSLPNQPFAIGVSRGTASGKTTVGNMIIQQLHDHCVVLVNKDLFYHGLNPEKLKRVHKYNFNHPDAFDTK

SEQ ID NO: 165747 - protein, 40 aa, Glycine max
  Coding DNA Sequence Number=SeqID_48969
MLFLCHRAPPHGHTGARSPPSWHQSGVRGTSPPPAMRSGA

SEQ ID NO: 165748 - protein, 53 aa, Glycine max
  Coding DNA Sequence Number=SeqID_48970
MAVVGAAGPLQLQVLHGGKQNVRVVAGWSSRRDEVVQAIAGALGRCTYKHRLL

SEQ ID NO: 165749 - protein, 140 aa, Glycine max
  Coding DNA Sequence Number=SeqID_48971
  Gene Ontology: Mol. function=RNA-directed DNA polymerase activity; Cellular component=intracellular; Biological process=RNA-dependent DNA replication
MCVDYTDLNKNCLKNLYLLPSMDKLIDNSLGFKFFTSMDAYSRYNQIPLHHSNQEKISFTIERENDCYKSLTKELHIKDLEETFQCLDTFNIKLNPTRWTFGASAGKFLGFMLMERGIEVNLDKCKAVLTMQSHKNVKKV

SEQ ID NO: 165750 - protein, 54 aa, Glycine max
  Coding DNA Sequence Number=SeqID_48972
MVGLCVICGCGELTCTIARPPPSTTYDGVVPGDMSWGSGDLGDVRWGAIAQNQA

SEQ ID NO: 165751 - protein, 167 aa, Glycine max
  Coding DNA Sequence Number=SeqID_48973
  Gene Ontology: Mol. function=receptor activity; Cellular component =integral to membrane; Biological process=intracellular protein transport
  Homolog annotation: Hit_ID=Q9SJL6; Match level="QueryCoverage=84%, HitCoverage=63%, E-value=1e-45, Identity=64%"; Hit description =Membrin 11
  Pfam annotation: Domain name=V-SNARE; Domain location=1-144; Score =62.3; E_value=1.5e-15; Accession=PF05008.5; Description=Vesicle transport v-SNARE protein
MNLRGEERESVIERKTQRFNTVFRKVEQIAEEAESLRASLDKYNLRNQKRMREANERAELLGRANGDSAHVLRIYDEEAQALQSVRSSSQELENANALGEAILSSIHGQRERLKSAHRKALDILNTVGISNSVLRLIERRNRVDQWIKYAGMLLTVIFLLAFIMWRH

SEQ ID NO: 165752 - protein, 335 aa, Glycine max
  Coding DNA Sequence Number=SeqID_48974
  Gene Ontology: Mol. function=RNA-directed DNA polymerase activity; Cellular component=chromatin; Biological process=chromatin assembly or disassembly
  Homolog annotation: Hit_ID=Q8LLX2; Match level="QueryCoverage=71%, HitCoverage=44%, E-value=5e-20, Identity=30%"; Hit description =Putative retroelement
MGVEIEGKILPDAERDGDTQMTSDRGGMEFDQQGLDEGITGILPDGMQHGLPELKQATIEKLDSSEGLVNETLTLGKWFNAGKSDRHDIGNTGLAPVIRKYSKLVAEQILAPFMDSSGDSVQFANESTQILLIGGNGSVYNSLDLGLLGFNSFAGNDVPQVLQLSLGEQTFGAFEQGFAVDLDVVKEYSGELAQEWLKECIHHGLKSLSLENQEAWSRSSKSSSIVDIEKRSFTEVDVIDDLLRRWKVSRCLEDGSKFGKDSFNGGYRKMLNLWGRNVCRPRSNVNVKLHKLAQMGESHSKSDVISSYRAQMLKPFNSQNDIDSTNGNMWRVTVN

SEQ ID NO: 165753 - protein, 328 aa, Glycine max
  Coding DNA Sequence Number=SeqID_48975
  Gene Ontology: Mol. function=chitin binding; Cellular component =extracellular region; Biological process=chitin metabolic process
  Homolog annotation: Hit_ID=UPI000044A8F0; Match level="QueryCoverage =79%, HitCoverage=99%, E-value=2e-35, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
DLLLSHKDGPVGTSTLTFRGLYILAFRGLHVLAIRGLRVLAIRGLHVLAFRGLHVLAIRGLHVLAFRGLHVLTIRGLHALTFRGLLVLAFRGSCTFTFKRLHVLAFRGLHVLAFRGLHGLTFRGLHTLTFRGLHVLTFRGLHPLIFKGLHALTFRGLHVLTFRGLHPLIFKWLHALTFRGLHVLAFKVLHALIFKGLHAFTFRGLHALTFKGIHAFIFKGLHALTFRGLHVLALRGLHVLAFGGLHALVFRGLYVLPLRGLHVLAFRGLRSPSPFEGYASSLSGQLCKHNQRKAIAQLLCIPGQAFTRATGKRRVWIMRTNMTTLKQI

SEQ ID NO: 165754 - protein, 200 aa, Glycine max
  Coding DNA Sequence Number=SeqID_48976
  Gene Ontology: Mol. function=RNA-directed DNA polymerase activity; Cellular component=exocyst; Biological process=RNA-dependent DNA replication
  Homolog annotation: Hit_ID=Q1T5Q8; Match level="QueryCoverage=78%, HitCoverage=28%, E-value=1e-35, Identity=41%"; Hit description=RNA -directed DNA polymerase
MADPQLLNDYRPISLIGSNEVIEEAKRSKKSCLVFKVDYEKAYDSVSWDFLLYMLRRTCFSSKWIKWIEGCLRSVSISILVNGSPSAEFIPQRELRQGDPLAPLLFNVVVEALNRLLKKAVEKNLFRGFPVGSNNARISILQYADDTIFFGEATMENVKVMMQSYPAKALDRRLQVDWARDPREGPRVLISLRVDFEPMG

SEQ ID NO: 165755 - protein, 322 aa, Glycine max
  Coding DNA Sequence Number=SeqID_48977
  Gene Ontology: Mol. function=ATP-dependent helicase activity; Cellular component=intracellular; Biological process=multicellular organismal development
  Homolog annotation: Hit_ID=Q8RYE1; Match level="QueryCoverage=93%, HitCoverage=37%, E-value=9e-55, Identity=52%"; Hit description =Putative RNA helicase A
MGEMLPSNPHLCLILMSASVDAARFSQYFGVCPIIYVPGLTYPVKTYYLEDVLSIIKSGADNHELSQVEKLSLDDAINLAWSNDEWCSLLELVYSKASPKVFDYQHSLIGLNPLMVFARKGENCHLRAKDGTTALEISEKENQQVVVELLKKHMDNDFSNQEGKNLLDKYLATVNPKVVDVVLIEQLIKKIYIGLVKEKSYDPYHNVFTLQSSWISKASAKQREGCASRCHLGICYRLYSKVQVASLPDFQVPEIKRMLIEELCLQGKFGDTLKKVKKIEADLNKMEEDTIHRQLSPQEVLTKKQLQEALWVAAQSHESLPR

SEQ ID NO: 165756 - protein, 263 aa, Glycine max
  Coding DNA Sequence Number=SeqID_48978
  Gene Ontology: Mol. function=RNA-directed DNA polymerase activity; Cellular component=extracellular region; Biological process=RNA -dependent DNA replication
  Homolog annotation: Hit_ID=Q1SRI1; Match level="QueryCoverage=82%, HitCoverage=41%, E-value=2e-28, Identity=28%"; Hit description=RNA -directed DNA polymerase
  Subcellular localization annotation: CTP_CleavageSite=23; ConfidenceScore=5.41e-01
MAPPLTYSPLSSTASPWWKITIEAQRSSLHRSPTSKLPSGLKINFAKSSFGAIRVPDQWKQLAANYLNCNLLAIPFVYLGIPIGANLRRCQLVPNRVVDKLVSLQQRFLWGGRPEHNKIAWIKWETVCLPKEKEGLGLKDIKTLNLALLGKWKWNLFQHQGQLWATVLESKYGGWRSLDTTSRVTNELIWWRDLKMAFLHMQQGRALQNGTMWRVGCGDRIKFWEDIWVSWEETLSAKYPRLYLISCQQNQIIRKMGDQKDIG

SEQ ID NO: 165757 - protein, 95 aa, Glycine max
  Coding DNA Sequence Number=SeqID_48979
  Subcellular localization annotation: CTP_CleavageSite=32; ConfidenceScore=5.15e-01
MTGSVMTWMPPLLPAGKLVPPLTTAGTRIPPLATAALSLNRQYERRDRRERGCIADSNGGTGEREAVPLFLLAGHANVAVPPLPPAEHLHVSGLQ

SEQ ID NO: 165758 - protein, 209 aa, Glycine max
  Coding DNA Sequence Number=SeqID_48980
MAKSNSSRLGFPSLITALCIARGVVSDSLMFESLSPAINLAYIRKNCWNPEDPSITFPGSRKATTQAPSDALTPTLALVPPPPAPISTPAGPSAPSSDTIVPMLQSIHHGLCLVMQSMQNLSQQQPIMSMEDFLEQVAWPEVQPSFLGGDSLSEIDWLSEPHLLSKAASSLRECKTLEDDQPESSALSTQPARPTRTLSPLVLSAPKLS

SEQ ID NO: 165759 - protein, 190 aa, Glycine max
  Coding DNA Sequence Number=SeqID_48981
  Gene Ontology: Mol. function=RNA-directed DNA polymerase activity; Cellular component=chromatin; Biological process=chromatin assembly or disassembly
MPDAYVSTVKGREKSDKSKTGAVPVQRCHDRRIPADKLLIKPGWSITQAKGHYPEFVVTMMCAKSCLTNVIFMHQNLVITLKKIQLQKPSGTAKFIKELINEDRGGEKASARSDEPLLQHGINLGFNFVFLKIRVTIRANFDKLRVGTKVDIVIGVSWQFGLKGIQRGQCEYERKHWHHPYELGDEVELE

SEQ ID NO: 165760 - protein, 87 aa, Glycine max
  Coding DNA Sequence Number=SeqID_48982
MQDVHCINKKFCGQKFEESSGSLFVNCDQCYQWQMAEHGRRPKFRHITCIVDCTLWCHQGKPLHKLPMAVDKKSATPFHHGSAMVTI

SEQ ID NO: 165761 - protein, 385 aa, Glycine max
  Coding DNA Sequence Number=SeqID_48983
  Gene Ontology: Mol. function=RNA-directed DNA polymerase activity; Cellular component=chromatin; Biological process=chromatin assembly or disassembly
  Pfam annotation: Domain name=RVP_2; Domain location=289-385; Score= -62.5; E_value=0.073; Accession=PF08284.2; Description=Retroviral aspartyl protease
  Pfam annotation: Domain name=zf-CCHC; Domain location=216-233; Score =7.9; E_value=0.05; Accession=PF00098.13; Description=Zinc knuckle
  Pfam module annotation: Pfam domain module=RVP_2::Retrotrans_gag::zf -CCHC; Domain location=289-385::36-126::216-233
MKLEVPRFDGADPVGWIFKINQFFEYHSTPEHECLTIASFYMEGRALTWFQWMTSNGHLTSWPIFLQALQTSFAPSQYEDPTRALFKLTQRNKVNAYLSEFEDLANRIIGLPLPFLLSCFISGLTPEIFREVQALQPLTLVQAAGLARLQEETFLDSRCLWCGRTTSISSSFTILSSTTFVVSSSSPLLLAPQKATLSLPIKRLPLEELALWWEHGLCFNCDRKFHRDHKCTSKVFLLIVDEDEGLQEDNLELGLLPDLPNTQISHLAQIILHILSGHLAPETLRLLGHIADQQVVILVDEGSTHNFVQEHLVHSLGLPTRATPPVRVMVVNGHQLHCHLLCEAFLICVQGVTFFVDLHVLSLCSANLVLGIQWLKSLSPILTNG

SEQ ID NO: 165762 - protein, 131 aa, Glycine max
  Coding DNA Sequence Number=SeqID_48984
MAKKMMIKFDKYWVVIHDIMGVATVLDPRYKMELLQYYYEKLYEHDCFAQVSKIRQLCYDLVSDYQFKMNGDSFHRSPIPEDGNVEGDELCEFDNILKSKILAQSDTLVNEIASNDEGDNASDMMGSVLTI

SEQ ID NO: 165763 - protein, 86 aa, Glycine max
  Coding DNA Sequence Number=SeqID_48985
MERRRRSRRWHDGRGRWRLTGESGVRNLWISMSILRPSSWTFPLDWVVLVVCSSYQNHKIATPEVDLLSSGLTAQSSSQNALIEKA

SEQ ID NO: 165764 - protein, 192 aa, Glycine max
  Coding DNA Sequence Number=SeqID_48986
  Gene Ontology: Mol. function=RNA-directed DNA polymerase activity; Biological process=RNA-dependent DNA replication
MTFVRQLFAHIMVTTNSGSSILVTWSLLKELSLFWRKSKISSNGPYHNLLGPCEAFWVLPGFINSLSAANPLALKYFKLPPMSGSFSLSPWQWRNGEANVEAIDVPYHTHGSQMLYCKIPEPLSSTLLLLLVPYLTFLEELKQQISHDQAFLQLRQTISDEPMTYPDYSIAQDLILKEGQIWLLQASPFIPT

SEQ ID NO: 165765 - protein, 320 aa, Glycine max
  Coding DNA Sequence Number=SeqID_48987
  Gene Ontology: Cellular component=cytoskeleton; Biological process =transport
  Homolog annotation: Hit_ID=Q9FNN2; Match level="QueryCoverage=74%, HitCoverage=47%, E-value=3e-59, Identity=46%"; Hit description=WD -repeat protein-like
MRRLGGLAACPGELELFTPKLFGGPERKKEQTKKREEGEEAVKRRTKKHAEGGIGGAPPAIAHRRRRTSDRCSCFSGVLFMGGVEDEAPALKRMKLSSKGLVGLSNGSSGEPVGGSSSDLMARPLSSEGDGEVIGSKGVIKREEFVRIITKALYSLGYKKSGVRLEEESGIPLHSSVVNLFMQQILDGHWDESIVTLNKIGLADENVVQAASFLILEQKFFELLDGEKVMDALKTLRTEITPLCSDSSRIRELSSRMLSPCGQVGSSKRDIVLALVLQREACLFHNSLDKEMSLYSDHHCGKTQIPSRTSQVRKRYVSLV

SEQ ID NO: 165766 - protein, 70 aa, Glycine max
  Coding DNA Sequence Number=SeqID_48988
MYTVQFCALKGPIGLSQDMTPTPKCMKTQELQIMRLLDHPNVVNPHTHQVRLWKCKSLGMFYVKGEPNIS

SEQ ID NO: 165767 - protein, 281 aa, Glycine max
  Coding DNA Sequence Number=SeqID_48989
  Gene Ontology: Mol. function=protein dimerization activity; Cellular component=nucleus; Biological process=regulation of transcription, DNA-dependent
  Homolog annotation: Hit_ID=Q8LNK9; Match level="QueryCoverage=63%, HitCoverage=23%, E-value=2e-39, Identity=47%"; Hit description =Putative transposable element
  Pfam annotation: Domain name=zf-BED; Domain location=79-124; Score =30.6; E_value=5.5e-06; Accession=PF02892.5; Description=BED zinc finger
  Subcellular localization annotation: CTP_CleavageSite=56; ConfidenceScore=5.26e-01
MKWQIKQVDIKIGPDYTPSPFLGPSYTSLPFPGPSYTPSPFVGHAPSTTPNESIPSPKAKKTIDNLEGTTQTGTSRLKSEIWKHFQKVKVNGQDKNQCNYCSKLLGGKSKNGITHLWGHKQICIQYKVAMRGSTGHAFLVPKVVHGKQELGTRTYGADNTRIELANAIIMHEYPLSIVDHVGFRRYSTALQPIFQDSCRNTIKREIFRIYQEERSITLKLLDSLQGRIDITSDMWTTSNLKRGYMTITAHYCGSNIFQDYFDDAKESRVKQVSRIKIKIQE

SEQ ID NO: 165768 - protein, 226 aa, Glycine max
  Coding DNA Sequence Number=SeqID_48990
MSVLEETTLTPSRSKDLGHQKSTHNQDNTNLYLCPHYLQIEVAREKIPIVHSTWKDAPECLKNNIWDDILGKFDIHEGTSAKKVMSTVATRWRQFKSSLTTRYVYSEKDNEHNHDPSGYDLLEKKLMAEKTKARLHEAEFTENTDRVVDPSSPISRHVKMNYRNKQHRELLSHMVIVATYPSAGGRRVTRGMRVPRKEYARSRHQRLFEENVGKTGKDAIYELLSE

SEQ ID NO: 165769 - protein, 84 aa, Glycine max
  Coding DNA Sequence Number=SeqID_48991
MYVVYIHGGCNDHIGYLWRGKEGLRIISIPEEGRGLLIIFNYPRKNASTWGHITQFKTSLRLMLITMRGVACAGKGDLMPSFPK

SEQ ID NO: 165770 - protein, 86 aa, Glycine max
  Coding DNA Sequence Number=SeqID_48992
MEVDEPWLGLWLPLNYQVDMGASQHRTLEFGVNSTGFLTAKFISWLVFWFMLKVVFVIRSAVVTARVSPSSSPSSFALVFSFVQAG

SEQ ID NO: 165771 - protein, 61 aa, Glycine max
  Coding DNA Sequence Number=SeqID_48993
MNLFLSAVHVSSTIEAGAPRIDFLEPAVHVSSTIEAGAPRNNCLALFAYPPPSTLNRRPMN

SEQ ID NO: 165772 - protein, 139 aa, Glycine max
  Coding DNA Sequence Number=SeqID_48994
MKLMPSSRCVMPESIASKRSPTKAQRSLSSMRTSFNKEDEESYCGGGEGVHSSRIRGGKLCLHTHWPSKSFRYPKEATAPAPIAKDCLTLTNEKRVKDHGEERKELGDAGGSPDVPWRRCPALVVVEVEPFLLFDGSAI

SEQ ID NO: 165773 - protein, 64 aa, Glycine max
  Coding DNA Sequence Number=SeqID_48995
MGITTIKRGLRFFASCNGKEKGMLKIREETGKEGERERTVRRMITTRITPRKPREKAEDAARFV

SEQ ID NO: 165774 - protein, 391 aa, Glycine max
  Coding DNA Sequence Number=SeqID_48996
  Gene Ontology: Mol. function=protein binding; Cellular component =cytoplasm; Biological process=heat acclimation
  Homolog annotation: Hit_ID=Q8LDN3; Match level="QueryCoverage=91%, HitCoverage=97%, E-value=1e-148, Identity=72%"; Hit description=F -box protein AtFBL5
  Pfam annotation: Domain name=F-box; Domain location=60-107; Score =27.9; E_value=3.6e-05; Accession=PF00646.23; Description=F-box domain
  Pfam annotation: Domain name=LRR_1; Domain location=178-201; Score =5.8; E_value=24; Accession=PF00560.23; Description=Leucine Rich Repeat
  Pfam annotation: Domain name=LRR_1; Domain location=231-252; Score =3.0; E_value=80; Accession=PF00560.23; Description=Leucine Rich Repeat
  Pfam annotation: Domain name=LRR_1; Domain location=257-280; Score =3.1; E_value=74; Accession=PF00560.23; Description=Leucine Rich Repeat
  Pfam annotation: Domain name=LRR_1; Domain location=283-311; Score =3.3; E_value=67; Accession=PF00560.23; Description=Leucine Rich Repeat
  Pfam annotation: Domain name=LRR_1; Domain location=325-352; Score =4.9; E_value=35; Accession=PF00560.23; Description=Leucine Rich Repeat
  Pfam module annotation: Pfam domain module=F-box::LRR_1::LRR_1::LRR _1::LRR_1::LRR_1; Domain location=60-107::178-201::231-252::257 -280::283-311::325-352
MTSTLFVCLGLRISDFGVESMVGKESLRTEVLNLSFEKLMMVECGGNSGKGVNIKAGVITEWKDIPVELLMQILSLVDDQTVIIASEVCRGWREAICFGLTRLSLSWCSKNMNNLVLSLSPKFTKLQTLILRQDKPQLEDNAVETIANFCHDLQILDLSKSFKLTDRSLYAVALGCRDLTKLNISGCSAFSDNALAYLASFCRKLKVLNLCGCVKAASDTALQAIGHYCNQLQFLNLGWCENVSDVGVMSLAYGCPDLRTLDLCGCVLITDDSVIVLANRCPHLRSLGLYYCQSITDKAMYSLAQSKLNNRMWGSVKGGGNDDDGLRTLNISQCTALTPSAVQAVCDSCPSLHTCSGRHSLIMSGCLNLTSVHCVCAGQAHRAITLPHAAH

SEQ ID NO: 165775 - protein, 136 aa, Glycine max
  Coding DNA Sequence Number=SeqID_48997
MLKEKSIQQKQNIEKNVEKAGKKKEKRKSGAEALQSCDRGSLPLSFLFVVLGIQPTVGTYQVDAHINTNKNFKGNCSRSILDLIGATILEVLHQVDAYINTNIDFRGNYFGSTFGLTCGPWPTVATKPTFPPSTTV

SEQ ID NO: 165776 - protein, 98 aa, Glycine max
  Coding DNA Sequence Number=SeqID_48998
  Homolog annotation: Hit_ID=Q3S4A7; Match level="QueryCoverage=74%, HitCoverage=7%, E-value=8e-16, Identity=60%"; Hit description =Cytokinin independent 2
MESDCIEDMDIEVLSSMWPEDVGTDVGKPFNIEKSGTDHDILEEVTMIEEPTNTNLQRLMELTNYTDKGSSQLTYKHDMLSWTNRPRLRNEFAFKCEG

SEQ ID NO: 165777 - protein, 134 aa, Glycine max
  Coding DNA Sequence Number=SeqID_48999
  Subcellular localization annotation: CTP_CleavageSite=48; ConfidenceScore=5.04e-01
AHLAKPHPESSSILPSPLALCPQSIHPLTGRRTCVLCIVPALRVAIVNQAKYSKLLPIEVADSKQPLQKAIVNLDDVTIIISKDGYEDIIILADNFAAFNQRSLVPVKVASGSWWKYANRAVSNQIKSCILETC

SEQ ID NO: 165778 - protein, 134 aa, Glycine max
  Coding DNA Sequence Number=SeqID_49000
MDQQQLGGRYPWSSSKDRSDERHMESRIFVRGNKIDFHSFKNFHGSSEFVLPICKEVSLTIFSKSYHKMVDSITIEDEKRRVTRVPLSMLVGLGSSSSMGSFASWKMNGSGMEKEEREETPLQGEDESRRSSPP

SEQ ID NO: 165779 - protein, 135 aa, Glycine max
  Coding DNA Sequence Number=SeqID_49001
MQELTPEEEREWKELAKKIQDTAAPPDAIFVTISARDQIFGEVGKVYAVKFKDVLKGLWHLVDRDDTYHIVVYNRDLDQPAIVAGWTTLCHFYHLTADHLGSLPAEVIPQVALFVSSSAMFYDLQGFSYLAENFP

SEQ ID NO: 165780 - protein, 50 aa, Glycine max
  Coding DNA Sequence Number=SeqID_49002
MAASMLRNKHVHELDCICPFKPWQQVIQTCNEYYEKDPPDEGWVTLNTDG

SEQ ID NO: 165781 - protein, 59 aa, Glycine max
  Coding DNA Sequence Number=SeqID_49003
  Subcellular localization annotation: CTP_CleavageSite=22; ConfidenceScore=5.05e-01
MFPWAISRRFSTILHRSSFVLRRSSVFNRSDFLITNEEYVGARETPLSTTKRFKKYKKA

SEQ ID NO: 165782 - protein, 480 aa, Glycine max
  Coding DNA Sequence Number=SeqID_49004
  Gene Ontology: Mol. function=zinc ion binding; Cellular component =nucleus; Biological process=regulation of transcription, DNA -dependent
  Pfam annotation: Domain name=FAR1; Domain location=24-208; Score =23.8; E_value=2.4e-08; Accession=PF03101.5; Description=FAR1 family
MTEENGDWKPKIGLELQDVEEAWKFWSKYGEKEGIRKPNKRDGQATKHRTETRTNRSVRVGLSLGKNGKYIIHEFVGKHKHPLQLPETTHMLASHRKITEVQAHEIELGEDSGLCQKASFQLMSTHVGHKANIGYTRLDAKNYLKAKRQRNMVYGEVGCLLQCFQQQLLENPSFFHAYQMDIDEQITNVFWADAKMVLDYEYFGDVVSLDTTYCTNQANRPLALFSGFNHYRSSTIFGATLLYDETVESFKWLFKTFLEAHSHKKPQTIFTDQDQAMAKALVEVMPETHHDFKKCMYEFDTKVEFEEEAFTLGMQSTQISESLNSHFKACMKPDVVPEKYILKRWTREGRSGIMHDFREREVEKDPRLSSTKRYRHLASKLIRVTSDVSPSKEYCQLVDESIDVVFKKIKELRLQAQSTNKNKNGVAALVINDDTQPKGFKQRPSTKRHNQKHLKSWLELQLKKKTKTITRCQSRSQTSK

SEQ ID NO: 165783 - protein, 287 aa, Glycine max
  Coding DNA Sequence Number=SeqID_49005
  Homolog annotation: Hit_ID=Q2HRX8; Match level="QueryCoverage=48%, HitCoverage=20%, E-value=1e-14, Identity=34%"; Hit description=IMP dehydrogenase/GMP reductase
  Pfam annotation: Domain name=DUF1723; Domain location=254-287; Score =20.3; E_value=0.002; Accession=PF08330.1; Description=Protein of unknown function (DUF1723)
  Subcellular localization annotation: CTP_CleavageSite=59; ConfidenceScore=5.66e-01
MPAREMLVSGHVFFRAPSSFVFFSGLPRSSLLLAGTSFGSPFWFHRSLRLLHWLSVSVSSAIEVEDEVLLREEASSALVLGDENGASGRRSMLPYSKRLVEVIFGWSKVGGRGRDLSQDVAEDVPRRRRPTASARRQRVTQRVEDVPQLAEDVPHGSDGSPEKTAAADDAEIDRLASDGTVDDDEGSLGGPRDPSVLIGFADHVAHSIWSGQRPDLKLVSHGRKVDKFGRPAAEIEGMIAATGLDSLIRCSVITTDPGLISAFVERWHRETSSFHLPVGEKTITLDD

SEQ ID NO: 165784 - protein, 436 aa, Glycine max
  Coding DNA Sequence Number=SeqID_49006
  Gene Ontology: Mol. function=DNA binding; Cellular component=beta -galactosidase complex; Biological process=DNA integration
  Homolog annotation: Hit_ID=Q1SKN1; Match level="QueryCoverage=99%, HitCoverage=30%, E-value=3e-93, Identity=43%"; Hit description =Integrase, catalytic region
MSPFEKLYGTVYDISSLKVFGCLCYTSILTNNRKKLDLRAFASVFLGFKPHTKGYITFDLSTRATKVSRHVIFYENCFPYASLSAFQYFPTFLVHSYPTIYDHGKDLDFSSSSSHFTIPDNSQSPNIFVDHSQLGSSNTSSDPSNSPIIIAPRRSDMERTIPKKFQDFHTTFTSLVTGQSSMSRTYHSFIMATSSKTEPKSFKEASQSDKWIKAMNAEIKALKDNRTWILTDLPPNKFSIGCKWVYKVKYKANGLLERYKAMLVAKRYTHIEGQDYLDTFSPVAKITNVRLLLALVVVNNCHLKQLDVNNVFLHGNLNEEVYMNLPPIMHSTKFNQVCILHRSLYGLKQASRLWYVRLSTFLTSHGYRQYSSDHSLFLKQHLQSSTALLVYVDDIVLLGNDLLEIKFITELLDEVFRIKDFDDLKIFLGFEVAHNK

SEQ ID NO: 165785 - protein, 155 aa, Glycine max
  Coding DNA Sequence Number=SeqID_49007
MEGCMKFNCDEAYLPVGVASCSVVIRGNNGSFVRAYSKRSGERKCFKELVAEIRKNQDWFRTIDVEHRQTTFLLSRFFLTWFKSGEVALLSPFSGAFGEVTFFAGFRSGLKGFPKLRRKDTNYKRVAMASLICAIYMLEFDRQENKTQENALAPS

SEQ ID NO: 165786 - protein, 312 aa, Glycine max
  Coding DNA Sequence Number=SeqID_49008
  Homolog annotation: Hit_ID=Q84YF3; Match level="QueryCoverage=95%, HitCoverage=95%, E-value=4e-25, Identity=29%"; Hit description =Hypothetical protein 4B
  Pfam annotation: Domain name=DUF1191; Domain location=22-300; Score =387.4; E_value=2.2e-113; Accession=PF06697.3; Description=Protein of unknown function (DUF1191)
MGSVFGLILMVFSWVSFTFPGSNAQEGVKSAHVLDLIIRDHTFKALDKNFRTAIPQSVSLPANLSGIGIDAVRFRCGSLRRYGAHLKEFHLGTGVTVHPCIERVMLIRQNMGYNWSSIYYANYDLSGYQLVSPIVGLLAYNADEDAKSSNPFQLGIVAGETPMTIDFTNATKMNQDGVKPLCASFEGDGRMTLAKAPNPSTPLVCVAKRHGHFGLVVEYSPPDQFRNKPLSRWKVAVGSTIGAALGAFLLGLLLVAMLVRVKKRSRIVEMERRAYEEEALQVSMVGHVRAPTAPGTRTTPVIEHEYIPHHPR

SEQ ID NO: 165787 - protein, 47 aa, Glycine max
  Coding DNA Sequence Number=SeqID_49009
MRQTTFGESHDFPRRDFVPDDRELKVDIHFSKWNRHSQRVWGLFSKF

SEQ ID NO: 165788 - protein, 82 aa, Glycine max
  Coding DNA Sequence Number=SeqID_49010
MSTAEEGSSVESHGRILPPLSTAEELRKNLLPWDSHGRRFFLSYNVNCGRRFFRGVPRKISSAPVNGRRTAEEPSSVESHGR

SEQ ID NO: 165789 - protein, 150 aa, Glycine max
  Coding DNA Sequence Number=SeqID_49011
MVIFHHGDAAEGKGEEERGHPLGNKPLKKELHHQECALDKKLEEDVLMEEKKERRGEHKIEGIKEGEKWNFEVCLIRLSFFKVTTTHGLEIYPKAHENPRTFPWISGPIYLESSIQCPCGIGFHHSLHLGKDLTSNLEVLHTLGSFPQHL

SEQ ID NO: 165790 - protein, 781 aa, Glycine max
  Coding DNA Sequence Number=SeqID_49012
  Homolog annotation: Hit_ID=Q948P3; Match level="QueryCoverage=32%, HitCoverage=42%, E-value=1e-96, Identity=63%"; Hit description=EIN3 -like protein
  Pfam annotation: Domain name=EIN3; Domain location=15-461; Score =511.9; E_value=7.1e-151; Accession=PF04873.4; Description=Ethylene insensitive 3
MTIDLLDNSVRTIEEGLNMVEEEENGQEQELTIEELETRMWRDRMLLRKLKDERKEREQGKTVEMMKKKALTRAQDIVLKNMLKMMEVCDVRGFVYGIIPEKGKPVSGASDNLRGWWKERVKFDRNGPAAMLRYDEESGLDDLLNEFSGDPASPYRLSDLPDTTLGSLLSCLMQHCDPPQRRYPLDKGVAPPWWPTGLEIWWPELGFSEDPGPPPYKKPHDLKKAWKLSVLTAVIKHISPDVTKINNIVRHSRTLQDKLTAKETSVWSAVMKREETLARRLHPHLFPPQPIIRRPNEIHGARNFLGGQSSHNPPPTLNVAAHSNNNMLLASGSARNFLGGQNNPPPAYNVSNGGARNFLGGQNSPTPPSNVGNGDGRSFLGEQNNPPPITTNVVNGISDNNSMVAVNNGNVVALGHGANKRKEVQGITIPHDAYSCHSPQCPYHESSFGFSDRNVRNNHQLTCRYNNGNKDNNNTIQVVGGGGASSSSQVGSGNPSNVNVPLGQSMNTAATVVNPNQTQNLTNGQPMNISAPVMTQNQSLTIGHPRHNAAPTVSQNQTLTVISDNSGEKGSGGLMHNMNVLQQKNSTSGAGSSSMSVVVPLGNQNLQQVQNVLQPQVVDNENFFGGGRVSLDKINFFGNNNNNMNINVHPLLEASQNMQQLQNAQPQVDKNFFGARVSVDKNNNLVGNTNNMNNIVPPLGSQNMQQVQNVQPQVDKSTFVGERVDGGASGYKLNNAEVHGDFSTSTSMDPSSYEWDANNSQSDFMDSLLEAPSQDLFWLYN

SEQ ID NO: 165791 - protein, 100 aa, Glycine max
  Coding DNA Sequence Number=SeqID_49013
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q3V656; Match level="QueryCoverage=57%, HitCoverage=14%, E-value=4e-17, Identity=68%"; Hit description =Protein phosphatase 2C
  Subcellular localization annotation: CTP_CleavageSite=44; ConfidenceScore=5.12e-01
MFWTKWLGVMNVTLRRQRSMVTSTQDHNGGSCCVTRLIRNGNLVVSNASDFRVVISKKGMAEVLTSEHKPSREDERDKIETRVSNQEAIDITHPFYVGNN

SEQ ID NO: 165792 - protein, 73 aa, Glycine max
  Coding DNA Sequence Number=SeqID_49014
MGGAGGNGDTSATWHVPDESANGGGAMHGVYVKKEHPSGICFVTRPMSFTTSGFAVEYTLSFSGKAVGHSIHR

SEQ ID NO: 165793 - protein, 49 aa, Glycine max
  Coding DNA Sequence Number=SeqID_49015
MGGLDATTTNATLSSSSARLTATEKRNVVFRKLKIAAKTKFGDLFQANV

SEQ ID NO: 165794 - protein, 280 aa, Glycine max
  Coding DNA Sequence Number=SeqID_49016
  Gene Ontology: Mol. function=protein transporter activity; Cellular component=membrane; Biological process=protein secretion
  Homolog annotation: Hit_ID=Q0XRE8; Match level="QueryCoverage=97%, HitCoverage=38%, E-value=1e-126, Identity=80%"; Hit description=Flp pilus assembly protein secretin CpaC-like precursor
ARTGVFHALQQARRSAVDHRGRDEDHQFGLFVLESLGPEQGTQHGQVSQEGNLVDVVATLARQQAGQHHGLAVLDVEFGEGAPSAQPGPRGRGERWVDVADLAVDLGPDDAVAVHARRDAQLDAVGLEHDHGAVDRGHGVRIFATGQELGLGAIARRQLGLGKNAGLSVAGQQVQLCGQAHVDGGEDVQASGQRAFVTAVRGDWRVLDADDQTGLMAAPRRRPDASHAGPALGGPAQAEFAQLIDREFDHLHVHEHHLLPADLVGEVDDLRVVLAQVFDL

SEQ ID NO: 165795 - protein, 102 aa, Glycine max
  Coding DNA Sequence Number=SeqID_49017
MNIHPLDKYLWLSEADSLSPAPEVVPPNPIPTRTEPAPAESQPLVVDPPASPEVEILSLPPAPPAPPLILIPDDSDAEAPAPPDSPSYYLEDGSNFFDWMDY

SEQ ID NO: 165796 - protein, 156 aa, Glycine max
  Coding DNA Sequence Number=SeqID_49018
MAITQIGMETTTIVQPGQQHQEEEMLLQVQVFEMCHHHVLALRQENTQHRSLNRTWKVQHKTYVRTEDGSQLLFANTLRKQLQQYKNPFLPRIMEAAFLVETLDYIKIMMTLVIQMNILMCMSPKLFCIPQTTPSCAGSSPLHQKGIPSIALFNYP

SEQ ID NO: 165797 - protein, 191 aa, Glycine max
  Coding DNA Sequence Number=SeqID_49019
MEAVSMVVDDEFNENQVLDTKVNIISRVHEDIDTEFDKGNTDINFEVDNMKTNTEVSQDIIKKIDTQFNQREKGINTEVDKEMTNTEKEVSPSQKKILSNRRNFKTKNCICNNSPIGFERPTSQTIKRIEGRTHWRQFNREARSRIMCTNIAKKRINNLNTKIYRLMNCQKYHFKITCSFFSCLLVLSGRG

SEQ ID NO: 165798 - protein, 105 aa, Glycine max
  Coding DNA Sequence Number=SeqID_49020
MEERDYTDHMMQVYEPLKLKRKKWKKVVQVEHIAALAKEATAQVTGVLADLNTIGALQENVENVTSPATSNVVKANEVLPTKKSTPTSTQQERSSEATSLQKGCF

SEQ ID NO: 165799 - protein, 107 aa, Glycine max
  Coding DNA Sequence Number=SeqID_49021
  Subcellular localization annotation: CTP_CleavageSite=46; ConfidenceScore=5.05e-01
MIGSAMSLMMNPSSFSFIKVIHLDWMQHFNGIFVVCNFFSIRPKCRGFSYVKPDSLTLVGFGIKTIKLACKVVTFEEGLPIPGMVNKFYFLTSARHFSVKVELGSIG

SEQ ID NO: 165800 - protein, 85 aa, Glycine max
  Coding DNA Sequence Number=SeqID_49022
MIEHVLAIRIAIPWITGLNQAHAFAKLVHQVKLKYRSNHLAKKLGQKMDRVTSLLHLPPNTFRTIDVLVTSSFTLTKMSWTMLKA

SEQ ID NO: 165801 - protein, 218 aa, Glycine max
  Coding DNA Sequence Number=SeqID_49023
MPLKGKQLVIYPCKTLWRAHSITHNHTPHIPQRFKTLMLWRKWESWVHALYNQVSHQPNNAKKNGASEEGENEGETHAVTAIPIQPSFPPTQQCHYSANNKPSPYPPPSYPQRSSLNQPQSQSTALPMTNTTFSTNQNTNQEMNFAAKKPIEFTPIPVSYANLLPYLLDNSMVAITPAKVHQPPFLREYDSNATCACHGEALGRSIEHCKVQGLIDAG

SEQ ID NO: 165802 - protein, 68 aa, Glycine max
  Coding DNA Sequence Number=SeqID_49024
MHVDKCSSAPSVTPTLRQEYKDPVNHPVNDPLHARSDQMLVQMVDPKEWILKESTKTSQSLFHSSSSV

SEQ ID NO: 165803 - protein, 181 aa, Glycine max
  Coding DNA Sequence Number=SeqID_49025
  Gene Ontology: Mol. function=RNA-directed DNA polymerase activity; Cellular component=mitochondrion; Biological process=RNA-dependent DNA replication
MKNRLEELPWTLFIDESSNKTQCGVGILLESPHGVVLRKALMIEFPLKNNQTKYEACIAGLEIVVIMEVQVLKVSSDSMLMINQLSREYQVKEPILQKYIHKIGLIKEKFKKLEFIYIPKGKMMLWPTFWAQNSTKKDIESRLLLGIDVLGPFPRALGQVKYLIVTVDYFIKWVEAKHLPP

SEQ ID NO: 165804 - protein, 201 aa, Glycine max
  Coding DNA Sequence Number=SeqID_49026
MASCKRKATTSVSQAANNILGWNILPERNVKLYITEFDEFRRELERRNWHREITNFSEGSIDVVVVKEFYANLYDPKDKAPKQVRVRGHLIKFDVDSLNTFLKTPVVVEKVESLPFCSIFARLRPNPQELAARLCIRGFVLNVEGLPWKLLRKDLTTLAQTWSVLSYSNLAPTSHTFDLNLDKARFHSLHSPTPRGLDFQP

SEQ ID NO: 165805 - protein, 98 aa, Glycine max
  Coding DNA Sequence Number=SeqID_49027
  Homolog annotation: Hit_ID=Q1SP02; Match level="QueryCoverage=80%, HitCoverage=17%, E-value=8e-08, Identity=39%"; Hit description=IMP dehydrogenase/GMP reductase
MARQLAGYITLLQCWIYKHFLSVATAVPTEDYDERRPRACRWTSSKALPVSTYRRSLDRLTPDAVCWISYGDHRSSREFEVISLFYDHLRWGPLTVIH

SEQ ID NO: 165806 - protein, 273 aa, Glycine max
  Coding DNA Sequence Number=SeqID_49028
MQKIRDQLEDSITEKVTRQLILSFSQMQSQFQSQMQSQGLALPPEPEVGPSAARVAQRRVVLIPQGTTKTRVTQRNGRLYEGSITVHNIHLCHDQVKVGVEEVRDADASIPVLTQQVQLVGQTLNTFVTWPTHLVKRLSEQGAMGSDKPTDRPDHDVNDPLYLMTLTIPQLFLNPLQNSKRDVYLGAYLNGLDNYLKGIINMLVLFFNTFALALVGNINILIVQYAFMFVLNALKGLDDTPQSKSKVVARWTVVKYFNDARPLELERLKVLHI

SEQ ID NO: 165807 - protein, 46 aa, Glycine max
  Coding DNA Sequence Number=SeqID_49029
MQKKRKCRKLGAREKMQLGIAHRSSAWRILQVIKPATLAKPGSGPA

SEQ ID NO: 165808 - protein, 356 aa, Glycine max
  Coding DNA Sequence Number=SeqID_49030
  Subcellular localization annotation: CTP_CleavageSite=23; ConfidenceScore=5.36e-01
MATPPPSLPQLENPPEVTSKRTRQSTRLRSLTSRCLDGPRPVVNVNPTTGRGSEPHKEKFHSYLGVVAKEKVPIVHANWNVVLDDLKSLIWKDILRKFDIPEGENAKKKVMSTVAARWRQFKSSLTSKFVFADNEGQQISDPTVKYGLDSETWAEFAKSRKTPNWQKLMEEKSKRGHEEHSCTESPTLNIDPPSSVSRHLKWKIARTKRHDQMTSEVAQEITDKIDSLQEQATHGSFFSHGLQDILNMAFGRPEHQGHVRVAWTGVTISQYFGQASRASSTLSPSINQQQLANIIGGIKDDIKKQLQDEIRNEVQDEIRKEVQQEHKQQQEVWIRAVEEKQCQNLEMMKQELKKNH

SEQ ID NO: 165809 - protein, 139 aa, Glycine max
  Coding DNA Sequence Number=SeqID_49031
MMMISIVSNNKCRDHDANKKTNNAYKLNISMLTKHHINLVHKLHFCPANRHYLNTSLISDASSIGACRPRIFFINGFLCFLEDKWQRNGERKRERRRHFKEKMSLEEAHHHRRPWIRAWRKKEMNEGRGREEHEILCSK

SEQ ID NO: 165810 - protein, 65 aa, Glycine max
  Coding DNA Sequence Number=SeqID_49032
MDMSIVLNHDDPLLVKDFINNKVEFQNPIVGAAPLSQGSLRFLWSPHNSNRICKIAHDLWPGISN

SEQ ID NO: 165811 - protein, 386 aa, Glycine max
  Coding DNA Sequence Number=SeqID_49033
  Homolog annotation: Hit_ID=Q1T493; Match level="QueryCoverage=91%, HitCoverage=76%, E-value=2e-26, Identity=23%"; Hit description =Nucleic acid-binding, OB-fold, subgroup
  Pfam annotation: Domain name=DUF223; Domain location=40-135; Score= -13.4; E_value=0.051; Accession=PF02721.5; Description=Domain of unknown function DUF223
MARVADKIKLIVGSREALKLSVRITDLWFIGIPGKTEQAEMVVVDSDGDEMHVVCKQDQLKSRKADLKENLTYVMHNFKVIKNDGKFRVCDHEYKLCFTGVTVVRQCDMEQLPFRKFRFVAFSSVIASHFKIGLLVDVIGVVDEVVFRYVSSKNTRVVLNLKDLRPIVILLTPARIKEAQGSYPTSVSNSFKASKLMINDLVLEIQEFRESLLDLGIEVRSILTPIGQGSSQVSGSSQLSSKDVFLSKTKVFFVENLMSVSSIGVCLCYCRQDYSRSDGQLFMVLSALWYRVEVMVSHKGEQTKFLIWDHECAQLIGQSADEVNRLKIEDGDVDLNASPQALDRLLGCFLAFKVKVQPRFRNSVVLKYSDELELINVVLDLIPDSE

SEQ ID NO: 165812 - protein, 90 aa, Glycine max
  Coding DNA Sequence Number=SeqID_49034
  Subcellular localization annotation: CTP_CleavageSite=54; ConfidenceScore=5.27e-01
LSLAHQWAKCASTAKWSFNALSATEESGRASISRSRAKCEISALSVVVVFSHAQCMTGAKLKSTYSAHHSAYLGKRALEAARGAAFAEIP

SEQ ID NO: 165813 - protein, 118 aa, Glycine max
  Coding DNA Sequence Number=SeqID_49035
MYKKERKKECLNHIHASYVIVEAMPSKIQRTNRLRILYLNTLEGTSFVVQVEGTSTWVVVTENKKWYISCGSVQVKGTSTWLFKGNKGGYIPCGSLLVKVFYKVERNLKDCRLLRDWM

SEQ ID NO: 165814 - protein, 85 aa, Glycine max
  Coding DNA Sequence Number=SeqID_49036
MENVAVFDECLRRGWGSNCDDNGNNVGAGNGHSARDTDSSGCDIDGDCSSVNIMVVATMVVVVLTLVVVVTIESVIFKCRNSLFF

SEQ ID NO: 165815 - protein, 220 aa, Glycine max
  Coding DNA Sequence Number=SeqID_49037
  Gene Ontology: Mol. function=nucleic acid binding; Biological process= apoptosis
NNNNRLEEAIVKLTDLSIASMANQKNINVFIKNVEIQVCQLAKQLHNSYVGFLATTKENPKVNCNAIMTRSGLVAHYPPKTKGQLAREGKFIPKTFLSKEKLYPHMSTKKDKERHCECFLEIFKQLNITISISYALELMSKIGNMEVKEIYMIIQLADHSTKLPHGVVENMLVDVGKFTLPVEFIIMDIEEGSDIHLILGRPFMNMANVIISVAEGKFTI

SEQ ID NO: 165816 - protein, 163 aa, Glycine max
  Coding DNA Sequence Number=SeqID_49038
MGQFMRSWSSQEGRGQIMRVVVNHEGHSQSIITQGFIITSDHSHGGFTTTVKVLANTPHSSIKFWALERVVLVVKTSGLGKDMSEVTSMLKRGVLGWPVLRQPLKRKPFPKRNRGSKAVGLKMHLTQRKMKISNPTNNFPHFTIKSYSKNWGGSRGSKSGRWN

SEQ ID NO: 165817 - protein, 68 aa, Glycine max
  Coding DNA Sequence Number=SeqID_49039
MSVSNLEFTGGPCLRLSFIVLHRDKQSKGRSQRPCLSMAFYVLKQRESETEIFRIERPRSSEMLLTLK

SEQ ID NO: 165818 - protein, 98 aa, Glycine max
  Coding DNA Sequence Number=SeqID_49040
MRLHRREVGIAAVETRLRQTLPQMRRSSKGDSLQPTTMPLHMAMDSLKGFTPSISIRLWIHSKGFTLHTTTGVGGVCSLCGMASQIWGLANRCLRKGA

SEQ ID NO: 165819 - protein, 280 aa, Glycine max
  Coding DNA Sequence Number=SeqID_49041
  Gene Ontology: Mol. function=RNA-directed DNA polymerase activity; Biological process=RNA-dependent DNA replication
MSFGLKNASVTYQRLMDQIFKQQIEQNVKIYVEDKVVKSYSIVQHVADLEEVFGEIYKYNMCLNSKKCTFRVGGGRFLFMITHLGIKVNLDKCIGILAMHSPTNILEAQMLNGRLASFLLGIALLLYLLIADEAISFALVQEERKHRIPIYLTSCMLHDAEKCYQMIEKVALAFITSAQCLKPYFQSHQVVVNTNYRIKQVLRKPKMVGRIVAWSIEISEFDLQYKPCGPMKTQFMAYFLAEFAGNNQTTPNWWNLYVDDVSNLEGPSNVTLIQALKQSG

SEQ ID NO: 165820 - protein, 413 aa, Glycine max
  Coding DNA Sequence Number=SeqID_49042
MDKSCMVSRVVTSTSAGVASMQNPMCQVRGASAFDNSTLLIVGECIEDKHFICVFATGEYSAHVISIGGSSSEETCHWASDSESSSSERLTVSYCTMEGISCLHRRAHPLASSLDGEPVLVTMILPSFVSRGVRKSGGGDIWASPYVRHSHNVGSKSLDEDLLTLMERVDKAILEQLPASVDAWANLSLPLAGDPFAALDIKQVRPDRGVVPLFATIPSAREGVAKVSHNMPSSVLAKRKRDDDARVLSCKKSGTPSSLRAVRQVAGLMPDSGHPSSLLGLPSAPSIVQAPALIIATIAAPPPPPVVSIQEIFAFPAAQVSALASLAGLIMASSSTVAVPLLSAAQLVPPSSVLASTSPSSFFHPSVSLDHIYTSHDADSLWGQGLPLEKFSDPGREWAKTLRYAKQGGILKG

SEQ ID NO: 165821 - protein, 206 aa, Glycine max
  Coding DNA Sequence Number=SeqID_49043
  Subcellular localization annotation: CTP_CleavageSite=58; ConfidenceScore=5.03e-01
MLVVVVIDPPTFVVLLAFLGFNLFPATSLVKKNPTPKNQQKPSPNHAYMIPLSRLPIPCLKGDSILVTILEEEFLVGLDKCKNYLHGCLLLLKTLVLYLKLLKPRKPFVIWKLIAIGGSEKGYFCRVLWSFSWILAIVFMKLYGPFKNNPKKPDNNGSQVDARSLGPVLTQPQKSNESPLDNGSLNNEEDALAIVIPLDDCVFKDL

SEQ ID NO: 165822 - protein, 54 aa, Glycine max
  Coding DNA Sequence Number=SeqID_49044
MEVIDPFMKQLSKGVINPLLNSSPLSMTWWLTIHFRRQASFWSGGDTPRIRKFL

SEQ ID NO: 165823 - protein, 84 aa, Glycine max
  Coding DNA Sequence Number=SeqID_49045
  Gene Ontology: Mol. function=3,4-dihydroxy-2-butanone-4-phosphate synthase activity; Cellular component=chloroplast; Biological process=riboflavin biosynthetic process
  Homolog annotation: Hit_ID=Q5L4Z2; Match level="QueryCoverage=91%, HitCoverage=18%, E-value=2e-20, Identity=58%"; Hit description =Riboflavin biosynthesis protein RibA [includes: GTP cyclohydrolase ii
  Pfam annotation: Domain name=GTP_cyclohydro2; Domain location=4-84; Score=-4.0; E_value=5.8e-10; Accession=PF00925.11; Description=GTP cyclohydrolase II
MLFLTHTSSARLPTQFGEFDIHVFTDSRNGVEHVALAYGDVQGASDPLVRVHSECLTGDVFGSTRCDCGEQLHHAQRLIKETGQ

SEQ ID NO: 165824 - protein, 197 aa, Glycine max
  Coding DNA Sequence Number=SeqID_49046
  Gene Ontology: Mol. function=two-component response regulator activity; Cellular component=membrane; Biological process=two -component signal transduction system (phosphorelay)
  Homolog annotation: Hit_ID=Q9I0I1; Match level="QueryCoverage=54%, HitCoverage=47%, E-value=5e-30, Identity=56%"; Hit description =Probable two-component response regulator
  Pfam annotation: Domain name=Response_reg; Domain location=91-196; Score=70.2; E_value=6.7e-18; Accession=PF00072.14; Description =Response regulator receiver domain
MSAVFRSLIYMFWTQRRAWMGWFALLVLLATLLFLPRADSGESAANAGRLSAKGEILSLEKISQKAKSYKPGEILEVELEKKHGRYVYEVDILDAGSQTQQALKTAGYACDWLQEGVEAGIQGELEPYDLVILDLGLPGRPGLEVLAEWRNKSLGMPVIVLTARSSWQEKVEAFNLGADDYVTKPFHMEELLARISA

SEQ ID NO: 165825 - protein, 81 aa, Glycine max
  Coding DNA Sequence Number=SeqID_49047
MANAQADKSADDEATINQMHQHNFLGKRPYAKTPVAKQNPDEKWVGAGIVTDKPEPSFDKHQQMRLNFIGRRPYNAGNGTD

SEQ ID NO: 165826 - protein, 138 aa, Glycine max
  Coding DNA Sequence Number=SeqID_49048
DLQCTGMLLANQAMCCTELHAYFIQQPLQQVIGPAEHEQFLPKAFKQSVMSKLYLVTGKMQTIVNASRFTSPTQAAESKAGETVQNTHHVQFLGKRAYQQPLVAKSDAEQAWVGATLRVDQTNQQQVLKMQSLGKRAY

SEQ ID NO: 165827 - protein, 115 aa, Glycine max
  Coding DNA Sequence Number=SeqID_49049
  Gene Ontology: Mol. function=transporter activity; Cellular component= integral to membrane; Biological process=transport
  Homolog annotation: Hit_ID=Q1VUF4; Match level="QueryCoverage=68%, HitCoverage=15%, E-value=1e-11, Identity=46%"; Hit description =Sulfate transporter
MSTSVQGSATTDLFKHINRDLPASIVVFFVALPLCLGIALASGAPLFSGVIAGIIGGIVVGLASGSQLGVSGPAAGLAVIVLAAISNLGSYEAFLAAVVLAGVFQFLLDSTCLWL

SEQ ID NO: 165828 - protein, 56 aa, Glycine max
  Coding DNA Sequence Number=SeqID_49050
MGQLRKPLHGQNRLRPRSEVETKLKAETNQEARVTIDKSSSLPSSGQAENAATRQP

SEQ ID NO: 165829 - protein, 72 aa, Glycine max
  Coding DNA Sequence Number=SeqID_49051
MHHFSKADREPDLVRVTVFWEHCMSDMPFRGLKSARKRIAFSGKRGELAKRECCAKRVHQYSLNIRVLGRTR

SEQ ID NO: 165830 - protein, 52 aa, Glycine max
  Coding DNA Sequence Number=SeqID_49052
MAPKTCSTIGSLILIKHHPQIPLVGLNLTRSALRQTYQQGYRTLIPRENMIK

SEQ ID NO: 165831 - protein, 81 aa, Glycine max
  Coding DNA Sequence Number=SeqID_49053
MAQLQLAVENFTGTTMSNERTVSLLLWMLMPSTSSRKQPWLWQINCRMQNMVLSMPGMWAKYLAWILTVDLTSYLAIILYS

SEQ ID NO: 165832 - protein, 578 aa, Glycine max
  Coding DNA Sequence Number=SeqID_49054
  Gene Ontology: Mol. function=binding; Cellular component =intracellular; Biological process=metabolic process
  Homolog annotation: Hit_ID=Q84ZM5; Match level="QueryCoverage=90%, HitCoverage=85%, E-value=0.0, Identity=59%"; Hit description =Putative pentatricopeptide (PPR) repeat-containing protein
  Pfam annotation: Domain name=PPR; Domain location=120-154; Score =47.2; E_value=5.4e-11; Accession=PF01535.11; Description=PPR repeat
  Pfam annotation: Domain name=PPR; Domain location=221-255; Score =56.7; E_value=7.5e-14; Accession=PF01535.11; Description=PPR repeat
  Pfam annotation: Domain name=PPR; Domain location=256-290; Score=2.3; E_value=4; Accession=PF01535.11; Description=PPR repeat
  Pfam annotation: Domain name=PPR; Domain location=27-61; Score=33.2; E_value=9.1e-07; Accession=PF01535.11; Description=PPR repeat
  Pfam annotation: Domain name=PPR; Domain location=292-326; Score =13.2; E_value=0.21; Accession=PF01535.11; Description=PPR repeat
  Pfam annotation: Domain name=PPR; Domain location=358-392; Score=0.5; E_value=6.6; Accession=PF01535.11; Description=PPR repeat
  Pfam module annotation: Pfam domain module=PPR::PPR::PPR::PPR::PPR::PP R; Domain location=120-154::221-255::256-290::27-61::292-326::358-392
MLACHWHHLGVHDARGFFDSMPLKDVASWNTMISALAQVGLMGEARRLFSAMPEKNCVSWSAMVSGYVACGDLDAAVECFYAAPMRSVITWTAMITGYMKFGRVELAERLFQEMSMRTLVTWNAMIAGYVENGRAEDGLRLFRTMLETGVKPNALSLTSVLLGCSNLSALQLGKQVHQLVCKCPLSSDTTAGTSLVSMYSKCGDLKDAWELFIQIPRKDVVCWNAMISGYAQHGAGKKALRLFDEMKKEGLKPDWITFVAVLLACNHAGLVDLGVQYFNTMRRDFGIETKPEHYACMVDLLGRAGKLSEAVDLIKSMPFKPHPAIYGTLLGACRIHKNLNLAEFAAKNLLELDPTIATGYVQLANVYAAQNRWDHVASIRRSMKDNNVVKIPGYSWIEINSVVHGFRSSDRLHPELASIHEKLKDLEKKMKLAGYVPDLEFVLHDVGEELKEQLLLWHSEKLAIAFGLLKVPLGVPIRVFKNLRVCGDCHSATKYISTIEGREIIVRDTTRFHHFKDGFCSCRDYCLKKGKRLINFRNSSYMGFVVEFNNSYLETDSYVACISKECWKQPTYDLLVEH

SEQ ID NO: 165833 - protein, 65 aa, Glycine max
  Coding DNA Sequence Number=SeqID_49055
MARHVNNAFLCNIDWDLCWESHHLWVEVVREKYNCGHDILPLIKMKQGDLVSWVNHNQTFGMILD

SEQ ID NO: 165834 - protein, 39 aa, Glycine max
  Coding DNA Sequence Number=SeqID_49056
MDQRRSRTLTAITNPSNNDGVEETTMAGLHENNKTVIVV

SEQ ID NO: 165835 - protein, 164 aa, Glycine max
  Coding DNA Sequence Number=SeqID_49057
MMTTEAETERVVVIQDASRDVNSNAILGALEWFSVKAGDQLIIVAILDWMSSPMGYMVRVDSSSMISTNKKIIEKRLTKKKEEYLMNQNIQEISNYCKLNEIGFQLEVLVGSTAEVASNAAKEFQATRLILVRTWNYADELVESNPGDNDTTNTPNLRTFQIII

SEQ ID NO: 165836 - protein, 92 aa, Glycine max
  Coding DNA Sequence Number=SeqID_49058
  Gene Ontology: Mol. function=nucleic acid binding
MDAMDDVKVKIPKFQGYALVWWNQLQVDVDWLRRPRVTTRRELHNKLQKFYQGNISVDEYYKETKISLIRDEIEETQETTTARLLHGLNRDI

SEQ ID NO: 165837 - protein, 61 aa, Glycine max
  Coding DNA Sequence Number=SeqID_49059
MSPRCSGEDMGTYWVQDKVLQDIGQLWLHSGTILDEMGGIRKHSKKGYLTLSSHTKCIRDT

SEQ ID NO: 165838 - protein, 91 aa, Glycine max
  Coding DNA Sequence Number=SeqID_49060
  Gene Ontology: Mol. function=RNA-directed DNA polymerase activity; Cellular component=chromatin; Biological process=RNA-dependent DNA replication
  Homolog annotation: Hit_ID=Q8S8M1; Match level="QueryCoverage=96%, HitCoverage=7%, E-value=3e-26, Identity=61%"; Hit description =Putative retroelement integrase
MDVYFGDILIYSLTFDDPLEHIRSVLEVLRKESSYANREKCTFCTNQVVFLGFLVGSKGVQINEEKVKGIRDWPTPKNVSGVRSFHELTSF

SEQ ID NO: 165839 - protein, 74 aa, Glycine max
  Coding DNA Sequence Number=SeqID_49061
MGGKGTIDSNLRMNSFQGGNDEGLQRDEELSLGGVVTRSRLKKLKKNINMKMNSLMEKEEKGDRKIINCSELFD

SEQ ID NO: 165840 - protein, 38 aa, Glycine max
  Coding DNA Sequence Number=SeqID_49062
MAPMTEMRLYKESVIDGDDQRVRLGRLHHEILVAATKE

SEQ ID NO: 165841 - protein, 846 aa, Glycine max
  Coding DNA Sequence Number=SeqID_49063
  Gene Ontology: Mol. function=zinc ion binding; Cellular component =nucleus; Biological process=transcription
  Homolog annotation: Hit_ID=Q9LIE5; Match level="QueryCoverage=99%, HitCoverage=100%, E-value=0.0, Identity=62%"; Hit description=Far -red impaired response protein; Mutator-like transposase-like protein; phytochrome A signaling protein-like
  Pfam annotation: Domain name=FAR1; Domain location=89-290; Score =251.7; E_value=1.5e-72; Accession=PF03101.5; Description=FAR1 family
  Pfam annotation: Domain name=SWIM; Domain location=568-604; Score =33.8; E_value=6.1e-07; Accession=PF04434.8; Description=SWIM zinc finger
  Pfam annotation: Domain name=WRKY; Domain location=149-189; Score= -13.7; E_value=0.034; Accession=PF03106.6; Description=WRKY DNA -binding domain
  Pfam module annotation: Pfam domain module=FAR1::SWIM::WRKY; Domain location=89-290::568-604::149-189
MDIDLRLPSGEHDKEDEETTTIDNMLDSEEKLHNGGIDGRNIVDTGIEVHALNGGDLNSPTVDIVMFKEDTNLEPLSGMEFESHGEAYSFYQEYARSMGFNTAIQNSRRSKTSREFIDAKFACSRYGTKREYDKSFNRPRARQNKQDSENSTGRRSCSKTDCKASMHVKRRSDGKWVIHSFVKEHNHELLPAQAVSEQTRRMYAAMARQFAEYKTVVGLKNEKNPFDKGRNLGLESGEARLMLDFFIQMQNMNSNFFYAVDLGEDQRLKNLLWIDAKSRNDYINFCDVVSFDTAYVRNKYKMPLALFVGVNQHYQFTLLGCALISDESAATFSWLFRTWLKGVGGQVPKVIITDHDKTLKSVISDIFPNSSHCVCLWHILGKVSENLSPVIKKHENFMAKFEKCIYRSLTSDDFEKRWWKIVDKFELREDECMQSLYEDRKLWAPTFMKDVFLGGMSTVQRSESVNSFFDKYVHKKTSVQDFVKQYEAILQDRYEEEAKADSDTWNKVATLKTPSPLEKSVAGIFSHAVFKKIQTEVVGAVACHPKADRQDDTTIVHRVHDMETNKDFFVVVNQVKSELSCICRLFEYRGYLCRHALFVLQYSGQSVFPSQYILKRWTKDAKVRNIMGEESEHMLTRVQRYNDLCQRALKLSEEGSLSQESYGIAFHALHEAHKSCVSVNNSSKSSPTEAGTPGAHGQLSTEEDTQSRNMGKSNKKKHPTKKKKVNSEAEVITVGALDNLQQMDKFSTRAVTLEGYYGTQQSVQGMLNLMGPTRDDYYGNQQTLQGLGPISSIPTSHDGYYGTHQGMPGLAQLDFLRTGFTYGIRVSMDDPNVRATQLHEDPSRHA

SEQ ID NO: 165842 - protein, 74 aa, Glycine max
  Coding DNA Sequence Number=SeqID_49064
MKCGGSSSSRRGMVVCREWGHPPEWVKVALACANAVLYYKYWILEVFHCNLKRARGIPFSTPDNQLIALVSPAL

SEQ ID NO: 165843 - protein, 123 aa, Glycine max
  Coding DNA Sequence Number=SeqID_49065
  Gene Ontology: Mol. function=unspecific monooxygenase activity
  Homolog annotation: Hit_ID=O04892; Match level="QueryCoverage=99%, HitCoverage=33%, E-value=4e-34, Identity=51%"; Hit description =Cytochrome P450 like_TBP
  Subcellular localization annotation: CTP_CleavageSite=44; ConfidenceScore=5.43e-01
SGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 165844 - protein, 97 aa, Glycine max
  Coding DNA Sequence Number=SeqID_49066
  Gene Ontology: Mol. function=transferase activity; Cellular component= cytosol; Biological process=glutamine metabolic process
  Homolog annotation: Hit_ID=Q1SPM3; Match level="QueryCoverage=92%, HitCoverage=36%, E-value=4e-27, Identity=67%"; Hit description=SNO glutamine amidotransferase; CobB/CobQ-like glutamine amidotransferase
MTNIILGQKTSGRYFVGGLDCTVHRNFFGSQIQSFEAELSMPELVSKEGDPETFCGIFIRAPAILGARPKVQVLVDCPVPSSILLSSDSSIEDQMVN

SEQ ID NO: 165845 - protein, 1298 aa, Glycine max
  Coding DNA Sequence Number=SeqID_49067
  Gene Ontology: Mol. function=RNA-directed DNA polymerase activity; Cellular component=chromatin; Biological process=chromatin assembly or disassembly
  Pfam annotation: Domain name=RVP_2; Domain location=325-443; Score= -32.1; E_value=0.00032; Accession=PF08284.2; Description=Retroviral aspartyl protease
  Pfam annotation: Domain name=rve; Domain location=973-1129; Score =83.0; E_value=9.1e-22; Accession=PF00665.16; Description=Integrase core domain
  Pfam annotation: Domain name=zf-H2C2; Domain location=914-955; Score =5.0; E_value=0.079; Accession=PF09337.1; Description=His(2)-Cys(2) zinc finger
  Pfam module annotation: Pfam domain module=RVP_2::RVT_1::Retrotrans _gag::rve::zf-H2C2; Domain location=325-443::510-679::98-188::973 -1129::914-955
MPDHNTCQSTLERLKEAIAKLTQAQATLTQDHTTLAQTQTSMNTKMDAMLEHLAALTIQPSSPQLSPHHNPIPSPHTYKPHMKLDVPRFNGQDPERITVASFYMDGPALSWYQWMTRNGFISSWPALLQASESRFALTFYDDPQGALFKLQQQGSVNDYRTKFERLANWIVGLSPMALLSYFISGLYPDLCREVQALQPMFIPQAVALAKLQEEKIQDRRRHSCTSYTPSGLPPSPPPPTAVPFTVLALVRPSVKRLSAEELDVRCDKGLCYHCDEKWILGHRCRPRLHLLITNDDDDDYTDPSPTIPYSRIDDHGDPLSSLQGPQISLNTLAGMSAPETIRLYGTISHHQVIILVDGGSTHNFIQSHLASFLHLTQVPTAAMRVMIGNGSTTDCDTKCPEVPILVQGHTFLVDLFQLPIGGADIVLGVQWLKQLGLVTTDYSLLTKSFTYFPGTHPSALAMHHHPPHPFTTNTNPINVRPYRYPYSQKNELERQVATMLDTDMIRHSHSPFSSPMLLVKKKDGSWRCCVDYCALNAITIKDRFPMPTIDELLDEIGTTSWFSKLDLRQGFHQIRMNEEDIPKTVFRTHHGHFEFKVMPFGLTNAPSTFQATMNNILRPFLRKFAVVFFDEILVYSPSFHAHLQHLQAILDTLSQGSFYLRRSKCIFAEQQLTYLGHIVSSQGVAPDPKKIHAMTAWPIPTTPSDLRSFLGLMGFYRKFIRNYATTAAQLTALLCKDSFIWTPEAHTAFQHLKTLMTQAPTLASPDFTVPFILETDTSGTAIGAASTYVRELHVITSMVRKWRHYLLGHNFIIMTDHRSLKELMSQVIQTPEQQCYLAKLLGYDYTIQYKPGATNVVADALSRDTTYQELLLKVQQNPADHPSFTVKQNGLLFRGKIWLPAGHDLSKVLLVEYHSTPLGGHMGVSKTLHRIQQHFWWPNMHQDIRQYIAVCVTCQQIKMETRKPAGLLQPLPLPSSLWSDLSMDFITGLPASQGYTIIMVVVDRYSKGTHFGPLPAHYTAHKVALLFMDTICKHHGFPRSIILDRDPIFISGFWRELFCISGTKLHFSTMYHPQTDSQTKVLNHVLEQYLHAFVHDHPQQWFKFLSLAEWCYNTSVHSGTGFSPFEIMYGTPTPAPPLYSVGTSTVEAVDAICTSQDVIYQTFTRRLQKQQASMKRLADSHKRDLTFSIGDWVYVHLCPYRQTSLQPAYTKLSKRYYGPYRIQAQVGNVAYRLQLPPTLKIHPVFHVSLLKAHHGPIPLDVPTLPPFSTANHLIVLALEDTTWEYWPQLKDIYDLEDK

SEQ ID NO: 165846 - protein, 70 aa, Glycine max
  Coding DNA Sequence Number=SeqID_49068
  Homolog annotation: Hit_ID=Q6EUN0; Match level="QueryCoverage=49%, HitCoverage=11%, E-value=9e-12, Identity=77%"; Hit description=ASC1 -like protein 1
MGHPSFIVHVPKSPKSSKGVRWCMSPPTVHAPSVEEIFALAVTYDEPWFTDTRYFWVGPGNQIWPDQKIK

SEQ ID NO: 165847 - protein, 98 aa, Glycine max
  Coding DNA Sequence Number=SeqID_49069
MDFIPVHPNLGLRSNLTQTDEISTNTTNNMLDFYNCQPLVGLHNISLTIGTTLVFDLEITRLNHNTMGETIQVFFTSSGRLNPQNDSPHYWKEKPIEP

SEQ ID NO: 165848 - protein, 178 aa, Glycine max
  Coding DNA Sequence Number=SeqID_49070
MDMCRVSSCVWYRCATWCEVLVATPLGAVESLWQFSDWVRGKEAKERWGVVWLEVIWMIWMKCNNIIFNEAHLDLKNVLNLVKIRACFGRGKTYGCYLGGLVVPKVGMQDIHMERDIDKRTSLMTTTPPYVEKKSLERQRARSNQNQGYSKPNTLTGHTRNQQRAKNPYIFGIPKYIR

SEQ ID NO: 165849 - protein, 164 aa, Glycine max
  Coding DNA Sequence Number=SeqID_49071
  Gene Ontology: Mol. function=RNA-directed DNA polymerase activity; Cellular component=mitochondrion; Biological process=RNA-dependent DNA replication
  Pfam annotation: Domain name=rve; Domain location=5-163; Score=37.6; E_value=4.3e-08; Accession=PF00665.16; Description=Integrase core domain
MWGMNLLRPLLKALGAIKFLIVFIDYFTKWIEVRPLRGITASEVEKFTWKHLICRDSLPYAIVADNNTQFKAQTYEDFLRRLGTKHLVTFVKHPQTNRQAEAVNRVILKALGTRLDKSKGLWKEELYNILWVKPGKTHEWESLVPTGKVPFGSKQTSTVEYIYY

SEQ ID NO: 165850 - protein, 238 aa, Glycine max
  Coding DNA Sequence Number=SeqID_49072
  Gene Ontology: Mol. function=hydrolase activity, hydrolyzing O -glycosyl compounds; Biological process=carbohydrate metabolic process
  Homolog annotation: Hit_ID=Q93Y12; Match level="QueryCoverage=60%, HitCoverage=14%, E-value=4e-55, Identity=69%"; Hit description=Alpha glucosidase-like protein
  Subcellular localization annotation: CTP_CleavageSite=66; ConfidenceScore=5.41e-01
MIEDALVLPSSSSHSYSVIKVGSVQSPSVLVSPLNHHHRVLLNVPFSSPIIALRRKGVGEKLVPKMANYEGQAVTSRDSEVRSGSMIFEPILEDGVFRFDCSANDRDAAYPSISFVNSKDRDTPITTQKVPLYTPTFECLLEQQIVKLELPVGTSLYGTGEASGELERTGKRVFTWNTDAWGYGPGTTSLYQSHPWVLAVLPNGEALGILADTTRRCEVLENWLFLIYNLVEMSMLLY

SEQ ID NO: 165851 - protein, 921 aa, Glycine max
  Coding DNA Sequence Number=SeqID_49073
MEENLNTSCKNQEGNEMIHNNEHKVGIRNKGPCKKQQPGVDVVEWGPGLHTLALRVLLIGGGTCKTKDSDAQELKDDVRDKGLGICAPMARWTCVSECHIGFVGPGHLFDAGDGSLDNQRVTSLSSPPSVVECCSMSGVVALTNVRVTRQCCLSIPRAWTCVVRAASISNPLDIGSSSRLAVPRVRILTKVPLIGSHSLHRGSVGGSGDVTLSPCVQPSVNVGSPLYAPVVVGYEWLRDDVLKCRSSLTSVASIIVLQHQVKLANVEDSYKLAVQACGNDDFPFLRAALGCLPFFFVYRCLFEILGVILPLTVFQCALLEHLNVALSQLHPNSWAMVRAFEILVSKNLFKFDSNAFFCFKDHFFKVLAIDVMANGMPTMVDKAILEQLLASLDAQAILCLLSASNPLVALNGKCLTLSSFVVRPASGTVPTSVAAPSAGKGGYPNIPSSFLAKKKKEDVAGSSGCKKSKAPNGLHAMRQAVGMMPTAGRLSIEQGLPQAAPTVETLTIAAVEVATLAILAPSLPPAVVQDVAPTTAEVVVLSTQVGPLLCVSVANIGASTISPTSSTLLALPAVVLAAMASPSSSWCPRVSLDHLYTSCDIDSLWGVTYKSKQKTLDGFMSAFDRNLIRSAGVWNPNGSAKENELRDQEVVKKVASLEAEVAKWKHPKVVNVTIAFAEVVKVNRQQFFKVGGSLAKLLHTWLDGDNLIRRCKGLQSESKLVESELQVAKEREAMRQAGLFAKDLDLGLFDPFKDVKDDALLDKEEIVAKEEEVADERRDDAEQGDDGHLNLDFNLIKGLVTHLVGLPSITWSFSPDGYEELCQCCPWFKVAVVLTCESTPLMVELTPLTVIVVAAACERTNLGLVEAVLCSCIHGTHRGWHVLEIIGLALAYMPLTKWKLSILGFEHRAIAYMPLVVGGTH

SEQ ID NO: 165852 - protein, 132 aa, Glycine max
  Coding DNA Sequence Number=SeqID_49074
  Gene Ontology: Mol. function=transporter activity; Cellular component= membrane; Biological process=transport
  Homolog annotation: Hit_ID=Q9FHJ8; Match level="QueryCoverage=95%, HitCoverage=17%, E-value=1e-57, Identity=83%"; Hit description=Urea active transporter-like protein
MASALVECPPFEFSSKYYHVSENGGVCVRQTSFFEGKPVLNQGVGYSVILGFGAFFAVFTSFLVWLEKRYVGSRHTSEWFNTAGRNVKTGLIASVIVSQWTWAATILQSSNVAWEYGVSGPFWYASGATIQA

SEQ ID NO: 165853 - protein, 690 aa, Glycine max
  Coding DNA Sequence Number=SeqID_49075
  Gene Ontology: Mol. function=actin binding; Biological process=actin cytoskeleton organization and biogenesis
  Homolog annotation: Hit_ID=Q1SZ88; Match level="QueryCoverage=92%, HitCoverage=74%, E-value=2e-91, Identity=61%"; Hit description=IMP dehydrogenase/GMP reductase
  Pfam annotation: Domain name=Extensin_2; Domain location=93-380; Score=-134.7; E_value=0.048; Accession=PF04554.4; Description =Extensin-like region
  Pfam annotation: Domain name=FH2; Domain location=365-680; Score =228.4; E_value=1.5e-65; Accession=PF02181.13; Description=Formin Homology 2 Domain
  Pfam module annotation: Pfam domain module=Extensin_2::FH2; Domain location=93-380::365-680
MMFRVMFNTAFIRSNILMLNAENLDILWDSKERYPKGFRAEVLFGEVESISPPRAQTSILDGEVKGGLPIEAFSRVQELFSGVEWVESGDAAAVWLLKQLTVLNDAKELSRFQGRGSWYSSPADSDSENNESSTADSSDEAFDVIPKSYADPSKLLISDNPDLVHLAFENNGGDYVNLTSRTPDQSLTDNVSSPHHAPRKEYSPCSSPPSPSPVPATQPFPIPAPPPPTSNIQPDLAPPPPPHQIDQNVNNASTFPSPPPPPPPLVSNTPSQPPPPLGPVRTSSAPPPPPPPPGHYTNRFSSTTSSSSSKCTNRFCSTTTTTTIGTKTSRCSSSSTWPWYISNATSTTCSKASTTNVGRGRGTGGTVNAPKKTLLKPLHWVKVARAAKGSLWADSQKQDSGTRAPEIDISELESLFSAASTSDGSSTKGGGRRGPNINKPEKVQLVDLRRAYNCEIMLSKIKIPLPDMLIAVLALDSAVLDIDQVENLIKFCPTKEEMEMLKNYTGNKEMLGKCEQFFMELMKVPRVESKLRVFAFKINFSSQVNDLKLNLNTINNAAREVKESGKLRQIMQTILTLGNALNQGTARGSAVGFKLDSLLKLSDTRARNNKMTLMHYLCKCKYKNFVPHYPEALRYAKVWGREYCTQPYPCICEEAVSGFEPMTNKSPRHNFTAAPGLALTQCKYTQIKTM

SEQ ID NO: 165854 - protein, 437 aa, Glycine max
  Coding DNA Sequence Number=SeqID_49076
  Gene Ontology: Mol. function=nucleic acid binding; Cellular component= nucleus; Biological process=regulation of transcription, DNA-dependent
  Homolog annotation: Hit_ID=Q8LRK9; Match level="QueryCoverage=58%, HitCoverage=15%, E-value=8e-34, Identity=33%"; Hit description=HAF1
  Pfam annotation: Domain name=zf-CCHC; Domain location=35-54; Score =8.5; E_value=0.039; Accession=PF00098.13; Description=Zinc knuckle
MKGGGAVFLENMMLRSGNGIWNQVFKEKKPSRETFVCGACGKAGHMRTNKNCPKYGEDLETQLESTDMEKSSGKSSFVDPSSLSQHKAPSKKSMSKGTTKIAPVDNSSKIPLKFKCSSTEKSSDKPAIESLQSSDKPVTSDSETAKSAKVNKIIIPKKVKPDDTQAESGKHAIVIRPPTDSGRGQVDSHKFPIKIRPPTEIDREQNHKKIVIKRTKEVIDLELDSPGGNTGLQHRKTKRIVELSNFEKQKKQETVYGTEGFKKWNSKEDRRWQEEQEKWRNDARLREEDRARRHRKEEIRMLKEQERLDEIKRFEEDIRREREEEEQQKAKKKKKKKPELRDEYLDDLRARRHDKRMPERDRSGKRRSITELGKIGADYMPPTKRRRGGGGEKQITNSYLVIYDVKVLISVQQLRKADENIEDWEENSPGAKFMPLP

SEQ ID NO: 165855 - protein, 577 aa, Glycine max
  Coding DNA Sequence Number=SeqID_49077
  Gene Ontology: Mol. function=transporter activity; Cellular component= membrane; Biological process=transport
  Homolog annotation: Hit_ID=Q9FHJ8; Match level="QueryCoverage=97%, HitCoverage=80%, E-value=0.0, Identity=71%"; Hit description=Urea active transporter-like protein
  Pfam annotation: Domain name=Nucleos_tra2_C; Domain location=257-414; Score=-145.4; E_value=0.1; Accession=PF07662.3; Description=Na+ dependent nucleoside transporter
  Pfam annotation: Domain name=SSF; Domain location=1-366; Score= -132.3; E_value=0.00039; Accession=PF00474.8; Description =Sodium:solute symporter family
  Pfam module annotation: Pfam domain module=Nucleos_tra2_C::SSF; Domain location=257-414::1-366
MAIEIKRKAPHAHTVCEIVKARWGTSAHIVFLIFCFLTNIIVTAMLLLGGSAVVNALTGVNLYAASFLIPLGVIVYTLAGGLKATFLASYIHSVIVHIVLVIFVYLVYTASSELGSPSVVYNRLLEVASKSRTCQDPISHQGQSCGPVSGNHKGSYLTMLSSGGLVFGIINIVGNFGTVFVDNGYWVSAIAARPSSTHKGYLLGGLVWFAVPFSLATSLGLGALALDLPINENEAGRGLVPPATAVALMGKGGSILLLTMLFMAVTSAGSSELIAVSSLCTYDIYRTYINPNASGKQILKVSRGVVLGFGCFMGLLAVILNKAEVSLGWMYLAMGVLIGSAVLPIAFMLLWRKANAIGAILGTVLGCVLGIITWLSVTKIQYGRVNLNTTGRNAPMLAGNLVSILTGGVAHAVCSMLRPQNYDWSTTKQITVVEKEKSNLPAEEFKEEKLIRAKSWVVKWGVGFTLLIVILWPILSLPAGEFSKGYFYFWAVIAIGWGTVGSAVIIVLPLIESWETIQTVIMGMFTNDRLMEKVEELNFKLQTIMQAMPEAERLYLLEKGKAKKLDSSEQQASSLPA

SEQ ID NO: 165856 - protein, 609 aa, Glycine max
  Coding DNA Sequence Number=SeqID_49078
  Gene Ontology: Mol. function=hydrolase activity, hydrolyzing O -glycosyl compounds; Cellular component=membrane; Biological process =carbohydrate metabolic process
  Homolog annotation: Hit_ID=Q93Y12; Match level="QueryCoverage=93%, HitCoverage=67%, E-value=1e-124, Identity=68%"; Hit description =Alpha glucosidase-like protein
  Pfam annotation: Domain name=Glyco_hydro_31; Domain location=1-303; Score=137.8; E_value=3e-38; Accession=PF01055.16; Description =Glycosyl hydrolases family 31
MVAKTFRKKSIPCDVVWMDIDYMDGFRCFTFDKAAIQPALERFRDPMSLVKDLHYSGFKAIWMLDPGIKQEEGYFVYDSGSKNDVWVQKADGTPYVGEVWPGPCVFPDYTQSKVRAWWANLVKDFIPNGVDGIWNDMNEPAIFKVLTKTMPESNVHRGDTELGGCQNHFFYHNVYGLLMARSTYEGMKLANEKKRPFVLTRAGFSGSQRYAATWTGDNLSTWEHLHMSISMVLQLVPCFLFAEGILKLAPLTMNPGLLGKSTLRRQGLDKLEITLPKGIWLNFDFNDAHPDLPALYLKGGSIIPVGLPHQHVGEANPSDDLTLFVALDEHGKAEGVLFEDDGDGYEFTKGSYLLTHYVAELKSSVVTVSVHKTDGSWERPKRRLHIQLLLGGGAMLDTWGTDGEVLQLILPSEDEVLKLVSTSEKNYKDRLENATPIPDVEEVSGPKGTELSRTPIELKNGEWNLKVVPWIGGRIMSMTHIPSGTQWLHSRIEINGYEEYSGMEYRSAGCSEEYSVIDREPGLVVLEGDIGGGLVLKRHIYVPKNVPNAIQIDSSIIARSVGAGSGGFSSLQCWIMGVKGVWLLSASIHFHLEMYPWTHFEMFGWQVQN

SEQ ID NO: 165857 - protein, 85 aa, Glycine max
  Coding DNA Sequence Number=SeqID_49079
MPWKEELHHQESALDKKLREEASMEEKMREGGGGGGHKIEGEKEEEKLNLEMCLTSFTFIKVVTRIFQGYAKDILAYSKNIPKAS

SEQ ID NO: 165858 - protein, 387 aa, Glycine max
  Coding DNA Sequence Number=SeqID_49080
  Gene Ontology: Mol. function=protein dimerization activity; Cellular component=nucleus
  Homolog annotation: Hit_ID=Q2QNH1; Match level="QueryCoverage=67%, HitCoverage=31%, E-value=1e-73, Identity=50%"; Hit description=HAT family dimerisation domain containing protein, expressed
ASSIGENVIEQPLIDHTDNKEIVIEQPPIDNTNNGVEQPPRDDTDNGENVIEQPPINNTDNINSHNFNQELEDNILEIGVEGNVEHNNTCSEVPTNIYDLGLWKNIDGKFRDLMIENGPIRHDNFQYPKDENNRYFYSSCYQRTLSNGEKHDRRWLVYSKDLDKVYCFCCKLFGSTNVSQLANEGTKDWKNPGSKLKSHETNHEHIINMTKWIELEKRLTTKQTIDKNIQEQINKEKEHWEKVLLRIIAIVKYLSKNNLAFHGTNEKIYEKGNGNFLSLIEMLAEFDPIMQEHVRRIKSNETRNHFLSNTIQNELIEMIAFQVKKSIIEKVKDAKYFSVILDCTPDESRIESVKAIKFHAPKGKRVCIGFRIHGKNGHRNGYRAKIL

SEQ ID NO: 165859 - protein, 460 aa, Glycine max
  Coding DNA Sequence Number=SeqID_49081
  Gene Ontology: Mol. function=catalytic activity; Cellular component =integral to membrane; Biological process=metabolic process
  Homolog annotation: Hit_ID=Q0LP45; Match level="QueryCoverage=96%, HitCoverage=30%, E-value=2e-21, Identity=25%"; Hit description=Amino acid adenylation
  Pfam annotation: Domain name=Condensation; Domain location=2-284; Score=-6.4; E_value=8.2e-09; Accession=PF00668.10; Description =Condensation domain
MDALIASPYTHTFWNEYMLNPHSCEYNLVLDQTIEGELDVGRLRAAIDGVCRDYILFHHVLDDSASQLRWVRSAKKIALETLDADCDVGKLINAPFDLREGPLCRFYLIELAPQRYNLIIVVHHILIDGLSGQEFYSAVSAYYNRGTAVTPPQADETDISTLYRRYEADIAALKHEFGSASFWGDMLAECAPRVALPYLPGAAAEAPGAGEVRFALPFAEWQALKSGVRYANPFVIFKTLWALLIARQSAQETVHIGYPIAPEGGEALFFGAQVNTAVFPLTLAPGATFNQLYRATLAYSKALKVAGKLRHSQLPVYDMLSLSPVRQLNVNFTQAYMKDAPLALEGCRIGVNHRFNVDLAGSELLLEYQPTEQAFEFRLRYRPDLFDATQMAEMAEQYLWLLQRALTEPDAPIAAWPQLTAQQVLRCRDAWESGPATADAEATLLDGLARQARRHPERIV

SEQ ID NO: 165860 - protein, 462 aa, Glycine max
  Coding DNA Sequence Number=SeqID_49082
  Gene Ontology: Mol. function=siderophore-iron transporter activity; Cellular component=outer membrane; Biological process=siderophore transport
  Homolog annotation: Hit_ID=Q5PHW8; Match level="QueryCoverage=86%, HitCoverage=56%, E-value=1e-151, Identity=65%"; Hit description =Probable TonB-dependent receptor
  Pfam annotation: Domain name=Plug; Domain location=79-191; Score =96.3; E_value=9.2e-26; Accession=PF07715.5; Description=TonB -dependent Receptor Plug Domain
MPVSFPLNAGTGSQKWLFSPPCGQLFQHYWQNYLMNKKRPALTPATLLLLQPIYIGSALAAEQKDSDTLVVMAQPTGLTELGSPVSVSVIDGEDLRNAAPQINLSENLGSVPGLQIQNRQNYAQDLQLSIRGFGSRSMFGVRGVRMYVDGIPATMPDGQGQTSNIDINSVERIEVLRGPYSALYGNASGGVINVDTITGTQPPTLEAGGYFGSDNTWRYGVKATGATGDGTQAGDVNYAISGTRFTTQGYRDHSAARKNLGNGKLGVRLDDVSTLTLMFNSVSIDAGDPGGLTEAEWKENPRQAPRADQYNTRKSLDQTQAGLRYQRQMSERDELTLTAYHGERHTTQYQSIPMGPQLNPTHAGGVIVLERKYQGIDTRWKHEDTLASLPVTLIGGLDYETMTERRQGFENFILRDGTVDYGEKGDQRRNEKNRIWNLDPYLQTSWQLTPHWDAGCRPALQH

SEQ ID NO: 165861 - protein, 90 aa, Glycine max
  Coding DNA Sequence Number=SeqID_49083
  Subcellular localization annotation: CTP_CleavageSite=38; ConfidenceScore=5.21e-01
MYAKLSRVALSDTMKFRKFTKYGGLSRHARLAQWLPVECSLSKCRNLPFGRRAMRDSRVRVPRKEYARSRHQRLFEENVEKIGKDVIYEL

SEQ ID NO: 165862 - protein, 294 aa, Glycine max
  Coding DNA Sequence Number=SeqID_49084
  Subcellular localization annotation: CTP_CleavageSite=68; ConfidenceScore=5.56e-01
TSSHHPFLIRTTHTLMKDMPFFFLKNSLGAKMKKGIKTFCNNNGSTSTLNQQNSHNNNNYSDFTSKVSSSNSPTLEDLILQLELEEEMARKSKLNSEYSGIMRGRMSCVNNSDILRSARNALNQYPRFSLDGRDAMYRSSFGNIEGIRRRSVCSETSFDLDNNHKGVCCLPPTLAGESVVWRKPGVVAKLMGLEAMPVPIGSSRRSCDNNKEKLSAVVRRQNLIRRRFERHDLERKLLTMEMQHQSYGYHTNNNNNNIRRHNKNNGCCSKNGNCVMKPVALEALAGGPGRRSYA

SEQ ID NO: 165863 - protein, 98 aa, Glycine max
  Coding DNA Sequence Number=SeqID_49085
  Gene Ontology: Mol. function=hydrolase activity
  Homolog annotation: Hit_ID=Q1T2K5; Match level="QueryCoverage=62%, HitCoverage=13%, E-value=5e-13, Identity=55%"; Hit description =Alpha/beta hydrolase fold
TLGELGTGFKDVLRQNLMNEDSYVVRKFNGPCSKVLKRPRFLNDLLPDDCDTVVFFIFILALARGDKKNLGEVVAKTFLTRKEETKLAKKSNDAMLKD

SEQ ID NO: 165864 - protein, 422 aa, Glycine max
  Coding DNA Sequence Number=SeqID_49086
  Gene Ontology: Mol. function=protein binding; Cellular component =integral to membrane; Biological process=protein amino acid phosphorylation
  Homolog annotation: Hit_ID=Q0PY41; Match level="QueryCoverage=94%, HitCoverage=66%, E-value=1e-147, Identity=61%"; Hit description =Leucine-rich repeat family protein
  Pfam annotation: Domain name=LRRNT_2; Domain location=369-409; Score =15.7; E_value=0.02; Accession=PF08263.3; Description=Leucine rich repeat N-terminal domain
MVNRSFKLAHTTEDCDFQTLYPFAMHISCGARQNVQTKPTNTLWREDFGFTGGIAANATRPSFITPPLNTLRYFPLSEGPQNCYNINKVPKGHYSIRIFFGLVGRSKDTSEPLFDISIEGTQIYSLKPGWNKQNDQVFVEALVFLTNDSVSICFHSTGHGDPAILSIEIQQIDDKAYYFGPWWSQGIILRTVKRLSCGFGQSKFDVDYGGDSRGGDRFWQRIKTFGDESDQPRSVETRIKQASHPPNFYPETLYQSALVSTNNEPDLTYALEVDPNRNYSVWLHFAEIDNSVTAAGQRVFNIIINDDHAFKDVDIVELSGDIYTALVLNTTVTVNGRILTITLKPKEGNLAIINAIEIFEVIMVESKTISEEVSALQTLKKALGLPPRFGWNGDPCVPQQHPWFGVDCQLNKSSGSWIIDGL

SEQ ID NO: 165865 - protein, 55 aa, Glycine max
  Coding DNA Sequence Number=SeqID_49087
MITITIMIVSVITVITVITTTNMTVNPCHHHGHDDNHGDSGCNDGGGCGDNLDVN

SEQ ID NO: 165866 - protein, 65 aa, Glycine max
  Coding DNA Sequence Number=SeqID_49088
MQGLLLHFSFLLPVHFVGGKGARISSELSKWQNCPTNIVDEWHCNLIDLLMVLVLHNIGFTTTKY

SEQ ID NO: 165867 - protein, 151 aa, Glycine max
  Coding DNA Sequence Number=SeqID_49089
  Gene Ontology: Mol. function=isomerase activity; Cellular component =nucleus; Biological process=biological_process
  Homolog annotation: Hit_ID=Q9FN32; Match level="QueryCoverage=90%, HitCoverage=75%, E-value=4e-19, Identity=50%"; Hit description =Protein yippee-like At5g53940
  Pfam annotation: Domain name=Yippee; Domain location=20-124; Score =25.3; E_value=4.7e-09; Accession=PF03226.5; Description=Yippee putative zinc-binding protein
MRILVTANSFTFVLTSTAVKGEHTFSAKCYYCTFTSIFYIFQYFVMDDFGGPPHLQGPSPTLRVNVTLGPQVDRMMISGLHTVEDIFCCSCGQPLGWKYVLTHEKNEIYKEGKFVLERWTIVDNEEEELNSDAQAGSLTGSQSGSSDTENA

SEQ ID NO: 165868 - protein, 229 aa, Glycine max
  Coding DNA Sequence Number=SeqID_49090
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=9e-35, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLAFKGLHTLVVRGLQLQTLRGLHVLTLRRPYALALKGLRILTFRGLHFLAFRKLHLLTFRGLHVLAFKGLHILAVRGLHVLAFNGVHVLAFRGLHVLGIRGLHVLTFRGLHVLAFRGLDALSSEDYTGLHILALRGLHALAFKGLHVLTFRGLHVLALKGLHVLTIRGLHVLAFKLLHVLTFRGLQVLAFRGLHVLTFRGLQILAFTGVHVFAIKGLHILAFRGLH

SEQ ID NO: 165869 - protein, 226 aa, Glycine max
  Coding DNA Sequence Number=SeqID_49091
  Pfam annotation: Domain name=zf-CCHC; Domain location=120-137; Score =14.8; E_value=0.0036; Accession=PF00098.13; Description=Zinc knuckle
  Subcellular localization annotation: CTP_CleavageSite=71; ConfidenceScore=5.18e-01
KKGEVVAAQLAQASSARPGEQGCFLQKQPPSGGSSGGPKWAWVLFAPPFLLSTPPLLFFCTSRGPKNGRTSSSKGPRTKLGYDTKNYSLMVNKFGKFLKKSKDKKFSKSTKKIESNNNTFTCSECGKQGHIKCECPIYLRKQVSEKKGKNDRKQKKAYIAWEDNASTSSNSSSDEEVANVCLMAKSMNDSSTMEETKVNSEFEEVLEAFNEMHEEAQRLVLDKWPQ

SEQ ID NO: 165870 - protein, 95 aa, Glycine max
  Coding DNA Sequence Number=SeqID_49092
MGTTRCKPTKGMLLHPTRNLRNHLGVGGLTAEDKILVVDVSNEIVDFTKASSEITERHLKKLGMRFFEHEWIMVGEPPVAGNMDQMDEEAEAEAS

SEQ ID NO: 165871 - protein, 75 aa, Glycine max
  Coding DNA Sequence Number=SeqID_49093
MEEELSQFIKNRVWNLVPPTKNQLVIGTCRNLPFCGSTKAGLLLLRTLHRRGNQTCVVLSKGANQAILFTWKVVI

SEQ ID NO: 165872 - protein, 119 aa, Glycine max
  Coding DNA Sequence Number=SeqID_49094
MCVEVREMVKLGVGGVVPYSVRNHLLMSIHLYHATAVQRLVFLIKKDEKSYQVLRLNKNRNQICARQGNLGRCEILIITEISQILVNFNGHVLAKGRSGRPPVDIVPEDLLRGTLEKGD

SEQ ID NO: 165873 - protein, 121 aa, Glycine max
  Coding DNA Sequence Number=SeqID_49095
MKGDDLESLIIHSLCIDGTHVSYFMLHGNSINFASKYLKFLIRGNTCTWGYVTRFWNSLKTQGDHHGGELPVHDNVTLTLTNVAPCEASEWRRKKDDWRRHFKEKMSQEQAHHHRKPWIRA

SEQ ID NO: 165874 - protein, 194 aa, Glycine max
  Coding DNA Sequence Number=SeqID_49096
  Gene Ontology: Mol. function=sequence-specific DNA binding; Cellular component=nucleus; Biological process=regulation of transcription, DNA-dependent
  Homolog annotation: Hit_ID=Q1T5K9; Match level="QueryCoverage=86%, HitCoverage=87%, E-value=5e-45, Identity=54%"; Hit description =Transcription factor, MADS-box
  Pfam annotation: Domain name=SRF-TF; Domain location=9-59; Score =71.9; E_value=2e-18; Accession=PF00319.9; Description=SRF-type transcription factor (DNA-binding and dimerisation domain)
MGRRKIQIAVVKDPNTRQVTFSKRRTGLFKKANELSILCGVEIAIVVFSIGNKPYSFGHPSVDVVVTKFLQHATNSNDALGSNNSSNEVVGDMERLNQQLSDLQTQILEEEIKGTKHDERLKQHEVTQVFQYKELQGLCLELQRKVKDYVDEIEVSECMLLLAQEPVVGPWVALISARYSEMGEKGTITVNKCF

SEQ ID NO: 165875 - protein, 86 aa, Glycine max
  Coding DNA Sequence Number=SeqID_49097
MFHAPFHSHYPRISTLANGEKNVTLENVMLLEGFATIGDPILIRFQSLEMMKVEKKLIHRQDNNNLQGVKRVGATNLQGVKRVGFI

SEQ ID NO: 165876 - protein, 344 aa, Glycine max
  Coding DNA Sequence Number=SeqID_49098
  Gene Ontology: Mol. function=porphobilinogen synthase activity; Cellular component=chloroplast; Biological process=tetrapyrrole biosynthetic process
  Homolog annotation: Hit_ID=P0ACB2; Match level="QueryCoverage=84%, HitCoverage=90%, E-value=1e-139, Identity=85%"; Hit description =Delta-aminolevulinic acid dehydratase
  Pfam annotation: Domain name=ALAD; Domain location=54-344; Score =634.1; E_value=1.2e-187; Accession=PF00490.11; Description=Delta -aminolevulinic acid dehydratase
  Subcellular localization annotation: CTP_CleavageSite=69; ConfidenceScore=5.49e-01
MAMNPQANVGVFVVLTRSALTRFSAMSDGVNDLVSALSGVQPNMETASQQTMTDLITRPRRLRQSASLRAMFEETTLSLNDLVLPIFVEEEIDDYKAIEAMPGVMRIPEKHLAREIERIANAGIRSVMTFGISHHTDATGSDTWNENGLVARMTRIAKQAVPEMIVMSDTCFCEYTSHGHCGVLCEHGVDNDATLENLGKQAVVAAAAGADFIAPSAAMDGQVQAIRRSLDAAGFTNTAIMSYSTKFASSFYGPFREAAGTALKGDRKTYQMSPMNRREAIRESLLDEAQGADCLMVKPAGAYLDILRDIRERSNLPLGAYQVSGEYAMIKFAAQAGAIDEEKV

SEQ ID NO: 165877 - protein, 411 aa, Glycine max
  Coding DNA Sequence Number=SeqID_49099
  Gene Ontology: Mol. function=nucleic acid binding; Cellular component= membrane; Biological process=DNA integration
  Homolog annotation: Hit_ID=Q1SKG1; Match level="QueryCoverage=58%, HitCoverage=23%, E-value=1e-48, Identity=38%"; Hit description =Integrase, catalytic region; Zinc finger, CCHC-type
MTLEELIVIFKVHEQELAQDKGTNKGKSLALTIPKKYDDDDFDEQDDELSLITKKIRKIQLVDSQPNDTVNSDGEEDFKKTYQPHLIDFILETTSLGDVQDTSVCEEVKALLDEKVSSGRKILLKYFQDLEERVKSLTTTLKDSKEEHKEMLKQKLLLLKECISHGTWIVAYRVYNSRTLTLEEAIHVRFNDNKPNTTMSKLDESFAEMKIEDIVKSIVASSQNQLVSNSPMDDQPKEKLVELPKGKSVVGAKWVFRNKLDETCKVVRNQARLVAKGYSQQEGIDYTKNFGPITRLKAICILLSFVAHHGMMLYQMDIKITLLNGLIKEDVYVKQPLEFKSSIYHHHVFKLNYSFVWFKASSSSLAEFEMSMIRQLKFFLGLQIKQTDEGIYIRQTKYVKELLKKFKMDDA

SEQ ID NO: 165878 - protein, 211 aa, Glycine max
  Coding DNA Sequence Number=SeqID_49100
MAHVSKRLAPKKQTQKPSPTIECVKTLSEIESVDDMPLVLRKRKVAPPSDETSVPQVSEEGLPVIDPNLIVEDIAWPGFLLAFLSKNAYNIQRRLDVKFQPQADWMKLPRDIEEKEEVTCPPSMHKDSQVVSTTTELDRLIGIEVLPPPKWKRLRPKVSKYSSITSQCKNVYKVPFGACREKVSYDKDIIGWFCKIDAQQIDPSSDDFLPN

SEQ ID NO: 165879 - protein, 70 aa, Glycine max
  Coding DNA Sequence Number=SeqID_49101
MALLTIHSKSLALLNSVPYRLEVLAQLGPHKECPMWVHPKQFIFICKGIDSRSFHISGAFMLLTPTTVGM

SEQ ID NO: 165880 - protein, 52 aa, Glycine max
  Coding DNA Sequence Number=SeqID_49102
MHYQKRKTLDEASLLSSELETQHDHRSTSTPYGSKGRYNKHITCCLPQDSMA

SEQ ID NO: 165881 - protein, 112 aa, Glycine max
  Coding DNA Sequence Number=SeqID_49103
MQQGETIRDVQKRFTYSESSQGPLKVFKEEELNIKILKSLNRTWQLKVMTISESKDFASTTHAEIFGKLKEYEMDMTRIIKEEAKEKKHRDLALQSSILSSDESDEECVKGS

SEQ ID NO: 165882 - protein, 111 aa, Glycine max
  Coding DNA Sequence Number=SeqID_49104
MAETKNKRIKSIGHRPIAPKTKSKKDNKSTKGGFSNKGFVFPELLEYHGLNKLVEMKGMFYPELVRVVYTTTHIDGETGYLCAEVKGKQIVMTTEIWEDIVGLFSKGIVVN

SEQ ID NO: 165883 - protein, 49 aa, Glycine max
  Coding DNA Sequence Number=SeqID_49105
MSAFEADSTEESGPGGIATSREQHILEVMRDQKEMTPNRVVNWPFRTLQ

SEQ ID NO: 165884 - protein, 182 aa, Glycine max
  Coding DNA Sequence Number=SeqID_49106
  Homolog annotation: Hit_ID=Q2HSF6; Match level="QueryCoverage=47%, HitCoverage=6%, E-value=2e-21, Identity=59%"; Hit description =Glycoside hydrolase, family 1; Zinc finger, CCHC-type; Polynucleotidyl transferase, Ribonuclease H fold
MLDYSLEYTKICIWCDSMRAINLTKNLIQHSRSKHIDIKQHFIRDHAEKGNIELKFLETKLQLANILTKPLTENSLKFSKSLIDKGKGKAIKVFSRFDLEPTMIITHLSSHSKGVVIRSPKKKNYVKNNSSLLGMPVDIKSLYDEWFDIMGLKKAKIMKKFLEEKDYDFKSKSLKYFGRTIH

SEQ ID NO: 165885 - protein, 227 aa, Glycine max
  Coding DNA Sequence Number=SeqID_49107
  Gene Ontology: Mol. function=nucleic acid binding; Biological process= DNA integration
MGTLLSDIAPCRACRPWIFFTNGVLCFLKINGNKMEKEKSLKVGEDEWRERERRGMKFMPQMRRKIYPKAYENPRAFSCISSSIFLESSIQCPWENGVAGRMNNTLLERAKCMLSNSRLNRSFWAKAVSRACYIVNRPPSTTINFKTPIVVWSNKPVKYSMLKVFGCLPYYHVSEGKFEDVTKQVEFKCSTIRNISDQKYFEAPDKTNHDLQMHPQHQNSTPVEGTN

SEQ ID NO: 165886 - protein, 117 aa, Glycine max
  Coding DNA Sequence Number=SeqID_49108
  Gene Ontology: Mol. function=DNA binding; Biological process=DNA integration
  Homolog annotation: Hit_ID=Q1SJY5; Match level="QueryCoverage=99%, HitCoverage=16%, E-value=4e-21, Identity=36%"; Hit description =Integrase, catalytic region
MCKEVYELMKEEFEMSMMGDLKFFIGLQIIQKYHDIFIHQEKFTKDHSKRFRMDEAKPIATPMHPSTVIYKDEKVGTTNRCPWFEKGPKFDLVSYYDVDFVGDKVERNSISGAIPFL

SEQ ID NO: 165887 - protein, 135 aa, Glycine max
  Coding DNA Sequence Number=SeqID_49109
  Gene Ontology: Mol. function=nucleic acid binding; Biological process= DNA integration
  Homolog annotation: Hit_ID=Q1SUD4; Match level="QueryCoverage=74%, HitCoverage=47%, E-value=3e-09, Identity=32%"; Hit description=Zinc finger, CCHC-type
MVNTIKIEKFTVKNNFNLWHEKAHSLILLALFDEVLYEVSKELIVVGLWFKLEKLLMTKSIYYKSFLKRRLFGLQMKPLPPSYENFVSSHSVGKDSITPEEVMSNLYSKELRLKASMNGDEVSMFGFSVTDSTKG

SEQ ID NO: 165888 - protein, 74 aa, Glycine max
  Coding DNA Sequence Number=SeqID_49110
MKNEVTLSKKGNRNEEKERVLKQAQPNTRAKRASGAKRAKKAGAKRGVKLEEAETVTCAKPSYALSARSNRSTG

SEQ ID NO: 165889 - protein, 102 aa, Glycine max
  Coding DNA Sequence Number=SeqID_49111
MHTLLGSFNSGNWSDSKVLDSTGLGCRTITRNRAHDQGWEQELSPYNQYEEERTPNLESVFEEFMAYHASSKANQNSMKNHEIHFGKSYSIENFQGGPELQP

SEQ ID NO: 165890 - protein, 146 aa, Glycine max
  Coding DNA Sequence Number=SeqID_49112
  Homolog annotation: Hit_ID=Q1SPB9; Match level="QueryCoverage=99%, HitCoverage=30%, E-value=3e-07, Identity=26%"; Hit description =Transposase
  Subcellular localization annotation: CTP_CleavageSite=49; ConfidenceScore=5.30e-01
MCPPPSKVNTKGAPKKPMKRSQRSTKPDPSYLEYVDAFHSVQSSNSSVKHSASSSEPPKPTRIIPMLDQFAPFRQDFIHNIVDVKADGNWISVHYRFIRWSHDYNNLFGGTKRFEQLRLSLLVDGFSKVSVDKWMDITEMGYVIAS

SEQ ID NO: 165891 - protein, 75 aa, Glycine max
  Coding DNA Sequence Number=SeqID_49113
MAEGVGVYGSLGGNVVVVKQHGSDEGGERPLGAVDLAVTDRGSLTASQRRVSALQTSTTRLTEKFKDGVRGVHEG

SEQ ID NO: 165892 - protein, 191 aa, Glycine max
  Coding DNA Sequence Number=SeqID_49114
  Gene Ontology: Mol. function=DNA binding; Cellular component =mitochondrion; Biological process=DNA integration
  Homolog annotation: Hit_ID=Q1S9T4; Match level="QueryCoverage=99%, HitCoverage=14%, E-value=1e-103, Identity=94%"; Hit description =Integrase, catalytic region
MTALKRIIRYIKGTITHGLHLSPSSVDKLTTYTDADWGGCPDTRRSTSGYCVYLGDNLVSWSAKRQPTLSRSSAEAEYRGVANVVSESCWLRNLLLELQCPIAKATLVYCDNVSAVYLSGNPIQHQRTKHIEMDIHFVREKVARGQIRVLHVPSRYQIADIFTKGLPLQLFSDFRDSLNIRPPPVSTTGVY

SEQ ID NO: 165893 - protein, 281 aa, Glycine max
  Coding DNA Sequence Number=SeqID_49115
MVDFLQYADDTIFFGEATTSNVLVGKDMGSHHYKFFKEALGLEAQAFIICGKSLPHKLVCCPKELRVKNIKLFDETLLGKWRWDVSGGTLFWWQDLMRVCGSKSGTKWFDNSFEWKLFLLSDQKEYEIVNMDHWENGHWHWHWNLIWRRDKSQSEQEMVEQLLVISGYGWGGIETRGGYCATVLVENPYVVASVFKLAKSYLFTARSWLRALMKMMNVSFVQWSFCPITYLAEVGNITCMALDNNGKVYAKDEKEKGKGGGFLMCHHFLLFLNPFCHHFNY

SEQ ID NO: 165894 - protein, 113 aa, Glycine max
  Coding DNA Sequence Number=SeqID_49116
MHASEESSSFFLLLMLSLSHPGKITLSSRNEWLKIFSETEPFDSDENDEDDEEEDVVELFVAAEVFLAGSMNGNPAAVGGHVGVAVNKEGNNHNGKRTQQGCGGRLYGCEKWR

SEQ ID NO: 165895 - protein, 99 aa, Glycine max
  Coding DNA Sequence Number=SeqID_49117
PELKVGPSATRVSTKGSCVDPSGQDLSTRESDKCGLYVDDNPFRLVALGRVYEGSTNIHNIPLGNDQVKDKQGAEGPTKPVDRPEPNDDPPYKMTLPIS

SEQ ID NO: 165896 - protein, 138 aa, Glycine max
  Coding DNA Sequence Number=SeqID_49118
MAIEEPIIRDNVSDFSDDEQQRDFHEHGEPSNQSESSLYFETISSQLLENQEYSNPYQRRGRASTNDLYEGLTFESKQVDVNAIKQFHFMHSFNFDVVKNKSGKVRVSFSKIRKRWELKKLNGIHTCTNSFISQIMLG

SEQ ID NO: 165897 - protein, 52 aa, Glycine max
  Coding DNA Sequence Number=SeqID_49119
MASSLRNAHVAGKPPFVGFALQDVQTCFAVQRKGSCNCHWRVKGKLQLPLAI

SEQ ID NO: 165898 - protein, 101 aa, Glycine max
  Coding DNA Sequence Number=SeqID_49120
MWEKERVLGEEEWRTNLGERESVETYRKYTIKVTQGENPHLRKIVEETQAGKVSDFVVDSEGVLHFGTCLCVPNSGGLREKIMEEVHHSSYTIHPGFYLNI

SEQ ID NO: 165899 - protein, 474 aa, Glycine max
  Coding DNA Sequence Number=SeqID_49121
  Gene Ontology: Mol. function=inorganic phosphate transporter activity; Cellular component=integral to membrane; Biological process=phosphate transport
  Homolog annotation: Hit_ID=Q8GSG4; Match level="QueryCoverage=98%, HitCoverage=89%, E-value=0.0, Identity=78%"; Hit description =Phosphate transporter PT4
  Pfam annotation: Domain name=MFS_1; Domain location=1-405; Score =37.6; E_value=4.4e-08; Accession=PF07690.6; Description=Major Facilitator Superfamily
  Pfam annotation: Domain name=Sugar_tr; Domain location=1-448; Score =71.4; E_value=2.8e-18; Accession=PF00083.14; Description=Sugar (and other) transporter
  Pfam module annotation: Pfam domain module=MFS_1::Sugar_tr; Domain location=1-405::1-448
TPTVPGKLPLNVNNMVTGVALVGTLSGQLVFGWLGDKLGRKKVYGITLILMVFCAICSGLSFGATAKSVMGTLCFFRFWLGFGIGGDYPLSATIMSEYANKRTRGAFIAAVFAMQGVGIIFAGLVSMALSGIFKYYYPAPAYIDNPVLSTQPEGDLLWRLVLMIGSVPAMLTYYWRMKMPETGRYTAIIEGNVKQAAADMAKVLDIEIQAEQDKLAEFNANNNYPLWSNEFFKRHGRHLIGTMSSWFLLDIAFYSQNLTQKDIFPAVGLIHKDFEMDAIREVFETSRAMFVIALLGTFPGYWFTVFFIEKIGRYKIQLIGFFMMSFFMFIIGVKYDYLKNEGKGYFALLYGLTFFFANFGPNSTTFVLPAELFPTRVRSTCHALSAAAGKAGALVGTFGIQSLTVGGQSYKIKKVMIILAVTNLLGFFSSFLVTETKGRSLEEISGEDGRESELTPTPNNRIQGRIQGSRTETM

SEQ ID NO: 165900 - protein, 100 aa, Glycine max
  Coding DNA Sequence Number=SeqID_49122
MADRKSAMGGSSSTSSDTKSRRFSKWIPNSVEKILSDDRNNVSAEGSDLVRYIEENEELKQKVASLLEETKANVEEIAYLSKKLAKEEEECRGYREEALK

SEQ ID NO: 165901 - protein, 89 aa, Glycine max
  Coding DNA Sequence Number=SeqID_49123
KVHLLGLLTENKRGYISCGSVLVEGTSTRLFKENKGGPLDPTGGASTAQEPVTEEPTTPAPSPAVAKEETTPAQTPQPSPPSVPAPEET

SEQ ID NO: 165902 - protein, 298 aa, Glycine max
  Coding DNA Sequence Number=SeqID_49124
  Homolog annotation: Hit_ID=UPI0000383ED6; Match level="QueryCoverage =63%, HitCoverage=44%, E-value=1e-26, Identity=38%"; Hit description =COG3598: RecA-family ATPase
VAKLWAQIADYTNCSIDIVHHLRKVADREATVEDARGAVSLIGAARSVRVLNRMSEEQAGEAGIDKADRFGYFYTTYGKSNLTPLSHKAEWRHLVSTPLGNGTGLAQPQDFAPVVTEWQWPSAEEVAGDLTEDQRASILAAVSASDYKKSPKAKNWVGGAVAYAVGLDLDDNVQRKRAASLVTALMREGALVEREERDPVRRELAVPPPRLVCMRAAENVRILLESHALFSFNVSEENFMSKRELIDTGSDKRYVRRDEKGQFKESVDVGRSLSADKRHQAKHDAKPGEGDRGDHKKH

SEQ ID NO: 165903 - protein, 453 aa, Glycine max
  Coding DNA Sequence Number=SeqID_49125
  Homolog annotation: Hit_ID=Q1NN52; Match level="QueryCoverage=37%, HitCoverage=21%, E-value=6e-21, Identity=38%"; Hit description=RecA -family ATPase-like
  Pfam annotation: Domain name=Prim-Pol; Domain location=93-266; Score =158.5; E_value=1.8e-44; Accession=PF09250.1; Description =Bifunctional DNA primasepolymerase, N-termi
MAGNTEIALLHLHVADLALAKVIEPTIWGPRVIVAMFVTFFACDDDHQIMFLRGDDTTLLLTAEPRVNARASVPLARLIKPRRPTLQTPLELAQHYVAQGWPVFPCRSHAEEHVDQATGEIVTLGEKTPLTPNGFKAATRFPRIIERWWSDWPDAAVGLPTGEKTGFFALDIDNKPGGANGFDWLAEMEAEHGPLPDTARVTSPNGGLHIYFKYVVGTRNRGALGAGVDIRSEGGYVLAAGSTMANGRSYKWETDTREIADAPAWLLDLLLPKSAPAHTQYSLSAATNNAYVDAAVDRELADLAGAPMGTRNNALNDAAFSIGTIVGAGALSEAEARALLQGVARGWGRDWSRCCKTIENGLKAGIQNPRHIPEPDFPAHNNTRLVDITRMIQRGLEKGRLREQAAATNNDLTVREDVAREDTNIPEQESASPVSDIEPANGHIPLSPITATA

SEQ ID NO: 165904 - protein, 45 aa, Glycine max
  Coding DNA Sequence Number=SeqID_49126
MAPKKLSAKRSRRDAATEGTSAAPEFDSHRFRSAEHQQCFKAIKG

SEQ ID NO: 165905 - protein, 35 aa, Glycine max
  Coding DNA Sequence Number=SeqID_49127
EMFDVGHQVILFQTSLSVNFPGRCRLAFLSISIGE

SEQ ID NO: 165906 - protein, 109 aa, Glycine max
  Coding DNA Sequence Number=SeqID_49128
MEHMTGAELITSSITERYKSKGALGLDRLKDGSVVMVFLKARKAWMLAYVELLNFLYVGWAMHHPYDSAFVGVSFNPLFPEDFFLVRHMLGYALRLENYVVHIYLDIFI

SEQ ID NO: 165907 - protein, 246 aa, Glycine max
  Coding DNA Sequence Number=SeqID_49129
  Gene Ontology: Mol. function=protein binding; Cellular component =membrane; Biological process=defense response
  Homolog annotation: Hit_ID=Q1SW22; Match level="QueryCoverage=90%, HitCoverage=23%, E-value=4e-57, Identity=48%"; Hit description =Disease resistance protein; AAA ATPase
  Pfam annotation: Domain name=NB-ARC; Domain location=1-155; Score= -95.4; E_value=0.00033; Accession=PF00931.13; Description=NB-ARC domain
DEKVAEYCRKSSFVEVHKLEKPLTEEESLKLFCKKAFQYSSDGDCPEELKDISLEIVRKCKGLPLAIVAIGGLLPQKDESAPEWGQFCRDLSLDLERNSELNSITKILGLSYDDLPFNLRSCLLYFGMYPEDYEVQSDRLIRQWIAEGFVKHETGKTLEEVGQQYLSRLVRRSLVQVSSFRIDGKVKRCRVHDLIHDMILRKVKDTRFCQYIDGRDQFVSSSSHQPLNGGECFYITLGLSRVFMID

SEQ ID NO: 165908 - protein, 211 aa, Glycine max
  Coding DNA Sequence Number=SeqID_49130
MSAPKPSLVCQKEKSRLGPTLGWDRRGCINYNPALAIRQLGYPMKGASTEESLSLFLVRDFGAQSFKIIQRVHKAWESLLRKDEEHRGIRNGIIGGYHEWLKVRTRGLDWLSKLKIINEENFEAPEKDEEVRALKNGLGKARLAKEKFKLVATNVRKECTELREENAATARALEQETKRARKEEHGRDKFRGALWGSNSELKLRREERDHS

SEQ ID NO: 165909 - protein, 132 aa, Glycine max
  Coding DNA Sequence Number=SeqID_49131
MCIRITLGCLRMSLDAWARINRCCVCTDNHSGYFRLPPDAWVRINRCCVCMDNHLGYFYLQLTHGSGLTDVVFITTRGISACHLTHGSGLTDVVFVRIITWVYPPATWHMGQDQQMLCVRITIGCLRMPPDS

SEQ ID NO: 165910 - protein, 112 aa, Glycine max
  Coding DNA Sequence Number=SeqID_49132
MAPRKLASKRSRKDKAAEGTSTAPEYDSHRFRSAVHQQRFEAIKGWSFLRERRVQLRDDEYTDFQEEIGRRRWTSLALPKRFRNVFREEFRKGFNRSSTFFIRSSSFFDLQR

SEQ ID NO: 165911 - protein, 107 aa, Glycine max
  Coding DNA Sequence Number=SeqID_49133
MGETYEIPHHNLANFEPCLGCATEGQAVRAPPAMAENGKLDRIEERLKVIEGSRDYAFPNLEELFLVPNVVTHPKFKVSDFEKYKETTCPKNHLKDVLSEDGDIRKR

SEQ ID NO: 165912 - protein, 115 aa, Glycine max
  Coding DNA Sequence Number=SeqID_49134
  Gene Ontology: Mol. function=helicase activity
  Homolog annotation: Hit_ID=Q1SRJ5; Match level="QueryCoverage=97%, HitCoverage=16%, E-value=8e-16, Identity=35%"; Hit description =Probable helicase [imported]-Arabidopsis thaliana-related
MVESEKLSYIRNNQKKLRVDKYSSLQTSLDTGTAKGLTKGKRVILPSTFVGSHVIWINFTLMVWQYAVILLSPLNLKPTDRPDIVSRIFRLKYEHMLSDLTKGQLLGKVVTYING

SEQ ID NO: 165913 - protein, 270 aa, Glycine max
  Coding DNA Sequence Number=SeqID_49135
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=4e-41, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Pfam annotation: Domain name=Cornifin; Domain location=63-264; Score=- 49.8; E_value=0.076; Accession=PF02389.6; Description=Cornifin (SPRR) family
  Pfam annotation: Domain name=OGFr_III; Domain location=137-156; Score= 3.7; E_value=16; Accession=PF04680.4; Description=Opioid growth factor receptor repeat
  Pfam annotation: Domain name=OGFr_III; Domain location=17-36; Score =3.0; E_value=21; Accession=PF04680.4; Description=Opioid growth factor receptor repeat
  Pfam annotation: Domain name=OGFr_III; Domain location=177-196; Score= 3.6; E_value=16; Accession=PF04680.4; Description=Opioid growth factor receptor repeat
  Pfam annotation: Domain name=OGFr_III; Domain location=201-220; Score= 1.6; E_value=39; Accession=PF04680.4; Description=Opioid growth factor receptor repeat
  Pfam annotation: Domain name=OGFr_III; Domain location=225-244; Score= 3.1; E_value=20; Accession=PF04680.4; Description=Opioid growth factor receptor repeat
  Pfam annotation: Domain name=OGFr_III; Domain location=249-268; Score= 0.3; E_value=68; Accession=PF04680.4; Description=Opioid growth factor receptor repeat
  Pfam annotation: Domain name=OGFr_III; Domain location=81-100; Score =3.4; E_value=17; Accession=PF04680.4; Description=Opioid growth factor receptor repeat
  Pfam module annotation: Pfam domain module=Cornifin::OGFr_III::OGFr _III::OGFr_III::OGFr_III::OGFr_III::OGFr_III::OGFr_III; Domain location=63-264::137-156::17-36::177-196::201-220::225-244::249 -268::81-100
MDHGVLVPTPSEGYTSSPSEGYTPSPSGDNTSSPPKDYLSSPSEDYTSSPSKGHIHSPLEDYMSSHSEDCMSTPSKDYTFSPSEGCMPSPSEDYTSSPLEDYTSSPSEGYTPSLSKDYTSSSSEGCTSYPSEDNTSSPSEGRVPSPSEDYMSSPSEDYTSSRSEGHTPSPLEDYTSSPSESYTPSPSEDYTCSPTEGYMSSPSEGYAPSPSEGYTLLPLEDYMSSPSEGYTPSPSEDYTSSPSEDYTSSPLEGCTPSPSEDYTSSPSEDY

SEQ ID NO: 165914 - protein, 287 aa, Glycine max
  Coding DNA Sequence Number=SeqID_49136
  Gene Ontology: Mol. function=phosphoglycolate phosphatase activity; Biological process=carbohydrate metabolic process
  Homolog annotation: Hit_ID=Q9EYY5; Match level="QueryCoverage=69%, HitCoverage=79%, E-value=1e-104, Identity=94%"; Hit description =Phosphoglycolate phosphatase
  Pfam annotation: Domain name=Hydrolase; Domain location=85-286; Score= 126.9; E_value=5.6e-35; Accession=PF00702.16; Description=haloacid dehalogenase-like hydrolase
  Pfam annotation: Domain name=Ribul_P_3_epim; Domain location=1-68; Score=-38.9; E_value=2.2e-07; Accession=PF00834.9; Description =Ribulose-phosphate 3 epimerase family
  Pfam module annotation: Pfam domain module=Hydrolase::Ribul_P_3_epim; Domain location=85-286::1-68
MSVNPGFGGQSFIPHTLEKLRQVRQLIDQSGYDIRLEVDGGVKASNIGEIAAAGADMFVAGSAIFGQPDYKKVIDQMRSELAKAIRGVAFDLDGTLVDSAPGLTAAVDSALYALELPVAGEERVVTWIGNGADVLMERALTWARQERATLRAAMGKPSVDDHDIPQDEQLRVLRKLFDRYYAEAAEEGSFLFPAVADTLGALHAKGLPLALVTNKPTPFVAPLLEALDIAKYFSVVIGGDDVQNKKPHPDPLLLVAQKLSLTPAELLFVGDSRNDIQAAKAAVAALS

SEQ ID NO: 165915 - protein, 43 aa, Glycine max
  Coding DNA Sequence Number=SeqID_49137
MAEPSKKRNGTSSRSQRHSGSQETPIPSSIPSGSLFSSEEQRI

SEQ ID NO: 165916 - protein, 223 aa, Glycine max
  Coding DNA Sequence Number=SeqID_49138
  Gene Ontology: Mol. function=3-isopropylmalate dehydratase activity; Cellular component=3-isopropylmalate dehydratase complex; Biological process=branched chain family amino acid biosynthetic process
  Homolog annotation: Hit_ID=Q8ZRI9; Match level="QueryCoverage=77%, HitCoverage=83%, E-value=1e-64, Identity=68%"; Hit description=3 -isopropylmalate dehydratase small subunit 2
MAVQHQQRRALAAAGHAQRNAIIQRHILQGKTGDKRRRAAIDNLTHGCSLRPVHRAAATDQHFALQGTDRKVNHFIRELNGLLLQRHADGVALRIGGHRAQTLIIRLAQTQRQHAVTLAVIVKNAGEAGADNRADAQLIQPPHRMFAAGAAAKIGTDQQKRRVLPARLIKDEIRVWCPVGQKAQVKEHPAIQPLPVNAFEKLLGHNHIGIDVSSRQRCQLAGD

SEQ ID NO: 165917 - protein, 297 aa, Glycine max
  Coding DNA Sequence Number=SeqID_49139
  Homolog annotation: Hit_ID=Q47522; Match level="QueryCoverage=12%, HitCoverage=45%, E-value=8e-14, Identity=97%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSKQDSALMYEQRRLIRKERIQKLSHNLVAKLSLYTDTFPFPDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 165918 - protein, 212 aa, Glycine max
  Coding DNA Sequence Number=SeqID_49140
  Gene Ontology: Mol. function=transporter activity; Cellular component= integral to membrane; Biological process=transport
  Homolog annotation: Hit_ID=Q0JY23; Match level="QueryCoverage=90%, HitCoverage=45%, E-value=7e-41, Identity=45%"; Hit description =Putative MFS transporter
  Subcellular localization annotation: CTP_CleavageSite=28; ConfidenceScore=5.46e-01
MVAFHQAGAMTPAGSASGWDKTMGSPVTAAEDSLLRHRSFVAFWLARTCSSFGFQMFSVAVSWQIYALTHSAMALGMIGLMQFLPSVLLALPAGHLADQYDRRRIVLLGQLIEWLALLGLVALTLLHWAGRIEIWGLVFLISLAKALEWPAITSMLPALVPPPILARAMAASSVGGQAAVIVGPTLGGLLYVAGPEVVYGVSALFYLLSIVL

SEQ ID NO: 165919 - protein, 208 aa, Glycine max
  Coding DNA Sequence Number=SeqID_49141
MENNSYHPYVTERVCRFDGTPIGACYSASLMHCVPERDALLHEGEIITQHYQSADAAGLIIIPLAGNSVMSFLHDVDNYSSLQHENVRLAINYATLRQAGSALRAVASRFSFWLYDLAPPGTEWKNITDFPFSGIVLSDDFFRENYLKFSFPFLLASLRETQAEVILPKRLANAAELSSALPGVNVYTKFCASALSPDYAGQDGAISS

SEQ ID NO: 165920 - protein, 442 aa, Glycine max
  Coding DNA Sequence Number=SeqID_49142
  Gene Ontology: Mol. function=transferase activity, transferring phosphorus-containing groups; Cellular component=membrane; Biological process=two-component signal transduction system (phosphorelay)
  Homolog annotation: Hit_ID=Q1LCE1; Match level="QueryCoverage=44%, HitCoverage=90%, E-value=2e-51, Identity=55%"; Hit description=Two component transcriptional regulator, winged helix family
  Pfam annotation: Domain name=HAMP; Domain location=302-371; Score =30.7; E_value=5.2e-06; Accession=PF00672.15; Description=HAMP domain
  Pfam annotation: Domain name=HisKA; Domain location=375-440; Score =56.9; E_value=6.5e-14; Accession=PF00512.15; Description=His Kinase A (phosphoacceptor) domain
  Pfam annotation: Domain name=Response_reg; Domain location=1-105; Score=75.3; E_value=1.9e-19; Accession=PF00072.14; Description =Response regulator receiver domain
  Pfam annotation: Domain name=Trans_reg_C; Domain location=137-205; Score=51.4; E_value=2.9e-12; Accession=PF00486.18; Description =Transcriptional regulatory protein, C
  Pfam module annotation: Pfam domain module=HAMP::HisKA::Response _reg::Trans_reg_C; Domain location=302-371::375-440::1-105::137-205
DEMIGANLQQALEAAGWSVDWVRDGVFASNAWQEGGYTCVLLDLGLPREDGINVLRRARTRGDMTPVLVLTARDTVQQRIQGLDSGADDYLLKPFDLQEVLARMRAITRRRHGAADSLLGNGDVQLDMMTREVLYKGQREQLTAREYALLYALLERPGAILSREQLENRIYGWGEEVTSNAVDVLIHGMRRKLDNEILYVYAVAAQQTAGHAGAAASGDDRRCHLDDQLAKIADAWSSSQRMPALMPMVMQQEKLKIGDCGDDCQWRVYTRPGELGSEIGNIQVLHNVGYMKSLMVKRVLSAIIPLILMMPLSLLVIWLVVRAITRDLRVASRQIAAQETLHPHSVSPDGLPDEVLPLVDAYNSLLDKLRAAWSSQRQFLEDAAHELRTPVTAVTLQLENLRQHILPGEASRQFDQLEAGVTRTRHLVTQLLNISRQEDQSV

SEQ ID NO: 165921 - protein, 170 aa, Glycine max
  Coding DNA Sequence Number=SeqID_49143
YAILTRMSIHVAQLIIDAIYIFAVLVAPSKVIRPPITRAFIEKYCTQRQVQGDAPQAADAPPPNQAGPAELFDTKQYLRHLVRQQVANHRAHVQTHDCLYQMSLSLQSKGFTSFPCPTPDQFRAEVAWPGDWPEARAGEASTEAPDEADEAREDEEMTDLLDFLGGSGAT

SEQ ID NO: 165922 - protein, 61 aa, Glycine max
  Coding DNA Sequence Number=SeqID_49144
MEARVGMAVDGGGVRKLVQPPPKQIGTVSQLLAGGVAGAFSKTYSGNAFQCCSFEKSQYME

SEQ ID NO: 165923 - protein, 68 aa, Glycine max
  Coding DNA Sequence Number=SeqID_49145
MSLPSAVHVFSLIKCEASGDWEARYSVVFQIGSFAKRKKRRSRDESRHCEKGRTDEISVLSLLSSYLR

SEQ ID NO: 165924 - protein, 208 aa, Glycine max
  Coding DNA Sequence Number=SeqID_49146
  Gene Ontology: Mol. function=transporter activity; Cellular component= mitochondrial inner membrane; Biological process=transport
  Homolog annotation: Hit_ID=Q9M058; Match level="QueryCoverage=76%, HitCoverage=38%, E-value=1e-36, Identity=51%"; Hit description=Ca -dependent solute carrier-like protein
  Pfam annotation: Domain name=Mito_carr; Domain location=15-137; Score= 101.2; E_value=3e-27; Accession=PF00153.17; Description=Mitochondrial carrier protein
MVPRLQSHRDNVSADLCVHFVGGGMAGITAATSTYPLDLVRTRLAAQPFPLWPYAFYLHLCPSFDEYYQSMICAQVVIQTNFTYYRGIWHALHTISKEEGIFGLYKGLGTTLLTVGPSIAISFSVYETLRSYWQSNRSDDSPVVISLACGSLSGIASSTVKNPLVKLLNLLNRRTSKKLMSVVVYYAFDAEKESLVQELHQVSNQTDP

SEQ ID NO: 165925 - protein, 47 aa, Glycine max
  Coding DNA Sequence Number=SeqID_49147
  Subcellular localization annotation: CTP_CleavageSite=23; ConfidenceScore=5.07e-01
MTKEVIHSHNSAAPQLQFSFSLSSSSTFSLKTCKECREILSGELQLA

SEQ ID NO: 165926 - protein, 402 aa, Glycine max
  Coding DNA Sequence Number=SeqID_49148
  Gene Ontology: Mol. function=zinc ion binding
  Homolog annotation: Hit_ID=UPI000034EE49; Match level="QueryCoverage =99%, HitCoverage=78%, E-value=1e-163, Identity=69%"; Hit description= zinc ion binding
  Pfam annotation: Domain name=LIM; Domain location=58-117; Score=15.6; E_value=8.4e-05; Accession=PF00412.12; Description=LIM domain
MALSSAEDLKRPNAHQGYNWGEDTGDDYSKAPRDTLNSSAHPPFAPTPFYPHEYRRICGGCNQEIMYGNCLGCMDTYFHPNCFRCHSCGYPITEREIPINAAGLIEYRCHPFWSQKYCPSHEYDNTARCCSCERLEPLNIKYYRLEDGRSLCLECMESAIMDTGDCQPLYHSIRDYYEGMQMRIDQQIPMLLVEREALNEAIVGEKNGFHHLPETRGLCLSEEQTVTSIHRRPRIGGHRLIGMRTQPQKLTRKCEVTAILVLYGLPRLLTGAILAHELMHAWLRLNGSIFLYFDPYGYRNLNPEVEEGICQVLSYMWLESEVMPSFQNMPSTSTSAASSYSSSKKGAKSHVENKLGEFFKNQIANDSSPAYGGGFRAANEAVNRYGLRRTLDHIHWTGFFPV

SEQ ID NO: 165927 - protein, 77 aa, Glycine max
  Coding DNA Sequence Number=SeqID_49149
MPRIHDAILYYNRKWNMPPQNKFVGCAFTGKNPKKFQIPSRCTIDELKNLIKQVAPKGIPPLGIHESQTVSGTSLNN

SEQ ID NO: 165928 - protein, 245 aa, Glycine max
  Coding DNA Sequence Number=SeqID_49150
  Gene Ontology: Mol. function=snoRNA binding; Cellular component =nucleus; Biological process=35S primary transcript processing
  Homolog annotation: Hit_ID=Q8W4D9; Match level="QueryCoverage=79%, HitCoverage=49%, E-value=7e-74, Identity=61%"; Hit description=SOF1 protein-like protein
  Pfam annotation: Domain name=WD40; Domain location=106-142; Score =10.3; E_value=2.3; Accession=PF00400.22; Description=WD domain, G -beta repeat
  Pfam annotation: Domain name=WD40; Domain location=165-203; Score =4.3; E_value=11; Accession=PF00400.22; Description=WD domain, G-beta repeat
  Pfam annotation: Domain name=WD40; Domain location=56-95; Score=11.0; E_value=1.9; Accession=PF00400.22; Description=WD domain, G-beta repeat
  Pfam module annotation: Pfam domain module=WD40::WD40::WD40; Domain location=106-142::165-203::56-95
MKVKVISRSVDEFTRERSQDLQRVFRNYDPSLRPQEKAVEYVRAVNAVKLDKIFARPFIGALDGHIDAVSCMTRNPSQLKGIFSSSMDGDGEGWKRRGGNLFCYVVDFQNMFPGHRGAVRGLTASTDGHILVSCGTDCTGADHQWDGEHFATAGAQVDIWNHNRSQPINSFEWGTDTVISVRFNPGEPNLLATSARYVRLPWPLAATMTSAVGWIEGAAVAFVIALVWYGAIAVCVAVSQLQLRF

SEQ ID NO: 165929 - protein, 358 aa, Glycine max
  Coding DNA Sequence Number=SeqID_49151
  Gene Ontology: Mol. function=caspase activity; Cellular component =membrane; Biological process=proteolysis
  Homolog annotation: Hit_ID=Q9FI89; Match level="QueryCoverage=99%, HitCoverage=43%, E-value=1e-144, Identity=73%"; Hit description =Similarity to regulatory protein Nedd1
  Pfam annotation: Domain name=WD40; Domain location=123-161; Score =16.8; E_value=0.077; Accession=PF00400.22; Description=WD domain, G -beta repeat
  Pfam annotation: Domain name=WD40; Domain location=165-205; Score =15.1; E_value=0.26; Accession=PF00400.22; Description=WD domain, G -beta repeat
  Pfam annotation: Domain name=WD40; Domain location=210-249; Score =18.6; E_value=0.022; Accession=PF00400.22; Description=WD domain, G -beta repeat
  Pfam annotation: Domain name=WD40; Domain location=252-290; Score =7.1; E_value=5.5; Accession=PF00400.22; Description=WD domain, G -beta repeat
  Pfam annotation: Domain name=WD40; Domain location=31-69; Score=24.2; E_value=0.00046; Accession=PF00400.22; Description=WD domain, G-beta repeat
  Pfam annotation: Domain name=WD40; Domain location=80-119; Score =11.0; E_value=1.9; Accession=PF00400.22; Description=WD domain, G -beta repeat
  Pfam module annotation: Pfam domain module=WD40::WD40::WD40::WD40::WD4 0::WD40; Domain location=123-161::165-205::210-249::252-290::31 -69::80-119
  Subcellular localization annotation: CTP_CleavageSite=56; ConfidenceScore=5.19e-01
MALLAASGGDTVKLFDASAVKPGVYTPAGDPCALSFTPSPGSQVNSVKWNHTNLVVASAGDDKKISLWRKNGNSMGTIPVAGTDSGDNIEESILAISFSNKASRYVCSGGTGQVVRIWDLQRKRCIKWLKGHTNTVTGVMYNCKDEHLASISLSGDLMLHNLASGQKAAELKDPNQQMLRVLDYSRVSRHLLVTAGDDGTVHLWDTTGRSPKVSWIKPHSAPTAGISFSPSNDKIIASVGLDKKMYIYDSGSRRPSSYISYEAPFSSLAFRDDGWMLAAGTSNGRVAFYDVRGKPQPVAVLHAYGSSEGKVGTIIYSIQACNRLLQAYAGKGLNQLLSMKEIALQRLLLWEIQLKIQY

SEQ ID NO: 165930 - protein, 377 aa, Glycine max
  Coding DNA Sequence Number=SeqID_49152
  Gene Ontology: Mol. function=hydrolase activity; Cellular component =cytoplasm; Biological process=chromatin modification
  Homolog annotation: Hit_ID=Q9MB26; Match level="QueryCoverage=99%, HitCoverage=97%, E-value=1e-139, Identity=92%"; Hit description=Type 1 protein phosphatase-1
  Pfam annotation: Domain name=Metallophos; Domain location=123-318; Score=144.2; E_value=3.4e-40; Accession=PF00149.18; Description =Calcineurin-like phosphoesterase
MSTQGQVIDEAVLDDIIRRLTEVRLARPGKQVQLSESEIKQLCVASRDIFINQPNLLELEAPIKICGTPFAFFSLSPLNLLPFVFRGLTQPLPLPGLETIRVALSLTEHNGIELLREFGFGFNSILKASDIHGQYSDLLRLFEYGGLPPTANYLFLGDYVDRGKQSLETICLLLAYKIKYPENFFLLRGNHECASINRIYGFYDECKRRFNVRLWKAFTDCFNCLPVAALIDEKILCMHGGLSPELTNLDEIRNLPRPTAIPDTGLLCDLLWSDPGRDVKGWGMNDRGVSYTFGPDMVAEFLTKHDLDLVCRAHQVVEDGYEFFADRKLVTIFSAPNYCGEFDNAGAMMSVDENLMCSFQILKPAEKKSKFVMSNKM

SEQ ID NO: 165931 - protein, 396 aa, Glycine max
  Coding DNA Sequence Number=SeqID_49153
  Gene Ontology: Mol. function=tetrahydrofolylpolyglutamate synthase activity; Cellular component=extracellular space; Biological process= folic acid and derivative biosynthetic process
  Homolog annotation: Hit_ID=Q8W040; Match level="QueryCoverage=90%, HitCoverage=63%, E-value=1e-138, Identity=66%"; Hit description =Dihydrofolate synthetase /folylpolyglutamate synthetase
  Pfam annotation: Domain name=Mur_ligase_M; Domain location=67-278; Score=-18.2; E_value=9.6e-05; Accession=PF08245.2; Description=Mur ligase middle domain
MSDQEGGKGSPKSSSLGPYEEAMEALSSLITRRTRADDSNVGDQFSLLYDYLKMLDLEEPIANMKIIHVAGTKGKGSTCTFTESILRNCGFRTGLFTSPHLIDIRERFRLDGMEICEEKFLAYFWWCYDRLKEKTDDNIPMPTYFRFLALVAFKIFAAEQVDVAIMEVGLGGKYDATNVVQSPIVCGITSLGYDHMEILGNTLGEIAGEKAGIFKNRIPAFTVPQPDEAMHVLEEKASLLNVPLQVVTPLDAKLLNGLRLGLEGEHQYLNAGLAIALCFTWLKRTGHVGDIYMEQTDTLPEQFVKGLTSASLQGRAQIVPDQHIKSERSNELVFFLDGAHSPESMEVCARWFSLAIKEYNPDQTLFHQQLNNSKLSHEVVKSTYHGERDPRENPLR

SEQ ID NO: 165932 - protein, 245 aa, Glycine max
  Coding DNA Sequence Number=SeqID_49154
  Gene Ontology: Mol. function=tetrahydrofolylpolyglutamate synthase activity; Biological process=folic acid and derivative biosynthetic process
  Homolog annotation: Hit_ID=Q9FI88; Match level="QueryCoverage=36%, HitCoverage=16%, E-value=1e-21, Identity=56%"; Hit description =Tetrahydrofolylpolyglutamate synthase-like protein
MILLFNCLTVRDPQLLLPRLMKTCADHGVYFKKALFVPSLSVFNKVGPQAFTPTDSKVDLSWQFSLQRVWENLMQGSKVRTIDVDGNYQVQILVCVFQWGWLNDQSMALGFIKNSYNYQAFSTRWDWLHGSNDIIMFIVLTEPNFNKPFVVWHSVPTPNLIFFCEFIEIYYMMGELPCLFSTRLFPCIPSLVVSCRSTDIVSEELKDDMEMSASNCEHSTVFSSLPLAIKWLRDRVQQNQSVRFQ

SEQ ID NO: 165933 - protein, 413 aa, Glycine max
  Coding DNA Sequence Number=SeqID_49155
  Homolog annotation: Hit_ID=Q9FI89; Match level="QueryCoverage=99%, HitCoverage=53%, E-value=1e-103, Identity=51%"; Hit description =Similarity to regulatory protein Nedd1
MASGSGFTSSILNASTAEETPQRNHLWPGGTLSRLHAPRASYNFKDDMEVFSPLVDVQPLTPSLWDENGIKKDNLFSDRKPLLFPSSSRRFSNSEDGTSDHPISDWKSGSTTKQDITQSSFPLVGSTPPPPSSKNEDSSITPPEAWGGERLSDKYAYTRQPVNAPSRFGVLASAGQTAGSMLSGLQDTSSSVGVSSYTSSSLSFANLRAKDASSSQETSLGFTDHMFSAPMSINTKTSLGQAIDSPKILDSPRMSSFNRRFSTYAERISTTSTLSDGVSLSVGSPKIKKSGAETREELLNSLLLKSDISAPIESGSLPLTSGIISQPKASQPDAQGSSFTLQLFQRTLEETLDSFQKSIHEDMRNLHIEILRQFHMQETEMSAVMNSILENQAELMKEVKSLRQENQQLRQML

SEQ ID NO: 165934 - protein, 113 aa, Glycine max
  Coding DNA Sequence Number=SeqID_49156
  Homolog annotation: Hit_ID=Q60EM1; Match level="QueryCoverage=77%, HitCoverage=32%, E-value=1e-14, Identity=49%"; Hit description =Unknow protein
MAHVATSANMQIFPPNNGGDRGPGYNTLGSPTEAFEQQPANNWRGVFSISSYSEYFNVDTDVVLIRLISSLNPVAGDFFSKIDANPDLCVIFLCPCAFILSIIKMEILIWITY

SEQ ID NO: 165935 - protein, 174 aa, Glycine max
  Coding DNA Sequence Number=SeqID_49157
MVQNLKVFMYKPNKPQLKCATTVESLFYSSLQNSTYLTQDPEEAHLFFFPFFLNLSTRFLARVLTRIRKDFILGVWRGGVWERRVVHREALRVGCVPVVVTRDSSTTCVYGCVELERKDSVCEKCARSDVFVGQHVEGTTKANEKIGCGGEYAPQVEPASFALRCVQHYMYQMP

SEQ ID NO: 165936 - protein, 473 aa, Glycine max
  Coding DNA Sequence Number=SeqID_49158
  Gene Ontology: Mol. function=histone acetyltransferase activity; Cellular component=nucleus; Biological process=metabolic process
  Homolog annotation: Hit_ID=Q9FJT8; Match level="QueryCoverage=97%, HitCoverage=98%, E-value=1e-137, Identity=53%"; Hit description =Histone acetyltransferase type B catalytic subunit
  Pfam annotation: Domain name=Acetyltransf_1; Domain location=226-295; Score=13.1; E_value=0.075; Accession=PF00583.14; Description =Acetyltransferase (GNAT) family
  Pfam annotation: Domain name=MOZ_SAS; Domain location=174-319; Score=- 106.9; E_value=0.015; Accession=PF01853.9; Description=MOZSAS family
  Pfam module annotation: Pfam domain module=Acetyltransf_1::MOZ_SAS; Domain location=226-295::174-319
MGQKQRSSSDADNEVKKRRRVGFSGVDSGVEAKDCITIYLVSSKEEFDAPESFVIHPVDLNSFFDDDGKIYGYEGLKITIWVSSISFYAYADITFQSSSDRGKGVTDLKSALQTIFAETLVDSKDEFLQKYLVDNDFVRTNISNGEALKHKAFQGNISDYNPHTDSSTSTVEVVRLVAGNMTTGQLYSHLIPLTLLLVDGSSPIDVTDSQWELYVLCQKKTDPQGEIQCRLIGFTAVYRFYHYPDDSRLRLSQILVLPPYQHKGYGRFLLEVLYDVAISENVFDFTVEEPLDHFQHVRTCVDSLRLLQFYPIQNIVTKAVSLLKQGKLSKKANCPRLLPPPSAIEDVRKSLKINKQQFLQCWEVLIYIGLNPVDKNTENFVSIILNRVKYDILGKDSGTSGKQLIEVPSDVDQEMSFVMFRSEANEASSVQMDDNQANQEEQLQRLVQERVKEIQLIAEKVTLHLGSSGVVVN

SEQ ID NO: 165937 - protein, 332 aa, Glycine max
  Coding DNA Sequence Number=SeqID_49159
  Gene Ontology: Mol. function=glutamate-5-semialdehyde dehydrogenase activity; Cellular component=cytoplasm; Biological process=amino acid biosynthetic process
  Homolog annotation: Hit_ID=Q6RUF7; Match level="QueryCoverage=99%, HitCoverage=46%, E-value=1e-151, Identity=80%"; Hit description =Delta-pyrroline-5-carboxylate synthetase
MEDPIGQVLKRTELSDGLILEKTSSPLGVLLIVFESRPDALVQIASLAIRSGNGLLLKGGKEAKRSNAILHKVITEAIPDTVGGKLIGLVTSREEIPELLKLDDVIDLVIPRGSNKLVSQIKSSTKIPVLGHAVCAITNPDGVCHVYVDKSANVEMARGIVLDAKLDYPAACNAMETLLIHKDLIEKGWLNDIVVDLRTEGVKLYGGPRASSLLNIPQAHSFHHEYSSLACTVEIVDDVAHTDSIIAEDKEVANVFLRQVDSAAVFHNASTRFSDGARFGLGAEVGISTSRIHARGPVGVEGLLTTRWILKGSGQVVDGDKGIVYTHKDLAA

SEQ ID NO: 165938 - protein, 253 aa, Glycine max
  Coding DNA Sequence Number=SeqID_49160
  Gene Ontology: Cellular component=mitochondrial matrix
  Homolog annotation: Hit_ID=Q8W487; Match level="QueryCoverage=74%, HitCoverage=76%, E-value=4e-48, Identity=51%"; Hit description =Protein At2g39795, mitochondrial precursor
  Pfam annotation: Domain name=MAM33; Domain location=73-251; Score =88.2; E_value=2.6e-23; Accession=PF02330.6; Description =Mitochondrial glycoprotein
  Subcellular localization annotation: CTP_CleavageSite=57; ConfidenceScore=5.23e-01
MAFNSILRKSGSFARALAVAGQLTKNSNLGHRSLHFTAINQHQHKDSFVPRFHFSSVASKKKPTSDENLLRVIESEIECAQETDDHNAAEEVPGNFPFKIIDSPGQQTIMLERTYQDEEIKVEVHMPDLVTGEENDDDNDNQSERTAQSSIPLSISVHKKDGPYLEFNCVGYPDEIVIDGLSVKNPDLTEDQVAYEGPGFQTLDENLQKSFHKYLEIRGIKPSTTNFLHEYMINKDSKEYLVWLNKLKSFVQA

SEQ ID NO: 165939 - protein, 104 aa, Glycine max
  Coding DNA Sequence Number=SeqID_49161
MTKFCLCLSSGPPPLDDKRVRITVRYLRVSSGPPPLDDTRVRITVRMTKFCLGVSSGPPPLDDKRVRITVRYFRVSSGPSPLDDSRVQNDRKVSPRVIEPAASG

SEQ ID NO: 165940 - protein, 178 aa, Glycine max
  Coding DNA Sequence Number=SeqID_49162
  Gene Ontology: Mol. function=hydrolase activity, acting on glycosyl bonds; Biological process=metabolic process
  Homolog annotation: Hit_ID=Q8VRN3; Match level="QueryCoverage=98%, HitCoverage=29%, E-value=1e-50, Identity=53%"; Hit description =Enterotoxin
MTYRDAETYRSIVRKGPLFPLNSLMYHGIVSAENAYYGLEKPQTDSDFADQELYITPSLLNKVKWDTLAQAAKWSRANADVLVDTHWVGGDPTALEVYGWASWNKDKAILGLRNPSDKPQQFYLDLAKAFEIPQGETSRFTLKSVYGSNATFPADYQQAAIVTLQPLQTLVFEATPVK

SEQ ID NO: 165941 - protein, 263 aa, Glycine max
  Coding DNA Sequence Number=SeqID_49163
  Gene Ontology: Mol. function=oxidoreductase activity; Cellular component=vacuole; Biological process=hydrogen peroxide catabolic process
  Homolog annotation: Hit_ID=Q9FX85; Match level="QueryCoverage=95%, HitCoverage=72%, E-value=2e-81, Identity=60%"; Hit description =Peroxidase 10 precursor
  Pfam annotation: Domain name=peroxidase; Domain location=1-226; Score= 305.8; E_value=7.7e-89; Accession=PF00141.13; Description=Peroxidase
MFNYLSKGCDASVLLDDTPYFTGEKNALPNHNSLRGFEVIDDIKEHLERICPSTVSCADILALAAREAIDQIGGPSWPVQLGRRDATTTSKEAAEQQIPSPIEPLENITAKFFSKGLDMKDVVALSGAHTIGFARCFTFKRRLFDFQGSGRPDPVLEFSLLSKLQNMCPNEDASNSNLAPLDATSTMMFDNEYYRNIVYNTGLLESDQALIKDRRTAPTVYYYSNNQFSFYNDFAESMVKLSNVGVLTGTEGQIRYKCGSVNY

SEQ ID NO: 165942 - protein, 96 aa, Glycine max
  Coding DNA Sequence Number=SeqID_49164
MQNSHKDVYLEVCLNGIHWQMVIILPKDNDVIWFCSLHNRPDNYLKGIINSQGSKFKTATRWIIVKVLIMPRCKQHKSTSSQNSRSRKQDQEKDKT

SEQ ID NO: 165943 - protein, 178 aa, Glycine max
  Coding DNA Sequence Number=SeqID_49165
  Gene Ontology: Mol. function=4 iron, 4 sulfur cluster binding; Biological process=nitrate assimilation
  Homolog annotation: Hit_ID=Q06457; Match level="QueryCoverage=94%, HitCoverage=20%, E-value=2e-31, Identity=44%"; Hit description =Nitrate reductase
  Pfam annotation: Domain name=Fer2_BFD; Domain location=121-173; Score= 67.3; E_value=4.9e-17; Accession=PF04324.5; Description=BFD-like [2Fe- 2S] binding domain
TAVRIHPLNVSWQGWLWQRDASPPDALRYWARTPYEGVQRFSVAGDGSPEQWLMATIPLAGLQLQTAHAAEPHYRLLAWRASLPEINHDWVAQAFRQAPVNAADRHALLAGQSAQRAVAGRTICSCFGVGENTILQAIKQGCHSTQALGNALNCGTNCGSCLPELKHLLLSVAVPEEE

SEQ ID NO: 165944 - protein, 78 aa, Glycine max
  Coding DNA Sequence Number=SeqID_49166
  Gene Ontology: Mol. function=peptidase activity
MALANFLFPEGNSINRPPIFNGEGYHYWKTCMQIFIEAIDLNIWEAIEIRPYAPTIVDASTTTEKPRNQWSEEDRRRF

SEQ ID NO: 165945 - protein, 132 aa, Glycine max
  Coding DNA Sequence Number=SeqID_49167
  Homolog annotation: Hit_ID=O48719; Match level="QueryCoverage=57%, HitCoverage=54%, E-value=1e-16, Identity=50%"; Hit description =Expressed protein
MSTPFVQQPPPLEVTQQSYTTHLGHGSVGPVIAVLAVITVLGVIAGMIGRLCSGRRVMGHGEYDVETWVETKCSSCVDGRIAPPTPRPRPPPPPEPNSGGDLPPEEPPQEIKEEEQQQEQHRRQHSHSHCDS

SEQ ID NO: 165946 - protein, 149 aa, Glycine max
  Coding DNA Sequence Number=SeqID_49168
  Gene Ontology: Mol. function=electron carrier activity; Cellular component=membrane; Biological process=electron transport
  Homolog annotation: Hit_ID=Q9XIL1; Match level="QueryCoverage=78%, HitCoverage=44%, E-value=1e-35, Identity=58%"; Hit description =Expressed protein
  Pfam annotation: Domain name=Cu_bind_like; Domain location=38-133; Score=-9.8; E_value=0.00071; Accession=PF02298.8; Description =Plastocyanin-like domain
MATNFAQCLILLAITASIFEVSMANKDWEIIVGGSEHWHFGYNYTNWAINNGPFYFNDTLVFKYDAPNATSFPHSVYLLANFWSFLNCDVKKAKMLANPKQGAEEGFKFVLKKWQPYYFACGERNGFHCNNGQMKFAVIPMLRPFWPWP

SEQ ID NO: 165947 - protein, 119 aa, Glycine max
  Coding DNA Sequence Number=SeqID_49169
  Gene Ontology: Mol. function=actin binding; Biological process =cytoskeleton organization and biogenesis
  Pfam annotation: Domain name=Transposase_21; Domain location=2-119; Score=23.8; E_value=1.2e-16; Accession=PF02992.5; Description =Transposase family tnp2
MDFSQNLFTKGAYYLTGPRQPRNDIDVYLSPLIEELTKLWDEGVAVFDGYRNETFKLRAMLFCTINDFPTYENLSGYNVKGHCACPICEEDTSYVQLKHGRKIVYTWHRHFLKPYHPYR

SEQ ID NO: 165948 - protein, 183 aa, Glycine max
  Coding DNA Sequence Number=SeqID_49170
  Gene Ontology: Mol. function=DNA-directed DNA polymerase activity; Cellular component=nucleus; Biological process=response to DNA damage stimulus
  Homolog annotation: Hit_ID=P22494; Match level="QueryCoverage=99%, HitCoverage=47%, E-value=1e-56, Identity=66%"; Hit description =Protein umuC
MRQPLAERAGTDDLFFRRRLIFPLQARLAAQLAYRALQHHAEGFTRQPAGESGGAPRPIPLPPGSAPAACAGAPDRINPPRRRYRAISWRRSWPVWPAFCSAQCRPRPLNAARAGCDRAPAGRTAPALRSAPRRPAAERLRPASRSPPTAPSLPAYPSPGGTYRRTARSWRRTPRRYGGASPL

SEQ ID NO: 165949 - protein, 136 aa, Glycine max
  Coding DNA Sequence Number=SeqID_49171
MSPNIVGEEEADDVHANRNDHDEGELINIVNANGYTAQLSSSSFYWCNIAFAVYLEADKKGGCDIRELEVSPCCKEGYDMGGYSVCQAEFNIPEASDVRIKKKILQTVEERWRQFKFDLTSKWVLATDKDSVDDTI

SEQ ID NO: 165950 - protein, 61 aa, Glycine max
  Coding DNA Sequence Number=SeqID_49172
MEHGRFPDSRGREISLRMSFFLTANWLLEDLRVKKAGCNMKMRKGDEEDKAYNFSAEKILK

SEQ ID NO: 165951 - protein, 544 aa, Glycine max
  Coding DNA Sequence Number=SeqID_49173
  Gene Ontology: Mol. function=protein serine/threonine kinase activity; Cellular component=flagellin-based flagellum; Biological process=protein amino acid phosphorylation
  Homolog annotation: Hit_ID=Q2QDF4; Match level="QueryCoverage=88%, HitCoverage=82%, E-value=0.0, Identity=71%"; Hit description=CDPK -related protein kinase
  Pfam annotation: Domain name=Pkinase; Domain location=110-382; Score =222.7; E_value=8.3e-64; Accession=PF00069.15; Description=Protein kinase domain
  Pfam annotation: Domain name=Pkinase_Tyr; Domain location=110-387; Score=-3.3; E_value=2.9e-12; Accession=PF07714.7; Description =Protein tyrosine kinase
  Pfam module annotation: Pfam domain module=Pkinase::Pkinase_Tyr; Domain location=110-382::110-387
  Subcellular localization annotation: CTP_CleavageSite=68; ConfidenceScore=5.65e-01
PAAADTPRRKDDAITGKRSPFYPFYSPSPARFLKKSPAPAGGSRSASSTPRRFFRRPFPPPSPAKHIRAVLARRQGKKASATAAIPEEGEEGAADLDKRFGFSKEFTSRLEVGEEVGRGHFGYTCSAKFKKGELKGQQVAVKVIPKAKMTTAIAIEDVRREVKILRALNGHSNLIQFYDAFEDQDNVYIVMELCEGGELLDMILSRGGKYSEDDAKAVMGVVHRDLKPEGLGADFRVGLRLSIRSLLFLLFWLAKNFLYAKKDESSELKAIDFGLSDFVRPDERLNDIVGSAYYVAPEVLHRSYSTEADVWSIGVIAYILLCGSRPFWARTESGIFRAVLKADPSFDETPWPSLSLEAKDFVKRLLNKDPRKRISAAQALTNNEEALSKTLTADELYYLREQFALLEPSKNGSISLENVNKALMKYATDAMKESRILDFLSSLNSLQYRRMDFEEFCAAALSVHQLEALDRWEQHARCAYELFDKDGNRAIVIEELVSELGLGPSIPVHVVLHDWIRHTDGKLSFLGFVKLLHGVSSRSLAKVQ

SEQ ID NO: 165952 - protein, 97 aa, Glycine max
  Coding DNA Sequence Number=SeqID_49174
MDGSITVQPLDFALHKRIVEGPLKPSLWSRSSLALGSFYVQPALLLGHPANNLLPEEEFVISGSAQELLPGERHPECFQKKLLPKDFHFLPEEGSSG

SEQ ID NO: 165953 - protein, 91 aa, Glycine max
  Coding DNA Sequence Number=SeqID_49175
MDEESIDSIEEDYEEKSTSTSIRVETKILSEEEGTIIFIDNEKDDDGNLDCDGKMLDHLESTFLSRLVDEYKFDHKPRVVTSLQKVTPLAS

SEQ ID NO: 165954 - protein, 83 aa, Glycine max
  Coding DNA Sequence Number=SeqID_49176
  Subcellular localization annotation: CTP_CleavageSite=42; ConfidenceScore=5.03e-01
MEMQHHVNAGVGPKNWIKIFLVSRTNITYPILARLAFVVLIVGASNFGIGNGVKFFMLLASLVCILSFSVTMVLPKLVGNWIS

SEQ ID NO: 165955 - protein, 134 aa, Glycine max
  Coding DNA Sequence Number=SeqID_49177
MDHTRLIYGLVMKMYMDPGSMISSQITQIAQSNSSRLGFPALITTLCDAKRGSGHSRCSTSHSSANSSSSGLCPAFSSLYSPSQYLLIQSLHHLSLHRLVMSPKAFLESVAWPGDQASSVGGGDTSGAGDHDML

SEQ ID NO: 165956 - protein, 382 aa, Glycine max
  Coding DNA Sequence Number=SeqID_49178
  Gene Ontology: Mol. function=nucleic acid binding; Cellular component= cytosol; Biological process=regulation of mRNA stability
  Homolog annotation: Hit_ID=Q1SZH9; Match level="QueryCoverage=68%, HitCoverage=58%, E-value=1e-132, Identity=87%"; Hit description=RNA -binding region RNP-1
  Pfam annotation: Domain name=RRM_1; Domain location=103-174; Score =48.9; E_value=1.7e-11; Accession=PF00076.12; Description=RNA recognition motif. (a.k.a. RRM, R
  Pfam annotation: Domain name=RRM_1; Domain location=197-269; Score =70.7; E_value=4.5e-18; Accession=PF00076.12; Description=RNA recognition motif. (a.k.a. RRM, R
  Pfam annotation: Domain name=RRM_1; Domain location=316-380; Score =28.7; E_value=2e-05; Accession=PF00076.12; Description=RNA recognition motif. (a.k.a. RRM, R
  Pfam module annotation: Pfam domain module=RRM_1::RRM_1::RRM_1; Domain location=103-174::197-269::316-380
MAQPSSNGDLNNNQQGQVQQQQQQWAAAQPHQYQQQWMAMQYPATAMAMMQQQMMMYPQHYMPYAHPHYPPPPPPPQSSHHHHHKQAAAAAAAAASSDEIRTVWLGDLHHWMDENYLHNCFAHTGEVVSAKVIRNKQTGQSEGYGFVEFYSRATAEKVLQNYNGTMMPNTDQAFRLNWATFSAGERRSSDATSDLSIFVGDLAIDVTDAMLQETFAGRYSSIKGAKVVIDSNTGRSKGYGFVRFGDENERTRAMTEMNGVYCSSRPMRIGVATPKKTYGYQQQYSSQAVLLAGGHAANGAVAQGSHSEGDLNNTTIFVGGLDSDTSDEDLRQPFLQFGEVVSVKIPVGKGCGFVQFADSETPAPLLCSGWFPVKWELAYVFL

SEQ ID NO: 165957 - protein, 51 aa, Glycine max
  Coding DNA Sequence Number=SeqID_49179
MAESSTSSAVSVDSISRDNKFWKGAFAVAGIMLTLVTYGVLQKCRFWGALW

SEQ ID NO: 165958 - protein, 237 aa, Glycine max
  Coding DNA Sequence Number=SeqID_49180
  Gene Ontology: Mol. function=kinase activity
  Homolog annotation: Hit_ID=Q93X47; Match level="QueryCoverage=47%, HitCoverage=22%, E-value=3e-30, Identity=59%"; Hit description =Cyclin dependent kinase C
MGHPHLCTLQIFSPRHVVDLCCGNSLHLRITAKDALDAEYFWTDPLPCDPKSLPKYESSHEFQTKKKRQQQRQNEENAKRLKMQHPQQHTRLPPIQQAGQQHPQMRQGPNHPIHGSQPAVAAGPSHHYGKPRGPSGGPGRYPSGGNSGGGYNHPNRAGQGGGSGYGSGPYPPQGRGAPYGSSGMPGGPSGGPRGGGGSGYGVGAPNYPQGAPYGGSAAGRGSNMMGGNRNQQYGWQQ

SEQ ID NO: 165959 - protein, 99 aa, Glycine max
  Coding DNA Sequence Number=SeqID_49181
MEWSVGRDGGREVGGWNNEEYLVIKEVISGAEWPDKACKLRCAGGGSRSKSKVGGGDHGVAASDVSSSSSPTKRNNKGNNGGVGLTEVDHVAVVVTVAD

SEQ ID NO: 165960 - protein, 132 aa, Glycine max
  Coding DNA Sequence Number=SeqID_49182
  Subcellular localization annotation: CTP_CleavageSite=37; ConfidenceScore=5.34e-01
MSENGGGKIGIGVKNLSVPTKAANAVQVVISLSLSVSSVHVGALSPSFVLLLCPPFTPIPPSHHHQSLHIRSQKPPPHSRKPSLCHPFTYPNSAKVGGDHGIVEEGLTGAGEIEDATRLALYGIETTLLCTC

SEQ ID NO: 165961 - protein, 265 aa, Glycine max
  Coding DNA Sequence Number=SeqID_49183
  Gene Ontology: Mol. function=RNA-directed DNA polymerase activity; Cellular component=chromatin; Biological process=chromatin assembly or disassembly
MKFIAGGKLVELHGDREKDMELVSPSQLRCLLHTNPSSTFFHIHMETCPQSSPTTQVLPEITSLITKYSSLFQPPTSLPPSRPTDHSITLLPNTTPVNVKPYRYPYYQKQEIEDQVTAMLVKGFIQPSSNLLSSPVLLVKKKDGAWRFCVDYRAFNAITVRDRFPIPTMVELLDEFGGARWFSKLDLMQGYHQILMRGVDISHVMAGEGVRPVPEKVQAIQTWPTLRSPRALRGFLGLAGFYRQFIRGYADLAPPLTKLLCNAQF

SEQ ID NO: 165962 - protein, 124 aa, Glycine max
  Coding DNA Sequence Number=SeqID_49184
MADVTRSKVSADRLEDAIAKLTASQLAMNMKIDDLLQRMSQLEANQQPLQTPPSSSVGQTPPVYNPMHRMKLDVPRNTSSVYDELLYLGVESRHSPGGASSTTSLLGSSSGVCTLIGGETPRCT

SEQ ID NO: 165963 - protein, 227 aa, Glycine max
  Coding DNA Sequence Number=SeqID_49185
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=6e-34, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=9; ConfidenceScore=5.18e-01
MARACSPLMAMTCRPLKVRTCIPLKLRTCSPLKVRACSPLKVRTCNHLEVRVWSPLIDRTCSPLMARMCSPIKVRGCSPLMATTCRPLKVRTCIPLKARTCSHLKVRACSPLKVRTCNPLEVKACSHLMARTCSLLMAGMCSPIKVRACPFMARTSSPLMARACSPVMVRTCSPVMPRTCSPPKVKVCSPLMARTCSPLMARMCSPLTVKACTPLMARTCSPLMARA

SEQ ID NO: 165964 - protein, 298 aa, Glycine max
  Coding DNA Sequence Number=SeqID_49186
  Gene Ontology: Mol. function=chromatin binding; Cellular component =chromatin; Biological process=chromatin assembly or disassembly
  Homolog annotation: Hit_ID=Q1SAV4; Match level="QueryCoverage=97%, HitCoverage=77%, E-value=5e-81, Identity=50%"; Hit description =Integrase, catalytic region
  Pfam annotation: Domain name=rve; Domain location=1-147; Score=85.9; E_value=1.3e-22; Accession=PF00665.16; Description=Integrase core domain
MDFIVGLPAYQGNICILIIVDRFSKGVHLGMLPPHHTLQTVAQLFMEMVGKLHGMPRSITSDRDPLFMSKFWQSLFSLSGTKLRISSAYHPQTDGQTEVANRVVEQYLRAFVHRRPSTWGHFLLWAEWSYNTSTHSATRLTPFKVTFGRKPPNFPHGRIAQSEGGHVHLLRRKLQKARTRMKEIADGHCRDHEFQVNKWVLVKLRPYRQTTVAGAGQSKLLRCFYGPFRIIERMGPVAYKLELAEHLRIHPVFHCSLLKPFVGSPNPIAVENLPSGAMDNQPITTPLAILGQKTVPTD

SEQ ID NO: 165965 - protein, 699 aa, Glycine max
  Coding DNA Sequence Number=SeqID_49187
  Gene Ontology: Mol. function=RNA-directed DNA polymerase activity; Cellular component=chromatin; Biological process=chromatin assembly or disassembly
  Pfam module annotation: Pfam domain module=RVT_1::Retrotrans_gag; Domain location=438-631::58-144
MTSKFDELLSRMNQLETSHANSHAPPSFVAASTAATSNAAYRSKLEVPRFDGTDPEGWIFKGPALAWFQWMYRSGQLSSWSAFLHAIHARFSSSAYEDPTGVLCKLTQRSTVSAYLSEFEALANRVIGLPAPFVLSCLISGLSPAIRRDVQVMQPHLVTQAVSFARLHEEKLLDSHRQGSKPSPSTTPGTSTTRPSPSLNGPLQESPLLPSASRPHAATIPFKRLTPSELALRREQEEDDDNRDMDPGPSLLPPSPQETSPAQISLHALSVHTTSYNRSWCLLFNYGHMRPPRYESQLVMKHEFQVDFHVLPIRGADVVLGVQWLKALGPVLTDYTALTMKFIYNGQLIELMEPLAETPLPITHPIPAIQRLLTKHSFLFQPLSTLPPSRPTNHAITLLPHSAPVNVKPYHYPHFQKQEIETQVAAMLRQGHIQHSSSPFSSPVLLVKKHDGTWCFCVDYKALNAITVRDRFPIPTVDELLDELGGAVWFSKLDLMQGYHQILMRESDISKTAFCTHHGHYEFRIMLFGLCNAPSSFQATMNRIRSLDEHLNHLEIAFQVLKKGKFTLKFTKCSFAQKQIDYLGHVVSGDGVQPVPEKIQGYATIASPLSQLLTKAELVWSPEVENAFQMLKNAVTTALVLALPDFTKPFTMETDASGLGMSDVLSQEGHPISFFSKQFCPKLLRSSTYVWELAAITTA

SEQ ID NO: 165966 - protein, 125 aa, Glycine max
  Coding DNA Sequence Number=SeqID_49188
  Homolog annotation: Hit_ID=Q10K64; Match level="QueryCoverage=96%, HitCoverage=31%, E-value=8e-31, Identity=54%"; Hit description =Nodulation protein, putative, expressed
MVEHLHEGFIVMQDAQAEILAKYKPTINSTLLIAQLKQVNETTTKALEYFKSTRHIILYYEDIVKNRTKLRDVQDFLKVPQMDLKSRQVKIHKGSLSSQVENWNDISKALTGTPYESFIHEDYRR

SEQ ID NO: 165967 - protein, 187 aa, Glycine max
  Coding DNA Sequence Number=SeqID_49189
  Homolog annotation: Hit_ID=Q10K64; Match level="QueryCoverage=88%, HitCoverage=45%, E-value=3e-56, Identity=62%"; Hit description =Nodulation protein, putative, expressed
MADDLSSFAKDALLVKGLKSSTLVWRLIVLTLAMVSGVYICSICLKQIGTSSKIGFLDIKVVQKPCPEPNIEPWEIPFVHYPHPKTYSRAECACHPVRYFAILSMQRSGSGWFETFLNSHANISSNGEIFSVKVRRSNMSTITETLDTIYNLDWLSSASKNECTTAVGLKWMLNQMHLQIFIKAMVA

SEQ ID NO: 165968 - protein, 99 aa, Glycine max
  Coding DNA Sequence Number=SeqID_49190
PKDHDRQWLRKQDLPHGRTPSSPPQQDASSALMNEVLSELCGLQAFVGDCFDAMDGHMDAMDARFAGMDTRITQLGDDMELVKGFYKIVELSNGLLGDW

SEQ ID NO: 165969 - protein, 304 aa, Glycine max
  Coding DNA Sequence Number=SeqID_49191
  Gene Ontology: Mol. function=hydrolase activity; Cellular component =nucleus; Biological process=metabolic process
  Homolog annotation: Hit_ID=Q1SZI1; Match level="QueryCoverage=96%, HitCoverage=92%, E-value=1e-102, Identity=61%"; Hit description =Lipolytic enzyme
  Pfam annotation: Domain name=Abhydrolase_3; Domain location=77-278; Score=194.2; E_value=3.2e-55; Accession=PF07859.3; Description =alphabeta hydrolase fold
MDQTTAAANEVVREFPGLLRVYKDGRVERLLGTETTPPGTDPGTAVQSKDVTINAETGAGVRLYLPPTAAAQKLPLLIYIHGGAFCVCTPYNPAYHHHLNALSAAANVVVASVHYRLAPEHPLPAAYDDAWEVLQWVAASDPEPWLNCHADLSTVFLAGDSAGANIAHNTAMRGTTQGFGNLTLKGMVLLHPYFGNDKKDELLEYLYPTYGGFEDFKIHSQQDPKLSELGCPRMLIFVSEKDFLRDRGCSYYEALRKSGWMGKVEMVEFEGEDHVFHLLDPTKDKSVDLVKQFVAFIKQIPAHC

SEQ ID NO: 165970 - protein, 178 aa, Glycine max
  Coding DNA Sequence Number=SeqID_49192
  Gene Ontology: Mol. function=RNA-directed DNA polymerase activity; Cellular component=chromatin; Biological process=chromatin assembly or disassembly
MNSLLQPFLRKFTAMFFDDILMYSDTLPSHLEHLEMVIQTPEQQYYLSILLGYEYKIQYRSGSSNVVIDALSQIEMPRDIQMFLLSIPNFVFMDQLHQALSDNPVFQEKLQSTMANLSSYSDFKMHNGLIMYKGSIWLDSANPFIQALLMEFHNAPLEVTWALPKLSTDFSPISFGII

SEQ ID NO: 165971 - protein, 204 aa, Glycine max
  Coding DNA Sequence Number=SeqID_49193
MSSKNIAVNLRKNGWRREFIVPWKGGGNWVGWLKMEANLLRIDWMVGKPIELKCKWAHMQRPLEVPLEVPDGKHVEGHRECVTLKIQDGGGEKLAVVEHKAVANHNAQRRCLLSGEAGEGIKADVGKVGVGLSSNLGLKGSGGEEIGEGSGSSYFIRGTVNKRGFGSRGRRESGGVWCGWPGRMEDVGRIVGPITYLPGVSQAQ

SEQ ID NO: 165972 - protein, 191 aa, Glycine max
  Coding DNA Sequence Number=SeqID_49194
  Gene Ontology: Mol. function=chromatin binding; Cellular component =chromatin; Biological process=chromatin assembly or disassembly
  Homolog annotation: Hit_ID=Q1SAV4; Match level="QueryCoverage=99%, HitCoverage=55%, E-value=4e-43, Identity=42%"; Hit description =Integrase, catalytic region
MNQVIEQHLCSFVHPRPTYWHKFLAFAEWSCNTLFHSNTRKTQYEATYGKPPPSIPHYIVGSSTNEVVDSLLATREVIHELLKCRLLTAHEKMKKHSDIKRKDEEFGIGHWVYVKLRPYRQISLIVSGCNSKIHPVFHCSMLFPHHDPLVRDSNPLPPYAIDNHPVLESLSILSSKMGETSNPPTRLVLVQ

SEQ ID NO: 165973 - protein, 151 aa, Glycine max
  Coding DNA Sequence Number=SeqID_49195
MVICLFLKTSMSFDRDYYSLICLPETIKSVGTQRQTWSSASFRRLQCLLTVTIIVSFAFQRQSSPLAHKDKHETNKVICPLLKTSMSFDEDYFSLLCLLETIEFVGIQRQTRSSALCRRLQCLLMKTITIFFAFQRHSSFADWAFASGRSD

SEQ ID NO: 165974 - protein, 126 aa, Glycine max
  Coding DNA Sequence Number=SeqID_49196
MGEKMNRVTSLLRLLPNIFRIVDVLVTSSFTLTKMSWTIKGHALRCPYRTRTRARVMGEAEEVQEKMKADMEAMKEQMATMMETMMSMKKIMEANAVIVAATSAVAKVNPMLPSGLKQMNHPTSNM

SEQ ID NO: 165975 - protein, 97 aa, Glycine max
  Coding DNA Sequence Number=SeqID_49197
MEAMKEKMTIMMEAMMNIRKMMEVNMTIVIAASTATEVDPTHPPGLNQDPQPTGETHEVPQDHTLANFEFHLGYATEGQAFCGIPLPNTLGGPQYCP

SEQ ID NO: 165976 - protein, 78 aa, Glycine max
  Coding DNA Sequence Number=SeqID_49198
MEREMIIMIVDTLPVFYYEKMVGYMPSSFADLVFVGERIKVGLRKVKFDYVALMNRKPKANGKNKKEGETHVVTVVLT

SEQ ID NO: 165977 - protein, 190 aa, Glycine max
  Coding DNA Sequence Number=SeqID_49199
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=100%, E-value=2e-23, Identity=28%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVVPFRGLHVLAIRGLHALTFRGLHILAVVGLHTLTFRGLHALTFSGLHVLPIRELHALANRGLHALTFRGLHALAFRGLHGLAYKGLHVLFIRGLHTLTFRRLRVLAFKGLRALAFVGLLALTFRGLHVLAYRGLHALAIRGLHVVIVRGLRALAFIGLHALAFVGLHALTIRGLHILAFSALHVPCL

SEQ ID NO: 165978 - protein, 131 aa, Glycine max
  Coding DNA Sequence Number=SeqID_49200
MATLQDPAPVAAMFPPRDTSLWYHFGISLVVCGACLPLVLNYCIVLLKCNLVLPMAVLLLHFLIGGCNGIGVEGEEDNLDPHKGRLLRGVVEADNEGDERNNYQVEVGVRGEEGFVEPVVEVVRVFKHSRN

SEQ ID NO: 165979 - protein, 33 aa, Glycine max
  Coding DNA Sequence Number=SeqID_49201
MVVEMTDIERSWSMGMGPNGTGISSLRIYLVRG

SEQ ID NO: 165980 - protein, 123 aa, Glycine max
  Coding DNA Sequence Number=SeqID_49202
MDQLKRLSIPSEMLRFSNHANYPRLGHPTRKISMQQGQTDILIARFPDPSYGVKTPSWKIPLRSKGSSQCGVATENNGGLWWLMVAVGDGESAWDVRNGFGRKKKEEMVFFLSYTKAKAEMLK

SEQ ID NO: 165981 - protein, 91 aa, Glycine max
  Coding DNA Sequence Number=SeqID_49203
MGEERCRIVSEEVAMLTVVVFIQEIDYSTWLSNVIMSHAIWVKEHQNHISMLDGKIFPGQLGQILEVYVDDMMVKFDNVTTHLVDLEEVFG

SEQ ID NO: 165982 - protein, 129 aa, Glycine max
  Coding DNA Sequence Number=SeqID_49204
  Gene Ontology: Mol. function=RNA-directed DNA polymerase activity; Cellular component=mitochondrion; Biological process=RNA-dependent DNA replication
  Pfam annotation: Domain name=rve; Domain location=1-128; Score=-4.8; E_value=0.015; Accession=PF00665.16; Description=Integrase core domain
MDILRPFPTAPGQRKFLLVVIDYFTLWVEVEPLASITTQFIDQKFNEFLGDHDIKRRVMSVKNPQTNGQAEATNKVILSELKKQLGGDKERHYFAKDENNEVLQIDLNLINQVREDVVIMIKACKRRKT

SEQ ID NO: 165983 - protein, 110 aa, Glycine max
  Coding DNA Sequence Number=SeqID_49205
GYIYLGCYTENKSGYISCGSVQVEGTSLVDLWLVKDFTRLKEISRIVGCLGTGCRHGHESEVGVILEGPTGMVEYKALLEGRRLTKEVDAQRVYCRSDSKISAGQINNVF

SEQ ID NO: 165984 - protein, 75 aa, Glycine max
  Coding DNA Sequence Number=SeqID_49206
  Gene Ontology: Mol. function=ribonuclease H activity; Biological process=DNA integration
MYQVVMPLVRDALLYKVRAVCPKVLPIVASPENSSSHGSFSGMQTTNTLMHFSKDILSLVLVKALEQRWGETPPI

SEQ ID NO: 165985 - protein, 91 aa, Glycine max
  Coding DNA Sequence Number=SeqID_49207
MTKRAASSRSPTRASNCTAVSETIRRRCNENISVINGRWWKAKILPYKHAMVGLPSQIAYGSWQKFATPFHYGNYGATRCCQIADIAALSH

SEQ ID NO: 165986 - protein, 885 aa, Glycine max
  Coding DNA Sequence Number=SeqID_49208
  Gene Ontology: Mol. function=transcription factor activity; Cellular component=endoplasmic reticulum; Biological process=regulation of transcription, DNA-dependent
  Homolog annotation: Hit_ID=Q6YUW7; Match level="QueryCoverage=72%, HitCoverage=77%, E-value=1e-108, Identity=36%"; Hit description =Chromosome structural maintenance protein-like
  Pfam annotation: Domain name=RINT1_TIP1; Domain location=221-736; Score=147.4; E_value=3.7e-41; Accession=PF04437.4; Description=RINT -1  TIP-1 family
MAWQIFASFHRRFVKGGPPWHSAYASDFVVYLDLACCKVYLIVSETAVQLEALVGDLEDAALFVIARHTGNMFSLKLSISSNSEDAASKHDNLLQAIKAMSDIEEVLVGVVKFHPQWHCLLKSVDTRVDKILSVLRPQAFADHRAFLVSLGWPPKLLPSKNGSDHITNLPNPLVLMQEDKRRNYSQSFIALCALQHLQNRREERQLNSSLIKRDTQNIQLWAIDELVSPIASRMEYHFTKWSEQPEYMFALAYKVIRDFITGIDDVLQPLIDKARLIGCSAKEAWVSAMVQMLSVFLEKKVFLLLTERYKVKHLKPDVSSSWLHLVDLIIAFDKKMQSLLNLDTCFLAVSGSFEGLSRGMSVLSMFCNRPDWLKIWAKIEFKNAWKKLKSELIEEKAWMTSKKCISGIDTEQEYLLLTVEDHKAPPIAEFFLKIIWEMIERCQTMPSSLLRAQFIRFTAGRFLWYFFKQLLFRFKATELCPDSSDDVAIVRVCGLINAARYIWIKLQEWSDAVDFLEMKIAENDSSKPIQDDSMDNDCFFEEEIRSLSEMETNWLMEIIAVVLRQFEVLSWKYVQNNDSFGDEQVYTNPVEDADLIVSNDFVEALDSLKRWLHTMKISLNKKDFLDLWRSIAEGLDHYISWSIVRSENWFFKMGVTQFEADMQALIFIFQPYCARPQAFFPCINEILKLLKLKKEEEKLMQAFLSRNENGSECLHLYGISHLSVNQILQVLRYKIWAGIFEFKNSIKDALRLLWLWELESSLINSFLARKVQFGAFPLAFLVFSLKERPELKLSSYRRKIEKIGRSIPEIEDIVTATGLSPLIKCSLDIDVTITLNDVASLLHLPIIGTFHCFEALHVDQAVDLLVDLLEVSSQEAREETFQCHG

SEQ ID NO: 165987 - protein, 108 aa, Glycine max
  Coding DNA Sequence Number=SeqID_49209
  Subcellular localization annotation: CTP_CleavageSite=48; ConfidenceScore=5.02e-01
FTIDSPHVSTSPHQLDFAPYASKSYSAQWNFPKLLHDMHMLRSSRILRKMEVEETKQGLWLPLHYQVGMGASFVIDLGMTFVDDWVVGNEKSLYWLSNNIVGLVGSLA

SEQ ID NO: 165988 - protein, 223 aa, Glycine max
  Coding DNA Sequence Number=SeqID_49210
  Gene Ontology: Mol. function=transferase activity, transferring nitrogenous groups; Cellular component=membrane; Biological process =biosynthetic process
  Homolog annotation: Hit_ID=Q8Y0E8; Match level="QueryCoverage=96%, HitCoverage=53%, E-value=9e-72, Identity=59%"; Hit description =Probable aspartate aminotransferase protein
GVEGASVVQDVLVDIVDQDEEIPVGTLADDLREFGQLGAVVGGAAGIAGRIQDQPFGPGADRRRQIGRRQRITALRRRHDRAQHAAIHDDDIAVGGPVRRRHDDLIARAQGRQERLVDDLLAATAHADLGDGAVDAVVAPELGDDGLAQPRAAVDGGVAGFTIADGADRRLADVLRRGEIRLAERHVDDAVALLDGLAGSFRHDLDGGKAQSGDDGSEHGRNP

SEQ ID NO: 165989 - protein, 480 aa, Glycine max
  Coding DNA Sequence Number=SeqID_49211
  Gene Ontology: Mol. function=protein dimerization activity; Cellular component=chromatin; Biological process=electron transport
  Homolog annotation: Hit_ID=Q2QPA8; Match level="QueryCoverage=85%, HitCoverage=51%, E-value=8e-60, Identity=36%"; Hit description=HAT family dimerisation domain containing protein
  Pfam annotation: Domain name=hATC; Domain location=283-364; Score =28.3; E_value=2.8e-05; Accession=PF05699.5; Description=hAT family dimerisation domain
MAKPGNVAACANCPIEVTEELWGYFKDKKKQECETFKGMCQHFLEDYGDSDEERALDEGPLHRFDVGRHWHSSTLRLLRFFTNKRELVRHAITRFATSFLTLERLHKEKGNLRKIFVSDDWTKNKLSKEAKGKEATKTVLMPAFWNNVLYILKVMAPLVKVLHLVDSEKKPAMGYIYEAMEKAKEAIMKSFENNESKYKQVFEITDSRWTCQLHRPLHAADHFLNPDLFFSNPSMEFDFEVVNRLYVCIEKLVPDQAVRQKILTELPIYKMGGSMLGQNLQFNKGALSHQHNISLDSTFVAPWWQSCGLPTPNLQQLEIKILSLTCSASGCERNWSIFEQIHSKKRNKLQHKRLNNLVYAKYNQALVKRYNYRNEIDPISLNDIDECNEWLMGQMDGGYDDDDDAGNERASGIGQPMTYTTQRTKKRKEPLGVEDAIPNTKRGQELQGIDFGDSKEVERHAPLQDNEDYDYIGEGAEQNE

SEQ ID NO: 165990 - protein, 143 aa, Glycine max
  Coding DNA Sequence Number=SeqID_49212
  Subcellular localization annotation: CTP_CleavageSite=75; ConfidenceScore=5.06e-01
MEPPPPSPPLPRLPNTADLTPQHLAFLDQHFRTKRDLSRESFNLPLSSSLSQLCSELESRLLQHLTKRTVSWISRSFSAKSSLQRLSLALQNLSLRTSPRIKKGIGSKRFQWVLSEGIPRLASEMNRIESLRCYLGEFVLESL

SEQ ID NO: 165991 - protein, 76 aa, Glycine max
  Coding DNA Sequence Number=SeqID_49213
MLSSKGSRFNQTIQIFSSIMGAKDMSFIHKVSQHALLGASEGEAHGCAFQRRKDAQSRHQRLFVENVGKTEGNWSK

SEQ ID NO: 165992 - protein, 198 aa, Glycine max
  Coding DNA Sequence Number=SeqID_49214
  Homolog annotation: Hit_ID=Q0C3K9; Match level="QueryCoverage=31%, HitCoverage=24%, E-value=9e-17, Identity=64%"; Hit description =Extradiol-type ring-opening dioxygenase
  Pfam annotation: Domain name=LigB; Domain location=5-197; Score= -36.7; E_value=2.7e-05; Accession=PF02900.8; Description=Catalytic LigB subunit of aromatic ring-opening dioxygenase
MVKVGTSYVPINVSFSPKVGPGLPGINRDTRIYLFCEVIFRHSCPSCSATDGVGELELHRGGGRSRTSGSPGLQEFDVAIDPQRGLDHGAWVPLRLLRPQADVPVVPLSIQPLLGPEHQFALGRALAPLREQGVLLVGSGSNQAYRYRRPRGGARYQLLFPLVRVNFELGVIMVIAVSCVKLLSAHNSTQHTSRKHKV

SEQ ID NO: 165993 - protein, 103 aa, Glycine max
  Coding DNA Sequence Number=SeqID_49215
MKGRVIGGRITLLGVTGTPNDWQRPVINAGKPKALLDLSRSRGCLDGIHQLTLRQRAVEIMIAGQDVAEQQRHPCLGQGSHVGVHDLHPSPGSGPGKILTWYA

SEQ ID NO: 165994 - protein, 149 aa, Glycine max
  Coding DNA Sequence Number=SeqID_49216
METCSVVRDLLQQMIDHGRVEVNNEGKGEQHICMQSAYKEGPKKPQPLVIHFTRDTVPQRPRQHSAVSGVRPIPFPYKNSRAVPWRYAPSGGKKEEATNIGSLSAKVTNITWLNSITRSGHVFAPPSLPTQPTNAKGKSKMTEGQTIKV

SEQ ID NO: 165995 - protein, 193 aa, Glycine max
  Coding DNA Sequence Number=SeqID_49217
  Gene Ontology: Mol. function=chitin binding; Cellular component =extracellular region; Biological process=chitin metabolic process
  Homolog annotation: Hit_ID=UPI000044A8F0; Match level="QueryCoverage =77%, HitCoverage=99%, E-value=5e-24, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MIGPLNESISCIHIWVDPWVHALTFRGLHVLALRGLHALTFRGLHALAFRGLDILTLRGLHVLAFKGLHALTFRGIHVLPFRGLHALAFRGLHALTFKGLHVLALRVLHALAFRGLDVLTFRGLHALTFKGRHVLNFRGLHALAFRGLHTLAFKGRHVLNFRGLHALAFKGLRVLAFSELHIRTLREFKVLCP

SEQ ID NO: 165996 - protein, 86 aa, Glycine max
  Coding DNA Sequence Number=SeqID_49218
MENSSLTVNHLIQPYFNLLSENQLRVFNRHHIHQLALRPLSMNARRTARKPHYKRNLKESWASSSKGNNTRKSSLPWIQTENAIET

SEQ ID NO: 165997 - protein, 70 aa, Glycine max
  Coding DNA Sequence Number=SeqID_49219
MVLRLCGDLCFWYPFVEGRSSFSWEYGMDYFSAVAPGTRTLARGIFSTPYYPEKAGAPCVLEPITIFRLT

SEQ ID NO: 165998 - protein, 106 aa, Glycine max
  Coding DNA Sequence Number=SeqID_49220
  Pfam annotation: Domain name=zf-GRF; Domain location=64-101; Score= -0.1; E_value=0.031; Accession=PF06839.3; Description=GRF zinc finger
MKLGFFQFPILLLLLLFLCLVLTSKCHSLKVFSYGGIRNSPGGHGASGGSANNDSVSDGAPLPPICDCEQLVVVQTTLTMNHFGRRFWGCPNYKKQHGSESGYNFF

SEQ ID NO: 165999 - protein, 91 aa, Glycine max
  Coding DNA Sequence Number=SeqID_49221
  Gene Ontology: Mol. function=DNA binding; Biological process=DNA integration
  Homolog annotation: Hit_ID=Q1RSC7; Match level="QueryCoverage=52%, HitCoverage=13%, E-value=6e-10, Identity=60%"; Hit description =Integrase, catalytic region
MELEGLARGKKDSPWRARRKETCSFKEMTILPLCYAILLWYMRTYLGDPDDHAKAWVLKLQNRTQESWILSSKVLMIHVLLQSNDPYRVPE

SEQ ID NO: 166000 - protein, 199 aa, Glycine max
  Coding DNA Sequence Number=SeqID_49222
  Homolog annotation: Hit_ID=Q8H6Q8; Match level="QueryCoverage=96%, HitCoverage=6%, E-value=4e-18, Identity=34%"; Hit description=CTV.20
MPGSMCSGIKIVNSSIHGKFTSKIILCIIFQIGSSNGGTTSDQFHIYSQKKSNRDSNNSTSSIIARNHYRYGKTENSKQYPPLQRHAFVKWWSQFDTSKTAPDQVKNWFQSNPEFLKPADPKTSLFLNQKSQLAAFLASSKSKESLAQNLKEVLQLLQQEVEEEPSKKEAESSETNDDQEDDPFYQNEDDCFGISLDED

SEQ ID NO: 166001 - protein, 63 aa, Glycine max
  Coding DNA Sequence Number=SeqID_49223
  Subcellular localization annotation: CTP_CleavageSite=21; ConfidenceScore=5.10e-01
MLMTVVVVITMTMILMIMVMVAMLVVVMMSVTMVMTMMMVVVIAMLVATRGNNDGGGSVGDAA

SEQ ID NO: 166002 - protein, 477 aa, Glycine max
  Coding DNA Sequence Number=SeqID_49224
  Gene Ontology: Mol. function=oxidoreductase activity; Cellular component=integral to membrane; Biological process=electron transport
  Homolog annotation: Hit_ID=Q15FD2; Match level="QueryCoverage=85%, HitCoverage=50%, E-value=1e-150, Identity=62%"; Hit description=NOX1
  Pfam annotation: Domain name=Ferric_reduct; Domain location=335-468; Score=101.0; E_value=3.4e-27; Accession=PF01794.9; Description =Ferric reductase like transmembrane component
  Pfam annotation: Domain name=NADPH_Ox; Domain location=72-175; Score =157.1; E_value=4.7e-44; Accession=PF08414.1; Description=Respiratory burst NADPH oxidase
  Pfam annotation: Domain name=efhand; Domain location=176-204; Score =25.9; E_value=0.00014; Accession=PF00036.22; Description=EF hand
  Pfam annotation: Domain name=efhand; Domain location=220-248; Score =9.7; E_value=1.2; Accession=PF00036.22; Description=EF hand
  Pfam module annotation: Pfam domain module=Ferric_reduct::NADPH _Ox::efhand::efhand; Domain location=335-468::72-175::176-204::220-248
MSTEKGGKDESSTWILEGIDIDPIVERPKRDDEAPPNGIMVLKSPNDADVNNNNNSNVRSRVGIQGNNGGRKMMRAESGAARGIKSLRFLDRTVTGKEADAWKSIEKRFTQNAVDGKLTKDKFGTCMGMGAESKDFAGELYEALARRRNVCAENGITLDEVKVFWEDMTNRDLESRLQVFFDMCDKNGDGRLSEEEVKEVIVLSASANKLGNLKVHADAYASLIMEELDPDHNGYIEMWQLETLLKEMASAEDGTKKLDNCRAMTLSRAMIPSKYRTPVSKFLSTTAEFALDKWKKIWVVALWLAINLVLFIWKFKQYREREAFKVMGYCLCFAKGAAETLKFNMALIVLTMCRRTLTKLRGSFLNRIIPFDDNINFHKTIAVAVVIGTFIHVMMHITCDFPRLISCPENKFMSILGQDFNYEQPTFYTLLKSILGVTGILMVLLMAFIFTLATHYFRKSVVKLPLSLHRLAGFNAF

SEQ ID NO: 166003 - protein, 185 aa, Glycine max
  Coding DNA Sequence Number=SeqID_49225
IGAFAVVIRQTNIIWVLFVACTGIINISVAHAKHSTKTDEPDVSIKHGLAYATGTNTEGFNLRKRKIVKSIGNSSSSLLASSPSFSSGFADEIWSILLTLWGPKDLLSHTYPTDTAGAKEAHAVTPHFAQMLYFSLVSVLAQAPMHFTITKAVDLFQMFRKSRALLFFQMFLALVVGLLSVHFFR

SEQ ID NO: 166004 - protein, 106 aa, Glycine max
  Coding DNA Sequence Number=SeqID_49226
  Homolog annotation: Hit_ID=Q8ZFD5; Match level="QueryCoverage=85%, HitCoverage=67%, E-value=7e-25, Identity=56%"; Hit description =Protein yebF precursor
MGASTAVWAQDQEQRTAKVGQCAGLQPADIAAQVKRDFLQNRITRWEADKKLLGTATPIAWVSPDAITGKEQVWQVPLTVRGTKVDKTYNVTLNCNTGEIAYSAPQ

SEQ ID NO: 166005 - protein, 105 aa, Glycine max
  Coding DNA Sequence Number=SeqID_49227
  Homolog annotation: Hit_ID=UPI00005F9A5C; Match level="QueryCoverage =63%, HitCoverage=65%, E-value=2e-20, Identity=73%"; Hit description =COG3097: Uncharacterized protein conserved in bacteria
MANKAIAKPVFFICPPVVISAIRAPIPGSQQGFGKGLPFDELDDKQRIQTRIDFLDHLLQFAERHVLLLCMAFGQRIQAHRRYRQHFDKAEKYAVFIAAYAQYLA

SEQ ID NO: 166006 - protein, 68 aa, Glycine max
  Coding DNA Sequence Number=SeqID_49228
MTPPQLPHRGRATYQDLFLTRYYDQMPLHYELQLLVECMRPYLYGEVDLSPHLSADAVEGTDHHGNWP

SEQ ID NO: 166007 - protein, 163 aa, Glycine max
  Coding DNA Sequence Number=SeqID_49229
MIKHCTLIEWPNSLAVPSGATKCCNLPFGGRATRDSKANLPTKENARSCHQRLFEENARKTKKDEGLRILKIRVRELFKHGEIVSRIFPLDLMMKSMQFQWAKRASIAKRNFSALRAIEESGRASISRSCAKHKISVLSTAVVFSQPQRTIGAKLNVTNSEPI

SEQ ID NO: 166008 - protein, 102 aa, Glycine max
  Coding DNA Sequence Number=SeqID_49230
MQKKLSNCATKLPIMQEKKWLCSASFCCHGKGSFMTNGIELFGCCESLAGLMGTRAERNEEKATYMHSGTWRYVAGVRRPWGRQVGCYCPKPSLANPEPTRA

SEQ ID NO: 166009 - protein, 99 aa, Glycine max
  Coding DNA Sequence Number=SeqID_49231
IAYPAFTGRVASLVGVEGKERTGSAVRGMRKQITPIKEAKTRTLNQNQRFLLSFKGVVKKAKDEASRSDTAFGSLPVEKAVEEVAFADQSKDGWGFFIA

SEQ ID NO: 166010 - protein, 378 aa, Glycine max
  Coding DNA Sequence Number=SeqID_49232
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=98%, HitCoverage=63%, E-value=0.0, Identity=86%"; Hit description =Photosystem I P700 chlorophyll a apoprotein A2
  Pfam annotation: Domain name=PsaA_PsaB; Domain location=1-377; Score =398.4; E_value=1e-116; Accession=PF00223.9; Description=Photosystem I psaApsaB protein
DPLHVRPIAHAIWDPHFGQPAVEAFTRGGALGPVNIAYSGHLVHVAIPGSRGEYVRWNNLLSILPHPEGLGPFFTGQWNLYAQNPDSNSHIFGTPQGAGTAILTLLGGFHPQTQIAGHMYRTNFGIGHSIKDLLEAHTPPGGRLGRGHKGLYDTINNSIHFQLGLALASLGVITSLVAQHMYSLPAYAFIAQDFTTQAALYTHHQYIAGFIMTGAFAHGAIFFIRDYNPEQNEDNVLARMLDHKEAIISHLSWASLFLGFHTLGLYVHNDVMLAFGTPEKQILIEPIFAQWIQSAHGKTSYGFDILLSSTNSPAFNAGRSIWLPGWLNAVNENSNSLFLTIGPGDFLVHHAIALGLHTTTLILVKGALDARGSKINAR

SEQ ID NO: 166011 - protein, 355 aa, Glycine max
  Coding DNA Sequence Number=SeqID_49233
  Gene Ontology: Mol. function=RNA-directed DNA polymerase activity; Biological process=RNA-dependent DNA replication
  Subcellular localization annotation: CTP_CleavageSite=20; ConfidenceScore=5.45e-01
MDRLTTMMNALLSAQNSQAAAATVEQPLVSTTPLSTVTSPPLFLPPGCTWGMPPPVCGSPQPAVSEVPPPFAQQSAPIPQPNTSFPQAAMTYSAPLIHTIQQEVEPIFQAENVVAFDKMEELQERFDGMQREVEALRGRDLFGKDACELCLVPNVTIPHKFKVPDFEKYKGNSCPRSHLVMYARKMSMYTDNHKLLIHFFQDSLTGAALKWYMNLDSASIRTFNDLGEAFIRQYKYNLDMAPDRDQLRAMTQKEKETFKEYAQRWREVAAQIVPPLEEREMTKIFLKTLSQFYYEKMVASAPTDFTEMVNMGVRLEEGVREGRLTGESAPAASNAKKFGGHFAKKKDQEVGMVAH

SEQ ID NO: 166012 - protein, 69 aa, Glycine max
  Coding DNA Sequence Number=SeqID_49234
MAPSAGVWHVAMETPFPAALPLLHENASSVGELVKASPRLAVLQCRLTAAGKRQLLLRVWKRYWYQRFA

SEQ ID NO: 166013 - protein, 77 aa, Glycine max
  Coding DNA Sequence Number=SeqID_49235
  Gene Ontology: Mol. function=RNA polymerase II transcription factor activity; Biological process=regulation of transcription, DNA -dependent
  Homolog annotation: Hit_ID=Q1SAY0; Match level="QueryCoverage=87%, HitCoverage=63%, E-value=7e-14, Identity=50%"; Hit description=DNA -directed RNA polymerase, subunit C11/M/9
  Pfam annotation: Domain name=RNA_POL_M_15KD; Domain location=1-55; Score=19.7; E_value=0.0012; Accession=PF02150.7; Description=RNA polymerases M15 Kd subunit
MEFCPSCGNMLQYELPYMGRPSRFFCSACPYVCHIENRVEIKRKQRLVRKEIEPIFSEDDMTNAPSTEEGDRDRARL

SEQ ID NO: 166014 - protein, 343 aa, Glycine max
  Coding DNA Sequence Number=SeqID_49236
  Gene Ontology: Mol. function=metalloendopeptidase activity; Biological process=proteolysis
  Homolog annotation: Hit_ID=Q41440; Match level="QueryCoverage=42%, HitCoverage=28%, E-value=7e-52, Identity=70%"; Hit description =Mitochondrial processing peptidase
MDSNNLFSNYFSDDLDSSPTVPTVVTTTTTTTATWWLEEADHRGEAVLYMVSCNSDFEAEILLHLRKEENPHNNNIEVSTRQYAFFLTSMLAPQRFLYTLSHARSCSSSRIPASARFASSVATQQSSSGLGGLFGWLTGDRSSSLPSLDFPLLGVILPPSLPNFVAPGKTIITTLPNGLKVASETSPVNEQLLKVKAEIGEASKNPQDLLLEAIHSAGFSGALANPLLASESVLNRLNGTILEEFVTENYMAPRIVLVASGVEHEELLFVAEPLFSDLPSVPRLEEPKSMYTGGDYRCQSESGRTHFALAVELPGGWHKLKDAMVLTILQVLIMSYIFLLFCT

SEQ ID NO: 166015 - protein, 54 aa, Glycine max
  Coding DNA Sequence Number=SeqID_49237
MTYTIRTIEGYSDIIVMRQHPTQLGNPETSNAEDWMGLVDYAWSHSDEHLNTLR

SEQ ID NO: 166016 - protein, 66 aa, Glycine max
  Coding DNA Sequence Number=SeqID_49238
  Gene Ontology: Mol. function=metal ion binding
  Homolog annotation: Hit_ID=O23280; Match level="QueryCoverage=62%, HitCoverage=11%, E-value=2e-10, Identity=69%"; Hit description=RING -H2 finger protein RHF1a
MNSRSQRSKECPICWQSLALKDPASQELVAAVEDEKCMRSRNIANSRAPLELFFCSQELVAAMKAT

SEQ ID NO: 166017 - protein, 157 aa, Glycine max
  Coding DNA Sequence Number=SeqID_49239
MRDSEQAMYSLKDSLNRDREKLLGTPEKKHLCELFDVPSTGLCRSEDGNPNHRVGYWKGHQRKIVKILSKGKVDPPDRSRFSRCLYMLRETYSSRKKPASARHLTVASFGSTCRKLSQCIRVANPPAEHPESKAYKSSLIYHHMLTSFTSMLTHHNT

SEQ ID NO: 166018 - protein, 103 aa, Glycine max
  Coding DNA Sequence Number=SeqID_49240
MNNQFLEMLLHQSVQRWSSLQTTKGGISRAMRHLMGVKGDVGACQKVPLEIKEASEKNKVVNDVAVGQEKDDDEVEALEEIYNIRVGKRLAATGSTPAAKGNT

SEQ ID NO: 166019 - protein, 137 aa, Glycine max
  Coding DNA Sequence Number=SeqID_49241
  Gene Ontology: Cellular component=cellulose and pectin-containing cell wall
  Homolog annotation: Hit_ID=Q153F8; Match level="QueryCoverage=79%, HitCoverage=31%, E-value=5e-26, Identity=43%"; Hit description =Pectin acetylesterase
  Pfam annotation: Domain name=PAE; Domain location=1-127; Score= -123.7; E_value=3.6e-08; Accession=PF03283.4; Description =Pectinacetylesterase
MRSFYHDVAQLQCLFPSEIAKNIKTPLFLVHPAYDFWQIRNILVPQGSDPDGHWQRCRLDIRSCNANMIDKLDSYRGSLLKAVNEFQQRKEIGMFIDSCFVHCQTEMEVTWHSPNSPKINDKPQGYSPTSATVKGFK

SEQ ID NO: 166020 - protein, 136 aa, Glycine max
  Coding DNA Sequence Number=SeqID_49242
MFNETLLAKWKWGSFRNDQSLWGQVIESRYGGWRGLEERGGGRNSSIWWRDLRRVCGEESEDKWFDKMSVEVRGWKIYPLWKKFFQWLNCSSVLPVEHKSKCILPQLSRISGGFVTSDHVCSLAICDAINRVFESE

SEQ ID NO: 166021 - protein, 42 aa, Glycine max
  Coding DNA Sequence Number=SeqID_49243
MNTAGYFTNILLLQKLPTIDIDRSVKETLLTNDRDSLCMNIK

SEQ ID NO: 166022 - protein, 58 aa, Glycine max
  Coding DNA Sequence Number=SeqID_49244
  Subcellular localization annotation: CTP_CleavageSite=49; ConfidenceScore=5.12e-01
MGVQIAPRPTWALWNIPPEGAKALPKRFRNVFREESRKGLNRSSTFFIRSSSFFDLQR

SEQ ID NO: 166023 - protein, 352 aa, Glycine max
  Coding DNA Sequence Number=SeqID_49245
  Gene Ontology: Mol. function=oxidoreductase activity; Cellular component=integral to membrane; Biological process=electron transport
  Homolog annotation: Hit_ID=Q15FD2; Match level="QueryCoverage=99%, HitCoverage=40%, E-value=1e-137, Identity=68%"; Hit description=NOX1
  Pfam annotation: Domain name=FAD_binding_8; Domain location=28-156; Score=149.3; E_value=1e-41; Accession=PF08022.2; Description=FAD -binding domain
  Pfam annotation: Domain name=NAD_binding_6; Domain location=162-335; Score=248.5; E_value=1.4e-71; Accession=PF08030.2; Description =Ferric reductase NAD binding domain
  Pfam module annotation: Pfam domain module=FAD_binding_8::NAD_binding_ 6; Domain location=28-156::162-335
MQTWMYLVVPLVLYAFERIHPFFRGKDHRVSIIKAIIYTGNVLALYMTKPQGFKYKSGMYIFVKCPDISSFEWHPFSITSAPGDDYLSVHIRTLGDWTTELKNKFTQVCEPHSAQPRKGNLMRMETRAPSSNYNHSSNSSIRYPKILIKGPYGAPAQSYKNYDVLMLIGLGIGATPMISILKDMLNNMKSESPKEGTYMQDSDHSYHLDDQIKKGPERAYFYWVTREQSSFEWFKGVMDDIADYDHDNIIEMHNYLTSVYEEGDARSALIAMIQKLQHAKNGVDVVSESRIRTHFARPNWKKVFTQLANAHQSSRIGVFYCGSPTLTKTLKELCLEFSLNSSTRFQFHKENF

SEQ ID NO: 166024 - protein, 210 aa, Glycine max
  Coding DNA Sequence Number=SeqID_49246
  Homolog annotation: Hit_ID=Q9SIB4; Match level="QueryCoverage=30%, HitCoverage=26%, E-value=1e-25, Identity=84%"; Hit description =WUSCHEL-related homeobox 3
  Pfam annotation: Domain name=Homeobox; Domain location=5-66; Score =53.2; E_value=8.4e-13; Accession=PF00046.19; Description=Homeobox domain
MSPAGSSRWSPTTEQLMILEELYRSGIRTPSASQIQQITTHLSFYGRIEGKNVFYWFQNHKARDRQKLRRKLTKQLQLQQQQQQQQFQLHHHCQQLNQDHITNHFVGSFGYSTARSTTHDFSFFNSPSLIFQGGAANTPEQALSCKWNVHNPQSNLVENKEMAFCNYGWTLVDVDNQASSCCTTRPLKTLDLFPLTTTRINEDCTATPPK

SEQ ID NO: 166025 - protein, 150 aa, Glycine max
  Coding DNA Sequence Number=SeqID_49247
  Subcellular localization annotation: CTP_CleavageSite=71; ConfidenceScore=5.51e-01
MASLKGSNNFSTFLSQLSTNTAEKVGETIVALVMATIVKVGTSESMITNPKTCFVTLRTARSSATLPVEFMFMSRKGMNKDLFYMYDCLFHNLHDKVWWISLIQIPNHPLFRPFTSCKNFKTGYFNVAIRPVVEKDYFYNSMRNSLFPFY

SEQ ID NO: 166026 - protein, 274 aa, Glycine max
  Coding DNA Sequence Number=SeqID_49248
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=88%, HitCoverage=20%, E-value=3e-68, Identity=46%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
VKSAFLNGPLDEEVYIQQPPGYEVIGSGDKDGIVMHQKNYIKEVLKRFDMDQCYKVDIPVEGNLKLDTGDHEASVDATLFKQLVGCLRFVYHNRPKISYGVGLVNIFMSNPKQSHLAIAKRILRYLKGTLNYGIFFPHQKEKDELYLVAYSDSDWFRDKVERRSTSTEYISACSAACQALWILSLISKLNMKTDDFVELQVDNKSTIDLARNPMSHGRSKHIETKFHFLRDQVNKGRIRLKHCGTDLQLAYIMTKELKADRFKLLRNMLGVVHI

SEQ ID NO: 166027 - protein, 221 aa, Glycine max
  Coding DNA Sequence Number=SeqID_49249
  Gene Ontology: Mol. function=DNA binding; Biological process=DNA integration
  Homolog annotation: Hit_ID=Q1SAZ0; Match level="QueryCoverage=24%, HitCoverage=3%, E-value=1e-09, Identity=48%"; Hit description =Integrase, catalytic region
MAATVKISWLWNVLDSTSLSLMTPRVNPKINTYAVAYAIDGLSPSLMIIQESRVFFMKETSEVGRIFENFHNMVQTQFQTSIQPHCSKLDPKSIKCIFLGYSPHQKECYSPSTRKFYHTMDVIFFETQPYYPKVAIQGKKTIAQEESQLLEIGEMETIKTNSEPTTEQVAPPTNAPVAPTALVEIQMAEPSEPDSDSPGAQEIKKPHVYSKRQKNSEGVRI

SEQ ID NO: 166028 - protein, 119 aa, Glycine max
  Coding DNA Sequence Number=SeqID_49250
  Gene Ontology: Mol. function=phosphotransferase activity, phosphate group as acceptor; Biological process=nucleobase, nucleoside, nucleotide and nucleic acid metabolic process
  Homolog annotation: Hit_ID=Q08480; Match level="QueryCoverage=55%, HitCoverage=44%, E-value=5e-21, Identity=55%"; Hit description =Adenylate kinase B
  Pfam annotation: Domain name=ADK; Domain location=1-73; Score=-32.4; E_value=1.3e-05; Accession=PF00406.12; Description=Adenylate kinase
MKKPSCQKGFILDGFPRTVVQAQKLDEMLQNQGVKVNKVTGEPLIQCKDDTAAVLKSRLEAFHKQTESQLRSLATSSSSTARLLVSSSSSSSSSSSSARRHCQDAPQFVGLIEAEYGSS

SEQ ID NO: 166029 - protein, 157 aa, Glycine max
  Coding DNA Sequence Number=SeqID_49251
  Gene Ontology: Mol. function=metal ion binding; Cellular component =intracellular; Biological process=metabolic process
  Homolog annotation: Hit_ID=Q5ZDP1; Match level="QueryCoverage=98%, HitCoverage=57%, E-value=2e-29, Identity=29%"; Hit description =Pentatricopeptide (PPR) repeat-containing protein-like
  Pfam annotation: Domain name=PPR; Domain location=92-126; Score=41.4; E_value=3.1e-09; Accession=PF01535.11; Description=PPR repeat
MDAHSDLFAAIGLVDMHSKCEMMDDARRAYDSMCILSVKAIKVCKQIHIISIKVGIYSDFYVIYSLVDKFGKCNHIDEASKTFEDCTWEDLVAYTSMIRTYSQYGDGEEALKLYLEMQDADINPDPFICSSLLNACANLSTYEQGKQLHVHAITFGN

SEQ ID NO: 166030 - protein, 145 aa, Glycine max
  Coding DNA Sequence Number=SeqID_49252
  Homolog annotation: Hit_ID=UPI0000612705; Match level="QueryCoverage =85%, HitCoverage=93%, E-value=1e-08, Identity=37%"; Hit description =UPI0000612705 related cluster
GVNIEEEELTDLRSNPLQGEGDDAILPRKGPVTRTMSKRLQEDWARAVEGGPRVFMNLRRNACPRLQRTTRPRHLRAARPRLHRAVLAFKGLHALAFRGLHILALSGLHILAFGGLHASGQHVRAFRGLHTLAFRGLHVLAFTGL

SEQ ID NO: 166031 - protein, 159 aa, Glycine max
  Coding DNA Sequence Number=SeqID_49253
MICPLRCHEKMHDAIKEQAKVSLLCVGFIPESQLKSKISHSLIHMGFIGLVAWSGRKMQGSCMSAHNMRMMKIECFIPESQLKSKISHSLIHMGFIGLVAWSGRKMQGSCMSAHNMRMMKIECFIPESQLKSKISHSLIHMGFIGLVAWSGVRGHERKD

SEQ ID NO: 166032 - protein, 73 aa, Glycine max
  Coding DNA Sequence Number=SeqID_49254
MVYSDNHSGISARQRNSKIAKKNVYTDKHSGISACQHDSKLSMTDLVSAEDYENLRVSTGLSAAIDEVRRRRR

SEQ ID NO: 166033 - protein, 198 aa, Glycine max
  Coding DNA Sequence Number=SeqID_49255
  Gene Ontology: Mol. function=ATP binding; Biological process=defense response
HDKVDVTYETWKEVFAAQKDLIWEDIQAKFEIPEASDSRTKKKVLQTVGERWRKWALAADKDGVDDIVCEKYGISKEKWAQFCQTRRDPSWEDVRKKAQAIQKQNTAPHGVINPQSPIRRHVKWKMVRTKKTGQMTSEAAKEIAEKIDSLEEQASQGSFVPHGCQDVLTIAIGRLEHLGHVRATGASVTIKQYFSSAP

SEQ ID NO: 166034 - protein, 64 aa, Glycine max
  Coding DNA Sequence Number=SeqID_49256
MDKVNEESELMVVSIDSTDESELMVVSVELDNGFELMVAAVSVFFPRGMGCGCVQKKCFLEKYG

SEQ ID NO: 166035 - protein, 176 aa, Glycine max
  Coding DNA Sequence Number=SeqID_49257
MQFTASFHNDMDTIEVPSFYHQQCPVYPRFVRFRYDGTTFYIRLRQHRQKVYFADGLNHFRKDLEIFESVTIKFLTCKNNSTFDLYFIPSLQHQSCGRPCLFSREHIWTLQITQSMLAAPEPLRLPNCAMAHVNVCGKHMTILRRIRTPLQWNDVVLDIGMSQRYVVQPMVSIPHG

SEQ ID NO: 166036 - protein, 88 aa, Glycine max
  Coding DNA Sequence Number=SeqID_49258
  Gene Ontology: Mol. function=zinc ion binding
  Homolog annotation: Hit_ID=Q1SL48; Match level="QueryCoverage=88%, HitCoverage=63%, E-value=4e-16, Identity=49%"; Hit description=Zinc finger, GRF-type
  Pfam annotation: Domain name=zf-GRF; Domain location=16-62; Score =43.1; E_value=9.7e-10; Accession=PF06839.3; Description=GRF zinc finger
MERSSSLYTSEARSRVFCLCNIEAPLVTLWTEENPGRRFYGCGLYKDTGRKGCNFFQWHDPVGNNHQKKIIVALMKEFDELKLREKDL

SEQ ID NO: 166037 - protein, 386 aa, Glycine max
  Coding DNA Sequence Number=SeqID_49259
  Gene Ontology: Mol. function=helicase activity; Cellular component =membrane; Biological process=protein amino acid phosphorylation
  Homolog annotation: Hit_ID=Q9LTU4; Match level="QueryCoverage=98%, HitCoverage=26%, E-value=1e-105, Identity=50%"; Hit description =Helicase-like protein
  Pfam annotation: Domain name=DUF889; Domain location=159-386; Score =348.3; E_value=1.3e-101; Accession=PF05970.5; Description=Eukaryotic protein of unknown function (DUF889)
MAYDKEMLPKQYNTTYQLLTDEQKTIVDTIMSVVNTQSAAVYFLYGYGGTSKTFVWTTLSSGIRSNGGIVCTIASSGIASLLLPGGRTAHSKFAIPVPATENSTCNIHQGSELAELLKVTKLIVWDEVPMCHKFPFEALDKSLKDIMQNNLPFGGRIMVFGGDFRQILPIVPKGNRSDIVHATINASYIWDHCQILKLTKNMRLLSNAPQQPNNEELKQFSHWLLDIGDGKIGQYNDGFSEITIPDEFLIKNYDDPIHAIVEATYPSLIDNYSDTDYLQKRVVLASKKEIVDKINDYVLSLIPNHEKEYCSADSIDKSDELLNPAFALLPPEFLYSLQTSGIPNHKLKLKVGTPIMLIRNLDQIDGLCNGTRLIITKLGSNVIEAE

SEQ ID NO: 166038 - protein, 129 aa, Glycine max
  Coding DNA Sequence Number=SeqID_49260
MNGPSDKVNAPPHEHTQHAHANAFPTSINIPCSHHSKHRHHLVSMTLSTTTTTLFHIQIIITNGKQRRLTTATGGLGWWKISGPFALSRSPLLALSPNGQTVETYLREIQTKFEYDPTVNESGIEILLK

SEQ ID NO: 166039 - protein, 117 aa, Glycine max
  Coding DNA Sequence Number=SeqID_49261
MNFDASVRNDGTGLGLILRDDEGMALEAATYFLQSTNTSLEAEAICFRWGGEGSLKQDRNYVQGIIDDSYVLCDEFHSISLTFTTSRMGNRVAHELVGLAVLFHGSYWIEEVPQFVV

SEQ ID NO: 166040 - protein, 182 aa, Glycine max
  Coding DNA Sequence Number=SeqID_49262
  Pfam annotation: Domain name=RNA_pol_Rpb1_R; Domain location=127-140; Score=18.8; E_value=0.02; Accession=PF05001.4; Description=RNA polymerase Rpb1 C-terminal repeat
  Pfam annotation: Domain name=RNA_pol_Rpb1_R; Domain location=141-154; Score=10.0; E_value=4.2; Accession=PF05001.4; Description=RNA polymerase Rpb1 C-terminal repeat
  Pfam annotation: Domain name=RNA_pol_Rpb1_R; Domain location=155-168; Score=17.1; E_value=0.064; Accession=PF05001.4; Description=RNA polymerase Rpb1 C-terminal repeat
  Pfam module annotation: Pfam domain module=RNA_pol_Rpb1_R::RNA_pol _Rpb1_R::RNA_pol_Rpb1_R; Domain location=127-140::141-154::155-168
MDIRLPFYPAEVSKVCMIQFGIPSPDEIANVCGANRAWLDNGEREDEVHQYPGTIPLHLARTLPLQLIILVLQDIVLQVQLICLPVHPTLLHCWVTSEVKVWCQISLCGGSWSIGVNLPSVYPPRISPTSPSYSPTSPAYSSTSSSYSPTSPSYSPTSPSYSPTSLGYSQHHTIILPKITIV

SEQ ID NO: 166041 - protein, 76 aa, Glycine max
  Coding DNA Sequence Number=SeqID_49263
MEEEKSMAAKICVGVDLDEACVGQRGWTVRIGGRKRRVATSCCVQCEGVNEEIKEIFFPRKNHGIIRKGRDKCLPL

SEQ ID NO: 166042 - protein, 89 aa, Glycine max
  Coding DNA Sequence Number=SeqID_49264
MGNWKGWRYFNRLSIYPIKSILRKVTSNFRFKTEGHRNGLLSLYKDMESCGEYADIKVMWKMIESSSPQYACHKKRINRSSYWVVCRLT

SEQ ID NO: 166043 - protein, 99 aa, Glycine max
  Coding DNA Sequence Number=SeqID_49265
DQMVPACHPACRLWMTKGAEDDVSLCVPSDMTVSEWRKGVEDDVSLCVPSDMVVSEWRKGAEDDVSLCVPSDMTVSEWRKEDDVSLCVPSDTAVSEWRK

SEQ ID NO: 166044 - protein, 76 aa, Glycine max
  Coding DNA Sequence Number=SeqID_49266
MDEFIELMKEHNLETLGCWSAHLAVAMTNFARCFQIIIVMRALWSGRGVRPETDTLTPKFVLPQISRLGSHDKRPH

SEQ ID NO: 166045 - protein, 136 aa, Glycine max
  Coding DNA Sequence Number=SeqID_49267
MPKTLTPYLPPPTTSNGNHESPLLAVGPPHREECFNWSRIFRIHLKDSIENEAPNLFFRGFFEDSMFGPMNLNARDLRTTLRGVEGEITIDDDVEMMMQSYPARALDRRLQVDWARDAREGPRVLMSLRTDFGPMG

SEQ ID NO: 166046 - protein, 387 aa, Glycine max
  Coding DNA Sequence Number=SeqID_49268
  Gene Ontology: Mol. function=beta-1,4-mannosylglycoprotein 4-beta-N -acetylglucosaminyltransferase activity; Cellular component=membrane; Biological process=protein amino acid N-linked glycosylation
  Homolog annotation: Hit_ID=Q0WV60; Match level="QueryCoverage=98%, HitCoverage=97%, E-value=0.0, Identity=77%"; Hit description=Beta-1 ,4-N-acetylglucosaminyltransferase like protein
  Pfam annotation: Domain name=Glyco_transf_17; Domain location=27-386; Score=902.2; E_value=2.3e-268; Accession=PF04724.4; Description =Glycosyltransferase family 17
MSEGYYNSKKTDDICDDVCGQNGTPAALSMSRLKCILKGLDFKTYIFLFVIVPVGIFGLYLHGQKISYFLRPLWESPPKPFHEIPHYYHENVSMESLCKLHGWGIRESPRRVFDAVLFSNEVDILTIRWKEMQPYVTQYVLLESNSTFTGFVKPLLFSGNRDKFKFLESRLTYGVIGGRFKKKENPFIEEAYQRVALDQLLRIAGIEDDDLLIMSDVDEIPSAHTINLLRWCDGIPPVLHLQLKNYLYSFEFFLDNKSWRASIHRYQTGKTWYAHYRQADVLLADAGWHCSFCFRHINEFIFKMKAYSHYDRVRFPHYLNPDRIQDVICKGADLFDMLPEEYTFKEIIGKLGPIPHSYSAVHLPAYLLNNAERFRFLLPGNCRRERG

SEQ ID NO: 166047 - protein, 152 aa, Glycine max
  Coding DNA Sequence Number=SeqID_49269
  Gene Ontology: Mol. function=transferase activity; Biological process= DNA integration
  Homolog annotation: Hit_ID=Q1RVB5; Match level="QueryCoverage=96%, HitCoverage=24%, E-value=7e-22, Identity=67%"; Hit description =Peptidase, cysteine peptidase active site; Zinc finger, CCHC-type; Peptidase aspartic, ...
  Homolog annotation: Hit description=catalytic; Polynucleotidyl transferase, Ribonuclease H fold
MDNINNLNTLFAQLLTSDFNIEENERAKLLLHSLPNSYDQFIINIIVSRLTFDDVARTIPKEESKQKNKKDRQENSKHAKALMMTKIHTECGILKAMKGNLVLIKAEKIIANLCMLLGDMLQEVYALVATTSQEEAMMIWHQRLGHMSESKA

SEQ ID NO: 166048 - protein, 81 aa, Glycine max
  Coding DNA Sequence Number=SeqID_49270
MTLFTFKLSHNWVSEKMHSQLTRMVHLKETKSEKEDEIGKEGGLTGEKWRWKIQHLEEKILNPNRTDSERGSRDLALLFDW

SEQ ID NO: 166049 - protein, 223 aa, Glycine max
  Coding DNA Sequence Number=SeqID_49271
  Subcellular localization annotation: CTP_CleavageSite=49; ConfidenceScore=5.53e-01
MQRKFHFLVKNKATASADGGTRFTCGTQFSRKSVGSAFSCVIGNKTTPRGKHASKLKKKKEPIGDSGNGKAALSQLLALEETDHAGDAKQNRKDRQRVKMNLPLMSFLKKKRGWNNFMRARFSSGVHGDGSNVVTKFGQVKRKASLRRLVRVPSKILVLRLKLKMIKCLIIKKAPKQFEQRAEDEDRELCKKRILLGERCRPLSSPSPGYDTSNFFYPRNSYT

SEQ ID NO: 166050 - protein, 206 aa, Glycine max
  Coding DNA Sequence Number=SeqID_49272
  Gene Ontology: Mol. function=single-stranded DNA binding; Cellular component=mitochondrion; Biological process=DNA replication
  Homolog annotation: Hit_ID=Q84J78; Match level="QueryCoverage=65%, HitCoverage=63%, E-value=4e-50, Identity=76%"; Hit description =Single-stranded DNA-binding protein, mitochondrial precursor
  Pfam annotation: Domain name=SSB; Domain location=29-140; Score=91.2; E_value=3.2e-24; Accession=PF00436.15; Description=Single-strand binding protein family
MQFLTGFNLVGNRRRKSRDAMRFRDASLSKQAIICGKVGQAPVQKILRNGRNITIFTVGTGGMFDQRIQGPKDLPKPAQWHRIAVHNDILGTYAVQQLFKNSSVYVEGDIETRVYNDSINGNVKSIPEICVRRDGSAAKLEGEFASSRMGRALIKLPWMNCIKVCLLIGIMPDYNAGRRRVVLGKVDHLTEAYTSERNFALLLQHL

SEQ ID NO: 166051 - protein, 138 aa, Glycine max
  Coding DNA Sequence Number=SeqID_49273
  Gene Ontology: Mol. function=single-stranded DNA binding; Cellular component=mitochondrion
  Homolog annotation: Hit_ID=Q2HW28; Match level="QueryCoverage=51%, HitCoverage=28%, E-value=1e-16, Identity=59%"; Hit description =Single-stranded DNA binding
MNSMAVRLAKHLRLSALTSFSLGGVPRSGASWYSTSLSGGENDHPLPDNDAPKKEALDEEFDDFLGEKPELQLQGVDPKKGWGFRGVHKVLHFCYAMTKYKFLQYKILKIELILDNGHAGANVVNNGSWKIAKAENPL

SEQ ID NO: 166052 - protein, 992 aa, Glycine max
  Coding DNA Sequence Number=SeqID_49274
  Gene Ontology: Mol. function=protein binding; Cellular component =integral to membrane; Biological process=protein amino acid phosphorylation
  Homolog annotation: Hit_ID=Q1SLU2; Match level="QueryCoverage=99%, HitCoverage=88%, E-value=0.0, Identity=47%"; Hit description=Leucine- rich repeat, plant specific
  Pfam annotation: Domain name=LRRNT_2; Domain location=27-69; Score =32.2; E_value=1.8e-06; Accession=PF08263.3; Description=Leucine rich repeat N-terminal domain
  Pfam annotation: Domain name=LRR_1; Domain location=121-143; Score =10.2; E_value=3.5; Accession=PF00560.23; Description=Leucine Rich Repeat
  Pfam annotation: Domain name=LRR_1; Domain location=204-226; Score =11.6; E_value=1.9; Accession=PF00560.23; Description=Leucine Rich Repeat
  Pfam annotation: Domain name=LRR_1; Domain location=228-250; Score =5.0; E_value=34; Accession=PF00560.23; Description=Leucine Rich Repeat
  Pfam annotation: Domain name=LRR_1; Domain location=252-274; Score =6.0; E_value=22; Accession=PF00560.23; Description=Leucine Rich Repeat
  Pfam annotation: Domain name=LRR_1; Domain location=276-296; Score =6.3; E_value=19; Accession=PF00560.23; Description=Leucine Rich Repeat
  Pfam annotation: Domain name=LRR_1; Domain location=300-322; Score =9.2; E_value=5.4; Accession=PF00560.23; Description=Leucine Rich Repeat
  Pfam annotation: Domain name=LRR_1; Domain location=324-343; Score =9.5; E_value=4.7; Accession=PF00560.23; Description=Leucine Rich Repeat
  Pfam annotation: Domain name=LRR_1; Domain location=348-369; Score =10.8; E_value=2.8; Accession=PF00560.23; Description=Leucine Rich Repeat
  Pfam annotation: Domain name=LRR_1; Domain location=371-394; Score =15.5; E_value=0.19; Accession=PF00560.23; Description=Leucine Rich Repeat
  Pfam annotation: Domain name=LRR_1; Domain location=396-418; Score =9.6; E_value=4.5; Accession=PF00560.23; Description=Leucine Rich Repeat
  Pfam annotation: Domain name=LRR_1; Domain location=420-441; Score =11.2; E_value=2.3; Accession=PF00560.23; Description=Leucine Rich Repeat
  Pfam annotation: Domain name=LRR_1; Domain location=445-467; Score =13.4; E_value=0.84; Accession=PF00560.23; Description=Leucine Rich Repeat
  Pfam annotation: Domain name=LRR_1; Domain location=469-492; Score =5.9; E_value=23; Accession=PF00560.23; Description=Leucine Rich Repeat
  Pfam annotation: Domain name=LRR_1; Domain location=494-517; Score =5.9; E_value=22; Accession=PF00560.23; Description=Leucine Rich Repeat
  Pfam annotation: Domain name=LRR_1; Domain location=522-542; Score =1.7; E_value=1.3e+02; Accession=PF00560.23; Description=Leucine Rich Repeat
  Pfam annotation: Domain name=LRR_1; Domain location=545-567; Score =12.9; E_value=1.1; Accession=PF00560.23; Description=Leucine Rich Repeat
  Pfam annotation: Domain name=LRR_1; Domain location=569-590; Score =13.0; E_value=1.1; Accession=PF00560.23; Description=Leucine Rich Repeat
  Pfam annotation: Domain name=LRR_1; Domain location=593-614; Score =13.0; E_value=1.1; Accession=PF00560.23; Description=Leucine Rich Repeat
  Pfam annotation: Domain name=LRR_1; Domain location=638-660; Score =9.9; E_value=4.1; Accession=PF00560.23; Description=Leucine Rich Repeat
  Pfam annotation: Domain name=LRR_1; Domain location=662-681; Score =13.0; E_value=1; Accession=PF00560.23; Description=Leucine Rich Repeat
  Pfam annotation: Domain name=LRR_1; Domain location=687-709; Score =8.3; E_value=8.1; Accession=PF00560.23; Description=Leucine Rich Repeat
  Pfam annotation: Domain name=LRR_1; Domain location=711-733; Score =14.9; E_value=0.29; Accession=PF00560.23; Description=Leucine Rich Repeat
  Pfam annotation: Domain name=LRR_1; Domain location=735-757; Score =11.0; E_value=2.5; Accession=PF00560.23; Description=Leucine Rich Repeat
  Pfam annotation: Domain name=LRR_1; Domain location=759-780; Score =6.4; E_value=18; Accession=PF00560.23; Description=Leucine Rich Repeat
  Pfam annotation: Domain name=LRR_1; Domain location=785-808; Score =6.0; E_value=21; Accession=PF00560.23; Description=Leucine Rich Repeat
  Pfam annotation: Domain name=LRR_1; Domain location=903-925; Score =8.1; E_value=8.6; Accession=PF00560.23; Description=Leucine Rich Repeat
  Pfam annotation: Domain name=LRR_1; Domain location=927-949; Score =11.2; E_value=2.3; Accession=PF00560.23; Description=Leucine Rich Repeat
  Pfam annotation: Domain name=LRR_1; Domain location=951-973; Score =20.4; E_value=0.0063; Accession=PF00560.23; Description=Leucine Rich Repeat
  Pfam annotation: Domain name=LRR_1; Domain location=97-119; Score =10.4; E_value=3.2; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1; Domain location=27-69::121-143::204-226::228-250::252 -274::276-296::300-322::324-343::348-369::371-394::396-418::420 -441::445-467::469-492::...
  Pfam module annotation: Domain location=494-517::522-542::545 -567::569-590::593-614::638-660::662-681::687-709::711-733::735 -757::759-780::785-808::903-925::927-949::951-973::97-119
MRIHQIFFTFFIPLCLINIDVATFHCLDHQQFLLLHLKDNLVFNPDTSKKLVHWNHSGDCCQWNGVTCSMGQVIGLDLCEEFISGGLNNSSLFKLQYLQNLNLAYNDFNSSIPLEFDKLKNLRCLNLSNAGFHGQIPAQISHLTNLTTLDLSTSLASQHFLKLQNPNIEMILQNLTKLTELYLDGVRVSAEGKEWCHALSSLQKLKVLSMASCNISGPIDSSLEALEELSVVRLNLNNISSPVPEFLVNFSNLNVLELSSCWLRGNFPKGIFQMQTLSVLDISNNQDLHGALPNFLQQEVLHTMNLSNTNFSGKLPGSISNLKQLSKLDLSNCQFIETLPISMSEITQLVHVDLSFNKFTGPLPSLKMAKNLRYLSLLHNNLTGAIPTTHFEGLENLLTVNLGDNSLNGKIPLTLFTLPSLQELTLSHNGFDGLLDEFPNVSASKLQLIDLSSNKLQGPIPESIFHINGLRFLQLSANEFNGTIKLVMIQRLHNLHTLGLSHNKLSVDIIVNDDHDLSSFPSMKYILLASCKLREFPGFLRNQSQLNALDLSNNQIQGIVPNWIWRFDSLVYLNLSNNFLTNMEGPFDDLNSNLYILDLHSNQLSGSIPTFTKYAVHLDYSSNKFNTAPLDLDKYIPFVYFLSLSNNTFQGKIHEAFCNLSSLRLLDLSYNRFNDLIPKCLMRRNNTLRVLNLAGNKLKGYLSDTISSSCNLRFLNLNGNLLGGVIPDSLANCQSLQVLNLGSNQFSDRFPCFLSNISSLRVLILRSNKLNGPIACPHNTSNWEMLHIVDLAYNNFSGILPGPFFRSWTKMMGNEAESHEKYGSLFFDVFDNHATVRYNNLFTVISKFLVMKLYKLLATEPYFVADHIFAYYVTSNEFGGRYLDSVTIVNKALQMKLIKIPTIFTSLDLSSNHFEGPIPEELVSLKALNVLNLSHNAFSSHIPLSIGSLVHLESLDLSNNNLSGKIPLELASLNFLAYLNLSFNQLRGQIPT

SEQ ID NO: 166053 - protein, 227 aa, Glycine max
  Coding DNA Sequence Number=SeqID_49275
  Gene Ontology: Mol. function=disulfide oxidoreductase activity; Cellular component=extracellular space; Biological process=antigen processing and presentation of exogenous peptide antigen via MHC class II
  Homolog annotation: Hit_ID=Q10MT8; Match level="QueryCoverage=76%, HitCoverage=67%, E-value=4e-37, Identity=39%"; Hit description=Gamma interferon inducible lysosomal thiol reductase family protein, expressed
  Pfam annotation: Domain name=GILT; Domain location=50-157; Score =50.7; E_value=4.9e-12; Accession=PF03227.6; Description=Gamma interferon inducible lysosomal thiol reductase (GILT)
MVFPKLGIIITAALALVPLLFINESDGASYYPSGLHADIAEIAPFASQKVNLSVYYASLSQPCATFIVKNLEEIFHSDLINIVNLQLVPWANAYVDKTNHSINGPDECELNSLEACALNVLNDVNKHYALIYCFEFLAIEGRHKNWQDCFSQLDLPEEPILSCYNRGNGTELGQKSINETALLYAPHEFLPWVMVNNQSIGKEYENFSRYVCEAYKGITAPAACNLH

SEQ ID NO: 166054 - protein, 145 aa, Glycine max
  Coding DNA Sequence Number=SeqID_49276
MTMMMVVAVMDGDGGGGNIDDSSSDNVIVVIISVAMIVAVAVVVGGVGGGCNEVVVVVAVMKVVLLVVMTMIVIVTLMVVVTMLTMMVMVMLAVMLVAVSVVVVIITSYGNDNNDSGSDDGGGNGIGDDDNDNGDGRCNIPFFVK

SEQ ID NO: 166055 - protein, 329 aa, Glycine max
  Coding DNA Sequence Number=SeqID_49277
  Gene Ontology: Mol. function=protein binding; Biological process =multicellular organismal development
  Homolog annotation: Hit_ID=Q1SGM6; Match level="QueryCoverage=92%, HitCoverage=24%, E-value=1e-122, Identity=82%"; Hit description =Lissencephaly type-1-like homology motif; CTLH, C-terminal to LisH motif
MGSTGHQGSEIEINGAVLDLSVRYDFSEQRIGVSHTPVSGGREIQRICTQFFPFSLQVVDVSDSGVVGTWDEFEMRLEKESGFFFNMKYFEEKVQAGEWEEVEKYLSGFTKVDDNRYSMKIFFEIRKQKYLEALDQQDKAKAVEILVGDLKMFSTFNEELYKEITQLLTLTNFRENEQLSKYGDTKTARSIMLIELKKLIEANPLFRDKLIFPTLKSSRLRTLINQSLNWQHQLCKNPRPNPDIKTLFTDHTCAPPNGPLAPTPINLPIAAVAKPATYTPLGAHGPFPPAAATANANALAGWMANASASSSVQAAVVTASTIPVPQNQG

SEQ ID NO: 166056 - protein, 47 aa, Glycine max
  Coding DNA Sequence Number=SeqID_49278
MNTRAKPAKALCSIHQENALKLSPIIPISISQCEPGFAPDETMMPKE

SEQ ID NO: 166057 - protein, 543 aa, Glycine max
  Coding DNA Sequence Number=SeqID_49279
  Gene Ontology: Cellular component=nucleus; Biological process =regulation of transcription, DNA-dependent
  Homolog annotation: Hit_ID=Q00LP4; Match level="QueryCoverage=54%, HitCoverage=98%, E-value=7e-56, Identity=42%"; Hit description=GRAS5
  Pfam annotation: Domain name=GRAS; Domain location=150-455; Score =24.3; E_value=1.9e-09; Accession=PF03514.5; Description=GRAS family transcription factor
MMQSEDLQFQWPFFEDMNSTFDQGVESYGFTTMYGHVGDCGPYDFTMNDHVGDCGLNTLLSTPEDSTSEICSIPFPSSPIFSIDHIHIQYPINEETMHLPSLMELDDFDSILDTQIISIQGHGESEGSFFPSQNFSSEVENAWSPTPSVRSELSTNQTSPLTLPLENMEVENQVSLPHLLKAYGEALEQGQKALEEVILRCISQKASPLGESLERLAFYLSQGMTNHGDYLKGEALKNFEAALRALYQGFPIGKIAHFAAVSAILEALPQDCDVHIVDFYIGHGVQWPPMIEAIAHMNKTLTLTSIKWGGEVPECVSSPCNFEETRRQLYEHAKSCGLKLKVEEKGVEELVSDIKKMNKKGEKGEFLAFNCTIDLPHMGKVRSRKHALQFLRVADELISTSDNRGIITFADGDAFEKVKNNLNFRSFFDGHLVHYQALLESMESHFPTSFSEARIAMEKLFLQPCISSLDWLQTWEEMKRGGHLEEETSLEGCQLSKNILMEIREVLRGSDGSYQARIEGQHDNELVLEYKGTQLLRFSTWKN

SEQ ID NO: 166058 - protein, 124 aa, Glycine max
  Coding DNA Sequence Number=SeqID_49280
MLKVSWSLEPRWNSLWVIEMESKDFESSPPSERKAILNRIVIFDEFSMLYSKSDEVLGKDEDITKQFESPSETVHGLQMHPQDQTSAPVEETDWTIQNNLKQPKTTTPRKSQRKIKAPKRYDLI

SEQ ID NO: 166059 - protein, 150 aa, Glycine max
  Coding DNA Sequence Number=SeqID_49281
  Subcellular localization annotation: CTP_CleavageSite=63; ConfidenceScore=5.62e-01
MPPFSHSKFAFTLTSLDLSQNALFGSLNNMSFLPSHSNLQSLNLSTNLLECDLLQQPTTSKTSENEKEDRGRVQVVIGLLRVDPDADSGSAGIAALEVQPPPCHRLLLQQPTTSKTSENEKEDRGRVQVVIGLLRVDPDADSGSASWCWY

SEQ ID NO: 166060 - protein, 87 aa, Glycine max
  Coding DNA Sequence Number=SeqID_49282
  Homolog annotation: Hit_ID=Q2HW42; Match level="QueryCoverage=95%, HitCoverage=5%, E-value=6e-17, Identity=94%"; Hit description =Phospholipase D/Transphosphatidylase; Pleckstrin-like
MDKLVHVLPATVSRCKFFIKGEKVYNGVKNNYFVDDMPCQKPYAYTERVIRSVSQWSAGTSQPEESIHTAYCSLIEEAKHFIYIEVN

SEQ ID NO: 166061 - protein, 156 aa, Glycine max
  Coding DNA Sequence Number=SeqID_49283
  Homolog annotation: Hit_ID=Q1T1Y0; Match level="QueryCoverage=59%, HitCoverage=23%, E-value=3e-13, Identity=44%"; Hit description =Ankyrin
  Pfam annotation: Domain name=DUF1723; Domain location=60-109; Score =55.4; E_value=1.9e-13; Accession=PF08330.1; Description=Protein of unknown function (DUF1723)
MTCRSSIGGPFGATCESGPKETSLLTSYADHVVWEVWGDMIHDVVKGSSLFSLTACSYQTIDKGLLLAFAERWHKEKNTFHLLMGEMTITLDDVASLLDITITSVFYNCEHMDKEAPISVLVELLRFEYKDSFDDGLVNISRARGGTRGGCHRGGH

SEQ ID NO: 166062 - protein, 33 aa, Glycine max
  Coding DNA Sequence Number=SeqID_49284
MWDCDISSLERLRASSKDVETQRWVTNESARLL

SEQ ID NO: 166063 - protein, 158 aa, Glycine max
  Coding DNA Sequence Number=SeqID_49285
  Gene Ontology: Mol. function=hydrolase activity
  Homolog annotation: Hit_ID=Q1SMF0; Match level="QueryCoverage=70%, HitCoverage=20%, E-value=1e-17, Identity=48%"; Hit description =Tetratricopeptide-like helical
MDDTVKNEDCNNFFKTTKVFDTRDELLKRVWEVAFELDVVVVILRYIHWHVMNDEVVCNIFWTQPDVVKLLNAFNIVFYMDNTYKTNRYRLPLLEIIGVTCTVLTFSASFAYMKVEREKKIRWALERFRGLFRKHDESKSDCNKQRPNFDECSKNCVS

SEQ ID NO: 166064 - protein, 229 aa, Glycine max
  Coding DNA Sequence Number=SeqID_49286
  Gene Ontology: Mol. function=transcription factor activity; Cellular component=intracellular; Biological process=regulation of transcription, DNA-dependent
  Homolog annotation: Hit_ID=Q7N443; Match level="QueryCoverage=98%, HitCoverage=88%, E-value=9e-62, Identity=50%"; Hit description =Similar to hypothetical transcriptional regulator YgbI of Escherichia coli
  Pfam annotation: Domain name=DeoR; Domain location=48-204; Score =158.7; E_value=1.5e-44; Accession=PF00455.13; Description=Bacterial regulatory proteins, deoR family
  Pfam annotation: Domain name=HTH_DeoR; Domain location=3-34; Score= -1.1; E_value=0.08; Accession=PF08220.3; Description=DeoR-like helix -turn-helix domain
  Pfam module annotation: Pfam domain module=DeoR::HTH_DeoR; Domain location=48-204::3-34
MAVSAMTIRRDIKFLQDAGLVVGIHGGVRLPAVVHQALPYVEKAQLNVHAKQSLGRYAASLVEDGQVVYLDAGTTSYEIARALGDQASLTVLTNDFTIAAWLMRHSHITLFHTGGKVDKRHIASVGAMAATALAAFNIDLAFLSASAWDVTHGLSTPDEDTLLVNQAVLAASAQRYLVADSSKYGRYSVYSVCKLQQLDGVITDDDCPCAAVEEMKQRGIRLHRVNRRG

SEQ ID NO: 166065 - protein, 1220 aa, Glycine max
  Coding DNA Sequence Number=SeqID_49287
  Homolog annotation: Hit_ID=Q1STF1; Match level="QueryCoverage=42%, HitCoverage=100%, E-value=0.0, Identity=69%"; Hit description =Pectinesterase; Pectinesterase inhibitor
  Pfam annotation: Domain name=DUF1399; Domain location=106-217; Score =79.7; E_value=9e-21; Accession=PF07173.3; Description=Protein of unknown function (DUF1399)
  Pfam annotation: Domain name=PMEI; Domain location=715-870; Score =59.5; E_value=1.1e-14; Accession=PF04043.6; Description=Plant invertasepectin methylesterase inhibitor
  Pfam annotation: Domain name=Pectinesterase; Domain location=905 -1205; Score=662.9; E_value=2.5e-196; Accession=PF01095.10; Description=Pectinesterase
  Pfam module annotation: Pfam domain module=DUF1399::PMEI::Pectinestera se; Domain location=106-217::715-870::905-1205
MSENLDASEISPSTSSASLGETPEIAAIPLGIDLVSAARRNICFLRTVADSLWLHHTPIMVEAVRRYHDFWMPLIADLTLQNSSPPMILPPLDIHWVWFCHTLNPVSYREYCETRFSKLIGKAGIFDEENREYALMRCMEIWSSRYPLESFENEASWDSQDSDTVAVVGGSLKERVFKEVEKQRRFTREFSSRLVPTSDILLMWLTHQSYPTVYCEDLKALAIEGDLQKVATLSETVKEKESEETKKLWDRAFNQPYEKAGGEVPFMLDVVTSIKSPVYWEESGTDVNTKYRSMLPRFLLEACVFVRLKQRITTLQKDINHDFLHLRIVRCHSELKLDKALSKFTNDSWKKAWHFYCEFGTKGVMFEYRRHGGNCLRGSSLLDTVSFRWNDLLRADSLTLEKEVSQQVNVVTSITPPVQAPYLLKCVPDRVTDDSGAMISDVILKMNSYRPQEGRWLSRTVLDHAGRVCFVIRIRVGGGFWRRGGEAPSAVKWEDRIIEIREGSWSYVAGYIGRAPEKVVATATPKEPTEQCKAAWCFSTGDELTIQWESSQSVSGRQMQYQVKKTKSKRKGEDMKIELEEKEIEGEEDEESFITVVRFTEDNPDGKATALLNWRLLVVEVLPEEDAVLMLLLCLSILKSVSEMKKQDVGGLLVRRRLKEARLGSRDWGSVILHPSSWSSSIDSTYLQPWHWNAVVVMKSDAVDQLKRYPTLSPSPVEAFSSTPNGSCDTTPYPAFCKTTLPASQYLSIQDQCRFFPQQSLSITKTIFNLVSSYLRDPYTIPHSTVHALEDCLNLSELNSDFLSNVLQAIENTLASYEVYDLQTLLSAILTNQQTCLDGFKEVTPYPIVTNALSSPLSDAIKLYSTSLALFTRGWVSAATTTTGSSTTVETIINRKLLQTSVDDNVVVNPDGSGDFATINDAIHAAPNNTGTNNGYHVIYVVAGIYNEYVSVPKSKQNLMLVGDGINRTVLTGNRSVVDGWTTFQSATFVGKGFVAVNITFRNTAGSSKHQAVAVRNGADMSTFYNCSFEGYQDTLYVHSLRQFYKSCDIYGTVDFIFGNAAALLQDCNMYPRLPMQNQFNAITAQGRTDPNQNTGISIQNCCIIAASDLGDATNNYNGIKTYLGRPWKEYSRTVYMQSFIDGLIDPKGWNEWSGDFALSTLYYAEFANWGPGSNTSNRVTWEGYHLIDEKDADDFTVHKFIQGEKWLPQTGVPFKAGLQ

SEQ ID NO: 166066 - protein, 683 aa, Glycine max
  Coding DNA Sequence Number=SeqID_49288
  Gene Ontology: Mol. function=protein serine/threonine kinase activity; Cellular component=cell surface; Biological process =protein amino acid phosphorylation
  Homolog annotation: Hit_ID=Q5DMV1; Match level="QueryCoverage=96%, HitCoverage=97%, E-value=1e-176, Identity=50%"; Hit description =Receptor lectin protein kinase-like
  Pfam annotation: Domain name=Lectin_legB; Domain location=25-273; Score=319.7; E_value=5.2e-93; Accession=PF00139.10; Description =Legume lectin domain
  Pfam annotation: Domain name=Pkinase; Domain location=358-660; Score =154.8; E_value=2.3e-43; Accession=PF00069.15; Description=Protein kinase domain
  Pfam annotation: Domain name=Pkinase_Tyr; Domain location=358-627; Score=86.0; E_value=1.2e-22; Accession=PF07714.7; Description =Protein tyrosine kinase
  Pfam module annotation: Pfam domain module=Lectin_legB::Pkinase::Pkina se_Tyr; Domain location=25-273::358-660::358-627
MPIPLMASPTLLVFLLFLSLLHQVASKAVIFEGFDENSELNLQGSSIIKTSRLLKLTNRSTNIVGHAFYATPFQMLNKNNTNPPLQPYAYSFSTNFVFSIVSPISGSGGFGLAFTIAPSTQFPGAEAGHYLGLVNSANDGNDSNHIFAVEFDTVNGYKDDSDTEGNHVGVNINGMDSIITEPAAYIEEGTDNVKEDFRMAKVDAVQVWIEYDGEKKTLNVTIAPLPLPRPSKPIIMNHNIDLYNVMEESMYVGFSASTGQETSSHYLLGWSFVVNGVAPLLNISNLPKPPPKEKEPTSFPWVNVAIGILSGLTFCLLCILFCLTCYRRYMDFEVLEDWEMDCPHRFRYKDLHIATKGFIESQLIGVGGFGAVYKGVLPSTGAEVAVKRIVRSPFHGMREFAAEIESLGKLRHKNLVNLQGWCKKKNDLLLVYDFIPNGSLDYVLYKPNNNNNFVLNWGQRFNILKDISAGLLYLHEEWEQVVIHRDVKTSNILIDAHLNARLGDFGLARLYNHGQVSHTTSVVGTIGYIAPELTRTGKACANTDVYSFGVVLLEVATGKRPLDSDQFFLVEWVIENYHLGQILEVVDPKLDSLYDEEEVELVLKLGLLCTQHRADYRPSMKQVTRYLNFDDPLPDIADWGHDVSGSSRLSEGFLEVTSSMGTVEALGYLSSISMSTKSIDAGR

SEQ ID NO: 166067 - protein, 226 aa, Glycine max
  Coding DNA Sequence Number=SeqID_49289
  Gene Ontology: Mol. function=dihydrodipicolinate synthase activity; Biological process=metabolic process
  Homolog annotation: Hit_ID=Q0S0T5; Match level="QueryCoverage=92%, HitCoverage=70%, E-value=2e-54, Identity=52%"; Hit description =Dihydrodipicolinate synthase
  Pfam annotation: Domain name=DHDPS; Domain location=4-224; Score= -96.4; E_value=2e-05; Accession=PF00701.12; Description =Dihydrodipicolinate synthetase family
MVCVGAISTDAVLHLAEDAQFAGADALLLPAMSYQPLRNEEVYALFETVTRHASVPVCVYDNPGTTHFRFTDELLGQLSSLKGIRSIKIPGVPDTPIAAAERVAALRQHLRPGVTLGISGDASAGLGLNAGCEVWYSVCGGIFPETAKQITQAAAINDAERVTALTHRLQPLWDLFRKHGGSLRVIAAAAGLLGLTDADCLPRPLLPLSVAEVAEVAAVMAALDLK

SEQ ID NO: 166068 - protein, 97 aa, Glycine max
  Coding DNA Sequence Number=SeqID_49290
MTHTRNIISSPIANTNPEHLTSSELHLDFLKRESKMAEKIEELTESSFDVEGLVVKRIERVAMKRRENMAEMKIRTENKLQKLEPPLPPLATTAIGY

SEQ ID NO: 166069 - protein, 80 aa, Glycine max
  Coding DNA Sequence Number=SeqID_49291
MKEEVRKEVLKLLEAGLIYPISDSAWVSPVQVVPKKGGLGSSSSMDSFASWKMNGSGMEKEEREETPLQGEDESRRSSPP

SEQ ID NO: 166070 - protein, 101 aa, Glycine max
  Coding DNA Sequence Number=SeqID_49292
MAAQLIHDHVWTVEWILPTPTQHRLVEPIQVIEVSSSEEDPEEDPEELPPEPAVDALDLSEDDEDPLPVVDSPEDILSASEADSTEESGPGGTANSEDSSS

SEQ ID NO: 166071 - protein, 265 aa, Glycine max
  Coding DNA Sequence Number=SeqID_49293
VLNNFLRTRNLTYMCKMIHSVFFIIVMPRVGSRDYAFKGNLNPKVKKNFIPYGMLFIRIRRLAGVDVSSKEPSSGATSLKRETLALSSYVDHTIGTQANPLDLESGASPQQIQRSLIDAKEKARVEKVLLRKKKRRRAPTSYRARKDSCGRKGGSRCCNAQFVIKVSLQGFDVSTKNDSIETNLGVAPLQPRPITTEDEVDVEPLLAHPMMKRERRRHFKEKMSLEEAHHHRRPWIRAWRKKEMNEGRGREEHEILCSKRALKSE

SEQ ID NO: 166072 - protein, 178 aa, Glycine max
  Coding DNA Sequence Number=SeqID_49294
SLPNRPSYKSNPQETQRTDAHAKVEYVKRLYDQVKVQIAKKNENYAKQANKKRKEVVLEPGDDPGHLRTNVIQEGGNDENHETGQIQAKGRSGEGRRPKWRRTKPPKFLSGFLVEPIIRLIKVILVASSQTYLPSLEVASTVTYLPSPEVASTLTYLPSSEVASSKLYKLYQAIRSYS

SEQ ID NO: 166073 - protein, 84 aa, Glycine max
  Coding DNA Sequence Number=SeqID_49295
MVKKLGKFLKRSKDRRFSKPSKKTEGNNNTFHMLQMWEASEEDVANVCLMIDSMDDSSTIEETEVCLQARDSLWYLDSGCLFEL

SEQ ID NO: 166074 - protein, 82 aa, Glycine max
  Coding DNA Sequence Number=SeqID_49296
GARSPRQGHVIIALITGLCQFYGVLVTSGKGIRPPTNRAFIKKYCIPRQAQGETPQQPGDGRQRATDASPSPLEFTSAHPQK

SEQ ID NO: 166075 - protein, 111 aa, Glycine max
  Coding DNA Sequence Number=SeqID_49297
  Gene Ontology: Mol. function=DNA-directed RNA polymerase activity; Cellular component=nucleus; Biological process=transcription
  Homolog annotation: Hit_ID=Q1L5Y7; Match level="QueryCoverage=99%, HitCoverage=24%, E-value=3e-30, Identity=44%"; Hit description=RNA polymerase II largest subunit
  Pfam annotation: Domain name=RNA_pol_Rpb1_3; Domain location=5-105; Score=-14.8; E_value=0.00026; Accession=PF04983.8; Description=RNA polymerase Rpb1, domain 3
MHVPESFETRAEVLELMMDAEKSPRHFHHKDFEGKVPTPAILKSEPLWTGKQVFNLIIPKQLNLIRYFWLEEVDPDSAQKFLGHTKWLVNYWLLQNAFSIGIGDAIADAFT

SEQ ID NO: 166076 - protein, 328 aa, Glycine max
  Coding DNA Sequence Number=SeqID_49298
  Gene Ontology: Mol. function=DNA binding; Biological process =regulation of transcription
  Homolog annotation: Hit_ID=Q1SC80; Match level="QueryCoverage=86%, HitCoverage=86%, E-value=4e-47, Identity=42%"; Hit description=Myb -like DNA-binding domain, SHAQKYF class, putative
  Pfam annotation: Domain name=Myb_DNA-binding; Domain location=66-117; Score=35.5; E_value=1.8e-07; Accession=PF00249.21; Description=Myb -like DNA-binding domain
MEEERHGSSECSKTSPSNEEDCEESEGYEDESKQNNNNGGSSSNSTVEENEKKTTVRPYVRSKMPRLRWTPDLHLRFVHAVQRLGGQERATPKLVLQLMNIKGLSIAHVKSHLQEQEGRHKSRYGYGDASLAIYENMVHRPFMNRSSLDESGAEFCGSRLTERIHGTNSNINWTRNMFQVDSSSSFNEPSTSKVQEPKHKFFSFGGNESSCTQIKMSQVDLHQSTQLQPGAQELMPNNKFATNEVELKTLKRKASDIDLDLNLSLKLNSRVNAENQGSMVDHEVVDSNLSLSLCSQSSSFSSNRLKNSQDHSKEQGEIIRASALDLTI

SEQ ID NO: 166077 - protein, 85 aa, Glycine max
  Coding DNA Sequence Number=SeqID_49299
  Subcellular localization annotation: CTP_CleavageSite=79; ConfidenceScore=5.60e-01
MTPLMKKIQGLQALHGATSCTVQGSQSTCVMLYGTLRHTSTLHVSPSAGVPLLVLLTKATLSPTCKVQEPTLARSTLMSASSEFW

SEQ ID NO: 166078 - protein, 75 aa, Glycine max
  Coding DNA Sequence Number=SeqID_49300
MMIWLVLLLLKGGWPWKKASCRKVVVRGHIVDNRDIEDGGCRVQGCCMRCCGGNAWVLRARVVLRTNEGFLLGFY

SEQ ID NO: 166079 - protein, 133 aa, Glycine max
  Coding DNA Sequence Number=SeqID_49301
  Subcellular localization annotation: CTP_CleavageSite=75; ConfidenceScore=5.62e-01
MAHQHVISHFFKGSSNPRSALGSSNPRFALGESHIVKGSQNPRSALSEYRFSKGSQNPRSALGEYHFSKDSSNPRSSLGEACISKGSQNLRSSLGESLFSKDLSNPRSSLGKPHHNSTGLSNPRSTLGEPLHC

SEQ ID NO: 166080 - protein, 532 aa, Glycine max
  Coding DNA Sequence Number=SeqID_49302
VSREEAPEYQEPLDLRSNPFHGGGDDAILPLKGLVLPLTMFQCALLEHLNVALPNSTPIVGPWMGWVSLNCVSKKLFKFDSNVFLHFKDHFFKFLTSDVVAYGLPLMFNQEEEPRFMFYWQFDLTSFKSLNEDLLTLLERVDKAILEQLSTLLDVRIILSTELTLACAIVASFARIMVDFPWRSLLKQVGPDGGQPAVEVGLVTHVAETALGAPSFVLAKRNSGCPSSLRDLPPTQLNVEAHTPIVAIVSAPPPPLVVPIQEIALAAKVDAPATSTGLVMVHHHCTLAECECGNHECSQDVVSSFFSSPGSSLGCDGYKPEQKTPKFGYYGGEWTAAPGGSEQGGVLGCKVERLKVANAIVAFTKAMKLNHQLPSKVGSVLANLLHTRLDSDELFECCKDLQGEKKDLAGKMKGIVMEKDEFAKEREADKELEEELLMYKKEVMEQHEKGFNKAIRKARFFDKDLDLGLFDPFKDVQDGVLLDDKTLVMWSQDIGGLYDFHLIEGLVDQLGGNLFSLVESEPLTMVVIVPKE

SEQ ID NO: 166081 - protein, 186 aa, Glycine max
  Coding DNA Sequence Number=SeqID_49303
  Gene Ontology: Mol. function=RNA-directed DNA polymerase activity; Biological process=RNA-dependent DNA replication
MGENALAPRGRYQLEILSCNGFNKKKNQLYQRAAKCIGGDAVVSDELNHMLTASFEKDELKEALFHMNPENTSGLDGLNAAFYRRFWNLCGNEFSKLDVLDQIGEEQSTFVEGRTIMDNYKVKVNHDLIGPINPRLGLSFGAGSEAFALLQAMKMLAQLPYYMVIFETNSKQFVDHLQRAESSFNK

SEQ ID NO: 166082 - protein, 147 aa, Glycine max
  Coding DNA Sequence Number=SeqID_49304
  Gene Ontology: Mol. function=DNA binding; Cellular component=nucleus; Biological process=regulation of transcription, DNA-dependent
  Homolog annotation: Hit_ID=Q8LG33; Match level="QueryCoverage=45%, HitCoverage=26%, E-value=2e-15, Identity=59%"; Hit description=MYB -family transcription factor, putative
  Pfam annotation: Domain name=Myb_DNA-binding; Domain location=21-68; Score=35.3; E_value=2.2e-07; Accession=PF00249.21; Description=Myb -like DNA-binding domain
MAGNRENAAAGANPIRVRRTHIRWTEEEHRRFLRGIELYGASNVRDIAKNVVLTKTPAQVSSHAQKYFQRQKSGKKARPSIFDIEPVVAQPQNIHDSEPVVEQPQNIHHREPVVEQPHNAELPEQPIQQGLNQPNNIITNDFLANFK

SEQ ID NO: 166083 - protein, 97 aa, Glycine max
  Coding DNA Sequence Number=SeqID_49305
  Homolog annotation: Hit_ID=Q2QYM8; Match level="QueryCoverage=91%, HitCoverage=88%, E-value=5e-13, Identity=47%"; Hit description =Expressed protein
MCPLRFILIFLSATLAGFLVLRNLGWQPDHITDTELEDANNEDDHTTLTSDAASPSLNNATSMVQGALLSGFWNLLDMASGRYLWKQLVSSSSPKPE

SEQ ID NO: 166084 - protein, 139 aa, Glycine max
  Coding DNA Sequence Number=SeqID_49306
  Gene Ontology: Mol. function=protein serine/threonine kinase activity; Cellular component=cytoplasm; Biological process=protein amino acid phosphorylation
  Homolog annotation: Hit_ID=Q9C562; Match level="QueryCoverage=83%, HitCoverage=24%, E-value=4e-27, Identity=60%"; Hit description=SOS2 -like protein kinase PKS2
MPSISSPFLLVLIFVSSLETVFRKGNFTSRLASFIIYRLEEIVKQMKLKIKKRAAGLLKLEGIHEGRKGILSIDAEIFEVTALLHLVEMNKLNGDTLEYEKILKEIRRALKDIVWVWLVDRQEQSQQLEQQQQQQRSQS

SEQ ID NO: 166085 - protein, 71 aa, Glycine max
  Coding DNA Sequence Number=SeqID_49307
MLAYLEAINHIFVFPEELVLPFFKSWATCVYYKDMGKRWYILVLVVDKLGACGSMLQIQKLACKAWNTFLS

SEQ ID NO: 166086 - protein, 35 aa, Glycine max
  Coding DNA Sequence Number=SeqID_49308
MVRTEKSETYNSNFLMAIDNNLSYRDKLEGKGREG

SEQ ID NO: 166087 - protein, 146 aa, Glycine max
  Coding DNA Sequence Number=SeqID_49309
MGCGSNLDVNNLLSQIEELKLKVATNEERVFLYEEQIMDLKKMLVKEENQSQPNSEVVVELRKKIAKQHTKTNTEQKMVKPTSARVIFRSKLGKAIFRPTSAKTIFWPTSTQFFQQTSVNDVFWPTSAGAIFLWISSITIFAQHGS

SEQ ID NO: 166088 - protein, 100 aa, Glycine max
  Coding DNA Sequence Number=SeqID_49310
  Subcellular localization annotation: CTP_CleavageSite=61; ConfidenceScore=5.45e-01
MGPKSTLRLMRALGLSLASLTQSSWSLLSNALVGSLKLQKCCGRSLPLVSIQNVITCPLVRQVNDTHTKPYRLSEMMTMRIAKARWLAIANLNWWWLMVV

SEQ ID NO: 166089 - protein, 91 aa, Glycine max
  Coding DNA Sequence Number=SeqID_49311
MAKNLKFDDREKRLTESGVGREVQVVMGRMVGDSDHHRRHVVVSGGAAVIRRSRRFASLHEHSAGTHSDSMKRSQFSGDVVLNRWKLESQI

SEQ ID NO: 166090 - protein, 416 aa, Glycine max
  Coding DNA Sequence Number=SeqID_49312
  Gene Ontology: Cellular component=membrane
MMLFGDTHNPESTPFPNYLEINCIFLRTLNTFYCSSSMGALPTNAFLVTGLYPTLTSLQALSLNPWNIYSKIRTLHVDIMAYYQHSKSHRPGRLISWETTPTLPFVKFNTDGSSFGNLGIAGFGVKSNGEPISVKSRTFVPKAASMSASNKWRAMSHHQHQPLCTRTHQIGALLLVATTFFFTRMLSTSTLSTSVVHVSQPRFQWGQSQLSLKIYVYQEDEIDGLKELLRGRDAKITDEACLKGQWGSQVKIHKLLLQSKQRTWKKEEADLFFVPSYVKCARMMGGLNDKEINSTYVKVISQMPYFRLSGGRNHIFVFPSGAGAHLFKSWATYINRSIILTPEGDRTDKRDTSAFNTWKDIIIPGNIDDGMTKTGDTTVQPLPLSKRKYLANYLGRAQGKAGRLKLIELSKQFPEK

SEQ ID NO: 166091 - protein, 133 aa, Glycine max
  Coding DNA Sequence Number=SeqID_49313
MGPMLSPRELLGMTESASEGLLLGLRETVDKLLYGMPHLDRGDKKVLNTFVRTSNLIYMCRMIHSVLFNILMPKAFKDKFNPKVKKNPNLYGMLFTQILRLDGVEVSLMDPSSGATQLNGATFVKMGIAKNFP

SEQ ID NO: 166092 - protein, 125 aa, Glycine max
  Coding DNA Sequence Number=SeqID_49314
  Gene Ontology: Mol. function=RNA-directed DNA polymerase activity; Biological process=RNA-dependent DNA replication
  Subcellular localization annotation: CTP_CleavageSite=59; ConfidenceScore=5.78e-01
MASGKDKSKKEGSSPPKQQGSKSPSGKHVPNPSTSSTSRSSSIKCFKCLGRGGSCINVSSSRLVSILNIKTTPHPNPYCLKFPCEKGELVVGQQVLMSFTYGKYKDVMLCDVAPIEACHILLGKP

SEQ ID NO: 166093 - protein, 140 aa, Glycine max
  Coding DNA Sequence Number=SeqID_49315
  Gene Ontology: Mol. function=RNA-directed DNA polymerase activity; Cellular component=chromatin; Biological process=chromatin assembly or disassembly
MADIFDGSGAMPAAETITKVEGALCEGVEDCFQVLNVVCPRIIVDQYIVEEDCNEFAQEWSEQFVHRGLEGGRRVAEPKGHHAVLIMAGVGAKGYFGDVFFGHPDLMESLAIERAIIHAAAPATVLLLHKEHRRGIRVVT

SEQ ID NO: 166094 - protein, 337 aa, Glycine max
  Coding DNA Sequence Number=SeqID_49316
  Gene Ontology: Mol. function=ubiquitin-protein ligase activity; Cellular component=ubiquitin ligase complex; Biological process =protein ubiquitination
  Homolog annotation: Hit_ID=Q6ZC56; Match level="QueryCoverage=82%, HitCoverage=33%, E-value=1e-102, Identity=70%"; Hit description =Putative arm repeat-containing protein
  Pfam annotation: Domain name=Arm; Domain location=140-180; Score =35.2; E_value=2.3e-07; Accession=PF00514.13; Description =Armadillobeta-catenin-like repeat
  Pfam annotation: Domain name=Arm; Domain location=181-221; Score =37.7; E_value=4.1e-08; Accession=PF00514.13; Description =Armadillobeta-catenin-like repeat
  Pfam annotation: Domain name=Arm; Domain location=222-261; Score =16.6; E_value=0.093; Accession=PF00514.13; Description=Armadillobeta- catenin-like repeat
  Pfam annotation: Domain name=Arm; Domain location=262-302; Score =35.5; E_value=1.9e-07; Accession=PF00514.13; Description =Armadillobeta-catenin-like repeat
  Pfam annotation: Domain name=Arm; Domain location=99-139; Score=37.8; E_value=3.7e-08; Accession=PF00514.13; Description=Armadillobeta -catenin-like repeat
  Pfam module annotation: Pfam domain module=Arm::Arm::Arm::Arm::Arm; Domain location=140-180::181-221::222-261::262-302::99-139
  Subcellular localization annotation: CTP_CleavageSite=60; ConfidenceScore=5.14e-01
MHKHESPVGYVSDMKILFIVKGSSLISLAYGRSWSSTSSSGIWSSEWLVPRVVSNPIKTRADLSAAETQVRKLLEQLKCDSVHCKREATAELHLLAKENMDNRIVISNCGAISLIVDLLQSTDTTIQEHSVTTLLNLSINDNNKAAIANAGAIEPLIHVLQIGSPEAKENSAATLFSLSVTEENKIRIGRAGAIRPLVDLLGNGTPRGKKDAATALFNLSLFHENKDRIVQAGAVKNLVDLMDLAAGMVDKVVAVLANLATIPEGKTAIGQQGGIPVLVEVIESGSARGKENAAAALLHLCSDNHRYLTMVLQEGAVPPLVALSQSGKGQRKGLGSP

SEQ ID NO: 166095 - protein, 176 aa, Glycine max
  Coding DNA Sequence Number=SeqID_49317
  Homolog annotation: Hit_ID=Q5MP56; Match level="QueryCoverage=35%, HitCoverage=28%, E-value=5e-23, Identity=85%"; Hit description =Barren stalk1
  Pfam annotation: Domain name=HLH; Domain location=47-94; Score=30.6; E_value=5.6e-06; Accession=PF00010.16; Description=Helix-loop-helix DNA-binding domain
  Subcellular localization annotation: CTP_CleavageSite=67; ConfidenceScore=5.29e-01
MECISNPTPCEGSSSSSKHSNKSNKEKKGVRKSNKGGGGGGVRLSTDPQSVAARERRHRISDRFKILQSMVPGGSKMDTVSMLEGAIHYVKFLKTQILLHQALIDFVDVDHHESPLFLPSEYNNFPDEHSISLQQNPSSSVSVHSHHNQQSLPQLPLAQCYFQGEEDFNTFDAMPL

SEQ ID NO: 166096 - protein, 125 aa, Glycine max
  Coding DNA Sequence Number=SeqID_49318
  Subcellular localization annotation: CTP_CleavageSite=32; ConfidenceScore=5.10e-01
MVSASTTIGTWSSRTLSKTSFPKGRSFRLCLVAAIYMEWAWTNINLGAYGNEWYLRRGFLFTKGVAITNDETPVSPMEGARQDEVEAVSPMGGVRQTDVDGAVSACGNTWRRKKILSACIAKQRT

SEQ ID NO: 166097 - protein, 490 aa, Glycine max
  Coding DNA Sequence Number=SeqID_49319
  Gene Ontology: Mol. function=aminoacyl-tRNA ligase activity; Cellular component=membrane fraction; Biological process=tRNA aminoacylation for protein translation
  Homolog annotation: Hit_ID=Q9M876; Match level="QueryCoverage=87%, HitCoverage=83%, E-value=1e-174, Identity=71%"; Hit description =Putative tyrosyl-tRNA synthetase
  Pfam annotation: Domain name=S4; Domain location=423-470; Score=34.3; E_value=4.1e-07; Accession=PF01479.15; Description=S4 domain
  Pfam annotation: Domain name=tRNA-synt_1b; Domain location=84-392; Score=346.1; E_value=6e-101; Accession=PF00579.15; Description=tRNA synthetases class I (W and Y)
  Pfam module annotation: Pfam domain module=S4::tRNA-synt_1b; Domain location=423-470::84-392
  Subcellular localization annotation: CTP_CleavageSite=74; ConfidenceScore=5.85e-01
MASIYAPTRSLLFTHTTKCFFRPFKPSSSPFPLHCATKTTCSTLQQQQQQPRRNNSNNNVIGILEERGLVESITSDALRSACLTPPPLKVYCGFDPTAESLHLGNLLGLIVLSWFRRCGHRAVALIGGATARVGDPSGKSLERPELDAETLERNQMGISNTIHEILGRAQNSNLVGPDSDSSVVILNNYNWWKEFSLLDFLKRVGRFARVGSMMAKESVRKRLESEQGMSYTEFTYQLLQGYDFLHLFQNEGVSVQIGGSDQWGNITAGTELIRKILQVEGAYGLTFPLLLKSDGTKFGKSEDGAIWLSPTFLSPYKFYQYFFSVPDDDVIRFLKILTFLDIEEIVSLEGEMGKPGYVPNTAQRRLAEEVTRFVHGEDGLAEALKATEALRPGSETKLDWKTIEGIAEDVPSCSLAYDAVLNLSLVDLSVSSGLFESKSAARRLLKQGGLYLNNNRVDSESKRIEAADIVDGKVLLLSAGKKNKVLVRIA

SEQ ID NO: 166098 - protein, 127 aa, Glycine max
  Coding DNA Sequence Number=SeqID_49320
MALTISDFSSGKGGKSPCSHEFHTAATTLKLDGDASFTQQQHHGLHREAAIMRPTQIATTLMATNTNNTAINNVISHRDVKYLRRGSLFTKGVAITNGETSLTADVETMGGARQTDVDSAANACGDT

SEQ ID NO: 166099 - protein, 557 aa, Glycine max
  Coding DNA Sequence Number=SeqID_49321
  Gene Ontology: Mol. function=chromatin binding; Cellular component =chromatin; Biological process=chromatin assembly or disassembly
  Homolog annotation: Hit_ID=Q1SAV4; Match level="QueryCoverage=59%, HitCoverage=95%, E-value=6e-95, Identity=54%"; Hit description =Integrase, catalytic region
MTTAPVLTPLDFDIPFCLETDASGAAMGAVLSQCSHPIAFFSKIFCPRLQHSSTYVRELHAITAAVVQTPEQQHYLAKLLGYDYTIKYRSGASNTAANALSRIPTPGQCLVLSIPSPECLNDIKNFLSQSSVYHNLRQQIQSYPEAHPEFSLTTDWIRYRGKLWLPPNNPFIPMLLVEFHSTPLGGHMGETKTLRRLQDNFYWDNMRHDVHLHISECSVCQHIKHINRKSVGLLQPLPIPSSLWEELSLDFVTGLPLSHGYTAILVMVDRYSKDTHLGALPPKFTAHKYASSMASPVVWFSVAIPSSSVHSGANSSALVPPSSDTVPLITQEPMARPSYNTSVHSGTGLSPYEVTYGKPPPALPHYVAGTSPVEAADSMLVTRQDLHRKLQRRLLKAQTAMKSFADRHRRDVQFQVGDGVYVRLRPYRQISLRPRYSKLAKRYYGPYQVTEKIGLVAYCLKLPDGSKIHPVFHVSLLKLHHGVPPTTANTLPPEKLDNHPIVEPLSFLDWKWNTETDPPSRMDEVDFPGEGVDSSRIQDNTRPKRTIKKPAQYKDFI

SEQ ID NO: 166100 - protein, 183 aa, Glycine max
  Coding DNA Sequence Number=SeqID_49322
  Gene Ontology: Mol. function=RNA-directed DNA polymerase activity; Cellular component=chromatin; Biological process=chromatin assembly or disassembly
  Pfam annotation: Domain name=RVP_2; Domain location=1-103; Score= -52.8; E_value=0.013; Accession=PF08284.2; Description=Retroviral aspartyl protease
MSAPETFRVYGTVCGHRLTILVDGGSTHNFVQLWVAKFLGLPSTMISPLTVMVGDGGIIQCTRRYPSVSITIQGHAFNIDLFGLALSGVDIVLRVQWLRGLGPDITDYTSLSMDFTHLGLPVHLVADVPLTPPSASAQQLKRMLQTQAISVLFHIGPIRTPSYSPTLIVDDQPPPPDCRCNWL

SEQ ID NO: 166101 - protein, 494 aa, Glycine max
  Coding DNA Sequence Number=SeqID_49323
  Homolog annotation: Hit_ID=Q1T4Z3; Match level="QueryCoverage=27%, HitCoverage=53%, E-value=2e-62, Identity=73%"; Hit description =Thioredoxin domain 2
  Pfam annotation: Domain name=Thioredoxin; Domain location=332-409; Score=19.9; E_value=4e-06; Accession=PF00085.10; Description =Thioredoxin
  Pfam annotation: Domain name=Thioredoxin; Domain location=426-494; Score=55.0; E_value=2.5e-13; Accession=PF00085.10; Description =Thioredoxin
  Pfam module annotation: Pfam domain module=Thioredoxin::Thioredoxin; Domain location=332-409::426-494
MKTLFYVYKSPVEVPWEATQFGLPDVGAKFFITHADLAEIISGDKCLNISILQLWTIFMNNCGRSKVDQSLYGLLEPQSIHNAKDRREQCQEYIQTWVKESQRQLYLGAYLHQAHWQLFVLCPRENTVVRFCSLRKKPDINIKATINSAMKTITSSFQGMSNQAAPWWVEPKSHVQTGAYECGYYVMHWMWCIMTGGLKDDWNKWFSDGSPLDVEAITTLRQKWATFFLTNNVDLDGLVVIGGDDLNTNVCLLAENFRFICHSQWTSFALLAFTVPLKSLLFLLFLHLFKFSGYGNVGFSTGYSCARQLKIDATCKDSWVGFSGRWSSKGKFILILVMFFGRLKKFNMKGGKAWKLSWPVDCDEHKSLCSKYGVSGYPTIQWFPKGSLEPKKYEGPRTADSLAEFVNTEGDLLAGTNVKIATAPSNVVVLTSKNFNEVVLDETKDVLVEFYAPWCGHCKSLAPTYEKVATTFKLEEDVVIANLDADKYKDLAEK

SEQ ID NO: 166102 - protein, 315 aa, Glycine max
  Coding DNA Sequence Number=SeqID_49324
YIDGIGCGKQGNAVSNLSWRWKGSGFWKRVWYLVSRASMARKGALDLGHRNWSRPNINISMEFNMVRSVAGHMWVQSRIDPLQTKTHNGEVMAVAKEMKGIGGEGGKQGFGEGSEGLLSAIKRRMCPLQRWVQEKVRVMEMKMGKFEADGNGHVEDEVADKAIWWKPDDTVHQTFKLGQIVIDQPGEKLEPRACKNLDQEVMNPLRNIHWYQLKAGSSRSTLDGARTGSGRRGVKGKMIEAVEDGIDFIHKVGVFVSEGGLVDRKMGNSLLEAIGSGFARGVFGHGRQSVLEEVQHSEVLHLCKPRQRLESVVRK

SEQ ID NO: 166103 - protein, 121 aa, Glycine max
  Coding DNA Sequence Number=SeqID_49325
MGRDASKFIHISPKDSEYVIYGDNKQRPLNQQAQQVISNDTNRKCLLTMRQLCGINDFQDYFDDAKESRVKQVLKNQESKSFKNQVSQNQDSRTIKFQDSIKFQESRFKNNQDQDSRLKIQ

SEQ ID NO: 166104 - protein, 195 aa, Glycine max
  Coding DNA Sequence Number=SeqID_49326
  Gene Ontology: Mol. function=DNA binding; Cellular component =chromatin; Biological process=DNA integration
MVQWPNPKTPKDLCAFLGLTDFYRKFIKGYAAIANPLTSLLCKDAFTWTSATQTAFHNLKEAMTRAPILALPDFSLPFMVETDTSGMAIGVVLFKQGHPLAFFSKPFGPRYDYSIQYKTGASNIVDDALSCIVSPTNGQRLILSMPNFMFLDYLRRPFTLAQLSGLSWLTYKNNLQLIQIFKSPMSYYSFKGAFG

SEQ ID NO: 166105 - protein, 259 aa, Glycine max
  Coding DNA Sequence Number=SeqID_49327
MYLMNRFATLRDKLKNYIGEVMPKPLKRHVVAAIQFKKFKVVDYMDKYYSRDTYGVCYGHKGPGRPKKLRRIEPDEDPNRTRLRRDTTSYKCSRSGATSHNTMRCTLQPPIVPEEVNEEVSGAVEVNLVEGGNEGTTKGAFAGVQTGLVNLIEGGNEGAIDPIQHQRNVNQQIKSTNINNKGPGGKNRSVNETLKKIAPKHKAPTTNITNLSKNKMKGCNLPTVEKKVKKEIGLAATHAKANTSINKAKGPVEDTNRQK

SEQ ID NO: 166106 - protein, 103 aa, Glycine max
  Coding DNA Sequence Number=SeqID_49328
TSVSTLIAHIKSAKGYTTTYHKAWLAKQKVIDNIYDNWEKIVPQFTEIVVSYATISSWYGHGEGNTTNATHKEGTLLMAITLDDNNKILPIAFAVLKSETAGA

SEQ ID NO: 166107 - protein, 184 aa, Glycine max
  Coding DNA Sequence Number=SeqID_49329
MELLRMFTSMLWKLDWKLGRRPNKDSTNWLLLSRSQPQTELELVLVLDENVKLFHGVKGYKLSKGKTSNQAWREKIDIDTQRLDLEMHKIELQKLNLIKLGKEVDKPILIPKATCYKGKEKLLEDDKDTPPMELTSGDWQALQRYHRLGAHYYGLEPKEMPPSNGLHHKTRHCYQTINHNPFCG

SEQ ID NO: 166108 - protein, 377 aa, Glycine max
  Coding DNA Sequence Number=SeqID_49330
  Gene Ontology: Mol. function=signal recognition particle binding; Cellular component=signal recognition particle, endoplasmic reticulum targeting; Biological process=SRP-dependent cotranslational protein targeting to membrane
  Homolog annotation: Hit_ID=Q9M0A0; Match level="QueryCoverage=77%, HitCoverage=48%, E-value=6e-90, Identity=60%"; Hit description =Signal recognition particle receptor-like protein
  Pfam annotation: Domain name=SRP-alpha_N; Domain location=110-377; Score=226.3; E_value=7e-65; Accession=PF04086.4; Description=Signal recognition particle, alpha subunit, N-terminal
MKGSNIGLGRILLVEENMCDQSASHLYLSLSHNPLIAIMDNDIFANNSCCVELVNMWMEKGLGHDLQGIARELVGRRGKNWKFSRMLEQLLIFTRGGLILWTCKELGNALKGSPIDTLIRSCLLEERSGAAAYNYDAPGASYTLKWTFHNDLGLVFVAVYQRILHLLYVEDLLAMVKREFSQVYDPKTTAYPDFDETFRQLKMEALARTEDLKRSNSNPVAGNAKKQVQGNDKSGFEGGNKKKKSGGGADGDDGKRKLENGHSNGNFLVAKDTNLSRDVNGRHNGSPNVGAFDVHKLQKLRTKGGKKTDTVVAKASKAEPNKKVTKKNRVWDEAATTETKLDFTDHSGEDGERNIDFVVAADQGESMMDKEEIVSSE

SEQ ID NO: 166109 - protein, 650 aa, Glycine max
  Coding DNA Sequence Number=SeqID_49331
  Gene Ontology: Mol. function=protein binding; Cellular component =integral to membrane; Biological process=defense response to fungus
  Homolog annotation: Hit_ID=Q1T2W9; Match level="QueryCoverage=84%, HitCoverage=86%, E-value=1e-141, Identity=32%"; Hit description =Leucine-rich repeat; Leucine-rich repeat, cysteine-containing type
  Pfam annotation: Domain name=LRR_1; Domain location=122-143; Score =8.1; E_value=8.6; Accession=PF00560.23; Description=Leucine Rich Repeat
  Pfam annotation: Domain name=LRR_1; Domain location=146-165; Score =7.5; E_value=11; Accession=PF00560.23; Description=Leucine Rich Repeat
  Pfam annotation: Domain name=LRR_1; Domain location=167-189; Score =6.1; E_value=21; Accession=PF00560.23; Description=Leucine Rich Repeat
  Pfam annotation: Domain name=LRR_1; Domain location=192-214; Score =9.8; E_value=4.2; Accession=PF00560.23; Description=Leucine Rich Repeat
  Pfam annotation: Domain name=LRR_1; Domain location=216-235; Score =8.3; E_value=7.9; Accession=PF00560.23; Description=Leucine Rich Repeat
  Pfam annotation: Domain name=LRR_1; Domain location=22-45; Score =10.6; E_value=3; Accession=PF00560.23; Description=Leucine Rich Repeat
  Pfam annotation: Domain name=LRR_1; Domain location=240-262; Score =11.1; E_value=2.3; Accession=PF00560.23; Description=Leucine Rich Repeat
  Pfam annotation: Domain name=LRR_1; Domain location=264-286; Score =12.5; E_value=1.3; Accession=PF00560.23; Description=Leucine Rich Repeat
  Pfam annotation: Domain name=LRR_1; Domain location=288-309; Score =9.5; E_value=4.7; Accession=PF00560.23; Description=Leucine Rich Repeat
  Pfam annotation: Domain name=LRR_1; Domain location=312-333; Score =0.3; E_value=2.5e+02; Accession=PF00560.23; Description=Leucine Rich Repeat
  Pfam annotation: Domain name=LRR_1; Domain location=338-361; Score =5.5; E_value=26; Accession=PF00560.23; Description=Leucine Rich Repeat
  Pfam annotation: Domain name=LRR_1; Domain location=411-433; Score =7.0; E_value=14; Accession=PF00560.23; Description=Leucine Rich Repeat
  Pfam annotation: Domain name=LRR_1; Domain location=435-457; Score =14.2; E_value=0.47; Accession=PF00560.23; Description=Leucine Rich Repeat
  Pfam annotation: Domain name=LRR_1; Domain location=459-481; Score =15.0; E_value=0.27; Accession=PF00560.23; Description=Leucine Rich Repeat
  Pfam annotation: Domain name=LRR_1; Domain location=47-72; Score=7.9; E_value=9.6; Accession=PF00560.23; Description=Leucine Rich Repeat
  Pfam annotation: Domain name=LRR_1; Domain location=483-504; Score =10.9; E_value=2.5; Accession=PF00560.23; Description=Leucine Rich Repeat
  Pfam annotation: Domain name=LRR_1; Domain location=75-95; Score=5.4; E_value=28; Accession=PF00560.23; Description=Leucine Rich Repeat
  Pfam annotation: Domain name=LRR_1; Domain location=98-120; Score =16.4; E_value=0.1; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1; Domain location=122-143::146 -165::167-189::192-214:...
  Pfam module annotation: Domain location=:216-235::22-45::240-262::264- 286::288-309::312-333::338-361::411-433::435-457::459-481::47-72::483- 504::75-95::98-120
VLDLSGNDLNGSIPTDIFQLRSLSVLELSSNKLNGTLKLDVIHRLENLTTLGLSHNHLSIDTNFADVGLISSIPNMKIVELASCNLTEFPSFLRNQSKITTLDLSSNNIQGSIPTWIWQLNSLVQLNLSHNLLSNLEGPVQNSSSNLSLLDLHDNHLQGKLQIFPVHATYLDYSSNNFSFTIPSDIGNFLSSTIFLSLSKNNLSGNIPQSLCNSSNMLVLDFSYNHLNGKIPECLTQSEKLVVLNMQHNKFHGSIPDKFPVSCVLRTLDLNSNLLWGSIPKSLANCTSLEVLDLGNNQVDDGFPCFLKTISTLRVMVLRGNKFHGHIGCPHANSTWHVLQIVDLALNNFSGVLPKNCFKTWKAMMLDEDDDGSKFNHIASPVLKFGGIYYQDSVTLTSKGLQMEFVKILTVFTSVDFSSNNFEGTIPEELMNFTRLNLLNLSDNALAGHIPSSIGNLKQLESLDLSRNHFDGEIPTQLANLNFLSYLDLSSNRLVGKIPVGNQLQTFDASSFVGNAELCGAPLTKKCSDTKNAKEIPKTVSGVKFDWTYVSIGVGFGVGAGLVVAPALFLERLKKWSNHKIDKILLVILPMFGLTWIPTDDDEAEEDTEENNSDMEEESDYNEDQNSLVHQRFQGWYCVLCSKLDISKKK

SEQ ID NO: 166110 - protein, 2104 aa, Glycine max
  Coding DNA Sequence Number=SeqID_49332
  Gene Ontology: Mol. function=protein kinase activity; Cellular component=chromatin; Biological process=protein amino acid phosphorylation
  Homolog annotation: Hit_ID=Q1T2W9; Match level="QueryCoverage=48%, HitCoverage=98%, E-value=0.0, Identity=49%"; Hit description=Leucine- rich repeat; Leucine-rich repeat, cysteine-containing type
  Pfam annotation: Domain name=Chromo; Domain location=1998-2049; Score= 22.9; E_value=0.0012; Accession=PF00385.14; Description='chromo' (CHRromatin Organisation MOdifier
  Pfam annotation: Domain name=LRRNT_2; Domain location=21-63; Score =40.2; E_value=7.1e-09; Accession=PF08263.3; Description=Leucine rich repeat N-terminal domain
  Pfam annotation: Domain name=LRR_1; Domain location=117-139; Score =12.4; E_value=1.4; Accession=PF00560.23; Description=Leucine Rich Repeat
  Pfam annotation: Domain name=LRR_1; Domain location=201-223; Score =16.1; E_value=0.13; Accession=PF00560.23; Description=Leucine Rich Repeat
  Pfam annotation: Domain name=LRR_1; Domain location=225-247; Score =10.4; E_value=3.3; Accession=PF00560.23; Description=Leucine Rich Repeat
  Pfam annotation: Domain name=LRR_1; Domain location=249-272; Score =15.8; E_value=0.16; Accession=PF00560.23; Description=Leucine Rich Repeat
  Pfam annotation: Domain name=LRR_1; Domain location=292-314; Score =13.3; E_value=0.89; Accession=PF00560.23; Description=Leucine Rich Repeat
  Pfam annotation: Domain name=LRR_1; Domain location=316-337; Score =13.6; E_value=0.72; Accession=PF00560.23; Description=Leucine Rich Repeat
  Pfam annotation: Domain name=LRR_1; Domain location=339-362; Score =16.5; E_value=0.097; Accession=PF00560.23; Description=Leucine Rich Repeat
  Pfam annotation: Domain name=LRR_1; Domain location=364-386; Score =8.3; E_value=8; Accession=PF00560.23; Description=Leucine Rich Repeat
  Pfam annotation: Domain name=LRR_1; Domain location=388-409; Score =8.5; E_value=7.4; Accession=PF00560.23; Description=Leucine Rich Repeat
  Pfam annotation: Domain name=LRR_1; Domain location=413-435; Score =13.2; E_value=0.93; Accession=PF00560.23; Description=Leucine Rich Repeat
  Pfam annotation: Domain name=LRR_1; Domain location=437-460; Score =10.1; E_value=3.6; Accession=PF00560.23; Description=Leucine Rich Repeat
  Pfam annotation: Domain name=LRR_1; Domain location=462-487; Score =6.2; E_value=20; Accession=PF00560.23; Description=Leucine Rich Repeat
  Pfam annotation: Domain name=LRR_1; Domain location=490-510; Score =2.9; E_value=81; Accession=PF00560.23; Description=Leucine Rich Repeat
  Pfam annotation: Domain name=LRR_1; Domain location=513-535; Score =16.4; E_value=0.1; Accession=PF00560.23; Description=Leucine Rich Repeat
  Pfam annotation: Domain name=LRR_1; Domain location=537-558; Score =8.1; E_value=8.6; Accession=PF00560.23; Description=Leucine Rich Repeat
  Pfam annotation: Domain name=LRR_1; Domain location=561-580; Score =9.3; E_value=5.2; Accession=PF00560.23; Description=Leucine Rich Repeat
  Pfam annotation: Domain name=LRR_1; Domain location=582-604; Score =6.1; E_value=21; Accession=PF00560.23; Description=Leucine Rich Repeat
  Pfam annotation: Domain name=LRR_1; Domain location=607-629; Score =8.7; E_value=6.8; Accession=PF00560.23; Description=Leucine Rich Repeat
  Pfam annotation: Domain name=LRR_1; Domain location=631-650; Score =8.3; E_value=7.9; Accession=PF00560.23; Description=Leucine Rich Repeat
  Pfam annotation: Domain name=LRR_1; Domain location=655-677; Score =12.6; E_value=1.2; Accession=PF00560.23; Description=Leucine Rich Repeat
  Pfam annotation: Domain name=LRR_1; Domain location=679-701; Score =10.7; E_value=2.8; Accession=PF00560.23; Description=Leucine Rich Repeat
  Pfam annotation: Domain name=LRR_1; Domain location=703-724; Score =9.5; E_value=4.7; Accession=PF00560.23; Description=Leucine Rich Repeat
  Pfam annotation: Domain name=LRR_1; Domain location=727-748; Score =0.3; E_value=2.5e+02; Accession=PF00560.23; Description=Leucine Rich Repeat
  Pfam annotation: Domain name=LRR_1; Domain location=753-776; Score =7.4; E_value=12; Accession=PF00560.23; Description=Leucine Rich Repeat
  Pfam annotation: Domain name=LRR_1; Domain location=826-848; Score =10.5; E_value=3.1; Accession=PF00560.23; Description=Leucine Rich Repeat
  Pfam annotation: Domain name=LRR_1; Domain location=850-872; Score =15.1; E_value=0.26; Accession=PF00560.23; Description=Leucine Rich Repeat
  Pfam annotation: Domain name=LRR_1; Domain location=874-896; Score =14.9; E_value=0.29; Accession=PF00560.23; Description=Leucine Rich Repeat
  Pfam annotation: Domain name=LRR_1; Domain location=898-919; Score =6.5; E_value=17; Accession=PF00560.23; Description=Leucine Rich Repeat
  Pfam annotation: Domain name=LRR_1; Domain location=93-115; Score =16.4; E_value=0.1; Accession=PF00560.23; Description=Leucine Rich Repeat
  Pfam annotation: Domain name=RVP_2; Domain location=1376-1509; Score=- 39.6; E_value=0.0012; Accession=PF08284.2; Description=Retroviral aspartyl protease
  Pfam annotation: Domain name=rve; Domain location=1678-1851; Score =74.3; E_value=3.9e-19; Accession=PF00665.16; Description=Integrase core domain
  Pfam module annotation: Pfam domain module=Chromo::LRRNT_2::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1:...
  Pfam module annotation: Pfam domain module=:LRR_1::LRR_1::LRR_1::LRR _1::LRR_1::LRR_1::RVP_2::RVT_1::Retrotrans_gag::rve; Domain location =1998-2049::21-63::117-139::201-223::225-247::249-272::292-314::316 -337::339-362::...
  Pfam module annotation: Domain location=364-386::388-409::413 -435::437-460::462-487::490-510::513-535::537-558::561-580::582 -604::607-629::631-650::655-677::679-701::703-724::727-748::753 -776::826-848::850-872::874-896::...
  Pfam module annotation: Domain location=898-919::93-115::1376 -1509::1645-1831::1146-1236::1678-1851
MAALFFFLFCVYYTGVKAQIVEDQQQSLLKLKNSLKFETNKSTKLVSWNPSVDFCEWRGVACDEDGQVTGLDLSGESIYGGFDNSSTLFSLQNLQILNLSANNFSSEIPSGFNKLKNLTYLNLSHAGFVGQIPTEISYLTRLVTLDISSVSYLYGQPLKLENIDLQMLVHNLTMLRQLYMDGVIVTTQGYKWSNALFKLVNLQELSMSDCNLSGPLDPSLTRLQNLSVIRLHQNNFSSPVPETFANFPNLTTLDLSSCELTGTFQEKIFQTLIVSGTNFSGAIPPAINNLGQLSILDLSDCHFNGTLPSSMSRLRELTYLDLSFNDFTGPIPSLNMSKNLTHLDFSSNGFTGSITSYHFDGLRNLLQIDLQDNFLDGSLPSSLFSLPLLRSIRLSNNNFQDQLNKFSNISSSKFEILDLSGNDLNGSIPTDIFQLRSLIVLELSSNKLNGTLKLDVIHRLANLITLGLSHNHLSIDTNFADVGLISSIPNMYIVELASCNLTEFPSFLRNQSKITTLDLSSNNIQGSIPTWIWQLNSLVQLNLSHNLLSNLEGPVQNSSSNLRLLDLHDNHLQGKLQIFPVHATYLDYSSNNFSFTIPSDIGNFLSDTIFLSLSKNNLSGNIPQSLCNSSNMLVLDFSYNHLNGKIPECLTQSERLVVLNLQHNKFHGSIPDKFPVSCVLSSLDLNSNLLWGSIPKSLANCTSLEVLDLGNNQVDDGFPCFLKTISTLRVMVLRGNKFHGHIGCPHANSTWHVLQIVDLAFNNFSGVLPKNCFKTWKAMMLDEDDDGSQFNYIGSQVLKFGGIYYQDSVTLTSKGLRMEFVKILTVLTSVDFSSNNFEGTIPEELMNFTRLHLLNLSDNALAGHIPSSIGNLKQLESLDLSSNHFDGEIPTQLANLNFLSYLNVSSNCLAGKIPGGNQLQTFDASSFVGNAELCGAPLIKNCSNETYGLPTSPHARRCTFGWNIMRVELGFVFGLALVIGPLLFWKQWRQWYWKRVDLILCRVFPQLNLEYESSGGHCYQVLSPTVNDASGPTGNTENVVIGPDMRPARATPTPSMTTPRHTAPPPPSNEELARQLATISTRLEAVWKRLDDPNASSSTRSTAESTYRPRLKLDVPRFSGDDAPGWIFKISQFFTYHQTPEEERITIASFYLDGAALAWYQWMYRNRQIVSWNQFLTALETRFAPTAFDDPRGKLFKLTQSSTVTAYLTEFEALANRLEGLSEVDLLSCFVSGLRMDIRREVLTQRPITISQATGLARLQEDKLQDITRMSRSKVWHSSSTPTKELIKGGSDSTPPSTNTAGLLPTPAAKPRFRHLSSAEMDERREKGLCFNCDQRWSRQHKCGARIFLMVATSDDDDPLISELEQAVDLLDPGDSEIQAAQLSLHALSGSHAADTFRVVGMIGSHSVHVLVDGGSTHNFIQNSLALTLGLNRSDIPFFRVLVGSGQELLCDKVCHDVTMLIQNNSFQLDLYSLDLRGADIILGAQWLKQLGPVLMNYTTLTMTFFHNNSCVVLQGASPTPSVSLHCFQKMARLEPEAHLYSLQILDQTPSYPDTDHHPPKPSLIIPETIPIDPQIQTLIDRYQHIFTEPTSLPPSRPTDHTIPLLPNTAPVSVRPYRYPHSQKLEIETQVAKFLSSGWIQPSTSPFSSPVLLLKKKDGSWRMCVDYRALNALTVRDRFPLPTIDELLDELGHARIFSKLDLTSGFHQIRVAPQDVHKTAFRTHDGHYEYVHLGALPSNYTAFKVAELFVNLVCKHHGLPKSIISDRDPIFISKFWTELFKFSGTLLRMSSSYHPQTDGQTEVTNRTIEQYLRAFVHHKPSLWHKYLPWAEYHYNTAFHSSAGMTPFQVVFGKPPPSLPIYVAGASSVAATDALLNDREAVLELLRVNLAKAQTRMKAIADGKRRDVSYEVGSWVHVKLQPYRQSSVSGGKYNKLNKRYYGPYRVLERLGPVAYKLELPSNAKIHNVFHCSLLKPYVGSIPPTVTELPENFVDNHPIITPLALLASRIVTNDAGNKVSQVLVQWDGLHPDDTSWENWSEIQVVYNLEDKVGFDGDGIDTIDTSPTVNDASGPTGNTENVVIGPDMRPARATRLPTKFRDHILFK

SEQ ID NO: 166111 - protein, 302 aa, Glycine max
  Coding DNA Sequence Number=SeqID_49333
  Gene Ontology: Mol. function=protein binding; Cellular component =integral to membrane; Biological process=protein amino acid phosphorylation
  Homolog annotation: Hit_ID=Q1T2W9; Match level="QueryCoverage=99%, HitCoverage=70%, E-value=1e-82, Identity=35%"; Hit description =Leucine-rich repeat; Leucine-rich repeat, cysteine-containing type
  Pfam annotation: Domain name=LRRNT_2; Domain location=21-63; Score =37.8; E_value=3.6e-08; Accession=PF08263.3; Description=Leucine rich repeat N-terminal domain
  Pfam annotation: Domain name=LRR_1; Domain location=117-139; Score =12.4; E_value=1.4; Accession=PF00560.23; Description=Leucine Rich Repeat
  Pfam annotation: Domain name=LRR_1; Domain location=201-223; Score =16.6; E_value=0.089; Accession=PF00560.23; Description=Leucine Rich Repeat
  Pfam annotation: Domain name=LRR_1; Domain location=225-247; Score =5.7; E_value=25; Accession=PF00560.23; Description=Leucine Rich Repeat
  Pfam annotation: Domain name=LRR_1; Domain location=249-272; Score =13.5; E_value=0.78; Accession=PF00560.23; Description=Leucine Rich Repeat
  Pfam annotation: Domain name=LRR_1; Domain location=273-295; Score =6.8; E_value=15; Accession=PF00560.23; Description=Leucine Rich Repeat
  Pfam annotation: Domain name=LRR_1; Domain location=93-115; Score =16.4; E_value=0.1; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1; Domain location=21-63::117-139::201-223::225 -247::249-272::273-295::93-115
MAALFFFLFCVYYTGVKAQIVEDQQQSLLKLKNSLKFKTNKSTKLVSWNSSIDFCEWRGVACDEDGQVTGLDLSGESIYGGFDNSSTLFSLQNLQILNLSANNFSSEIPSGFNKLKNLTYLNLSHAGFVGQIPTEISYLARLVTLDISSVSYLYGQPLKLENIDLQMLVHNLTMLRQLYMDGVIVTTLGNKWSNALFKLVNLQELSMSNCNLSGPLDPSLTRLQYLSIIRLDLNNFSSPVPETFANFTNLTTLHLSSCELTGTFPEKIFQVATLSVVDLSFNYHLYGSLPEFPLNSPLQTLI

SEQ ID NO: 166112 - protein, 125 aa, Glycine max
  Coding DNA Sequence Number=SeqID_49334
  Subcellular localization annotation: CTP_CleavageSite=74; ConfidenceScore=5.43e-01
MYPPLFSLNNLVDVPSTRTDPQEMYPLLFSVTTTQVDVPSTCTTKNVPSNVLRQSSQAVSPLKLCEGRNKRILRREKGMKKMNSTSFVFKVWKTRKLKKAFAKEEEEEEVQRDSRVVKDCNDCSE

SEQ ID NO: 166113 - protein, 1138 aa, Glycine max
  Coding DNA Sequence Number=SeqID_49335
  Gene Ontology: Mol. function=protein binding; Cellular component =integral to membrane; Biological process=defense response to fungus
  Homolog annotation: Hit_ID=Q1T2W9; Match level="QueryCoverage=92%, HitCoverage=99%, E-value=0.0, Identity=50%"; Hit description=Leucine- rich repeat; Leucine-rich repeat, cysteine-containing type
  Pfam annotation: Domain name=LRRNT_2; Domain location=80-122; Score =37.9; E_value=3.5e-08; Accession=PF08263.3; Description=Leucine rich repeat N-terminal domain
  Pfam annotation: Domain name=LRR_1; Domain location=152-174; Score =19.0; E_value=0.018; Accession=PF00560.23; Description=Leucine Rich Repeat
  Pfam annotation: Domain name=LRR_1; Domain location=176-198; Score =12.4; E_value=1.4; Accession=PF00560.23; Description=Leucine Rich Repeat
  Pfam annotation: Domain name=LRR_1; Domain location=260-282; Score =16.6; E_value=0.089; Accession=PF00560.23; Description=Leucine Rich Repeat
  Pfam annotation: Domain name=LRR_1; Domain location=284-306; Score =10.7; E_value=2.8; Accession=PF00560.23; Description=Leucine Rich Repeat
  Pfam annotation: Domain name=LRR_1; Domain location=308-331; Score =13.5; E_value=0.78; Accession=PF00560.23; Description=Leucine Rich Repeat
  Pfam annotation: Domain name=LRR_1; Domain location=332-354; Score =2.7; E_value=91; Accession=PF00560.23; Description=Leucine Rich Repeat
  Pfam annotation: Domain name=LRR_1; Domain location=356-378; Score =10.3; E_value=3.4; Accession=PF00560.23; Description=Leucine Rich Repeat
  Pfam annotation: Domain name=LRR_1; Domain location=380-402; Score =13.8; E_value=0.63; Accession=PF00560.23; Description=Leucine Rich Repeat
  Pfam annotation: Domain name=LRR_1; Domain location=404-425; Score =11.5; E_value=2; Accession=PF00560.23; Description=Leucine Rich Repeat
  Pfam annotation: Domain name=LRR_1; Domain location=427-450; Score =10.5; E_value=3.1; Accession=PF00560.23; Description=Leucine Rich Repeat
  Pfam annotation: Domain name=LRR_1; Domain location=452-474; Score =8.3; E_value=8; Accession=PF00560.23; Description=Leucine Rich Repeat
  Pfam annotation: Domain name=LRR_1; Domain location=476-497; Score =8.5; E_value=7.4; Accession=PF00560.23; Description=Leucine Rich Repeat
  Pfam annotation: Domain name=LRR_1; Domain location=501-523; Score =16.7; E_value=0.085; Accession=PF00560.23; Description=Leucine Rich Repeat
  Pfam annotation: Domain name=LRR_1; Domain location=525-548; Score =9.1; E_value=5.6; Accession=PF00560.23; Description=Leucine Rich Repeat
  Pfam annotation: Domain name=LRR_1; Domain location=550-575; Score =6.6; E_value=17; Accession=PF00560.23; Description=Leucine Rich Repeat
  Pfam annotation: Domain name=LRR_1; Domain location=578-598; Score =5.4; E_value=28; Accession=PF00560.23; Description=Leucine Rich Repeat
  Pfam annotation: Domain name=LRR_1; Domain location=601-623; Score =16.4; E_value=0.1; Accession=PF00560.23; Description=Leucine Rich Repeat
  Pfam annotation: Domain name=LRR_1; Domain location=625-646; Score =8.0; E_value=9; Accession=PF00560.23; Description=Leucine Rich Repeat
  Pfam annotation: Domain name=LRR_1; Domain location=649-668; Score =9.3; E_value=5.2; Accession=PF00560.23; Description=Leucine Rich Repeat
  Pfam annotation: Domain name=LRR_1; Domain location=670-692; Score =4.9; E_value=35; Accession=PF00560.23; Description=Leucine Rich Repeat
  Pfam annotation: Domain name=LRR_1; Domain location=695-717; Score =8.6; E_value=7.1; Accession=PF00560.23; Description=Leucine Rich Repeat
  Pfam annotation: Domain name=LRR_1; Domain location=719-738; Score =7.5; E_value=11; Accession=PF00560.23; Description=Leucine Rich Repeat
  Pfam annotation: Domain name=LRR_1; Domain location=743-765; Score =12.8; E_value=1.2; Accession=PF00560.23; Description=Leucine Rich Repeat
  Pfam annotation: Domain name=LRR_1; Domain location=767-789; Score =12.5; E_value=1.3; Accession=PF00560.23; Description=Leucine Rich Repeat
  Pfam annotation: Domain name=LRR_1; Domain location=791-812; Score =9.5; E_value=4.7; Accession=PF00560.23; Description=Leucine Rich Repeat
  Pfam annotation: Domain name=LRR_1; Domain location=841-864; Score =7.7; E_value=10; Accession=PF00560.23; Description=Leucine Rich Repeat
  Pfam annotation: Domain name=LRR_1; Domain location=914-936; Score =9.6; E_value=4.6; Accession=PF00560.23; Description=Leucine Rich Repeat
  Pfam annotation: Domain name=LRR_1; Domain location=938-960; Score =14.7; E_value=0.34; Accession=PF00560.23; Description=Leucine Rich Repeat
  Pfam annotation: Domain name=LRR_1; Domain location=962-984; Score =13.2; E_value=0.98; Accession=PF00560.23; Description=Leucine Rich Repeat
  Pfam annotation: Domain name=LRR_1; Domain location=986-1008; Score =12.0; E_value=1.6; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1; Domain location=80-122::152-174::176-198::260 -282::284-306::308-331::332-354::356-378::380-402::404-425::427 -450::452-474::476-497::...
  Pfam module annotation: Domain location=501-523::525-548::550 -575::578-598::601-623::625-646::649-668::670-692::695-717::719 -738::743-765::767-789::791-812::841-864::914-936::938-960::962 -984::986-1008
  Subcellular localization annotation: CTP_CleavageSite=36; ConfidenceScore=5.10e-01
MAHDKDVVYFDLASPSYTPSEAKSFPFTFSLHIFLPSNSNMHPCTTPMRIPHVSLLSFIFCYCFWIHHSVYYTGVSAQIVEDQQQSLLKLKNSLKFKTNKSTKLVSWNPTVDFCEWRGVACDEERQVTGLDLSGESIYGEFDNSSTLFTLQNLQILNLSDNNFSSEIPSGFNKLKNLTYLNLSHAGFVGQIPTEISYLARLVTLDISSVSYLYGQPLKLENIDLQMLVQNLTMLRQLYMDGVIVTTQGNKWSNALFKLVNLQELSMSNCNLSGPLDPSLTRLQNLSVIRLDQNNFSSPVPETFANFTNLTTLHLSSCELTGTFPEKIFQVATLSVVDLSFNYNLYGSLLEFPLNSPLQTLIVSGTSFSGGIPPSINNLGQLSILDLSNCHFNGTLPSSMSRLRELTYLDLSLNDFTGQIPSLNMSKNLTHLHFWKNGFTGSITSYHFGGLRNLLQIDLQDNFLDGSLPSSLFSLPLLRSIRLSNNNFQDQLNKFSNISSSKLEILDLSGNDLNGSIPTDIFQLRSLCVLELSSNKLNGRLKLDVIHRLVNLSTLGLSHNHLSIDTNFADVGLISSIPNMKIVELASCNLTEFPSFLRNQSKITTLDLSSNNIQGSIPTWIWQLNSLVQLNLSHNLLSNLEGPVQNPSSNLRLLDLHDNHLQGKLQIFPVHASYLDYSSNNFSFTIPSDIGNFLSSTIFLSLSKNNLSGNIPQSLCSSSSMLVLDFSYNHLNGKIPECLTQSERLVVLDLQHNKFYGSIPDKFPVSCVLRTLDLNSNLLWGSIPKSLANCTSLEVLDLGNNQVDDGFPCFLKTISTLRVMVLRGNKFHGHVGCPYSNSTWYMLQIVDLSVNNFSGVLPKNCFKTWKAMMLDEDDDGSKFNHIASQVLKFGGIYYQGSVTLTSKGLQMEFVNILTGFTSVDFSSNNFEGTIPEELMNFTRLNLLDLSDNALAGQIPSSIGNLKQLEALDLSSNHFDGEIPTQLANLNFLSYLDLSSNRLVGKIPVGIQLQTFDASSFVGNAELCGAPLPKNCSNETYGLPCTFGWNIIMVELGFVFGLALVIDPLLFWKQWRQWYWKRVDLILCRIFPQLNLEYESSGGHCYQVLSFSAHTTEDDIASESDTTEGGKEILAISLVEGMFA

SEQ ID NO: 166114 - protein, 167 aa, Glycine max
  Coding DNA Sequence Number=SeqID_49336
  Gene Ontology: Mol. function=nucleic acid binding; Cellular component= endoplasmic reticulum membrane; Biological process=DNA integration
MVKSMGVQFHEINRVIAPLVVVQNNNEEEQHNNESTIHNESIVEESQEVTLRRFQRERRPTISNDYVIYLCETETGLSINDNYPVSFSQAVSCDNFEKLLNAMKEEINSMKYNYVWDLVELPKGCKWVFKTKRDFHDNLERYETRLVAKGFTQKDDIDYKETFSPIS

SEQ ID NO: 166115 - protein, 1115 aa, Glycine max
  Coding DNA Sequence Number=SeqID_49337
  Gene Ontology: Mol. function=RNA-directed DNA polymerase activity; Cellular component=chromatin; Biological process=chromatin assembly or disassembly
  Pfam annotation: Domain name=Chromo; Domain location=1007-1055; Score= 35.8; E_value=1.5e-07; Accession=PF00385.14; Description='chromo' (CHRromatin Organisation MOdifier
  Pfam annotation: Domain name=RnaseH; Domain location=449-567; Score= -24.2; E_value=0.01; Accession=PF00075.14; Description=RNase H
  Pfam annotation: Domain name=rve; Domain location=702-858; Score =105.6; E_value=1.4e-28; Accession=PF00665.16; Description=Integrase core domain
  Pfam annotation: Domain name=zf-H2C2; Domain location=643-684; Score =27.4; E_value=5e-05; Accession=PF09337.1; Description=His(2)-Cys(2) zinc finger
  Pfam module annotation: Pfam domain module=Chromo::RVT_1::RnaseH::rve: :zf-H2C2; Domain location=1007-1055::188-357::449-567::702-858::643 -684
MVGNGNQLECNTICEEIPVTIQAHNFHVDLYVLPISSANVVLGVQWLKSLGPVLTDYNTLLMKFFHNGGLITLQGDMDASLTSLSSFRRLSRKPDNAMYYHITLLPDLNSTTHPLPQPVQTLLDKFDSLFQPPQSLPPPRHTDHHIHLLPHAAPVNVRPYRYPHYQKREIEEQVDSMLQRGLIQPSTSPFSSPVLLVKKSDGSWCFCVDYRALNALTVRNRFPIPTIDELLDELGGACYFSKLDLLQGYHQIRMHLGDILKTAFRTHHGHYEFKVMPFGLCNAPSSFQATMNQIFRPYLRRFIIVFFDDILVYSHSMDDHLHHLELTFQVLLANHFVLKFSKCFFAQLQVEYLGHLVSRSGVEPLPSKITAIQQWPMPQTTKAVRSFLGLVRFYRRFIRGYATIAAPLVKATTVDPLQWTAETQLAFENLKQALSSAPILALPDFSIPFTVETDASGVGMGAILSQKGHPIAFFSKPFSAKLLRSSTYVRELFAITAAIKKWRQYLLGHRFIILTDHRSLKELLTQAVQTPEQHMYLARLMGYDYKIMYRSGAHNQAADALSRAPVSSSTLYMILSVPCFTFLEELIQQLKLHDDYLRQRQNITTDPTSFEGFTLTDDFILFRNRIWLPRDLSIIPTLLREYHATPTGGHAGITKTLTRLSENFFWSGMRSDVSTFVANCFECQCTKYETKKKPGLLCPLPVPRQPWEDLSLDFITGLPPYQGHTVILVVVDRFSKGVHLGMLPTAHTAHAVASLFLNIVVKIHGPPRSLVSDRDPLFISNFWRELFRMSGTQLRMSSAYHPESDGQTEVINRVIEQYLRAFVHRKPTSWGRLLPWAEYSHNTSWSSSTGTTPYEVTFGRKPFNFLTYLAGQSTIDAVDTILTDRNEVFHMIHKKLLKTQEAMKHKVDLKRREVTYNPGDWVLLKLLPHRQVSAKGSEQVTNKLSKRFFGPFQVVERVGKVAYRLQLPPEAKLHPVFHCSLLKLFHGDPAVASDSFTSLPFDQQGPVAPLVILATRRKADTLMEVLVQWQGLSPDDATWENWDTLHDEFHLEDKVLLHGPWNYTEEQTLQPTITEEQATTIAANQENAEATEQRVQLANRPKRPIVKPSYLRDYV

SEQ ID NO: 166116 - protein, 191 aa, Glycine max
  Coding DNA Sequence Number=SeqID_49338
  Gene Ontology: Mol. function=catalytic activity; Biological process =cellular metabolic process
  Homolog annotation: Hit_ID=Q8S4X1; Match level="QueryCoverage=91%, HitCoverage=33%, E-value=4e-83, Identity=75%"; Hit description=UOS1
  Pfam annotation: Domain name=CIA30; Domain location=2-101; Score =17.8; E_value=8.1e-07; Accession=PF08547.2; Description=Complex I intermediate-associated pro
MVALQVSELRRVFTIDFQNFSEPENLSAYDGLEFRLKGDGRRYKIIVRTSSDWDTLGYTAGFDTEKGKWQSLMFSKFESDGKLNETFVEGPFELPVSSIRAYIKDPITPRFVHVSSAGVTRPERPGIDLSKQPPAVRLNKELDYILTFKLKGEDLLRESGIPYAIVRPCALTEEPAGANLIFDQGDNITVL

SEQ ID NO: 166117 - protein, 867 aa, Glycine max
  Coding DNA Sequence Number=SeqID_49339
  Gene Ontology: Mol. function=protein binding; Cellular component =integral to membrane; Biological process=defense response to fungus
  Homolog annotation: Hit_ID=Q1T2W9; Match level="QueryCoverage=91%, HitCoverage=90%, E-value=0.0, Identity=35%"; Hit description=Leucine- rich repeat; Leucine-rich repeat, cysteine-containing type
  Pfam annotation: Domain name=LRRNT_2; Domain location=80-122; Score =40.2; E_value=7.3e-09; Accession=PF08263.3; Description=Leucine rich repeat N-terminal domain
  Pfam annotation: Domain name=LRR_1; Domain location=152-174; Score =19.0; E_value=0.018; Accession=PF00560.23; Description=Leucine Rich Repeat
  Pfam annotation: Domain name=LRR_1; Domain location=176-198; Score =12.4; E_value=1.4; Accession=PF00560.23; Description=Leucine Rich Repeat
  Pfam annotation: Domain name=LRR_1; Domain location=260-282; Score =16.1; E_value=0.13; Accession=PF00560.23; Description=Leucine Rich Repeat
  Pfam annotation: Domain name=LRR_1; Domain location=284-306; Score =10.7; E_value=2.8; Accession=PF00560.23; Description=Leucine Rich Repeat
  Pfam annotation: Domain name=LRR_1; Domain location=308-331; Score =13.5; E_value=0.78; Accession=PF00560.23; Description=Leucine Rich Repeat
  Pfam annotation: Domain name=LRR_1; Domain location=332-354; Score =9.7; E_value=4.4; Accession=PF00560.23; Description=Leucine Rich Repeat
  Pfam annotation: Domain name=LRR_1; Domain location=356-378; Score =11.1; E_value=2.4; Accession=PF00560.23; Description=Leucine Rich Repeat
  Pfam annotation: Domain name=LRR_1; Domain location=381-402; Score =13.4; E_value=0.84; Accession=PF00560.23; Description=Leucine Rich Repeat
  Pfam annotation: Domain name=LRR_1; Domain location=404-427; Score =14.7; E_value=0.33; Accession=PF00560.23; Description=Leucine Rich Repeat
  Pfam annotation: Domain name=LRR_1; Domain location=429-451; Score =8.3; E_value=8; Accession=PF00560.23; Description=Leucine Rich Repeat
  Pfam annotation: Domain name=LRR_1; Domain location=453-474; Score =8.5; E_value=7.4; Accession=PF00560.23; Description=Leucine Rich Repeat
  Pfam annotation: Domain name=LRR_1; Domain location=478-500; Score =16.7; E_value=0.085; Accession=PF00560.23; Description=Leucine Rich Repeat
  Pfam annotation: Domain name=LRR_1; Domain location=502-525; Score =9.8; E_value=4.2; Accession=PF00560.23; Description=Leucine Rich Repeat
  Pfam annotation: Domain name=LRR_1; Domain location=527-552; Score =7.9; E_value=9.6; Accession=PF00560.23; Description=Leucine Rich Repeat
  Pfam annotation: Domain name=LRR_1; Domain location=555-575; Score =5.4; E_value=28; Accession=PF00560.23; Description=Leucine Rich Repeat
  Pfam annotation: Domain name=LRR_1; Domain location=578-600; Score =16.4; E_value=0.1; Accession=PF00560.23; Description=Leucine Rich Repeat
  Pfam annotation: Domain name=LRR_1; Domain location=602-623; Score =8.1; E_value=8.6; Accession=PF00560.23; Description=Leucine Rich Repeat
  Pfam annotation: Domain name=LRR_1; Domain location=626-645; Score =7.5; E_value=11; Accession=PF00560.23; Description=Leucine Rich Repeat
  Pfam annotation: Domain name=LRR_1; Domain location=647-669; Score =6.1; E_value=21; Accession=PF00560.23; Description=Leucine Rich Repeat
  Pfam annotation: Domain name=LRR_1; Domain location=672-694; Score =7.6; E_value=11; Accession=PF00560.23; Description=Leucine Rich Repeat
  Pfam annotation: Domain name=LRR_1; Domain location=720-742; Score =12.6; E_value=1.2; Accession=PF00560.23; Description=Leucine Rich Repeat
  Pfam annotation: Domain name=LRR_1; Domain location=744-766; Score =12.8; E_value=1.1; Accession=PF00560.23; Description=Leucine Rich Repeat
  Pfam annotation: Domain name=LRR_1; Domain location=768-789; Score =9.5; E_value=4.7; Accession=PF00560.23; Description=Leucine Rich Repeat
  Pfam annotation: Domain name=LRR_1; Domain location=818-841; Score =10.6; E_value=3; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1; ...
  Pfam module annotation: Pfam domain module=Domain location=80 -122::152-174::176-198::260-282::284-306::308-331::332-354::356 -378::381-402::404-427::429-451::453-474::478-500::502-525::527 -552::555-575::578-600::602-623::...
  Pfam module annotation: =626-645::647-669::672-694::720-742::744 -766::768-789::818-841
  Subcellular localization annotation: CTP_CleavageSite=36; ConfidenceScore=5.09e-01
MAHDKDVVYFDLASPSYTPSEAKSFPFTFSLHIFLPSNSNMHPCTTPMRIPHVSLLSFIFCYCFWIHHSVYYTGVSAQIVEDQQQSLLKLKNSLKFKTNKSTKLVSWNPSVDFCKWRGVACDEERQVTGLDLSGESIYGEFDNSSTLFTLQNLQILNLSDNNFSSEIPSGFNKLKNLTYLNLSHAGFVGQIPTEISYLTRLVTLDISSVSYLYGPPLKLENIDLQMLVRNLTMLRQLYMDGVIVTTQGNTWSNAFFQLVNLQELSMSDCNLSGPLDPSLTRLPNLSVIRLDQNNFSSPVPETFANFTNLTTLHLSSCELTGTFPEKIFQVATLSVLDLSFNYHLYGSLPKFPLNSPLQTLIVSGTNFSGAIPPSINNLGQELTYLDLSFNDFTGQIPSLNMSKNLTHLDFTRNGFTGSITSYHFGGLRNLLQIDLQDNFLDGSLPSSLFSLPLLRSIRLSNNNFQDQLNKFSNIFSSKLEILDLSGNDLNGSIPTDIFQLRSLCVLELSSNKLNGTLKLDVIHRLENLTTLGLSHNHLSIDTNFADVGLISSIPNMKIVELASCNLTEFPSFLRNQSKITTLDLSSNNIQGSIPTWIWQLNSLVQLNLSHNLLSNLEGPVQNSSSNLSLLDLHDNHLQGKLQIFPVHATYLDYSSNNFSFTIPSDIGNFLSYTIFLSLSKNNLSGNIPQSFCSSSNMLVQDFSYNHLNGKIPECLTQSERLVVLNLQHNKFHGSIPDKFPVSCVLRTLDLNSNLLWGSIPKSLENCTSLEVLDLGNNQVDDGFPCFLKTISTLRVMVLRGNKFHGRVGCPHSNSTWYMLQILDLSFNNFSGCTSKKLLQNFEGNDALMKMMMGSKFNYIASKVLKFG

SEQ ID NO: 166118 - protein, 93 aa, Glycine max
  Coding DNA Sequence Number=SeqID_49340
MSRPSTLLLLFMLLFASFCSCLEARKLVLDKKLNPSSRRDSLFLSALPKGTVPPSSPSKKGHSMEVDEKLIARHLITIDPVLLRSVPSPGVGH

SEQ ID NO: 166119 - protein, 373 aa, Glycine max
  Coding DNA Sequence Number=SeqID_49341
  Homolog annotation: Hit_ID=Q94A76; Match level="QueryCoverage=16%, HitCoverage=7%, E-value=6e-16, Identity=62%"; Hit description =Potassium channel GORK (Guard cell outward rectifying K(+) channel)
MECIEEVIAKLASNQLHVTTILDELIQRITVLEARQHNPPTPPSSSSAKTFLTHTPISPLSLPPPLKPTPSPTSMPTSPPRSALTLQHPASLLAPLTSRGDTIGKLVAPPPPTLPFERSNNIHLGARLPLNVLNVGSRVPQTILRKVLKDFASPTANSEFHNVLHVTQHHLVPLGSFLASLSRPWYSPPSPPPPPPKPPSPPPPRSVRVSPLHISTTEGLYFRAKLLFEGGASVFTKDRWRNTPLDEAQMCGNKNLIKLLEDAQSAQRSEFPSQEYTDENASEAQPILFLNTTKLFRGLELRSQHLEDKVFFDGSGNVMNGKQNTEHYAATEQYVESNDAAKSEHEAEPNKEECRRPKREINKPYYLKDFVNK

SEQ ID NO: 166120 - protein, 441 aa, Glycine max
  Coding DNA Sequence Number=SeqID_49342
  Gene Ontology: Mol. function=zinc ion binding; Biological process =protein folding
  Homolog annotation: Hit_ID=Q338Y6; Match level="QueryCoverage=88%, HitCoverage=93%, E-value=3e-66, Identity=36%"; Hit description =Expressed protein
  Pfam annotation: Domain name=DUF641; Domain location=57-192; Score =225.0; E_value=1.6e-64; Accession=PF04859.3; Description=Plant protein of unknown function (DUF641)
  Subcellular localization annotation: CTP_CleavageSite=28; ConfidenceScore=5.27e-01
METMKPKSALSNRSKKLAKTFQKVMSLRSATKLASNNGICMLNSHLKVKEDLFTDQNKKPHQGNNKNRAIMEALIARLFAGVTTIKAAYAELQMAQHPYNNESIQAADQAVVDELRAISELKRRFLKRDLDLSPQVTIMLAEIQEQQSLMKTYEITIKRLEAEVDFKDNNISSLKKHLDECVSFNKSLEKKLNSSGSLSLFDNLTLSSLSPSHFVHFLHHSLRSVRSFSKIMIAEMESAHWDLEAAVKFIHPNAVFNKPTHQTFAFESFVCITMFEGFNYPNFNVQEDKNLHNQGAENLYFDKFKRLKSLNPKQYLTHNPNSSFSKFLKSKYLQVVHAKMECSFFGNLNQRKVVNSGGYPDSTFFISFAEMAKRVWALHCLALSFQDDDVTVFQIKKNSRFSEVYMESVTEESVSPSAGESSDSSSGELRVGFTVVPGFKI

SEQ ID NO: 166121 - protein, 70 aa, Glycine max
  Coding DNA Sequence Number=SeqID_49343
MANLDYFRGLVEGLYELRYGHELLSSDDDFAGTAPYYLGLLTARHVLPSYIFFRIVSQISFVIGIFHHHI

SEQ ID NO: 166122 - protein, 76 aa, Glycine max
  Coding DNA Sequence Number=SeqID_49344
MVEKTKGSRRLPRLWTITKLPRRWTKKKKQKREEEAPRHLPPNHGNNGGNGLGGSLGRRRRRRRMKKMQKLEEVEE

SEQ ID NO: 166123 - protein, 228 aa, Glycine max
  Coding DNA Sequence Number=SeqID_49345
  Gene Ontology: Mol. function=glutathione transferase activity; Cellular component=cytoplasm; Biological process=auxin mediated signaling pathway
  Homolog annotation: Hit_ID=Q9FQE1; Match level="QueryCoverage=99%, HitCoverage=99%, E-value=1e-110, Identity=84%"; Hit description =Glutathione S-transferase GST 17
  Pfam annotation: Domain name=GST_C; Domain location=99-195; Score =29.1; E_value=1.6e-05; Accession=PF00043.15; Description=Glutathione S-transferase, C-terminal domain
  Pfam annotation: Domain name=GST_N; Domain location=4-77; Score=82.4; E_value=1.4e-21; Accession=PF02798.10; Description=Glutathione S -transferase, N-terminal domain
  Pfam module annotation: Pfam domain module=GST_C::GST_N; Domain location=99-195::4-77
MGSEDVKLLNFWVSPFGKRVEWALKLKGVEYEYIEEDIFNKSNLLLELNPVHKKVPVLVHAQKPIAESFIILEYIDETWKKYPLLPHNPYQRALARFWATCVEQKLGKAGWVAMSTSGDEQEEAMKEAKEMMEKIEEEIKGKNFFGGDNIGYLDIAIGWIAYLVPVWEEVGSMQIIDPLKFPATFAWMTNFLSHPVIKDSLPPRDKMLVYYHNRKNNLPSVFRNLVKD

SEQ ID NO: 166124 - protein, 139 aa, Glycine max
  Coding DNA Sequence Number=SeqID_49346
MGPFWNILEVGLLKEEATGCKLLQVLLKNSFWGFRDFRNASIKRRGKKSSRSASVTLLRHFREQICEDFPPFFIRSSFILRSSTEVSLNELTNNQSETKAKINSQIKLCAQKSLKTVLKVQRLKWSSLLLSVNMDHSKA

SEQ ID NO: 166125 - protein, 80 aa, Glycine max
  Coding DNA Sequence Number=SeqID_49347
MALKCENKIPDNSAKNLLALWQVYQIARSNNFSCSVKRYPLPSGLTLKTDSSIHSLPLIRLYPLPSGLNPNRKQVQRYRM

SEQ ID NO: 166126 - protein, 380 aa, Glycine max
  Coding DNA Sequence Number=SeqID_49348
  Gene Ontology: Mol. function=protein dimerization activity; Cellular component=chromatin; Biological process=electron transport
  Homolog annotation: Hit_ID=O81190; Match level="QueryCoverage=88%, HitCoverage=60%, E-value=4e-72, Identity=45%"; Hit description =Putative transposase
  Pfam annotation: Domain name=DUF659; Domain location=33-185; Score =228.5; E_value=1.5e-65; Accession=PF04937.6; Description=Protein of unknown function (DUF 659)
MYDACISLNAIHSPYFALALDAIVAIGPSFKGPSCHDLRINLLGDCKRECQLVVEGYRANWVKSGYTIMANAWTNQRQRTLINFLVYFPTSIIFVKSVDASNVVKDAKTLWNLFCEVIQWVGAENVVHIVTNNAANYVVAGRLIHEKYGTIFWSPCAAHCLNLLLKDVANLPYVANLASKASKIIIFVYNHMVLLSWLRKREGWKQVVRPRGTQFATTFITLESIYDHKQDFQALVVHKHFTSHKLSKTVVGQTARLDKHLKLKLHAIAYWFNLAFSETGIYQEWRESFGHPSALNVSKTIRPDQWWLMFGISAPILQKMEIRIISQTASSFGCDDNLDTMEFQVDSGDVGGSTTSTNEDVIPIMSKFDGINLNDYYSDS

SEQ ID NO: 166127 - protein, 252 aa, Glycine max
  Coding DNA Sequence Number=SeqID_49349
  Gene Ontology: Mol. function=RNA-directed DNA polymerase activity; Cellular component=intracellular; Biological process=RNA-dependent DNA replication
MASEDMEKTMFVTLWGTFCYKVMSFGLKNVGATYQRAMVALFHDMMHKEIEVYMDDMIAKSRTEEEHLVNLRKLFERLWKYQLRLNLAKCTFRVMSGKLLGFIISQKGIEVDPDKVKAIIEMHDPRTEKVPSLRILVESGLKELEWAQARFDQLILIEGKRLAAMSHEGLYQRWVKNAFEKKVRPYKFNEGDLVLKKVSQAQKDNRGKWAMNYEGPFVVKKAFSGGALVLANMHDEELSSPMNYDIVKRYYA

SEQ ID NO: 166128 - protein, 180 aa, Glycine max
  Coding DNA Sequence Number=SeqID_49350
MEPLEIHQHKFLPLFHLPSHPTYFPLMVSVKVHKILIIVDQSLFYSLTKLPSQGVPFDDTLVDDWKFNYSSHDARRMVCNDQVDMTGRLLVGAPRSSSICDASSIGACRPRIFFINGFLCFLEDEWQRNGERERERRRHFKEKMSLEEAHHHRRPWIRAWRKNEMNEGRGREEHEILCSK

SEQ ID NO: 166129 - protein, 103 aa, Glycine max
  Coding DNA Sequence Number=SeqID_49351
MGLGRNGDGVAILVEFKENRGRFRLGYNPTRADVRRITLERKGRSMAEDEEDKDAGFPPELERMVTQEDREMKPHQEEMEIVNLGVGEEKKEVKVGTCMTTPV

SEQ ID NO: 166130 - protein, 294 aa, Glycine max
  Coding DNA Sequence Number=SeqID_49352
MALRKLPTKRSRKDTTGEGSSATPHADVDLDRHRFRSVEHQQRFETIRGWHRAPLVSPMAKFDPEIVMEFYANAWPTEEGASNASIAGGGVRPQALMRRLLANCCACRGRTLPGPQQGESKILPSDHNSDLTLLKCQLVYTILTHVSVHVAQLISDAIYQFAGIVRTRHPVDPEKSNRALRFHALIIGLCQFYGVSVTPSKLIRPPINRAFIEKYCMPRQAQGQAPQQPEDGQQQAAADAPPPSPKSTSTHLRRPGPAGTSEDGDGPQEDNDLANVMDFFLGGGGVVWPGSPNL

SEQ ID NO: 166131 - protein, 172 aa, Glycine max
  Coding DNA Sequence Number=SeqID_49353
  Gene Ontology: Mol. function=RNA-directed DNA polymerase activity; Cellular component=intracellular; Biological process=RNA-dependent DNA replication
MDIDLILWGENNTSHPNYLYLSSLLAFPLCFLLSSSLIHHVFTLLTPLPPHLQYVFLEGEDEKPTINSSTLCNEEEKRLVEVLKKHKQALGRKISNLKGISPSICMQNINLEEDFKLVAQQQRKLNLVMKKGVRKEVLKLLEVGMIYAISNSTWVTPVHVVPPKIWNKSDKE

SEQ ID NO: 166132 - protein, 171 aa, Glycine max
  Coding DNA Sequence Number=SeqID_49354
  Subcellular localization annotation: CTP_CleavageSite=70; ConfidenceScore=5.50e-01
MSPPPLEPHNHSQTHPMLSGWLPLYSQFSASALASACVLSATLARLLSLSACVQLILRPDSSSRLAARVVKAHEESLVEEHDSREKDEGKKEKGEERTQQQWEKCLQVEIQQERPLQVNNSPHQLISKEERHEECDKSISVIYSLITNTFLAMIWKAIRGYMIFMESLAKK

SEQ ID NO: 166133 - protein, 205 aa, Glycine max
  Coding DNA Sequence Number=SeqID_49355
MVIGGLEDWIRKATTEIENKEKIVEKQRMKMMSSEGLVLDRNQSRVMNLRIFLCKLALLKVVIWVVVVILAVVTMFAVGIEMVSLPSHGSGRGGWYEATESTNGRVGSGGWGWWEEAMGSEAGMGVSVGGDFAEEEDGGDLGEDGVGVRMNSRQRMTLSLVVISRVLVVMVDRFWARVGVTVGEKAGRGSHGWQVGPNCYEVKGR

SEQ ID NO: 166134 - protein, 350 aa, Glycine max
  Coding DNA Sequence Number=SeqID_49356
  Gene Ontology: Mol. function=protein transporter activity; Cellular component=nuclear pore; Biological process=protein import into nucleus, docking
  Homolog annotation: Hit_ID=Q84NP8; Match level="QueryCoverage=99%, HitCoverage=35%, E-value=1e-120, Identity=59%"; Hit description =Putative Ran binding protein 11-like
MKILVAFQGRHPYSFGDKFVLSSVLDFCLNRITDPEPYLLSFEQFLIQCMVMIKNILECKEYKPSLTGRVMDENGVTLELMKKNISSAVGGVLTSLLPTERIVHLCNVLISRYFVLTASDLEEWYRNPESFHHEQDMVQWTEKLRPCAEALYIVLFETNSQLLGPVVVSLLQESMNNCPTPVTEITPALLLKDAAYGATAYVYYELSNYLSFKDWFNGALSLELSNEHPNLRIIHRKVAVILGQWVSEIKDDTKRPVYCALIRLLQGKDLSVRLAACRSLCLHIEDANFSEREFVDLLPICWDSCFKLFEEVQEFDSKVQILNLISILIGHVSEVIPFANKLVQFFQKVQ

SEQ ID NO: 166135 - protein, 331 aa, Glycine max
  Coding DNA Sequence Number=SeqID_49357
  Gene Ontology: Mol. function=DNA binding
  Homolog annotation: Hit_ID=Q1S0F5; Match level="QueryCoverage=62%, HitCoverage=48%, E-value=5e-16, Identity=28%"; Hit description=IMP dehydrogenase/GMP reductase
MAIVAKVVKILAQELDRVKQNRNGVVGIPRKNLEEKAKDLADQREWTSFVDVLALLVFRIVIFPNVDGLVDLAMVDAFLAYHYNKESLVIVVLAYAYDTFDLRCEKSSARIVCCTPALYVWLVSHVFCHESRLVCPLQGHCMCAEKGKTNLEELLAGVYNPMLAIRQLGYPVRGVPSEEIIVPFITRGFSEGNVKVLQRFRKAWNAVERRDGELKGSNNDVIGGYHKWLKVRTQEITWLPKLKSPSGEETEVLEESEEVQALKAKLERTRVVKEKLKTTVTRARKECDELRDVNMSTTQELERETKRAQKEEWGRNKFRGALWGSNNELKL

SEQ ID NO: 166136 - protein, 271 aa, Glycine max
  Coding DNA Sequence Number=SeqID_49358
  Gene Ontology: Mol. function=protein transporter activity; Cellular component=nuclear pore; Biological process=protein import into nucleus, docking
  Homolog annotation: Hit_ID=Q10MW7; Match level="QueryCoverage=70%, HitCoverage=15%, E-value=2e-47, Identity=49%"; Hit description =Importin-beta N-terminal domain containing protein
MEDERTSIGGEAEGRVHWNKVWEESSGESLLQIQLLVALRNFVVALGYQSPICYNILLPILENGIDINSPDELNLLEDSMLLWEATLSHAPSMVPQLLQYFSRLVEIMERNFDHLQVAVNIIEDYIILGGNNFLSMHATNIAKILDLVIGNVNDKGILSVLPVVDILIQSIGIKTSYPIAQRLFAMRRYAQRLLSQLCFPMDVPPLISSTLQLFQKYLLTYTFPHLSIPPPLKMDLVLKVKLRKNSLHFISKFPTIFMVGSQFSFRAVGNS

SEQ ID NO: 166137 - protein, 867 aa, Glycine max
  Coding DNA Sequence Number=SeqID_49359
  Pfam annotation: Domain name=SURF2; Domain location=464-654; Score= -80.8; E_value=0.037; Accession=PF05477.2; Description=Surfeit locus protein 2 (SURF2)
  Pfam annotation: Domain name=zf-U1; Domain location=664-699; Score =10.1; E_value=0.0052; Accession=PF06220.3; Description=U1 zinc finger
  Pfam module annotation: Pfam domain module=RVT_2::SURF2::zf-U1; Domain location=55-199::464-654::664-699
MSQASMSFEFWDHAVISAVYLINRLPSSSIHQEVPYQRLFKRLPDYKFLKVFGCALLSPTKAIQSAQTSAKGIKSVSFGVTYDYNVTFSPVIKSVTVRILLSLAVTHKWSLQQLDVNNAFLNGILEENIYMSQPPGFENSNKQLVCKLNKAIYGLKHAPRACPSILGICWGKQKWMRPTQSLLQWFGGCKLTKSGYEAFPDPTLYRSVVGALQYATITRPEISFSVNKVCQYMSDPSEQHWAAVKRILRYLAATINFGLKFLPPSTGPLFSQHAYYDAHWASDPDDRRSTSGAAIFFGSNLVSWWSKKQSVVARSSTEAEYHSLALATAEASYFLSELHIPHHTPVIFCDMTTVALAHNPVMHSRTKHMELDLFFVREKVMVKHLQVIHVPATDKKADILTKALTSSNFTTYRSKLRIGPSQYRGAGRRGGRSFRGYGRGRFNHHRGRGRGRGGDGRQFSSHSSEATIANVADAPAADGATSEMQPSSVSGPSSLHNPAQVPSAPLQAPPCKLWCEICKAECNTPEMMEQHKNGKRHKKNLLVHEEVQRRKALNGQQGGNISTSQSNLTIQPEEVQESEEKRIPEENMGSEATADNHNDGTELQNNVEGVSEVQTEEPQEKPRDNSAIQGRGFKRKMRGGRGGKYMRSDDGSRKSVETPKPKQVTSLICELCNVKCDSQVVYNSHLAGKKHLSNFKRVHGYQPLNGEAGIQPLHPPNIIALSNANNFPVQQGVSVPLGINDPRNLLAQLLMNVLSNVQVPATTPLSGPVAAQIQVPALMAGSSHEPLSQNLSQIQVSDSLAHFESENPIGETKDQMSSVTFQLDETAGSSNNGNIETADGTVVKLSQDCSVMTPAENPVAADKQLPS

SEQ ID NO: 166138 - protein, 206 aa, Glycine max
  Coding DNA Sequence Number=SeqID_49360
MAYTPPQSGCTALIDLVFNKAGVPIKQALVQRQGLSPDDTFWGNWDELQSTYNLGDKVAFDGGGIDKVIENGVAQSVNEEVQQERPKRIVKQKCGSEYVYYWHKGIEDSRQGISLGTPSRFPTSCARAPATTATAAGLMEPGTVAACSGDNKVVMIDHTMEFEFEMGRSHVVVLVDIHAAANISVFLSPPPPRYFTVRNSVILMRE

SEQ ID NO: 166139 - protein, 306 aa, Glycine max
  Coding DNA Sequence Number=SeqID_49361
  Gene Ontology: Mol. function=RNA-directed DNA polymerase activity; Biological process=RNA-dependent DNA replication
MEEMSKFQNEVAGKKHFKREGNTKTDSHRSDNRHKPGKRQPLPKGPRYECYTTLTTNHTTILEEAFNLEVPIKLPPLLSPRLGLDKTKYCRYHCNIGYNTEDCWALKEKIKELIQAGLGIYLSLLRDQTTTKQKQDLEDPKRINIGITTWTKEETKQKIEEDIDTTRARPANQRCNQHQCGWILLWRAVQPILQASPPCHSGHRHQLCRYSITRSHPLITFIDRNFKGINPINQNDPVVVSIAIANFMVSKVLISQGNSTDILYWKTFRRLEVSLDTIQPYAGPLLGFAGESVETRGYVNLMSTFG

SEQ ID NO: 166140 - protein, 48 aa, Glycine max
  Coding DNA Sequence Number=SeqID_49362
MLQLLLITSKGVVAHRWLSGMYPNILNSNSDSIKLGVGTPTYVIVQTV

SEQ ID NO: 166141 - protein, 205 aa, Glycine max
  Coding DNA Sequence Number=SeqID_49363
  Gene Ontology: Mol. function=binding; Cellular component=nuclear pore; Biological process=protein import into nucleus, docking
  Homolog annotation: Hit_ID=Q84NP8; Match level="QueryCoverage=94%, HitCoverage=20%, E-value=1e-47, Identity=51%"; Hit description =Putative Ran binding protein 11-like
  Subcellular localization annotation: CTP_CleavageSite=39; ConfidenceScore=5.19e-01
KLIVICLSGGDDHDPSKTSVKASSAAILARLLVMNTNSLAQLASDPSTSQLLQTASIPVQENILLCLVDIWVDKVDNVSSIQKKTIGLALSIILTLRLPQVLDKLDQILSVCTSVILGRNDDLTEEESSGDISSSTSPDEGTIPSKEFRKRQIKFSDRINQLSLEDCVRENLQTCAAIHGESFNAAMSSMHPSAFAQLKQALKMT

SEQ ID NO: 166142 - protein, 483 aa, Glycine max
  Coding DNA Sequence Number=SeqID_49364
  Gene Ontology: Mol. function=RNA-directed DNA polymerase activity; Biological process=RNA-dependent DNA replication
MAIEVLVELHTRAEFMTELQLDKLFNRLWASIKSVIAWIYIEFIIQACLVDSKGSNCRPFIHTHDLSGTIRFGVRLDRLPSGRIRCHLQAFCVALVCLLLIGLNRHNLPSRWGTSSSYAVDIASSLYTFSCKAKEWAGVRLDGVNGVTLADEDLGHHEVSDCDRDNYGVILVDRVDTLEVSINESDKRVMLARLVGLPSIGESTRIDVDYTSDLLGGLLFLWRLSISTGGVYVFLDLLLCLFFCPCRDSYVDPLGVLQGCVALVPGPFWERLALARLVPVSFTHLRNLFMLLRGFLHRLSVNLLSHSARSIECNATSGLASVVDVIRCDRIVAYCALKHSTVVSELSMDLGGSPPYQVNAAPLRDVGKTQHRIASSLVYRFAWLKKASRCSSRSVVPSYRFRLSGFQPRGMSASIMRGVIPFHYAQAMRIGAFEMGLAFEARLRANHGGRQMDLPKFGAGTRHGGHGQGGLLDFARWLESGLR

SEQ ID NO: 166143 - protein, 87 aa, Glycine max
  Coding DNA Sequence Number=SeqID_49365
MTTDPPPLPVSHIDPGIGPNISTCVQKCRCHLCIEKSKNYPTLLAKQTDNSKVDATSTSHVVYPGFNGTKMFLTTNVIDRKIHTKRK

SEQ ID NO: 166144 - protein, 85 aa, Glycine max
  Coding DNA Sequence Number=SeqID_49366
MRGRHRSHLRPYSHRIERERKPQEANINLPYFHGKDNVEAYLDWEIRIEQQLQRKDTSKSYWPSLLSKERPRSRHLRGGTFEAQR

SEQ ID NO: 166145 - protein, 1347 aa, Glycine max
  Coding DNA Sequence Number=SeqID_49367
  Gene Ontology: Mol. function=RNA-directed DNA polymerase activity; Cellular component=chromatin; Biological process=chromatin assembly or disassembly
  Pfam annotation: Domain name=Chromo; Domain location=1268-1322; Score= 36.9; E_value=6.8e-08; Accession=PF00385.14; Description='chromo' (CHRromatin Organisation MOdifier
  Pfam annotation: Domain name=RVP_2; Domain location=273-406; Score= -51.2; E_value=0.0097; Accession=PF08284.2; Description=Retroviral aspartyl protease
  Pfam annotation: Domain name=rve; Domain location=1016-1165; Score =9.4; E_value=0.00098; Accession=PF00665.16; Description=Integrase core domain
  Pfam annotation: Domain name=zf-H2C2; Domain location=957-998; Score =33.7; E_value=6.5e-07; Accession=PF09337.1; Description=His(2) -Cys(2) zinc finger
  Pfam module annotation: Pfam domain module=Chromo::RVP_2::RVT _1::rve::zf-H2C2; Domain location=1268-1322::273-406::531-700::1016 -1165::957-998
MASKSNSDKLEEAIAKLTIHQLSLSESPQTMTHKLNTLISTLTTKSPEPSPTSPPHVSPSSPSSPHPRVKLDEPRFDGSDPLGWIFKITQFFEYHHTPDHDRLTIASFYMDDRALDPTGALFKLTQKTTVQAYLSEFEDLANRVVGLPPHFLLSCFVSGLNADIRREVQPLQPLTVTQAAGLARLQEEKLFEARKALRPRLPPSSSQPLPMSPFPLSHPSLPSAQFGFNCDERYHRGHRCNSRVNLLVADEDERPVEDYTLLGLEPDPSDPSIVNEAQLNLHSLTGPLAPETLRFSGLIADHQVLILVDGGSTHNFIQDSMITGFGLIPRPTTPLKVMVGNGQFLRCQQVCQAVPLTIQNIVFIVDLHVLPLCGAHVVLGVQWLRSLGPVLMDYTSLSMKFMHQGQIIEFKGDDTSTLQPLTSTQVRRLVRTARATVYFHLSVIPLDTSPSDTPNLSYPPAIQSLLTKFASLFQPPTALPPSRSTDHHIHLTSNSQPVNVRPYRYPHYQKTEIESQVASMLQRGIIRSITSPFSSPVLLVRKHDGTWRFCVDYRALNALTIKDHFSIPTIDELLDELGGASWFSKLDLLQGYHQILMTEEDIYKTAFPTLHGHFEFRVMPFGLCNAPSSFQATMNTIFRPYLRQFIIVFFDDILIYSATLEDHVLHLEQAFQILLQEQFVLKLSKCTFAQPQVEYLGHVVSAQGVEPVMAKVQAIQQWLEPHSGRALRSFLGLAGFYRRFIRGYATIAAPLTKLVTAEPFQWTDEARAAFTHLKQVLTSTPVLRLPDFSLPFTVETDASGTSMGVVLTQQGHPIAYFSKAFPPKLMGASTYVRELFAITAAVKKWRLYLLGRRFHILTDHRSLKELLTQVIQTPEQQMYLARLMGYDYTIMYRSDSSNKAADALSRLPKSSSTNLMLLSVPYAHPEFSVTNDLILHKGRIWLPQALPFTTTLLSEYHLTPTSGHMGIAKTLARLTENFYWKGIRQDVERFIASCVDCQHTKYETRKPAGLLCPLPIPSKPWEDLSLDFITGLPAFQGHTVILVIVDRFSKGIHLAMLPTRHTAYTVADLFMDLLFRLSGTKLRLTSAYHPQSDGQTEVLNRVIEQYLRLSPYKITFGKKPVNFPRYLKGDSTIVAVEDMLSERQAVFEEIKKKLEKAQSRMKRFADARRRDVHFNVRDMVLVKLRPHRQRSVTGQLSGFSKLDKRFYGPFRVIEHIGPTAYKLQLPDNARIHPVFHTSLLKLFRSLEPNNDQYCSTLPSHYENDQLVVTPLAILDTRHFADSKLEVLVQWQGLSPDDTTWENWDQLREVYHLEDKVLPEGVKDDSKEAAETRPKRKKKIPAYLRDFV

SEQ ID NO: 166146 - protein, 376 aa, Glycine max
  Coding DNA Sequence Number=SeqID_49368
  Homolog annotation: Hit_ID=Q1RW27; Match level="QueryCoverage=78%, HitCoverage=82%, E-value=1e-31, Identity=41%"; Hit description =Octicosapeptide/Phox/Bem1p; CBS
  Pfam annotation: Domain name=CBS; Domain location=61-179; Score=80.2; E_value=6.5e-21; Accession=PF00571.18; Description=CBS domain
MVARRGDALLLTDSNALLCGILTHKDIAARVIAKEINLEETPVSKVMTRNPVFVLSETLAAEALQKMVQVSPTDSILTTRKKMVEFRASCAVVTFNDKPLGIFISKDILLRVIAQNLSPESTPVEKVMTPNSVCVVIDTPIVDALHTMHDGKFLHLPAVDRDGSVVAVVDVIHVTHAAVATVNQVGNNEAATTLMLRFWYSAMALTPNDDDDDTRSLDTWSMTEVITSVLQRLGDDIDPNNIPQILESWPYLPLYEDEDHDKVVLASDSDLAPAVDHARTADLKGIEIAFRLGGIVKGSRSGSYAYSDAWASAYSAALVAGLGILTYFNFVHLYIRGKENWDGHPLLAACILVILGFAASSTLETVYNNKSSVHFS

SEQ ID NO: 166147 - protein, 489 aa, Glycine max
  Coding DNA Sequence Number=SeqID_49369
  Homolog annotation: Hit_ID=Q9FMV0; Match level="QueryCoverage=92%, HitCoverage=93%, E-value=3e-86, Identity=41%"; Hit description =Arabidopsis thaliana genomic DNA, chromosome 5, P1 clone:MLE2
  Pfam annotation: Domain name=F-box; Domain location=27-74; Score =35.4; E_value=2e-07; Accession=PF00646.23; Description=F-box domain
  Subcellular localization annotation: CTP_CleavageSite=90; ConfidenceScore=5.22e-01
MEKPSSSLSSSRRKSSTMVKASTDANTSLSMLNEDLLQNILARLPSLHFASAACVSKSWNSLCSRILSRPKLSSAISLNPSLPDAVNEVVHKVLSEPIRPHFAIANIGTGFNTAKTLCLIRKSLGFNIPVIVTVANGIMGRDAVTDEFKEVKWGALFSGFGEESYTRFINEGLVLTVGYLPGLKVEALPLRRPTKTSQATWVDNFIKDIKEYSASVSSSPFPVGIILFGEASSDMKLVLEKLDHAMPMDMVIVGDERGSFDFVHKSGNDSRIICSKKGNIEAVALVFAQDRDRSLGTIRFHVALSNGVSTVGPRYKAASVKSNNADCSTWLTARREGQQENLDGDEEYLYVDGIGIKTGDIFQFYYSDPNTALASLTKVHDALKSIHLEKNSKSSKGDGDNATNVFGGIVFACYGRGESFFGRHNVDSSPFLENFPGVPVSGIFCGGEMVRPCTTVIGQCEGASPISCCLHVYSTVYLAMSYTPPSVED

SEQ ID NO: 166148 - protein, 153 aa, Glycine max
  Coding DNA Sequence Number=SeqID_49370
  Gene Ontology: Mol. function=protein dimerization activity; Cellular component=nucleus; Biological process=regulation of transcription, DNA-dependent
  Homolog annotation: Hit_ID=O22208; Match level="QueryCoverage=98%, HitCoverage=26%, E-value=2e-18, Identity=37%"; Hit description=BZIP family transcription factor
LAIPKDLDSALAIPKDLVLVEAEALGSGSAKALKDHTKSSATDGKMQQWFVKVLQFDVSPCTGAIVPITSIANVSTENHQNTTSVKKTRNRRTLHELPEPLNGVYTSSLNITEEQVKNLQEDHLHVVGDGDVDGMMRPKSLSWIFVVVLIDSV

SEQ ID NO: 166149 - protein, 414 aa, Glycine max
  Coding DNA Sequence Number=SeqID_49371
  Gene Ontology: Mol. function=metal ion binding; Cellular component =nucleus; Biological process=regulation of transcription, DNA -dependent
  Homolog annotation: Hit_ID=Q8LFW6; Match level="QueryCoverage=99%, HitCoverage=100%, E-value=7e-50, Identity=35%"; Hit description =Squamosa promoter-binding-like protein 13
  Pfam annotation: Domain name=SBP; Domain location=108-186; Score =171.3; E_value=2.4e-48; Accession=PF03110.5; Description=SBP domain
MDWNLKAPSWDLVDHVDKATTLQQNIGTKEEQNRFGVYRMKGEFSVDLKLGHHHVGNSGTESALANKSKDAAAASGAAASAGVSKMASSPSGSSKRARTISSTSLTVSCLVDGCNSDLSNCRDYHRRHKVCELHSKTPEVTIAGLKQRFCQQCSRFHSLEQFDERKRSCRKRLDGHNRRRRKPQPEPLSRPGSFLSNYQGTQLLPFSGPHVYASTAMVSPDWSGALVTSSADARLHNHNHHHHQQDLFLGSSHKEGKQVAFLHSNHHPSTLSNQNPPPFPSPSICHTLLRTRPLSETCGGGARSKMFCESLTTTTTASNNNNNSLHDTIPCALSLLSSSQTHTPGGNGLNQMVQQPPPPSMSLMMQPLGLSLQDNNNNSLESVDHCSSIYSLASDHHGSHCNEAAPQLFPFQWE

SEQ ID NO: 166150 - protein, 333 aa, Glycine max
  Coding DNA Sequence Number=SeqID_49372
  Gene Ontology: Mol. function=protein dimerization activity; Biological process=regulation of transcription, DNA-dependent
  Homolog annotation: Hit_ID=Q7XE06; Match level="QueryCoverage=85%, HitCoverage=44%, E-value=3e-24, Identity=29%"; Hit description=HAT family dimerisation domain containing protein
  Pfam annotation: Domain name=hATC; Domain location=268-332; Score =43.5; E_value=7e-10; Accession=PF05699.5; Description=hAT family dimerisation domain
MILIELVNHQKFQQNHKRHKESQHNKLNKLKKHKERLDNKLNHNKDNTLLGGDLMHMRCVAHILNLIVSDGLKEIDLYVSRIKAACKFARSSPSRLATFKRCAYEEFKRIEYDDPQYLIALANEGVLIVMIGIVHRKSNDPILQKFYYTYANQVFEILGNSEINNLFFVAVFLDPCYKLEYVEFCFGRLYGKERSQEMIKRLREIIEKLLECYVTMYPLPINGSDFGSILSSVASQPNFSTNDDNERDWENEFRMKIINKQGEVKRNEMDGYIEDDVEDSRPNIEFEILKWWRMKLAKYYILSRMARDILAIPMSIVSSESAFSIGSRVLDLF

SEQ ID NO: 166151 - protein, 184 aa, Glycine max
  Coding DNA Sequence Number=SeqID_49373
MLRRQKCYGDRCHRKDNELKKEAPRGREQQNYTRRRKRAKQQTLTQEIFCSQTTQADDEYGRMVLAVVLYSFLATLGTKLHTYNNSNTNLLPIITCAMLMLGSVVSILALSFISFTFAWITLALWVGIFTLISHEYGAHKRTKIGLPVASHGAKVVASLEKDSRFLIQEESIVGFMKASLLFHA

SEQ ID NO: 166152 - protein, 122 aa, Glycine max
  Coding DNA Sequence Number=SeqID_49374
MRNLFKELSENINKFSTLLFALITSTNSLFMKQHKLMVLLVLSIVVYSFLVIIGTILEKHNRSLLPIIICGMLIVGGAASFMALAIISFTVAIITLALWVGISILVVYMYVSAPRSSGLLPL

SEQ ID NO: 166153 - protein, 191 aa, Glycine max
  Coding DNA Sequence Number=SeqID_49375
  Homolog annotation: Hit_ID=Q9FMV4; Match level="QueryCoverage=95%, HitCoverage=93%, E-value=2e-29, Identity=41%"; Hit description =Arabidopsis thaliana genomic DNA, chromosome 5, P1 clone:MLE2
MEEQQSKTTQELAMEGQKYLEETIENAFQILSSMNDELCNPVLWSTSPSASSSPNADATSENSNHHADATTAAAGGGGALEQARSRYKKAVAALRTILTAIPNSQKLYPTAIHAISAAKVAATLKHSSMANAFNASSAASPADEAEIDKLEERASSLRRELANKNLHLKTLIDQLRDLITDISTWHSPFST

SEQ ID NO: 166154 - protein, 154 aa, Glycine max
  Coding DNA Sequence Number=SeqID_49376
MQINMFINGLRPHTRQLLDAFVGGKIKLETPEVAMKLIRNMVASDEAIHRDRTFIPAKKNLLELTADDAILVQNKLIAKQIKALTDKLNNLPQQLHALQPTQPSNMQVGGCTLCGGAHEVGLCMVQEEANKELNYMASVSPWQVYQFFKVILKQ

SEQ ID NO: 166155 - protein, 299 aa, Glycine max
  Coding DNA Sequence Number=SeqID_49377
  Gene Ontology: Mol. function=phospholipase C activity; Cellular component=integral to membrane; Biological process=intracellular signaling cascade
  Homolog annotation: Hit_ID=Q3SF15; Match level="QueryCoverage=90%, HitCoverage=21%, E-value=8e-46, Identity=36%"; Hit description =Hypothetical protein precursor
MDTDNPQNPAEVRRLDLTYPEVDITAQDFQFGEKQLGSLDLKAFNSGESWVIQRMNLTNPDSQLTADGTWRNSVRNPQTQLKFNLTSSNLGKTLQRFQPGGEMVKGGTGNMSGQLGWPGSPHEFAVERLDGNFTMQLEKGQILKVQPGVGRLLGLLSLQSLPRRLTLDFRDLFSEGFAFDKITSTANIRDGILRSDDLFMTGPAAEARIKGETNLKTETQRLRVKVVPHISDSVSLAALAGGPIVGVAAFVAQKLLKDPLNKISASEYMITGTWDNPQEADIDKKTPAAPSVQPLKSQH

SEQ ID NO: 166156 - protein, 179 aa, Glycine max
  Coding DNA Sequence Number=SeqID_49378
  Gene Ontology: Mol. function=methionyl aminopeptidase activity; Biological process=proteolysis
  Homolog annotation: Hit_ID=A0EVX1; Match level="QueryCoverage=69%, HitCoverage=24%, E-value=1e-21, Identity=51%"; Hit description=Cold -induced cell cycle-related nuclear protein
MEGSFLCTAIIPNFLTRLQGLKSCATMSDDEREEKELDLSSAEVVTKYKTTAEIVNSVFLTLLHLMFVVSNSIWVLNVNRRRRLWIFVRKGIHTLESKLIIFINEGALPVLNIYQTGNVYKNVKRKIERCVAFPTCLSVNSVVCHFSPMESVVSAIILKLMCKVIHYYKQFSLVKSERN

SEQ ID NO: 166157 - protein, 128 aa, Glycine max
  Coding DNA Sequence Number=SeqID_49379
DKVINVFKELQEILIKFLTLLIALISVTNTDSGKLLFTEQHKLLMSLILTIVLYFFFASIGTILQIYKGSLLQHVIWVMLIVGAVVSVLALSFISATVAWITLAMWVGILAVVAYDYGVPQRITNWIN

SEQ ID NO: 166158 - protein, 59 aa, Glycine max
  Coding DNA Sequence Number=SeqID_49380
FLVHQQGRKNLWVDKAACLAHLHALSTLESTGKATWQASGDYWRKFEARCMFSVRCALN

SEQ ID NO: 166159 - protein, 793 aa, Glycine max
  Coding DNA Sequence Number=SeqID_49381
  Gene Ontology: Mol. function=heat shock protein binding; Cellular component=integral to membrane; Biological process=protein folding
  Homolog annotation: Hit_ID=Q1T494; Match level="QueryCoverage=93%, HitCoverage=97%, E-value=1e-146, Identity=39%"; Hit description =Aminotransferase, class-II; Heat shock protein DnaJ
  Pfam annotation: Domain name=DnaJ; Domain location=66-127; Score =94.0; E_value=4.5e-25; Accession=PF00226.21; Description=DnaJ domain
MECNKAGALRAKELAEKMLLQRNFGGARMLAMKALELYPNLDGLPQFLATIEVYISSEARVNGELDWYSILGVQPLADEETIRRRYRKLALTLHPDKNRSVGADGAFNLVSQAWSLLSDKAKRITYDQKSSLWGNGNPGGKPSMPASQNGLHTNVFNPVLLKPTFWTFCSFCKTKFEYHNAYINSNLVCTCCHKPFLAFETLPPPGYRNVSSTQMKQHNFNSTRMERSYHFSGRTPMSTVNSSLGSGPFSMPGSISHVPTSASSAAEAPGAFRMPSENLKTRHEDSATVLREDAHFGKAHAVERTGAGSAFQSSRFGSNSIMKGDRPRKKRPTDEHKVCSDRRDMENKTASQNEGINLANGFGSGRVNAAGNHKRNGVRDRSQQQIKNILVEKARKEILIKLDEWKASSALKNFDKSKNIDTEIGEKGKEREVNGVKPGAQVGDSETVDKKCFSADPEPELPVSLSMNVPDPDFHDFDGDRIENAFGENQVWAAYDNDDGMPRYFCLIHDVISKKPLNMRISWLNAKSNDELAPIKWVSSGFPKTSGDFRIGKRVSYSTLNSFSHRVKWTKGSRGIVHIYPKKGDVWALYRNWSLDWNEFTDDEIIQKYDMVEVLEDYSEEKGVNIAPLVKVAGFKTVFRQNADPRKVRNISKAEMFRFSHQVPSYLLTGEEGQNAPKGCLELDPAATPMELFQVLAEDLEQEIVMTTEKSVEDELKHKENSGEEGLIKKCQTTKEEGSDEEGLVGEKKRKPESCQTTKEERSNEELGEKKRKPEILFVYKRRRLGEKRAVKC

SEQ ID NO: 166160 - protein, 300 aa, Glycine max
  Coding DNA Sequence Number=SeqID_49382
  Gene Ontology: Mol. function=sequence-specific DNA binding; Cellular component=intracellular; Biological process=regulation of transcription, DNA-dependent
  Homolog annotation: Hit_ID=Q9SMP0; Match level="QueryCoverage=58%, HitCoverage=80%, E-value=2e-81, Identity=82%"; Hit description =Nuclear transcription factor Y subunit C-1
  Pfam annotation: Domain name=CBFD_NFYB_HMF; Domain location=70-134; Score=87.3; E_value=4.6e-23; Accession=PF00808.13; Description =Histone-like transcription factor (CBFNF-Y) and archaeal histone
  Pfam annotation: Domain name=Histone; Domain location=64-137; Score =44.7; E_value=3.2e-10; Accession=PF00125.14; Description=Core histone H2AH2BH3H4
  Pfam module annotation: Pfam domain module=CBFD_NFYB_HMF::Histone; Domain location=70-134::64-137
METNNQQQQQQGAQAQSGPYPVAGAGGSAGAGAGAPPPFQHLLQQQQQQLQMFWSYQRQEIEHVNDFKNHQLPLARIKKIMKADEDVRMISAEAPILFAKACELFILELTIRSWLHAEENKRRTLQKNDIAAAITRTDIFDFLVDIVPRDEIKDDAALVGATASGVPYYYPPIGQPAGMMIGRPAVDPATGVYVQPPSQAWQSVWQSAAEDASYGTGGAGAQRSLDGQRISPSRELETNPSRYLDPCKRMTSPNRCSSIRLFYLKHASSRRELLCMRSGKVELMQMISLSPSSHKMDLSF

SEQ ID NO: 166161 - protein, 98 aa, Glycine max
  Coding DNA Sequence Number=SeqID_49383
MKCTPSSSFFEGVIGPLPRRLLFNPNIIADSSDVIFYIVGHPSSVLFVMNGKGGALSSSSSCPMMVKCKCEESNFCRIFQWVDDTEVVAIMFLQKGVN

SEQ ID NO: 166162 - protein, 98 aa, Glycine max
  Coding DNA Sequence Number=SeqID_49384
MGLEVIGGALKKIRESIKYVRASEAIKIAFKKCVLQVRGIDTKVGLRMNVACRNLLFDGRAMRDSRVRVTRKEYAWSRHQRLFEENIGKTGKDVIYEL

SEQ ID NO: 166163 - protein, 199 aa, Glycine max
  Coding DNA Sequence Number=SeqID_49385
  Gene Ontology: Mol. function=peptidase activity; Cellular component =intracellular; Biological process=DNA replication
  Homolog annotation: Hit_ID=Q1H0H3; Match level="QueryCoverage=98%, HitCoverage=39%, E-value=8e-95, Identity=86%"; Hit description =Peptidase U62, modulator of DNA gyrase
MIGKQVASKGITIVDDGTIADRRGSLTMDDEGNAPQNTVLIEDGILRGYIQDTLNARLMGMGLTGNARRESYAHIPMPRMTNTYMLNGDKDPQEIIKSVKKGLYAANFGGGQVDITSGKFVFSAAEAYMIEDGKITYPVKGATLIGNGPDVLTKVSMIGNDMALDSGVGTCGKEGQSVPVGVGQPTLKIDGLTVGGTSA

SEQ ID NO: 166164 - protein, 304 aa, Glycine max
  Coding DNA Sequence Number=SeqID_49386
  Gene Ontology: Mol. function=protein serine/threonine kinase activity; Biological process=protein amino acid phosphorylation
  Homolog annotation: Hit_ID=Q1STE7; Match level="QueryCoverage=71%, HitCoverage=71%, E-value=2e-28, Identity=33%"; Hit description =Uncharacterized plant-specific domain 01627
  Pfam annotation: Domain name=DUF579; Domain location=66-302; Score =259.1; E_value=9.1e-75; Accession=PF04669.4; Description=Protein of unknown function (DUF579)
  Subcellular localization annotation: CTP_CleavageSite=37; ConfidenceScore=5.22e-01
MPPDVIQFRPTLAPLQFSSQLTLKQRSSPRDHRQGMNLTNKKKLMPILLLILSIISILRLLSLILRTSSSATMSPPPSSSLFSTHNKVAKHAPDSSKHPNSTLTEKEFKVLSNLVALKSPSNLLIFGFQPQYLTLSSMNAPGSTIFLYDDMIAKVATNSNNTQTYKLGYNVPSKKAYNLLKHARQNQLACAPSYPKLLLQKSKCKLALMNLPAEVYEKKWDIIVVDGPKGDSPESPGRMGSIYTASVLARAGNVSDVVVHDVDRMIEKWFSLEFLCHENLLCSKGKLWHFRISGHSNSTTFCTS

SEQ ID NO: 166165 - protein, 443 aa, Glycine max
  Coding DNA Sequence Number=SeqID_49387
MGEQHENENGRTGTKNQHQQKKKKKKSEFEFCKACNINHDQGLRHKYFPNHKKSLSTFLSRFRKKLSDVRFFLNAPIPLNPQLASRNRFWCVFCDQHIDELNSSFACANAIRHLASAEHVKNLKQFFWKYGGAADQLDAFMVSDDDVDKWEKKCTARKDEASEGSRRTVIGPSSDDIHSGNVDSFEKNVYSNSLKSYPSNAVLPLQSYTNEYQVSCSGLSGVATGATSSEVCSGANNFSLQDFAVGRSSLSLPHDGRQRSSNGYSCNKKVRENGRMVSGESSHQGVQMVTQISTGSAGGKVFSEEPPPWLGTTDEVQMRSSNKLGKSKKLNSKRVGAAWVEKRKIEMEKERRGESIRNECDSNWLPNFGRVWQSGSRRESRKEFEREKQKLNVETQSEMAIKIKPYVSKRMRMDSGVIGCLLSPGSLLLNVGMVVIDTQIGIA

SEQ ID NO: 166166 - protein, 363 aa, Glycine max
  Coding DNA Sequence Number=SeqID_49388
  Gene Ontology: Mol. function=pyridoxal phosphate binding; Biological process=metabolic process
  Homolog annotation: Hit_ID=Q2R457; Match level="QueryCoverage=87%, HitCoverage=90%, E-value=4e-87, Identity=52%"; Hit description =Expressed protein
MGTNRQEHEISGGSEVTYQEMVENEVKDTQKGPTRKLITESCKSNSMVIKKRHTLIPPHIIAEAISTIPDLDIRWSGPITPKEMEYVEQYVLAKYPEYSGLMEGEGNGINLSSFMIFEEPNSEPMMDDRGKSPRESSTYLFGSNNLPEMDRAKIQLEPSRLLDILNKKSSFPGSFISIPEIQARNKVLKHYGLPDEEYLVLFTPSYKDAMMLVGESYPFVKGNYYMTILDQEEDYIREFASFKESKVISAPKTWLDLRISGSQLSQNFRRRCKISSKGLFSYPVDANGTMHWISEAHRNNWHVLLDASALEVGKDRLHLLALHRPDFVICSLDNPHSNPSRVTCLLVRKKSFEVSATSSQAVE

SEQ ID NO: 166167 - protein, 222 aa, Glycine max
  Coding DNA Sequence Number=SeqID_49389
  Homolog annotation: Hit_ID=Q67YI6; Match level="QueryCoverage=49%, HitCoverage=29%, E-value=3e-07, Identity=33%"; Hit description=RING -H2 finger protein ATL3G
MSIISATIFAGLDVHNLRHYICRPLGLRRRRNQRDAVALASQYSTTLKLKPYSSVFVIPIIITMMAPSQPPHWAPSPTPILSKSFLPPPSNSPAVDFTPPLIAMVVVVAAAFLVVTYSRLIARHLRPPVHRLLCRFRRRRFLPSSVGDLKTLPYDSPFDGPHVFSPYGLDETVIKTIPFSLYTAKYDAHFDESRYDCAKEKREERREPERREKEKTNQREKS

SEQ ID NO: 166168 - protein, 60 aa, Glycine max
  Coding DNA Sequence Number=SeqID_49390
MNQELLKPSAFVMLHCHSNVLVDMGGLEIVRGTMEGGNDYLQHSSTNNCYLQSCNNVVKK

SEQ ID NO: 166169 - protein, 116 aa, Glycine max
  Coding DNA Sequence Number=SeqID_49391
  Gene Ontology: Mol. function=RNA-directed DNA polymerase activity; Biological process=RNA-dependent DNA replication
MPDQWKHDAAKYMNCSLLFIPFIYLGIPIRTNPWQCQLWDPIINKVPNRVVDKLVSIQRRFLWGGGIEQKKIAWIKWDTMWLPKEKGGLGLKDIKTFNLALFGKWKWSLFQHQGEL

SEQ ID NO: 166170 - protein, 54 aa, Glycine max
  Coding DNA Sequence Number=SeqID_49392
MSKLVNNSKKKWDNLVEGQRIWNIENKYYDSENSSGTPTRGAAFSSFERISTGY

SEQ ID NO: 166171 - protein, 101 aa, Glycine max
  Coding DNA Sequence Number=SeqID_49393
  Subcellular localization annotation: CTP_CleavageSite=61; ConfidenceScore=5.39e-01
MGNLAQGISACSFSLFLFSVGEKVAGAQEFGSLTVNGSSFLGTSFCSFFWGPGQNFPSWVKAGGRVKILAQRACRKAGHDVCQGIGFASALGIRECTISFP

SEQ ID NO: 166172 - protein, 144 aa, Glycine max
  Coding DNA Sequence Number=SeqID_49394
MNPTRSYYIQRDKVVNVFMELQEILIKFLTLLIALISVTNTESGKLLFTEQHKLMMSVIILSIVLHLFFASIGTILQIYKGSLLQLVIWVMLIVGAVVSVLALSLISATVAWITLAMWVGIFAVVAYDYGVLHRIMNWIKGPSH

SEQ ID NO: 166173 - protein, 171 aa, Glycine max
  Coding DNA Sequence Number=SeqID_49395
MNSLSETTSLSEFIENPESEASEPQVLKPPYRLRSSRLSKPRPLLSCSLNAHASLSEVSLSPICIKVHTEAFLSSTYMHTEQGMWFGMLSKNTAHLAHRLPMLSAQGALNEMATTRAYMQSVATYPSAGGRREARGMRVPRKEYARSRHQCLFEENVRKTGKDAIYELLSE

SEQ ID NO: 166174 - protein, 101 aa, Glycine max
  Coding DNA Sequence Number=SeqID_49396
MHVGLEWFDMPHTTFCFVKTSFSFVHCPGLKSTISEEDLFPLDNEIERTCQRNNTIKKKRQQQEKRAGQRAQEASPSQPTSPPSPPPSLEEPPIMAEEEQP

SEQ ID NO: 166175 - protein, 280 aa, Glycine max
  Coding DNA Sequence Number=SeqID_49397
  Gene Ontology: Mol. function=RNA-directed DNA polymerase activity; Biological process=RNA-dependent DNA replication
MEIRNAIKIARLPNDMIRLDLFSFSLVNDAKKWLDSFKGHSLRDWNEVLDKTNFEGYFGRLLTHRFSEPMQINMFIDGLRPHTRQLFDAFMGGKIKLETPEVVMELGNMVASDEAIHRDRTFIPAKKNLLAKQIEALTDKLNNLPQQLHVVQPTQPSNIQVGGCTLCGGAHEVGLCMIQDEANKELNYMATVLTRSLRKDSPVHDGIVEDVVEVASDRDDVVGVDEVLSHKTKSQVVRKIEKCVSSDPTKDVPYPLVPSKKEKESHFAKFQDMFKQLETI

SEQ ID NO: 166176 - protein, 141 aa, Glycine max
  Coding DNA Sequence Number=SeqID_49398
MCVLNSSHSISMRDKVVNVFKELQEILIKFLTLLIALISVTNTESGKLLFTEQHKLLMSLILTIVLYFFCATIGTILQIYKGSLLQLIIWTMLIVGAVVSVLSLSFISSTVAWITLAMWVGIFAVVAYDYGVPQRIINWIN

SEQ ID NO: 166177 - protein, 121 aa, Glycine max
  Coding DNA Sequence Number=SeqID_49399
MGLGRYPRVTKNYLNNNSSSSFRPGISVVGYVLTTIVSLTLLLFLYIKHCNGGITDDKGGNSAPWTVVSFARRKKSVIDLSVVESLLIFIFGALWRQKEGLDCIVNVGNSDSELKNRGPIK

SEQ ID NO: 166178 - protein, 75 aa, Glycine max
  Coding DNA Sequence Number=SeqID_49400
MSDTMSRTSCPKILELLKALKLQDPRCRIRCPGHLARKYWTYKSVISLTDYCAIFRKNDRSHPAQAVAAQTHTLL

SEQ ID NO: 166179 - protein, 171 aa, Glycine max
  Coding DNA Sequence Number=SeqID_49401
MQLELVLELECGVGKWYPNVARGVDHFIEYLRFMMMSLVKLVEAPVLYYCNTVMPPYGDHRDFLFFVVIIFIRHTKLCTRVIQGPPYAEEDSPHYVLGPPYTGDDLEHTVATPLVPIPNVRDDNIEEDPEMMEEYRSKVAEEPSDLVIRVWRMTPGADPTKKIRGGGANIT

SEQ ID NO: 166180 - protein, 223 aa, Glycine max
  Coding DNA Sequence Number=SeqID_49402
  Subcellular localization annotation: CTP_CleavageSite=26; ConfidenceScore=5.26e-01
MPPFGFPSPPQDHSPKPNCNSPPQVNVANASNTSSNSWKAKYGDGVVWEEGHHVDTGEAGRLLFGEVLQKAYPCDDGECDPDNGRCSYAHGKDSESCEAVRDSSGCERDLVDAVGKILKDKQYRGRFLGQLQRWDRRAHRRGGDNLPRWVRQCLNSSDKTVCAANCFVTRVVTSGEICFDCGHDFIGICVVDAEVKRGDLGDDGVIVRANNQSRMTSSLIANS

SEQ ID NO: 166181 - protein, 109 aa, Glycine max
  Coding DNA Sequence Number=SeqID_49403
  Pfam annotation: Domain name=Vps54; Domain location=1-83; Score= -42.7; E_value=0.093; Accession=PF07928.3; Description=Vps54-like protein
  Subcellular localization annotation: CTP_CleavageSite=21; ConfidenceScore=5.31e-01
MVLSSAHSLPTHTPSPPMDIPVSNRKVVSGLKSITSKHLALASQVISFVHAIIPEIRKILFLKVPETRKTLLLSEIDRVAQRKGSSNREDKTCTNICKLKIAIATICEC

SEQ ID NO: 166182 - protein, 216 aa, Glycine max
  Coding DNA Sequence Number=SeqID_49404
  Gene Ontology: Mol. function=nucleic acid binding; Biological process= DNA integration
  Homolog annotation: Hit_ID=Q1S7C5; Match level="QueryCoverage=42%, HitCoverage=9%, E-value=1e-10, Identity=34%"; Hit description =Integrase, catalytic region
  Subcellular localization annotation: CTP_CleavageSite=44; ConfidenceScore=5.12e-01
MASANNNSSPSPPMPPVSTPALCSPALFSHDVTAKLMDSNYLLWCSQVQPVIIGHDHENNIVSAAYRFWEQEDQFFLSWLQSTISEAVLPCIINCATSWHLWDQLHEHFQSIASAKKKQSHSDFLSLDDVTSMPLAEESSIEKSRKKNLGSLNLVEGSNSNSTSEAQVHLTQGNTHSSSNYDFVSEGGVMVAIRTVEVELVGEGVAEHGRFAHVQC

SEQ ID NO: 166183 - protein, 427 aa, Glycine max
  Coding DNA Sequence Number=SeqID_49405
  Gene Ontology: Mol. function=protein binding; Biological process =retrograde transport, endosome to Golgi
  Homolog annotation: Hit_ID=Q5KJA8; Match level="QueryCoverage=63%, HitCoverage=15%, E-value=1e-22, Identity=28%"; Hit description =Retrograde transport, endosome to Golgi-related protein, putative
  Pfam annotation: Domain name=Vps54; Domain location=328-423; Score =25.7; E_value=5.6e-07; Accession=PF07928.3; Description=Vps54-like protein
MDQMMSFGMAHLVRAAEVKKTIEWILSNRDGHYATDSVVAAIVHGAVAAETSQESESHGTTFLPYSPQRSIAKGSSFQGKAIDSVSSSNMSKNFSCFPICLIFSNNLVLNRADILRENAEAVFAACDAAHGRWAKLLGVRAILHPRLKLQEFLTIYNITQEFITATEKIGGRLGYSIRGTLQSQAKAFVDFQHESRMSKIKAVLDQETWVEIDVPDEFQSIINLLFTSDNLASENLNEIEDDISTSYNGVVTNNDVLPMADSSESTAEQQIMRSNSIEASLNNETSDRSKSPVDSTEPNKAHGRISSAHSNNTEKDHKKSTSQALYYKGVGYHMVNCGLILLKMLSEYIDMNNLLPTLSSEVVHRVVEILKFFNTRTCQLVLGAGAMQPLSYPCSSASTFPFLVHLIFALAGTSFLNIQYHRASPVF

SEQ ID NO: 166184 - protein, 94 aa, Glycine max; identical to SEQ ID NO: 133574
  Coding DNA Sequence Number=SeqID_49406

SEQ ID NO: 166185 - protein, 193 aa, Glycine max
  Coding DNA Sequence Number=SeqID_49407
  Gene Ontology: Mol. function=two-component sensor activity; Cellular component=membrane; Biological process=two-component signal transduction system (phosphorelay)
  Homolog annotation: Hit_ID=Q47C60; Match level="QueryCoverage=95%, HitCoverage=25%, E-value=3e-48, Identity=51%"; Hit description =PAS:GGDEF
  Pfam annotation: Domain name=PAS; Domain location=11-127; Score=33.1; E_value=9.9e-07; Accession=PF00989.14; Description=PAS domain
  Pfam annotation: Domain name=PAS_3; Domain location=35-130; Score =109.7; E_value=8.5e-30; Accession=PF08447.1; Description=PAS fold
  Pfam annotation: Domain name=PAS_4; Domain location=17-132; Score =32.2; E_value=1.8e-06; Accession=PF08448.1; Description=PAS fold
  Pfam module annotation: Pfam domain module=PAS::PAS_3::PAS_4; Domain location=11-127::35-130::17-132
MESLLTAQQQRLLDTLLDNLDGMIYRCLYDSSWTMIYISKGCEPLTGYPAQELLLNKTISYENITHPDDREKARATIAAAIDKGERFELEYRIVRADGEEVWVAERGSAVLDPSGQPVALEGIIQDISSRKRIEHELFSTEQKYRSMFENSTLGMFQTTESGTYLNANPALAKLYGYASPAALISDLNNISSQ

SEQ ID NO: 166186 - protein, 415 aa, Glycine max
  Coding DNA Sequence Number=SeqID_49408
  Gene Ontology: Mol. function=hydrolase activity; Cellular component =extracellular region; Biological process=carbohydrate metabolic process
  Homolog annotation: Hit_ID=Q3W0W7; Match level="QueryCoverage=68%, HitCoverage=86%, E-value=1e-43, Identity=36%"; Hit description =Polyhydroxybutyrate depolymerase precursor
  Pfam annotation: Domain name=Abhydrolase_2; Domain location=107-298; Score=-67.2; E_value=0.0082; Accession=PF02230.7; Description =PhospholipaseCarboxylesterase
  Pfam annotation: Domain name=Esterase; Domain location=91-328; Score=- 59.0; E_value=0.067; Accession=PF00756.11; Description=Putative esterase
  Pfam module annotation: Pfam domain module=Abhydrolase_2::Esterase; Domain location=107-298::91-328
PVQHLTPPVAHPLKAVAIYSEGQNVAKIRLPAISRQQVKRWSTTHFTGAFMYALAILLSGALMISPKRLYYSVLLGLLSFPIWVWAQLAVGDYEFAVTINGDKRPYLVHVPMQSKAGQALPMVLVLHGGLGNMQVQANERFYHQVSAAEKYGYIVVFPNGYSRFPGGKFATWNAGNCCGPAVKKQSDDVAVIRAIIQEMQQRANVDAKRIFVDGMSNGGMMSYRLACELSETVSAIASVAGTDNTQDCQPARPVAVLHIHAKDDDHVPFNGGKGQQSMADVSFNSVAATVQKWVQLNQANAQAERIVEVAGAYCEIHRGGLAPVQFCVTETGGHSWPGGSKPRGGTAGSTAISANDVIWQPVRCDFVAMHTKVIIIEFLAVPGRPDQPIQACHSQFANAAVGPTKIEKVPVVHAA

SEQ ID NO: 166187 - protein, 73 aa, Glycine max
  Coding DNA Sequence Number=SeqID_49409
MRNNVNCMLSLPPAHVKVVPLGHMLVSPMSMAKCHAGFAAPIGEMSCSMPRGQQPEKAESMRIHVKSLFRSLD

SEQ ID NO: 166188 - protein, 199 aa, Glycine max
  Coding DNA Sequence Number=SeqID_49410
  Subcellular localization annotation: CTP_CleavageSite=33; ConfidenceScore=5.50e-01
MNIGALISGQMTSIAHSNTSRLGFPTLITTLCRARGVVSDSLTFECLSLSLQVVAPPGSIPSVEQFREMVAWPGTQPSLHMEDEGPTAQVPQHVEDESSEATIPEPFVQGGEAGETQVRQVAATTKRSLEVTLEPPTPVVDLPSSQCTIDPSTPILEILEDPTTPVLAMDTSPPATPVLHLTDEEDVQTQDTQDQSQKF

SEQ ID NO: 166189 - protein, 74 aa, Glycine max
  Coding DNA Sequence Number=SeqID_49411
MSNPIASKVDGESLISFAKYHQAKYLVTKSSCMPYIMKFFLLVASTNQVNLKGTYNPMSYRLDIHKQVKRDIVD

SEQ ID NO: 166190 - protein, 100 aa, Glycine max
  Coding DNA Sequence Number=SeqID_49412
  Gene Ontology: Mol. function=protein binding
  Homolog annotation: Hit_ID=Q1SRV7; Match level="QueryCoverage=79%, HitCoverage=27%, E-value=1e-15, Identity=60%"; Hit description=IMP dehydrogenase/GMP reductase
MKEEESTAIPIEDEDDPSSTLLDLTSYQLHDLDLVELPPNLTANRLSLLDPHIGNLSHLKKLSHCENLAVVPLSFPKTSSPLSSDFAEVLDVYERGDGLY

SEQ ID NO: 166191 - protein, 56 aa, Glycine max
  Coding DNA Sequence Number=SeqID_49413
MVLREYESGSESVRLGVGCARVREYERLDGTVVVVDTTVSGGGGFCWRKRRREREE

SEQ ID NO: 166192 - protein, 92 aa, Glycine max
  Coding DNA Sequence Number=SeqID_49414
MSITYDMGNCGLVLDRKYGSLALASVPRVTGQPSCITDYDQEKFHYVTWPCFMLFVTFLFAKSIASFFDSLIHVSDPICFQACSKTVLLLSP

SEQ ID NO: 166193 - protein, 207 aa, Glycine max
  Coding DNA Sequence Number=SeqID_49415
  Homolog annotation: Hit_ID=Q1RX00; Match level="QueryCoverage=43%, HitCoverage=16%, E-value=2e-42, Identity=91%"; Hit description =Pentatricopeptide repeat
  Pfam annotation: Domain name=PPR; Domain location=128-162; Score =19.7; E_value=0.011; Accession=PF01535.11; Description=PPR repeat
  Pfam annotation: Domain name=PPR; Domain location=163-197; Score =29.6; E_value=1.1e-05; Accession=PF01535.11; Description=PPR repeat
  Pfam module annotation: Pfam domain module=PPR::PPR; Domain location =128-162::163-197
MVNEARVAELIVGFVDAKAARDGHRWSVVVEEELGGVGEGLCEEKEEESDCFTLLNVFEACNTHPGEFGSPGRADPQLKFSASFLFGDCALRLGFEMEAKNKVKIEDSTTESPTSVLEDENWWDFGKMDFFMLITTYGKLGDFNGAEKVLGLMNKNGYAPNVVSQTALMEAYGKGGRYNNAEAIFRRMQKWGLEPSAFTYPIILKTF

SEQ ID NO: 166194 - protein, 183 aa, Glycine max
  Coding DNA Sequence Number=SeqID_49416
  Homolog annotation: Hit_ID=Q1RX00; Match level="QueryCoverage=44%, HitCoverage=14%, E-value=2e-37, Identity=93%"; Hit description =Pentatricopeptide repeat
  Pfam annotation: Domain name=PPR; Domain location=102-136; Score =19.7; E_value=0.011; Accession=PF01535.11; Description=PPR repeat
  Pfam annotation: Domain name=PPR; Domain location=137-171; Score =29.6; E_value=1.1e-05; Accession=PF01535.11; Description=PPR repeat
  Pfam module annotation: Pfam domain module=PPR::PPR; Domain location =102-136::137-171
ARDGHRWSVVVEEELGGVGEGLCEEKEEESDCFTLLNVFEACNTHPGEFGSPGRADPQLKISALFLFGDCALRLGFEMEAKNKVKIEDSTTESPTSVLEDEMDFFMLITTYGKLGDFNGAEKVLGLMNKNGYAPNVVSQTALMEAYGKGGRYNNAEAIFRRMQKWGLEPSAFTYQIILKTFVH

SEQ ID NO: 166195 - protein, 400 aa, Glycine max
  Coding DNA Sequence Number=SeqID_49417
  Gene Ontology: Mol. function=RNA-directed DNA polymerase activity; Cellular component=chromatin; Biological process=chromatin assembly or disassembly
MADATHNHVLEHEIEDRVENRLSSKIDERFMEMAASMQQTLHDSLTLSLALSISQQMHDLIRNNSKGKTHSPTGGSPIRGERSSYSCRTRLARIDFLRFSGSDVKQWLIQCDTFFSIDNTLEEFKVRLVVVHFEGKALQWHSSYVKSVGLQNLPPWSEYTRILIERFGKVCDDPMAELMQLGQKGSIGEYHEAFDDIVARLDLSEEHRLSCFSGGGLNKKSRVRMFQPNSVRRAFTLAKMHEAATVHGSVTKSWNKQSKPEVSSKPPLLPTPPKTISKTQDIPKIKQQASKTLTPAYMSDRRAKGLCYFCDEPFTPEHGLSHKTLQLHVMEVDELQEGAEEEVLLENSTGSSSIDPQISVHALTGIANFHTMRVTGYYQKKPLHMLIDSGSDVPSFSSIF

SEQ ID NO: 166196 - protein, 77 aa, Glycine max
  Coding DNA Sequence Number=SeqID_49418
MKTKIPEYPSISNPSKQQGLPSKSRSTWTIDLFALGGLVAKDRSHVTLRVHFKVDKDYDGTARGGGGGEAGGVAMGL

SEQ ID NO: 166197 - protein, 570 aa, Glycine max
  Coding DNA Sequence Number=SeqID_49419
  Gene Ontology: Mol. function=protein-methionine-S-oxide reductase activity; Cellular component=intracellular; Biological process =protein modification process
  Homolog annotation: Hit_ID=Q0WWY1; Match level="QueryCoverage=83%, HitCoverage=94%, E-value=1e-172, Identity=66%"; Hit description =Regulator of chromosome condensation-like protein
  Pfam annotation: Domain name=RCC1; Domain location=372-421; Score =11.8; E_value=0.038; Accession=PF00415.9; Description=Regulator of chromosome condensation (RCC1)
  Pfam annotation: Domain name=RCC1; Domain location=424-476; Score =32.5; E_value=1.5e-06; Accession=PF00415.9; Description=Regulator of chromosome condensation (RCC1)
  Pfam module annotation: Pfam domain module=RCC1::RCC1; Domain location=372-421::424-476
EHGITERACPFRNFGGNSWLEMAEESSGQHDATWKSNHVGIRRGTLLPLKMILGMAINNGGGSEEGALQTVLYMWGYLPGALPQRTPLLTPVAVRVPPCDYSWNDVCGGGCGFAIAISESGKLITWGSTDDLGQSYVTSGKHGETPEPFPLPTEASIVKAAAGWAHCVAVTEHGAVYTWGWKECIPSGRVFGEPSTGVSLEKDVPGRHSQVSTEQVSPRSQGSRSTGGTASSNSGEESTKRRRVSSAKQTAESSSSSDDSLTAFPCLVTLNPGIRIASVAAGGRHTLALSDTGLVWAWGYGGEGQLGLGSRIRMVSTPHLVPCIDSSYYSKDRSATLARGNMDSEGQTFRVPGSYIKRIACGGRHSAVITDAGALLTFGWGLYGQCGQGITDDELSPTCVSSILGIHIERVAAGLWHTVCTSADGDVYAFGENQFGQLGTGADQAEQTLPRLLDSPSLDNLRAKNISCGARHTALVTEGGKVFCWGWNKYGQLGVVLGISNIVVESSLLSCDFWALQLGLGDVVYPKMLLVVGGILFFWPSPPLDVMVYQRLLTQLLDSGSAMYMNIRAV

SEQ ID NO: 166198 - protein, 608 aa, Glycine max
  Coding DNA Sequence Number=SeqID_49420
  Gene Ontology: Mol. function=binding; Cellular component =intracellular; Biological process=metabolic process
  Homolog annotation: Hit_ID=Q2HS18; Match level="QueryCoverage=96%, HitCoverage=96%, E-value=0.0, Identity=77%"; Hit description =Tetratricopeptide-like helical
  Pfam annotation: Domain name=PPR; Domain location=183-217; Score =35.2; E_value=2.3e-07; Accession=PF01535.11; Description=PPR repeat
  Pfam annotation: Domain name=PPR; Domain location=285-319; Score =42.7; E_value=1.3e-09; Accession=PF01535.11; Description=PPR repeat
  Pfam annotation: Domain name=PPR; Domain location=386-420; Score =32.6; E_value=1.4e-06; Accession=PF01535.11; Description=PPR repeat
  Pfam annotation: Domain name=PPR; Domain location=423-457; Score=9.2; E_value=0.61; Accession=PF01535.11; Description=PPR repeat
  Pfam annotation: Domain name=PPR; Domain location=459-493; Score =21.4; E_value=0.0033; Accession=PF01535.11; Description=PPR repeat
  Pfam module annotation: Pfam domain module=PPR::PPR::PPR::PPR::PPR; Domain location=183-217::285-319::386-420::423-457::459-493
MVGGRQLAFENVAVGGKCKCLVFLAKQCSSSKTLQQVHAQMVVKSSIHSPNNHLLSKAIHLKNFTYASLLFSHIAPHPNDYAFNIMIRALTTTWHHYPLALTLFHRMMSLSLSPNNFTFPFFFLSCANLAVLSPARAAHSLVFKLALHSDPHTTHSLITMYSRCGRVAFARKVFDEIPRRDLVSWNSMIAGYAKAGCAREAVEVFGEMGRRDGFEPDEMSLVSVLGACGELGDLELGRWVEGFVVERGMTLNSYIGSALISMYAKCGDLGSARRIFDGMAARDVITWNAVISGYAQNGMADEAISLFHAMKEDCVTENKITLTAVLSACATIGALDLGKQIDEYASQRGFQHDIFVATALIDMYAKCGSLASAQRVFKEMPQKNEASWNAMISALASHGKAKEALSLFQCMSDEGGGARPNDITFVGLLSACVHAGLVNEGYRLFDMMSTLFGLVPKIEHYSCMVDLLARAGHLYEAWDLIEKMPEKPDKVTLGALLGACRSKKNVDIGERVIRMILEVDPSNSGNYIISSKIYANLNMWEDSARMRLLMRQKGITKTPGCSWIEVENHLHEFHAGDGLCLDSIDLSNIIDLLYEELKREGYVPKVVE

SEQ ID NO: 166199 - protein, 172 aa, Glycine max
  Coding DNA Sequence Number=SeqID_49421
MTGVSISWFPRWKEGEPGVLCSCYPMRGESSEKIITPFIERGFNEANAKILHKICKAWNRVGRKDKELRGGSNGVISDYHKWLKSRMQGIAWLPKLRSLSRKEAEILVESEEVQALKAELERTRLVKENLKTVVTRVRKECDELKDINMTTVEALEWETKRARKEEWSRNKF

SEQ ID NO: 166200 - protein, 400 aa, Glycine max
  Coding DNA Sequence Number=SeqID_49422
  Gene Ontology: Mol. function=zinc ion binding; Cellular component =cellulose and pectin-containing cell wall; Biological process =metabolic process
  Homolog annotation: Hit_ID=O22285; Match level="QueryCoverage=90%, HitCoverage=56%, E-value=1e-142, Identity=63%"; Hit description =Expressed protein
  Pfam annotation: Domain name=DUF248; Domain location=158-400; Score =232.9; E_value=6.9e-67; Accession=PF03141.7; Description=Putative methyltransferase
  Pfam annotation: Domain name=Methyltransf_11; Domain location=279 -374; Score=23.8; E_value=0.00025; Accession=PF08241.2; Description =Methyltransferase domain
  Pfam annotation: Domain name=Methyltransf_12; Domain location=279 -372; Score=18.2; E_value=0.012; Accession=PF08242.2; Description =Methyltransferase domain
  Pfam module annotation: Pfam domain module=DUF248::Methyltransf _11::Methyltransf_12; Domain location=158-400::279-374::279-372
  Subcellular localization annotation: CTP_CleavageSite=2; ConfidenceScore=5.64e-01
MKASISSNGDFLKIAFFFLFVAFTFFFVGKHFSDSSSQQLIFFSATTAAASTTTTAEVTISPNFNQFFNVAALIEAQTPKTNPSQQPPPPPPPPELLDTIKRFGILNDNGTMSDDFEIGHFEEGLPEDWGNDTVVEDSVSAPRIAVSKFGMCPRGMSEHIPCLDNAGAIRRLKSTQRGENFERHCPEEGKRLNCLVPPPKGYRPPIPWPRSRDEVWYNNVPHTRLVEDKGGQNWITRGKDKFRFPGGGTQFIHGADQYLDHISEMVPDIKFGQNIRVALDVGCGVASFGAYLLSRNVITMSVAPKDVHENQIQFALERGVPAMVAAYATKRLLYPSQAFDLIHCSRCRINWTRDDGILLLEVNRMLRAGGYFVWAAQPVYKHEEVLEEQWKGIIQLDFHS

SEQ ID NO: 166201 - protein, 237 aa, Glycine max
  Coding DNA Sequence Number=SeqID_49423
  Gene Ontology: Mol. function=zinc ion binding; Cellular component =cellulose and pectin-containing cell wall
  Homolog annotation: Hit_ID=O22285; Match level="QueryCoverage=93%, HitCoverage=30%, E-value=4e-98, Identity=73%"; Hit description =Expressed protein
  Pfam annotation: Domain name=DUF248; Domain location=1-228; Score =13.9; E_value=1.3e-26; Accession=PF03141.7; Description=Putative methyltransferase
YVNLKPCISQLPENGYGANVARWPVRLHTPPDRLQSIKFDAFISRNELFRAESKYWHEIIGGYVRALRWKKMRLRNVMDMRAGFGGFAAALIDQSMDSWVMNVVPISGPNTLPVIYDRGLIGVMHDWCEPFDTYPRTYDLLHAANLLSVEKKSDSLLLLHFSLVRCNLSSIMLEMDRILRPGGRAYIRDTLAIMDELIEIGKAMGWQVSLRDTAEGPHASYRVLIARAAGVGIVCII

SEQ ID NO: 166202 - protein, 552 aa, Glycine max
  Coding DNA Sequence Number=SeqID_49424
  Homolog annotation: Hit_ID=Q9LKB4; Match level="QueryCoverage=90%, HitCoverage=82%, E-value=1e-161, Identity=57%"; Hit description =Arabidopsis thaliana genomic DNA, chromosome 3, TAC clone:K15M2
NSWCTRDLRSYAGRSKKSGGAGSSGGRIEGNAEFRRRLKRNARARSKKYAESLFYRLKNPKGGGNYPDNFTEDELQQIGLGYDRMVRFMEKDDPNLRHPYDWYKYGQYGPYSWRGVVVGEPVRGRFSDECVTIISEVKDHEEWEQIEQGEMAEEYGEKLKQLDQSKLKYFWVFVRHPRWRISELPWQQWTLVSEVVLEAGKQRLDKWNLMGRLGNKARSSIGQCAAWMRPDIVYVKKPVFQCRFEPQDDFFKPIIPFLNPKTEQDFLFELENDDGSVELCTYFGGLCKIVKVNQKAFVDDVVNAYQKLSDEKKSKCLEFLLKNHPVELLHPYTKEWKAKLEEMELGCDAPDEEDDAIVDDPDETEVLDWIEDEGSDDDTNITDDDEDEEELIDDDDDDGDEDQDLVMDMEESEDGKFHAMEEDTLDEDEKDFNWNEEFQKALSSGEAMENLAKKALEFNKKLNKNQFMMNKVEEETALSVDGDETALRGKRAKVSQEEWKYIGVGPWRKKIKKSKIPPELFLRAVVRPFTYRNLVKEIVLTRHAILDGEIGA

SEQ ID NO: 166203 - protein, 73 aa, Glycine max
  Coding DNA Sequence Number=SeqID_49425
MALGEKLLKRGNGAGTWGPHTLPVTVTGITRHIQCNPSPSSYLSKPLIPTRGAVFYDPTRGPIGRIHGLSLTL

SEQ ID NO: 166204 - protein, 119 aa, Glycine max
  Coding DNA Sequence Number=SeqID_49426
MYNTTITYIGLLYSAHWQMVIILPKENLVVWFCSLHNRPDNYLKGIINSAFKGLDDTPQPKSKVGARWILLKQKGSTECGYYVMHWMSTIILGSFRNNWETYFNDGRPLESERLKALRI

SEQ ID NO: 166205 - protein, 105 aa, Glycine max
  Coding DNA Sequence Number=SeqID_49427
  Gene Ontology: Mol. function=NAD+ diphosphatase activity; Cellular component=peroxisome; Biological process=isoprenoid biosynthetic process
  Homolog annotation: Hit_ID=Q8ZAQ5; Match level="QueryCoverage=94%, HitCoverage=38%, E-value=1e-40, Identity=79%"; Hit description=NADH pyrophosphatase
  Pfam annotation: Domain name=NUDIX; Domain location=1-95; Score=24.5; E_value=0.00037; Accession=PF00293.18; Description=NUDIX domain
IYTVLAGFVEVGETLEQAVAREVMEESNVRVKNVRYVTSQPWPFPHSLMMAFMAEYDGGELQHDGKELLDAGWYRYDDLPLLPPPGTVARRLIEDTVALCRASAA

SEQ ID NO: 166206 - protein, 266 aa, Glycine max
  Coding DNA Sequence Number=SeqID_49428
  Homolog annotation: Hit_ID=Q47522; Match level="QueryCoverage=19%, HitCoverage=70%, E-value=4e-14, Identity=70%"; Hit description=LacZ protein
VPPVQLLTGWCVTAKAPPDISAGKCSGHAARRVPFAIQAAQLLGRAIGAGLFAITPAGERGMCCKAIKLGIRFQEKFRGLKETIRGALDEKLFNAIAAAIQNVDNQTLDQLIASLGATQWNALKATDAFNGMLGAMRGEAWRDEVEWIRLTRGEYAAWMAERGAEINARGGPDKMDPAQRAEFNRDAARKSSLSIPSTSRGGPVPAFVPFSEVGKPVVPAALMNRPTRGERRFAYWALAECILAYYVGTDEGVSEVLHVAGEKRLH

SEQ ID NO: 166207 - protein, 185 aa, Glycine max
  Coding DNA Sequence Number=SeqID_49429
VGLLAKQLAEKSSSSFGANIEKNPKEECKVVMTRSRKLMAAEDKDIVALKEQVVLKDTTDKENDEVKDERSQWREKQIIVGKKEIKDNEKEIKGEKQKEKEEFEKYKEEKKSKSEKAREKRKETTSDEGKEMPYPLVPVTTYPSVGGRRVTRGMRLPRKEYERSRHQRLFEENVRKTGKDVVYEL

SEQ ID NO: 166208 - protein, 173 aa, Glycine max
  Coding DNA Sequence Number=SeqID_49430
  Homolog annotation: Hit_ID=Q1SKD7; Match level="QueryCoverage=90%, HitCoverage=41%, E-value=2e-14, Identity=30%"; Hit description =Ankyrin
MAPRKLASKRSRKDKAAEGTSSAPEYDSHRFRSVVHQQRFEAIKGWSFLRERRVQLRDDEYTDFQEEIGRRRWAPLVTPMAKFDPEIVLEFYANAWPTEEGVRDMRSWVRGQWIPFDADAISQLLGYPMVLEEGQECEYGQRRNRSDGFDEEAIAQLLYMDDVAPQQHPAHRS

SEQ ID NO: 166209 - protein, 98 aa, Glycine max
  Coding DNA Sequence Number=SeqID_49431
MLDDEPFIQVKRSFAIGAGVVTSFGYHERTPSPPPHRDDSALMNEVLSELRGLRTYVGERFDSLDTRFAGMDIRLTQLEEDVGYIHQSFDLPPPPPPS

SEQ ID NO: 166210 - protein, 234 aa, Glycine max
  Coding DNA Sequence Number=SeqID_49432
  Homolog annotation: Hit_ID=Q9AVH2; Match level="QueryCoverage=35%, HitCoverage=41%, E-value=2e-39, Identity=70%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPC

SEQ ID NO: 166211 - protein, 438 aa, Glycine max
  Coding DNA Sequence Number=SeqID_49433
  Gene Ontology: Mol. function=nucleoside-triphosphatase activity; Cellular component=integral to membrane; Biological process =chromosome segregation
  Homolog annotation: Hit_ID=Q2KWD9; Match level="QueryCoverage=100%, HitCoverage=55%, E-value=0.0, Identity=85%"; Hit description=DNA translocase precursor
GRQRLRLVGRQRERIRDRLLALDGVADLGVVAGQVAHAHLAHQAVALFHLAHAPVQRVGGMAHVRDHRRQQMRNAFVDAHFEHLRVDQDQAGVRGVGLVQQRQDHGVDPDRLARPGGARHQQVRHLGQVGHHRIAGDVLAQRHGHDRMAGVIGLRPQDLGQLDHLAARVGQLQAHQVLARNGFHHPDADQAERARQVLGQIDDLAALDAGGRLDFVTRDDRTGLRRHHGDGHAEVGQLLFDQARGEFDGLGRHGFLVGQRRIQQADGRQVALAARRRREEQRLLLFLFDAFGLGHHRDRRLDAHRLLVHQLFLLGHHLLGAHGLGHLADLAVFARGVGIAHPAHQAFDPGADALGHGQPREREEQAQPDRQHHQEGQGAAGEADAAAHQIGQGMADDATGAAGAFRGARQMRAAAGQAQGFHAQRADQQQEETDALFP

SEQ ID NO: 166212 - protein, 66 aa, Glycine max
  Coding DNA Sequence Number=SeqID_49434
MTGPLDGPTSCFLIKVDPWVLVPITFRGPYVLAIRGLHALAFRGLRVLIFSVLHIHTLEEYKVLCP

SEQ ID NO: 166213 - protein, 110 aa, Glycine max
  Coding DNA Sequence Number=SeqID_49435
MPISPCRCISWDRAHKTPNGPEDVQQGPGVSSSGYGPLTVLQGTRSPSEESHPQRHPVDPEKSNRALGFPALVTGLCSPTGCPFPPARDRARKTPSGPEEVQQGLEVSKL

SEQ ID NO: 166214 - protein, 81 aa, Glycine max
  Coding DNA Sequence Number=SeqID_49436
  Subcellular localization annotation: CTP_CleavageSite=27; ConfidenceScore=5.07e-01
MLLNNNVIHIHVRVVMLVRMIRTRLFAAARVKSCPSMHTRCVIASLFGCARTVGRPPISGGGPGTDKRKLTGPLTGSASLG

SEQ ID NO: 166215 - protein, 100 aa, Glycine max
  Coding DNA Sequence Number=SeqID_49437
MEKMRKKNRYTSVELLGSRQNVNSNCPCDICNIICIMLDSGFEVAQGNFHFASVVKILRVECCVASSGKENHKFLVQSNVNFHVPLKSSTLSFASCRHHT

SEQ ID NO: 166216 - protein, 189 aa, Glycine max
  Coding DNA Sequence Number=SeqID_49438
  Homolog annotation: Hit_ID=UPI000044A741; Match level="QueryCoverage =23%, HitCoverage=11%, E-value=2e-08, Identity=70%"; Hit description =PREDICTED: similar to Ac1147, partial
MELTEGTNRSRSMQLNLSQHGETYQGGGAWPFLVGGAICLVNSVNETRPQPAKIAMWRSVMPLDIIAIVGLQRGIPSKRESSARVDYVPALCTHRPSLLPIEWSGEVFGLRRRERFAARDVVNLRKDHCRCLTIRLTRELVYSSTVGREGMTTAPRAPGLLVLATNTNPGASCAKELKSVKCDSRGPGD

SEQ ID NO: 166217 - protein, 125 aa, Glycine max
  Coding DNA Sequence Number=SeqID_49439
MEESNRENNKDHISQSRGSALHGEEHIGEWRNPIGKITKITFPSQEGPFSTGKNTLEIGGFNRENNKDHISQSRGSALDGEEHIGEWRNPIGKITKITFPSQEGPLLTVKNTLENGGIPSGKQQI

SEQ ID NO: 166218 - protein, 101 aa, Glycine max
  Coding DNA Sequence Number=SeqID_49440
MRLASNLWGSRLDGGGCMNDNQFMGLRIRFEGGEYTNSARQAFRGAPDSMAIHSWGSVLHGGGCMDDNQFMRLGIRFVGGGYTNRAGQAIRGVPDSKVQDA

SEQ ID NO: 166219 - protein, 167 aa, Glycine max
  Coding DNA Sequence Number=SeqID_49441
  Gene Ontology: Mol. function=helicase activity; Biological process =proteolysis
  Homolog annotation: Hit_ID=Q9LTU4; Match level="QueryCoverage=99%, HitCoverage=11%, E-value=2e-48, Identity=52%"; Hit description =Helicase-like protein
MREWFAYRLQCRPNEGQTLLHSRKLFQQFVAEGYTMIESERLSYVRNNQKKLRVDKFCSLQQSFEAGNIEGLAQGKRIILPLTFVDSPRYMDQLYFDGIAICSHVGFPNLFITFTCNPNWPEIHRLLIPLNLTAIDRPEIISRIFKLKYEQMLSDLTKNHLLGKVVA

SEQ ID NO: 166220 - protein, 114 aa, Glycine max
  Coding DNA Sequence Number=SeqID_49442
VSEDGTWPRIQHSLHREDKGPTAQVPQHVEDESSGATIPESFIIGEEVGETQVRQIADATPERSLEATSEPPAPVDSTTPILTLDTSPPATPILHLTDEEDVQTHDTQDQSQEF

SEQ ID NO: 166221 - protein, 146 aa, Glycine max
  Coding DNA Sequence Number=SeqID_49443
  Gene Ontology: Mol. function=transition metal ion binding; Cellular component=cytoplasm; Biological process=fucose metabolic process
MGCKNSLTLLSVVLCLVNVKARYGWSDKIFSSLLEVVHNLLPEDNMLPKTYYKAKKILCPMGMEYEKIHACPNDCILYRHDFQEMSKCPIYGTSWYKVEDEEESSSDENSNKGPPVKVLWYLPIIPRRLMVCIRILGKSQEILDLD

SEQ ID NO: 166222 - protein, 142 aa, Glycine max
  Coding DNA Sequence Number=SeqID_49444
MAEQAKQVFYVQDPYDERWHMATPPNSPPPLLESAAHLLSTPKKTRKATQLRSLATRLVEAERPMVHVDPATGNVVDLHRKKLRMYLGIVTRHKVDVTIDNWKQVHAAQKDLIWEDIQVEFDIPEASNLRMKKKIFQTVGER

SEQ ID NO: 166223 - protein, 121 aa, Glycine max
  Coding DNA Sequence Number=SeqID_49445
MALACDFCKETTHGVFWVRIGSEIPLAIYTLGMMAKYLDVLEIPRCAHVQFLVPQNAWSMHVCEFSQGDVWDVICHFCLKSNVPLVKLTFRMFAFAGMAPRKLASKRSRKDKAAEGTSSAP

SEQ ID NO: 166224 - protein, 205 aa, Glycine max
  Coding DNA Sequence Number=SeqID_49446
  Homolog annotation: Hit_ID=Q8TGM6; Match level="QueryCoverage=44%, HitCoverage=74%, E-value=2e-10, Identity=40%"; Hit description =Protein TAR1
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHITGPHPLPSRQFQALFDSPFKVLFIFPSWYLFAIGLSPVFSLGRNLPPDWGCIPKQPDSPTAPRGATGSGHDGALTLSGASGNN

SEQ ID NO: 166225 - protein, 196 aa, Glycine max
  Coding DNA Sequence Number=SeqID_49447
  Gene Ontology: Mol. function=DNA-directed DNA polymerase activity; Cellular component=DNA polymerase III complex; Biological process =DNA replication
  Homolog annotation: Hit_ID=Q9SB72; Match level="QueryCoverage=95%, HitCoverage=24%, E-value=2e-39, Identity=45%"; Hit description=DNA polymerase III like protein
MIYVSAFSRALRHHFAKIKDADSAIRLEKIWVEEGLQSEQVALDFIVARSYGSFRDVETMLDQLSLLGKIITISLVHKLYVLPFVFLLTGVISDHELLDLLDLALSTDTSNTIVRAQELVRTRIDPLQLISQLENLIIDILVAEADLQKLSHASRILSKIEKKLRISKNQTTWFTIALLQLNSLEYSSADTNDTNL

SEQ ID NO: 166226 - protein, 77 aa, Glycine max
  Coding DNA Sequence Number=SeqID_49448
MDTDVDICNTFPKGDNLEHLATTGLGVQEDHKGTLDSIWYKAIEMCLSSKLKTLTNNMRSTSSSPLMIKIASRIMLK

SEQ ID NO: 166227 - protein, 292 aa, Glycine max
  Coding DNA Sequence Number=SeqID_49449
  Homolog annotation: Hit_ID=Q47522; Match level="QueryCoverage=21%, HitCoverage=82%, E-value=4e-21, Identity=74%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFPIGRTWAERRHFVGRCRPTDGEHVDHGRLPAQDCAVDATAMLEDLGLSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 166228 - protein, 158 aa, Glycine max
  Coding DNA Sequence Number=SeqID_49450
MEVVAHAIVAGVSVFLSLPLYLFFFLLRGSYAAPLGVLQYLVASNPDLGGFVGGSLMVGLGAFFLLVALLFDLSNFIPEFGHFFNLDVALGLLAQLVHATRMTVCPNMSMNFLRDSLSACRKLAKAAEVMLVSKLSIDLGGSIPYQVNVAPLRDVGKT

SEQ ID NO: 166229 - protein, 150 aa, Glycine max
  Coding DNA Sequence Number=SeqID_49451
MIGEVPIELRTLLEFRFKLQLDELFDGFWAFVRGVVSRIYIKFVFPTCLVDDQGSDRRSFVHAYDLSALSCCGMRLGRLPGKRIWCYLQALYIALSCLLLDVSGIALADEDLGHHEVCNDDGDNHGVVLVNEVDTLEVLIRENDRKETSL

SEQ ID NO: 166230 - protein, 137 aa, Glycine max
  Coding DNA Sequence Number=SeqID_49452
MQSSKRDVYLGAYLNGGHWQMVVILPKEHLVVWFCSLHNRPDNYLQGIINSALKGLDDALQPKSKASARWIVVKCNRQKGSTECGYYVMHWMSTIILGTFRNNWEAYFNDPRPLEPKRLKALQIQWAQFYLRCRDQT

SEQ ID NO: 166231 - protein, 168 aa, Glycine max
  Coding DNA Sequence Number=SeqID_49453
  Gene Ontology: Mol. function=chitin binding; Cellular component =extracellular region; Biological process=chitin metabolic process
  Homolog annotation: Hit_ID=UPI0000612705; Match level="QueryCoverage =81%, HitCoverage=91%, E-value=2e-13, Identity=31%"; Hit description =UPI0000612705 related cluster
MSKSCGFGMTGPLDESISCFLIRVDPWVLVPITLRGLHVLAIRGLHVLNLRGLHVLAIRGPHVLALRGLHALTSRGLHVLALRGLHALTWVTLALRGLHVLANRGLHALTSRGLHVLALRGLHALTLGTSYPRLRRTTRPRQQRAARPPFQRTTCPRLERATRPHLGY

SEQ ID NO: 166232 - protein, 43 aa, Glycine max
  Coding DNA Sequence Number=SeqID_49454
HCFSAAALPAGGAAHNCTDHFFASHPADKISTGATSNKPDTAI

SEQ ID NO: 166233 - protein, 41 aa, Glycine max
  Coding DNA Sequence Number=SeqID_49455
MGVNLFHDPWPQGVSWAVVETRFSDMDFFEMVNHFFNRERE

SEQ ID NO: 166234 - protein, 180 aa, Glycine max
  Coding DNA Sequence Number=SeqID_49456
MVMRKKLFSAEDRQHWHVDNGQLQLLLRIVSIWSLNGCTLFANKSVTHTSVVFLDELRDLNQSRGFSWEAAALSWIYEHFPSIGNMIANEDYHESKPHACRWKCEKALSVTTYHKRLDRLMENFGYVQSIPPLPGDYSSPSLSTEDIDDRWLHFSQYLALIEEFVTFLVNVLQAIWSDFI

SEQ ID NO: 166235 - protein, 182 aa, Glycine max
  Coding DNA Sequence Number=SeqID_49457
MASRDQVWSFCTHDTRRYLTVIRPPLPFRHSRVRWQAETKFGHSAHMIRGDTLRLSAPPLPFRHSRVRWQAETKFGHSAHMIRGDTLRLSAPPLPFRHSRVRWQAETKFGHSAHMIRGDTLRLSTPPLPFRHSRVRWQAETKSGHSAHMIRGDTLRLSAPLCHSDTVVFDGKQRPSLVILHP

SEQ ID NO: 166236 - protein, 205 aa, Glycine max
  Coding DNA Sequence Number=SeqID_49458
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=97%, HitCoverage=12%, E-value=7e-52, Identity=47%"; Hit description=Chromo
MTSAEMQLRRERGLCFTCDDKFSPSHRYPNKQYFFPQWEEEDEPALQPDPPDEVETAGDPSLQDHHLSYNALKGSSGLRTMKFQGSINGLGVEILLDSGSSDNFLQPRLAQCLKLPVEPIPNLQVLVGNGNALTTEGLIQDLEVKIQGHTLKLPVYLLPVSGADLVLGAAWLATIVPDLSDYSTLTLKFYLGNQFITLHGERPSL

SEQ ID NO: 166237 - protein, 43 aa, Glycine max
  Coding DNA Sequence Number=SeqID_49459
MKFGGIIPFLISMTRGVTTHSLRIQTTECGGGTATVRYRLISK

SEQ ID NO: 166238 - protein, 91 aa, Glycine max
  Coding DNA Sequence Number=SeqID_49460
MTRRVELVSGMLRIPIGGIKRKSKKKKIGSCGSQFGVEMREIWCLEDWGKRGTSRGGVAAHHCWFSLAFIEKTTGNRLQDIVIDYKVDVLL

SEQ ID NO: 166239 - protein, 124 aa, Glycine max
  Coding DNA Sequence Number=SeqID_49461
  Subcellular localization annotation: CTP_CleavageSite=29; ConfidenceScore=5.08e-01
MTQGSFVPHGRDDILNMAIGKPEHLGRVRAAGSGMTLTQFYGRATRTSSSSSATLMQQQWVDIIGNIKEQVRNEYEEQHKRSLEEFKKELSSQIFIQLSQMGSQYSPLIEVDLQALAARLSTKG

SEQ ID NO: 166240 - protein, 92 aa, Glycine max
  Coding DNA Sequence Number=SeqID_49462
  Homolog annotation: Hit_ID=Q40452; Match level="QueryCoverage=55%, HitCoverage=11%, E-value=2e-17, Identity=76%"; Hit description=A membrane-associated salt-inducible protein
MIESEMIVDMGTAVHWSRCLRKIERTGGELTEALQKTFPPDWTSHNVLDVNSETETADLQIDDEDEDEDDVHYNVNGINNDDDDTDDDTVIS

SEQ ID NO: 166241 - protein, 64 aa, Glycine max
  Coding DNA Sequence Number=SeqID_49463
VHCEGCQGMAQDLGAIAEDLERVINLRMVTKGTDLYDIMTRCLRRTRGDTTDGSLRPRQRRRID

SEQ ID NO: 166242 - protein, 114 aa, Glycine max
  Coding DNA Sequence Number=SeqID_49464
MCGKRHRSSRSKTLPHVLSHGGYEYLEQKLMAENTKKKLKEAAQSKSTEVVMDPPSPIRRHVKWKMARAKKTGQMTFEAAKEIAEKIDVLTAAIGRPEHPGRVRTAGASVTIKQ

SEQ ID NO: 166243 - protein, 206 aa, Glycine max
  Coding DNA Sequence Number=SeqID_49465
  Homolog annotation: Hit_ID=Q1SS89; Match level="QueryCoverage=42%, HitCoverage=19%, E-value=3e-14, Identity=77%"; Hit description =Integrase, catalytic region
MDAVDRILCYLKSSPGKRLIFSKNNHLSVEGYTGADWAENHDQTKHVEVDKHFIKMNLEEKIIRFPLVKSEDQLADILTKAVSEAKLHEKSRLIQRCFDDNKDDDKGDDKKLKGQSKNEFKMFKIESRTLQDSRGKLISRIKNQDSRIKLPRIKIKIQESREDLIKISMKRFFQKLSSTWIFLKTCLPKRFYSLVIDYQIVVIDYQ

SEQ ID NO: 166244 - protein, 81 aa, Glycine max
  Coding DNA Sequence Number=SeqID_49466
  Subcellular localization annotation: CTP_CleavageSite=42; ConfidenceScore=5.47e-01
MHIAAYGTKEFLIPQNFSVLAIQPIGFVPMNASSSTFLVQICASSISNTSFPSKIRQVSSESLPNISCYELQNNIEESGLY

SEQ ID NO: 166245 - protein, 268 aa, Glycine max
  Coding DNA Sequence Number=SeqID_49467
MEGAATHWFYIWSQNNLDSDWESFSTALIKRFEDHHGNHIFERLNILKQEKSTKTKTHIKKWETSTKFLKWKTGISEWKHMLHKILNEEVDSHASQQDKNSMEGSGLEFSKAKASSWARKVELPSFDRNIERGTDLKGSSFECDSDPLQYLNSENRSKEDLIKKEVEIGDSTKPHCFQDSDFHKKIVMVKQKSFMKVVGTTMVLKSRNVNLLGEPLALNFVASMADSLAMELRQKECTEPVKLIKVIWSPPLSLPPPDLSFAGVVGRS

SEQ ID NO: 166246 - protein, 104 aa, Glycine max
  Coding DNA Sequence Number=SeqID_49468
MVIKLEVEDNLIFGHQFFFMKVLESWVSNRWHTIVDGDLPLDEKKLVFKVDVLLLPFNFFSDQKLPCMAIKPKVEDNFISGHQFFFYQDTGTMGQQLMAHHRGW

SEQ ID NO: 166247 - protein, 198 aa, Glycine max
  Coding DNA Sequence Number=SeqID_49469
  Gene Ontology: Mol. function=metallopeptidase activity; Biological process=proteolysis
  Homolog annotation: Hit_ID=Q7N103; Match level="QueryCoverage=99%, HitCoverage=41%, E-value=3e-74, Identity=65%"; Hit description =Aminobenzoyl-glutamate utilization protein B
MTDTQMEVRFDKACSNYVPNRSLERAMYQNLCDFGLPEYSDAERRFAEEIRQTLSRDDLRNAKLNIARTGGAAGREWVQLLGEKVLMDEVAPYVESDDLLYGSTDVGDVSWVAPTAQCFSPCFALGTPLHTWQLVAQGRTAIAHKGMCLAGKVMAATAIDLLSDSALLARCRSEFERRRAEQPYRCPIPQGVKPSPLK

SEQ ID NO: 166248 - protein, 119 aa, Glycine max
  Coding DNA Sequence Number=SeqID_49470
MKRVLADVLKDQRNLGNKGYRGWKSEILGQIEFDWDDTKHMITIENENAWNEYCIVLQNWGDIVDLCAKDRAIGHGAETTMDVDEAMSRETNEVEFMGLGATATIYLEEPSFNTEGKRQ

SEQ ID NO: 166249 - protein, 84 aa, Glycine max
  Coding DNA Sequence Number=SeqID_49471
MASYGVRPQEAKEYPLMKKIQGLQAPHGATSFTCYTPLPNHIVTLCAYPSCFTCLMKSTQKREQPPKLSASQKREQPPKLRTVL

SEQ ID NO: 166250 - protein, 74 aa, Glycine max
  Coding DNA Sequence Number=SeqID_49472
LTTVLNVLKNKDVVSNLENCNYGLLFDAKYMATVFSMGAYGSESMGWLMAKHAYMKLILCVHLLHHCDICTMHN

SEQ ID NO: 166251 - protein, 373 aa, Glycine max
  Coding DNA Sequence Number=SeqID_49473
  Gene Ontology: Mol. function=DNA binding
  Homolog annotation: Hit_ID=Q1S0F5; Match level="QueryCoverage=53%, HitCoverage=49%, E-value=1e-23, Identity=33%"; Hit description=IMP dehydrogenase/GMP reductase
MGSNQAPLSKKRFYQVKIKSLEVAILQELGQLMDQPQRQAFHKTYGKIWDLVMIELVPTVEEFEEILGCPLRGRRPSLFWVLSLHGKNSQVPRKLLGEKAKALADQGEWASFTDVLALLIFGVILFPNVDGLVDLAAMDAFLAYHHSKESPIAAILAAVYDTFDRRCEKSNAIIVCCTPALYVWLVSHLFCHERASINWFPRWKEGKVGVLSSCKGFPNIPLLGMRGCINYNPVLAIRQLGYPMRGASSKESITPFIARGFSDPNARILQGVRKAWELDWLPKLKVSSEEEAETPEEGEEVQALKEKLEKAQLVKEKFKIMAIKVKKKCDKLRDINIATTKALERETKRARKEEHGRNKFRGALWGRNNDLKL

SEQ ID NO: 166252 - protein, 285 aa, Glycine max
  Coding DNA Sequence Number=SeqID_49474
  Gene Ontology: Mol. function=DNA binding; Cellular component =intracellular; Biological process=DNA integration
  Homolog annotation: Hit_ID=Q1S3H4; Match level="QueryCoverage=71%, HitCoverage=58%, E-value=5e-50, Identity=39%"; Hit description =Integrase, catalytic region
MGDSSDYAVEVVLGQRKNKVFHVIHYASKVLNEAQSNYATTEKELLAVEFDLEIKDKKGSESHVPNHLSSLTINEVTTQGPEIQEGFPDEKLFNIAKGHANNLLRRYVTQAEARSILWHCHSAPHECHYNGEMTVLKVLQSGFYWPTLWTLYRRNEMPLENILEVEAFDCWGINFIGLFPSSYSHEYILLVMDYKNIFSKFGTPSDASSIGACRPRIFFINGFLCFLEDEWQRNGERERERRRHFKEKMSLEEAHHHRRPWIRAWRKKEMNEGRGREEHEILCSK

SEQ ID NO: 166253 - protein, 255 aa, Glycine max
  Coding DNA Sequence Number=SeqID_49475
MHHSHTSMFFIGCKELGSMSTPRFVQVQNKHPFPPYGLPNYTPPNVAHTLDENVNNSTPILIESQQTQSDHAHIPQPMGETHEIPHHNLVDFEPRLRYAPEGQAIGGVPPPNTLEGPQFRLQLQPLHFAVGKVPPAMVEKEKLDHIEERQRAIEEDGDHVFANMAELCLVPDVIIPPKFKVPNFDKYKGTTYPKNHLKMYYRKKGAYAKDEKLLIHFFQESLTGAVVTWYTNLEPSRVHSWKDLMVLLLGNIGIL

SEQ ID NO: 166254 - protein, 83 aa, Glycine max
  Coding DNA Sequence Number=SeqID_49476
  Gene Ontology: Mol. function=carboxypeptidase activity; Cellular component=cytoplasm; Biological process=fucose metabolic process
MEYQKIHACPNDCILYKHEFEEMSKCPRCGVSRYKVKDDEECSSDENSNNGWPPSEDVAKDLTWHANGSNYDGMVYHPADCSY

SEQ ID NO: 166255 - protein, 211 aa, Glycine max
  Coding DNA Sequence Number=SeqID_49477
  Gene Ontology: Mol. function=GTP binding; Cellular component =intracellular; Biological process=regulation of progression through cell cycle
  Homolog annotation: Hit_ID=Q5ZCV4; Match level="QueryCoverage=75%, HitCoverage=28%, E-value=9e-44, Identity=56%"; Hit description =Putative nucleostemin
  Pfam annotation: Domain name=GN3L_Grn1; Domain location=16-95; Score =92.3; E_value=1.5e-24; Accession=PF08701.1; Description=GNL3LGrn1 putative GTPase
MVKKSKKSKSKRVSLKKKYKVIRKVREHNRKKTKEAKKLRLSGKKKVEKDPGIPNDWPFKEQELKALEARRAKAIEELEQKKAERKERARKRKLGLLEDEDNSKLSDMDILKESNDFATVGKTRDSSDRAFYKDLVKVIEASDVLLEVLDARDPLGTRCVDIEKMVMKSGPDKRLVLLLNKIGSLLITFILFPFYCLEYLFFHWLIIWLLK

SEQ ID NO: 166256 - protein, 491 aa, Glycine max
  Coding DNA Sequence Number=SeqID_49478
  Homolog annotation: Hit_ID=Q2P4X1; Match level="QueryCoverage=25%, HitCoverage=5%, E-value=1e-48, Identity=77%"; Hit description=PilL protein
  Pfam annotation: Domain name=Hpt; Domain location=339-440; Score =52.9; E_value=1.1e-12; Accession=PF01627.13; Description=Hpt domain
MPSAFDAEPDLIAEPQLLAEDALEPVPAAAEPQPLDVAADSGLDVGELTASDDLSRYFDAGWASVPGEAEPAVADIGTIESIQPVESAPVVEVADVDAVPTIATVEDADLTVADDLSPYLDARALPVDDRDAEELPVSADVDAIDLNTSLSFDSGRGDDRVIDDAAALPLDSELSSLQDEMAVPGFAEPVTLAAALEAGLHVIEEEQTLDDYGQWFVIGLQASELAPGEADAFAEDADVGGEAAVGEGESADQPSPATVIEEITAEPPQGSAAVVRFFEMEEAPGQGMVEADADADADADAEIAEADVTPRAPHLEQAPDAADAEDGADALDFSVYDRELVDIFVEEGKDLLDHCDGLISELRDAPQDREVLAGLQRDLHTLKGGARMAGINAIGDLGHSIESLLEAVAAGRTEIERRDVQLLERGFDRLHQLLTRTGDHRVVEPAQDLVDAFEVRTTTDIAAAAAANVASVAETDSAPVASPAPALLDAP

SEQ ID NO: 166257 - protein, 213 aa, Glycine max
  Coding DNA Sequence Number=SeqID_49479
MPFPEVPFFCMGLCKPYVMVSKKHKASTSQARPQEPKQEWDSTKFTLEVAWHKYQENVHLRNILPKRNLQLTYSDYDEFLKEFERRHWDRMFTRLPEKNTDVALVRELYSNIYDPEDDSPKQCKVRGKVIKFDAQTLNTFLEMLVAIEAKLYLPGGSFIMNVEGAPWKIHRLGSSSSLDSFASWKMNDSGMEKEEREETPLQGEDESRRSSPP

SEQ ID NO: 166258 - protein, 38 aa, Glycine max
  Coding DNA Sequence Number=SeqID_49480
MGRVNLGLNVRMVVMTCGKAWAEQMRKMSDKGESKSHF

SEQ ID NO: 166259 - protein, 215 aa, Glycine max
  Coding DNA Sequence Number=SeqID_49481
  Gene Ontology: Mol. function=adenyl-nucleotide exchange factor activity; Biological process=protein folding
  Homolog annotation: Hit_ID=Q8PAL0; Match level="QueryCoverage=38%, HitCoverage=48%, E-value=2e-31, Identity=80%"; Hit description =Protein grpE
  Subcellular localization annotation: CTP_CleavageSite=74; ConfidenceScore=5.44e-01
HRRTSALASVAVTLRVTTTPAALNAPLQGASHSPFRLRNCWEGRSGFPSHDVVKRRPVNCNTTHYRANWSSTAVAAALELVDPPGCRNSILQQLLVGQLQALAQRMRVIAGRLQAGIQAVEHRQQLAQQLLVGELAGLLDVTGNALALVLEVGALTQRIGLDLLDLGAQALHFVVDAGGGGRIGGSLLGFDISSLSIPSTSRGGPVPAFVPFSEG

SEQ ID NO: 166260 - protein, 190 aa, Glycine max
  Coding DNA Sequence Number=SeqID_49482
  Gene Ontology: Mol. function=DNA binding; Cellular component =mitochondrion; Biological process=DNA integration
  Homolog annotation: Hit_ID=Q1S3H4; Match level="QueryCoverage=99%, HitCoverage=38%, E-value=5e-62, Identity=52%"; Hit description =Integrase, catalytic region
MANFKAVGIIPKDLTWQQQNFFFHDARFYIWDDPHLFKVGANNLLRRCVTSEEAKGILWHCYNSPCGGHYDGDKTATKVLQSGFFWPTLFKDAHHHVLMCDQCQRMGGISRRNEMPLQNIMEVEVFYCWGTDFMVPFPSSVGNEYILVTVDYVSKWVEAVITPGNDAKVLLQKVLSQYHVNHKVASLYHP

SEQ ID NO: 166261 - protein, 442 aa, Glycine max
  Coding DNA Sequence Number=SeqID_49483
  Gene Ontology: Mol. function=nucleoside-triphosphatase activity; Cellular component=intracellular; Biological process=protein metabolic process
  Homolog annotation: Hit_ID=Q9WY41; Match level="QueryCoverage=98%, HitCoverage=53%, E-value=1e-173, Identity=70%"; Hit description=ATP -dependent Clp protease, ATPase subunit
  Pfam annotation: Domain name=AAA; Domain location=29-222; Score=48.0; E_value=3.1e-11; Accession=PF00004.19; Description=ATPase family associated with various cellular activities (AAA)
  Pfam annotation: Domain name=AAA_2; Domain location=362-442; Score =77.5; E_value=4.1e-20; Accession=PF07724.4; Description=ATPase family associated with various
  Pfam annotation: Domain name=AAA_5; Domain location=29-168; Score= -10.9; E_value=0.012; Accession=PF07728.4; Description=ATPase family associated with various
  Pfam annotation: Domain name=UVR; Domain location=243-278; Score =30.4; E_value=6.3e-06; Accession=PF02151.9; Description=UvrBuvrC motif
  Pfam annotation: Domain name=Zot; Domain location=31-198; Score= -63.9; E_value=0.062; Accession=PF05707.2; Description=Zonular occludens toxin (Zot)
  Pfam module annotation: Pfam domain module=AAA::AAA_2::AAA _5::UVR::Zot; Domain location=29-222::362-442::29-168::243-278::31-198
MKGELDPVIGRENEIERLMQILVRRKKNNPVLIGEPGVGKSAIVEGLAQKIVSGEVPEPLKGKTIFSLDVAAIVAGTKYRGEFEKRMKKLLQVVKGNKDIILFIDELHMIVGAGSAEGAVDAANILKPALARGELHCIGATTPDEYRKYIEKDAALERRFQKIYVQEPTPQMALDILKGLKAKYESHHKVKYTDKALEAAVYLSQRYITDHFLPDKAIDVIDEAGSRARLKLFVMPSELQLLKLQIESVKREKEEAVNNQDYEKAAELKAKEQELREKFNEDYNKWKREIESVIAIVDTPDIEEVVAGWTGIPLQKLEETEREKLLKLEEALHERVVGQDEAINAISRAIRRARSGLKDPRRPVGVFLFLGPTGVGKTELAKALAEYLFGDEKALIRFDMSEYMEKFSVSRLIGAPPGYVGYEEGGTLTEKVRRRPFLCHII

SEQ ID NO: 166262 - protein, 85 aa, Glycine max
  Coding DNA Sequence Number=SeqID_49484
  Homolog annotation: Hit_ID=Q8H6S5; Match level="QueryCoverage=86%, HitCoverage=6%, E-value=3e-13, Identity=50%"; Hit description=CTV.2
MEVCKYMDRRVPEVLSDTHIQFHLYQRHFLAVRSNYLAMYEAIELKCCNQWVPEVSMAISQATFSFDGQAVYASFVDGAVAIFDT

SEQ ID NO: 166263 - protein, 87 aa, Glycine max
  Coding DNA Sequence Number=SeqID_49485
MNFDDAKEGSNKAASKDKHLLQDSLKIASTNKAFFKDSLKIKPCLKTMGFKVMQGSGNRLPEGKNEKELLKRVLNLNLNMQSITICL

SEQ ID NO: 166264 - protein, 89 aa, Glycine max
  Coding DNA Sequence Number=SeqID_49486
MENWRTALCNNFAGFQTRRWRMHELRQAMAFMGLRKKRYALTSRGSRLVGGGCMNSVRQGHSWGSVKKWRMEDWGTSRATHNFAGLQTR

SEQ ID NO: 166265 - protein, 62 aa, Glycine max
  Coding DNA Sequence Number=SeqID_49487
MENWRTALRNNFAGLQTRRALRNNFAGLQTRRWRMHEQRQAMTFMGLRKKVENGELAYNATQ

SEQ ID NO: 166266 - protein, 49 aa, Glycine max
  Coding DNA Sequence Number=SeqID_49488
MLLDNSSFFHSLLCAQPADVALSGWLAQRMKQLRTKMTLSSIVQGLICQ

SEQ ID NO: 166267 - protein, 348 aa, Glycine max
  Coding DNA Sequence Number=SeqID_49489
  Gene Ontology: Mol. function=nucleoside-triphosphatase activity; Cellular component=nucleus; Biological process=DNA replication initiation
  Homolog annotation: Hit_ID=Q1S047; Match level="QueryCoverage=83%, HitCoverage=34%, E-value=1e-127, Identity=82%"; Hit description=MCM; Nucleic acid-binding, OB-fold
  Pfam annotation: Domain name=MCM; Domain location=6-252; Score=163.8; E_value=4.5e-46; Accession=PF00493.13; Description=MCM235 family
MFSTETINSLPFAIQRRLSLMACGDRNAPFVIQRQSSPMAYGDKSWSSTFQYFQNYCSSLSRLCLFQVMEQQTVSIAKAGIIASLNARTSVLACANPSGSRYNPRLSVIDNIHLPPTLLSRFDLIYLMLDKAHEQTDRRLAKHIVSLHFENPENVEQDVLDISTLTDYVSYARRHIHPQLSDEAAEELTRGYVEIRKRGNFPGSSKKVITATPRQIESLIRLSEALARMRFSEWVEKHDVMEAFRLLEVAMQQSATDHSTGTIDMDLITTGVSASERMRRESLQQATRNIIMEKMQIGGQSMRLLELLEELKKQDTGSDVHLNDLRNAIATLAAEGFVTMHGDSVKRS

SEQ ID NO: 166268 - protein, 436 aa, Glycine max
  Coding DNA Sequence Number=SeqID_49490
  Gene Ontology: Mol. function=hydrolase activity; Cellular component =membrane; Biological process=proton transport
  Homolog annotation: Hit_ID=Q1S045; Match level="QueryCoverage=94%, HitCoverage=50%, E-value=0.0, Identity=81%"; Hit description=V-type ATPase, 116 kDa subunit
  Pfam annotation: Domain name=V_ATPase_I; Domain location=3-430; Score= 163.7; E_value=4.6e-46; Accession=PF01496.9; Description=V-type ATPase 116kDa subunit family
MCRISATFILFARSCVWYKFALVAKYQEANPTVYTVVTFPFLFAVMFGDWGHGICLLLAALYFIIREKKLSSQKLDDITEMTFGGRYVILLMAIFSIYTGFIYNEFFSVPFAIFAPSAYECRDLSCRDATTVGLIKVRDTYPFGVDPVWHGTRSELPFLNSLKMKMSILLGVAQMNLGIVMSYFNAIFFRNSVNVWFQFIPQMIFLNSLFGYLSLLIIVKWATGSQADLYHILIYMFLSPTDDLGENQLFAGQKNLQLVLLLLAVISVPWMLLPKPFILKKQHEARHGVESYEPLQSTDESLQVESNHDSHGHEEFEFSEVFVHQLIHTIEFVLGAVSNTASYLRLWALSLAHSELSSVFYEKVLMMAWGYNNVIILIVGLIVFIFATVGVLLVMETLSAFLHALRLHWVEFQNKFYEGDGYKFHPFSFSWLDDEE

SEQ ID NO: 166269 - protein, 56 aa, Glycine max
  Coding DNA Sequence Number=SeqID_49491
  Homolog annotation: Hit_ID=Q0WVF5; Match level="QueryCoverage=94%, HitCoverage=6%, E-value=5e-23, Identity=90%"; Hit description =Putative CDC21 protein
MALVHNRCRFADKQIVRVQETPDEIPEGGTPHTVSLLMHDKLVDNAKPGDRVEVRL

SEQ ID NO: 166270 - protein, 52 aa, Glycine max
  Coding DNA Sequence Number=SeqID_49492
MAKRSPNVSSARTGVTYEARTPQPLVVFGVRHAFVCPRVHVRVVSDVRVDAS

SEQ ID NO: 166271 - protein, 73 aa, Glycine max
  Coding DNA Sequence Number=SeqID_49493
PPVLRMCAMPFDPQAKPVSSIAVQDDAAVRDRVAVVVAVVLVDNAKHLRQNYLRHHVFRHQRGQHGRELQRQY

SEQ ID NO: 166272 - protein, 119 aa, Glycine max
  Coding DNA Sequence Number=SeqID_49494
  Homolog annotation: Hit_ID=Q1S049; Match level="QueryCoverage=95%, HitCoverage=41%, E-value=2e-26, Identity=61%"; Hit description=Zinc finger, LRP1-type
  Pfam annotation: Domain name=DUF702; Domain location=2-54; Score= -39.9; E_value=1.1e-05; Accession=PF05142.3; Description=Domain of unknown function (DUF702)
KFKFPAVMSSMASFSCVQVRSIDGTVNEIAYQATVNIGGHVFSGLLYDQGPEQSFNAKGGNIGPLDQQQNLNLWSVSIHTTRDGASATMPPLSATAAQEPFFPPPHPFPLASFRPDMTY

SEQ ID NO: 166273 - protein, 926 aa, Glycine max
  Coding DNA Sequence Number=SeqID_49495
  Gene Ontology: Mol. function=protein transporter activity; Cellular component=COPI vesicle coat; Biological process=intracellular protein transport
  Homolog annotation: Hit_ID=Q1S9I3; Match level="QueryCoverage=99%, HitCoverage=75%, E-value=0.0, Identity=89%"; Hit description =Coatomer WD associated region; Coatomer alpha subunit, C-terminal; Cytochrome cd1-nitrite ...
  Homolog annotation: Hit description=reductase-like, C-terminal haem d1
  Pfam annotation: Domain name=Coatomer_WDAD; Domain location=337-787; Score=844.2; E_value=6.9e-251; Accession=PF04053.4; Description =Coatomer WD associated region
  Pfam annotation: Domain name=WD40; Domain location=1-37; Score=2.2; E_ value=20; Accession=PF00400.22; Description=WD domain, G-beta repeat
  Pfam annotation: Domain name=WD40; Domain location=125-163; Score =51.2; E_value=3.4e-12; Accession=PF00400.22; Description=WD domain, G-beta repeat
  Pfam annotation: Domain name=WD40; Domain location=194-232; Score =39.6; E_value=1.1e-08; Accession=PF00400.22; Description=WD domain, G-beta repeat
  Pfam annotation: Domain name=WD40; Domain location=238-276; Score =36.2; E_value=1.1e-07; Accession=PF00400.22; Description=WD domain, G-beta repeat
  Pfam annotation: Domain name=WD40; Domain location=41-79; Score=41.6; E_value=2.7e-09; Accession=PF00400.22; Description=WD domain, G-beta repeat
  Pfam annotation: Domain name=WD40; Domain location=83-121; Score =46.8; E_value=7.5e-11; Accession=PF00400.22; Description=WD domain, G-beta repeat
  Pfam module annotation: Pfam domain module=Coatomer_WDAD::WD40::WD40:: WD40::WD40::WD40::WD40; Domain location=337-787::1-37::125-163::194 -232::238-276::41-79::83-121
MLTKFETKSNRVKGLSFHSKRPWILASLHSGVIQLWDYRMGTLIDRFDEHDGPVRGVHFHNSQPLFVSGGDDYKIKVWNYKMHRCLFTLLGHLDYIRTVQFHHENPWIVSASDDQTIRIWNWQSRTCISVLTGHNHYVMCASFHPKEDIVVSASLDQTVRVWDIGSLKRKAGPPADDVLRLSQMNTDLFGGVDAVVKYVLEGHDRGVNWAAFHPTLPLIVSGADDRQVKLWRMNDTKAWEVDTLRGHMNNVSCVMFHAKQDIIVSNSEDKSIRVWDATKRTGIQTFRREHDRFWILSTHPEMNLLAAGHDSGMIVFKLERERPAFAVSGDSLFYTKDRFLRFYEFSTQRETQVLTIRRPGSSCLNQSPKSLSYSPTENAILLCSDVDGGSYELYCISKDGTKDSFGRGDTQDPKKGLGGSAVFVARNRFAVLDKGSNQVCVKNLKNELVKKSALPISADAIFYAGTGNLLCRSEDRVFIFDLQQRIVLGDLQTPFIKYVVWSNDMESVALLSKHAIVIASKKLVHQCTLHETIRVKSGAWDDNGIFIYTTLNHIKYCLPNGDSGIIKTLDVPIYITKVVGNTIFCLGRDGKNKAITVDATEYIFKLSLLKKKYDHVMNMIKNSQLCGQAMIAYLQQKGFPEVALHFVKDERIRFNLALESGNIQIAVASATAIDEKDHWYRLGVEALRQGNSGIVEYAYQRTKNFERLSFLYLITGNVEKLSKMLKIAEVKNDVMGQFHNALYMGDIRERVKILENAGHLPLAYITASVHGLHDVAERLAAELGDNVPSVPEGKVQSLLMPPSPVVCGGDWPLLRVMRGIFEGGFNNTDRDADDEEYEAADGDWVEELDMVDVDGLQNGDVAAILDGVEVAEDDDEEGGWELEDLELPPEADTPKVSVSSQSSVFVAPAPGMAVGQIWDSEIISCS

SEQ ID NO: 166274 - protein, 63 aa, Glycine max
  Coding DNA Sequence Number=SeqID_49496
  Gene Ontology: Mol. function=zinc ion binding; Cellular component =intracellular; Biological process=regulation of transcription
  Homolog annotation: Hit_ID=Q1S9J1; Match level="QueryCoverage=98%, HitCoverage=27%, E-value=3e-22, Identity=72%"; Hit description=Zinc finger, B-box
  Pfam annotation: Domain name=zf-B_box; Domain location=1-47; Score =36.5; E_value=9.3e-08; Accession=PF00643.14; Description=B-box zinc finger
MKIQCDVCHKEVASFFCPSDEASLCHACDRTIHHPNKLSEKHKRFSLHHPISTKDSPLCDICH

SEQ ID NO: 166275 - protein, 294 aa, Glycine max
  Coding DNA Sequence Number=SeqID_49497
  Homolog annotation: Hit_ID=Q00YQ5; Match level="QueryCoverage=86%, HitCoverage=81%, E-value=2e-21, Identity=30%"; Hit description =Chromosome 11 contig 1, DNA sequence
MACLDLKNRTTFICAANQEAEEAFKKTVEIDRLIDMLREANPREIQKLVVENILAFNPSFWVRLAARTDTCKSEDDKKDYEELAATVMTVVDCVVHKTKEKIESSTDVLKGVLKPVIDDEGEIPWPPRDRQALTLMKKEISQREQEGQLDEGFLAEVNAQLRQYLAYNEQAREDGDKPGLEAMLQKVLQLYASKVLSKRSYAMKGKEVLKDEQLLETIIQAPEQEWSHILINGLTIGAGDISAEDLFAVLKKRIERVLIRTEGGSYQQRILTEYLKGIETRAEEIVQVLQGRPQ

SEQ ID NO: 166276 - protein, 110 aa, Glycine max
  Coding DNA Sequence Number=SeqID_49498
  Subcellular localization annotation: CTP_CleavageSite=57; ConfidenceScore=5.14e-01
DYEHQSAFQNQDVQVSMRSFPLQTWVPQSQGGSPQRSFTSNLYPQIDSLVGVMEMPKAKAGEGYSNWIYNYDYAAYKLPSICPPLIKKMQTLSLINYAVQLTPFKGHPYV

SEQ ID NO: 166277 - protein, 181 aa, Glycine max
  Coding DNA Sequence Number=SeqID_49499
MACEEPFGPAPFHLLSSRGGEPDDMRRQIIVIRLTFFHPDIVVSDSMQRQIMVIMRLLSSRGGGPDDMREPFGDRPDDMRGTIGPALFTLCHPEAAGQMTCGEPVGPALFHLLSSRGGGLDDMRGTIWSRTFYLLSSRGGRPDDMREPFGPALFHLLSSRGGGPDDMRGTIWSRTFSPFVI

SEQ ID NO: 166278 - protein, 78 aa, Glycine max
  Coding DNA Sequence Number=SeqID_49500
MSDKRVEMNYGHSAPFVIQEQQVEWRLCPVARKDKLWSFCALPPRLDRVCGHAEANYGHSAPCVNQEERIRQYQDDVS

SEQ ID NO: 166279 - protein, 69 aa, Glycine max
  Coding DNA Sequence Number=SeqID_49501
MIEVSVEAIASLTQYYDQPLRCFTVGDFHDAILPRKGPVTRAMSKRLQEDWARAAEEGPRVLMNLRVDF

SEQ ID NO: 166280 - protein, 215 aa, Glycine max
  Coding DNA Sequence Number=SeqID_49502
FMDVDKIRPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSLVAWLRETTGAVAKASLHRAIVTAYGPEPGSEPTDVEESADELWLGVKCHSNPELAGSPRNALRRSS

SEQ ID NO: 166281 - protein, 98 aa, Glycine max
  Coding DNA Sequence Number=SeqID_49503
MVVGTGYSTRPRDHLGFDGCLSDPETKNHKEKGKMVISKNFLDREEVQGWRTEEGEEEMQKEKEKKKKKSKAEALPNHNRGSFPTSFLSLALHPTQQS

SEQ ID NO: 166282 - protein, 122 aa, Glycine max
  Coding DNA Sequence Number=SeqID_49504
LEIQVGKLVKEVAKFVATREENFVEVEAHEESLVEEHDSREKGEEKSEEKAQQWKKCSQVEIQQESILQVNTPPHQLIVKEERHGEHEKSISVILSLITSTSLAMTWKVFPKYMSFMESLAK

SEQ ID NO: 166283 - protein, 72 aa, Glycine max
  Coding DNA Sequence Number=SeqID_49505
  Gene Ontology: Mol. function=kinase activity; Cellular component =cytoplasm; Biological process=carbohydrate metabolic process
  Homolog annotation: Hit_ID=Q8H407; Match level="QueryCoverage=78%, HitCoverage=22%, E-value=7e-15, Identity=78%"; Hit description =Xylulose kinase-like protein
MVKSIAPPNHIRFAPDRPRCVNSSRGGIVLVGYDPEVDSYPSWLVSQPYYHLLPSVVAPGTPISSFKGGNWK

SEQ ID NO: 166284 - protein, 247 aa, Glycine max
  Coding DNA Sequence Number=SeqID_49506
  Gene Ontology: Mol. function=protein serine/threonine kinase activity; Cellular component=mitochondrion; Biological process =fructosamine metabolic process
  Homolog annotation: Hit_ID=Q6D4J4; Match level="QueryCoverage=96%, HitCoverage=82%, E-value=8e-94, Identity=67%"; Hit description =Putative fructosamine kinase
  Pfam annotation: Domain name=APH; Domain location=1-202; Score=54.7; E_value=3.2e-13; Accession=PF01636.13; Description=Phosphotransferase enzyme family
  Pfam annotation: Domain name=Fructosamin_kin; Domain location=1-236; Score=384.2; E_value=2e-112; Accession=PF03881.5; Description =Fructosamine kinase
  Pfam module annotation: Pfam domain module=APH::Fructosamin_kin; Domain location=1-202::1-236
MLTLFSWEADQLDLLARTHTVRVPKVYGVGNDRDTSFLLLEYIPPQPLDAQSAFQLGQQLAHLHQWSEQPQFGLDFDNNITTTPQPNSWLRKWSVFFAEQRIGWQLQLAAEKGVHYGDMELIVDCVQRSLASHHPQPSLLHGNLWPANCAGSASGPWLFDPACYWGDRECDLAMLSYYADLPRQIYEGYHAVWPLPEGFSQRQPVYQLYYLLNRANVFGGNWAGEAQFAIGQLLEEDALGQRQVRPA

SEQ ID NO: 166285 - protein, 111 aa, Glycine max
  Coding DNA Sequence Number=SeqID_49507
  Gene Ontology: Mol. function=kinase activity; Cellular component =cytoplasm; Biological process=carbohydrate metabolic process
  Homolog annotation: Hit_ID=Q1S9J5; Match level="QueryCoverage=93%, HitCoverage=24%, E-value=6e-30, Identity=72%"; Hit description =Probable xylulose kinase [imported]-Arabidopsis thaliana-related
MINGLLVVLQTLVEPFLDKLFTDEQLEKLSEQINPSQPSLLDYYPLAIAGEGFPVADPDLAPRLLPRPENDVECLHGILESIARIEAKAYGLLKELGATQVDEIFHSRWRS

SEQ ID NO: 166286 - protein, 716 aa, Glycine max
  Coding DNA Sequence Number=SeqID_49508
  Homolog annotation: Hit_ID=Q39JK6; Match level="QueryCoverage=96%, HitCoverage=38%, E-value=3e-80, Identity=33%"; Hit description=Outer membrane autotransporter barrel
  Subcellular localization annotation: CTP_CleavageSite=42; ConfidenceScore=5.22e-01
MLPATPVSAVVLTPFTPERNDNKVGAYCLCNGSTQTLSGVPRFTAGESGMSSVTLGELQKVGRIINDNLIGEPRLQLGAQNYAIGIPDEETGSYRVYQVYNSAEMIAPAEINGATVVPDYYDVNDKQYIDARVATVTNGRLNINIGQQGAAANASTNRWSMAAKQSQLFASSNNGHINWDSNNRIRFTAATPPYGGDRLAFDAGGVVTYAGLFDVTLKDGSSNAYYVSNLNELRNYNDWLIDQISGGNLSPESYNAALNQAFSLRDGRVVYRMSTGNYDDEVAAALGDQVVLSADGAKASVKINRGKTLEVANSAIAVMRASNGATAIIAGKLATSNAPSSEAGALELISGARGINNGVINSGFFNAANGRGVAEDSLGYAGTAVSAIYDSEFRNNGVLNVHIGDAPWGTAGLFLGSSSAVNHGNINIGIHDVANGSSAAAVSFSGEGSFVNARDGTIYLGRTPQNHKGDVTQDVAVSLGGGISAISGLLDSRAINDGRIVIGSKVENAVGMRIEAGPNAVSLNNGVIDVNGMAQALPRENIAMLAMDSGSGGQVGNRGTLNLNGYNSTGLKVIATAGNQAHAFSSGAINVAGDADRFGGTNNTAVWVTGEPGGHASADITGPIRLSGKAGIGIRAEGQATVDVSAHAIPTSSGSDSMLDSGQISFYRIGPDARINLPANGRYSASVWNGTIFRVEQGADFDGRGLTLSMNSPFAT

SEQ ID NO: 166287 - protein, 65 aa, Glycine max
  Coding DNA Sequence Number=SeqID_49509
MGGEITLINSVLNALPIYLLSFFKIPQKLLITNSFGLGLSILSMEVGRPCSLLGLKEDILVGGGI

SEQ ID NO: 166288 - protein, 605 aa, Glycine max
  Coding DNA Sequence Number=SeqID_49510
  Gene Ontology: Mol. function=sugar porter activity; Cellular component=integral to membrane; Biological process=carbohydrate transport
  Homolog annotation: Hit_ID=Q48M64; Match level="QueryCoverage=65%, HitCoverage=86%, E-value=1e-148, Identity=66%"; Hit description =Sugar transporter family protein
  Pfam annotation: Domain name=MFS_1; Domain location=218-603; Score =51.1; E_value=3.7e-12; Accession=PF07690.6; Description=Major Facilitator Superfamily
  Pfam annotation: Domain name=Sugar_tr; Domain location=214-604; Score= 105.5; E_value=1.6e-28; Accession=PF00083.14; Description=Sugar (and other) transporter
  Pfam module annotation: Pfam domain module=MFS_1::Sugar_tr; Domain location=218-603::214-604
DGPYLNAEDAHGFVALARYANGDIALAKYTYGKGTVLLSGPHPEADESWMAPEKNNPAYTSAGSKMARLFNDLKPGRAAAAQIAYPLPPAATTRGRSTSEKPVRLAGDNPPAHEKRESGNVLIQHESNRVQPQRIPVFEIVVDMAAGYAQRIGQIAGQPGFERSARARLRRKPALSSQGGLESPMDDSKQNSSQSQSDDGGSLTFTVQQRLFFVVLVATMGALAFGYDTGIISGALPYMTLPAAQGGLDLTPFTEGLVTSALTFGSALGAFISGYVSDRFGRRITLRSLALLFIAGALGTTVAPNLETMVVMRFILGFAVGGGSSTVPVFIAEIAGPKRRAPLVSRNELMIVSGQLLAYVVSAAMSLLLHDPGMWRYMLSLAMIPGILLFIGTFFVPASPHWMVAEGRFNEALRILRKLRENPREIKKEMAEMRQNAREARQGPPARELLKEKWIVRLLLLGCGMGIVAQFTGVNAFMYYTPVILKSTGLGTSASIAATIGNGVPFRPAPDADDRAVGGDCDAAGAGRGAGSHATKPDAKPAGAGVYSGVSVLYADVHFPGLLAADVGVVSDESSRGINRFSGSISVDMQRRGGAGVSAFAVAGG

SEQ ID NO: 166289 - protein, 192 aa, Glycine max
  Coding DNA Sequence Number=SeqID_49511
MEEVNLSIQHDGKGHVIIGEAALSLALGKKKISVNTLIDELRHMKRAGGSDTRLSAISEAIGWLRSFDEPEQAAIHVPVYRPEKTVRDDVFTTIKPRINDFRQRGMWQRMRALATDVQRVEDVIVRVIDVPDKLEADRGARQPTFLTQNFNGGSPLFLICPPAAHDHLVGRKVTDTISSVQQQSSSRVRKSA

SEQ ID NO: 166290 - protein, 235 aa, Glycine max
  Coding DNA Sequence Number=SeqID_49512
  Gene Ontology: Mol. function=glycerophosphodiester phosphodiesterase activity; Cellular component=membrane; Biological process=glycerol metabolic process
  Homolog annotation: Hit_ID=Q9SZ11; Match level="QueryCoverage=92%, HitCoverage=29%, E-value=3e-55, Identity=51%"; Hit description =Probable glycerophosphoryl diester phosphodiesterase 2 precursor
KAAYLAEKQNLHVTDAVLDALQKAKPRSHKVMIQSTHSSVLKIFKDKSKFERVYKVDENIRDAADSAIEDIKTFADSVVIGKASVFPESSAFLVNSTNTVARLKSFKLPVYVETFSNEFVSQAWDYYSDPSIEINSFVIGTKVNGIITDFPKTANRYRRNLCLKNGNKEPYRSPIEPGKLFKQISNLYLPPLPPPLPVLTDSNVTEAPLPGVSGKVPSSKAAPGVGAAAPAPITA

SEQ ID NO: 166291 - protein, 75 aa, Glycine max
  Coding DNA Sequence Number=SeqID_49513
MTKRETEGRERRMKRDTNQDHSEQRVKKKKQKESTGNGAWLPHSGEVSASGEVPAKPAGEKKPRVLASLQGCVLV

SEQ ID NO: 166292 - protein, 469 aa, Glycine max
  Coding DNA Sequence Number=SeqID_49514
  Gene Ontology: Mol. function=glycerophosphodiester phosphodiesterase activity; Cellular component=membrane; Biological process=glycerol metabolic process
  Homolog annotation: Hit_ID=Q2WGN6; Match level="QueryCoverage=87%, HitCoverage=54%, E-value=1e-141, Identity=59%"; Hit description =Putative glycerophosphoryl diester phosphodiesterase family protein
  Pfam annotation: Domain name=GDPD; Domain location=7-298; Score= -14.0; E_value=9.8e-05; Accession=PF03009.8; Description =Glycerophosphoryl diester phosphodiesterase family
MVIARGGFSGIFPDSSSLAYGLALDTCGPNVTLWCDVQLTKDGVGICFPELKLDNATDISIAYPGKAKDYLVNGVSTRGWFSVDYNFGELANVSVVQGVYSRTNKFDGNKLPILTVEQVAKLIKSPSTGLWLNFQHASFFKQQNLSVENFLQSLPGRSVPVNYISSPDVDFLRRVKSSFSSGPTSFIFRILEQSKIEPTTNQTYGELLKNLALIKTFSSGILVPKGYIWPVDSDHYLQPHTPLVTDAHREGLQVFVSDLTNDVPFSYNFSYDPLAECLSFIDGDDFSVDGVLSDFPVTPSAAINCFSGLGENAKRQVDTLVITKYGASGDNPACTDLAYNQAKSDGADVLDCPVQMSKDGIPFCLSSIDLLESTTVADTQFKNRATTILEIKFRSGIYTFSLTWDEIKTLTRVILFSHSPSLFYFLMEYLAMGTLNCLKLFKSFIPSFFPLAKSPRYNFIGKLEQGKNK

SEQ ID NO: 166293 - protein, 301 aa, Glycine max
  Coding DNA Sequence Number=SeqID_49515
  Gene Ontology: Mol. function=sodium:hydrogen antiporter activity; Cellular component=integral to membrane; Biological process=sodium ion transport
  Homolog annotation: Hit_ID=Q8S397; Match level="QueryCoverage=98%, HitCoverage=56%, E-value=1e-113, Identity=66%"; Hit description =Sodium/hydrogen exchanger 4 (Na(+)/H(+) exchanger 4)
MQTGLLTAYILKALSFGRHSSVREISLMILMAYLSYMLAELFDLSGILTVFFCGILMSHYAWYNVTETSRITTRHVFATMSFIAETFIFLYVGMDALDIEKWKMTQLSYGNLMGIYSSLILLILLGRAAFVFPLSALANYTNTRATSDQASSITFKHQIIIWWAGLMRGAVSIALAFKQFTFSGVTTDPVNATMITNTIIVVLFSTLVFGFLTKPLIRYLLPHSATRKSISHSESGPPFDDLNLPFLSLEESAATNISRAKASLSMLIESPVFTIHRYWRRFDDAYMRPIFGGPHGNQSQC

SEQ ID NO: 166294 - protein, 56 aa, Glycine max
  Coding DNA Sequence Number=SeqID_49516
MAYTRPDLAQVVSVVSRCLKSTIDIGIVYHEVTFCALADYSNSEYPAYLGARRSKI

SEQ ID NO: 166295 - protein, 134 aa, Glycine max
  Coding DNA Sequence Number=SeqID_49517
VVYKSKGERKDIELVEEEQAWIGVDPSSETSNKSENYKEEARKKTQKHKPKRVESVNADAEAFGDSTMLKIGDSAKVVIKQDMKGRRHKYGFNNNKREKAQKKRVVDDETGTNISWMKSYEDPPHSQRGERATI

SEQ ID NO: 166296 - protein, 87 aa, Glycine max
  Coding DNA Sequence Number=SeqID_49518
  Gene Ontology: Mol. function=transferase activity; Cellular component= nucleus; Biological process=DNA integration
  Homolog annotation: Hit_ID=Q8RUQ2; Match level="QueryCoverage=97%, HitCoverage=9%, E-value=8e-18, Identity=42%"; Hit description =Putative retroelement
MAMNEEMESLLKNQTWDVIELPKGRQVLGCNCAMEILDKKLEYFDVKTSFLHGRLEEDILRQEPKGFEVEGKENFIYRLKRSLYGLK

SEQ ID NO: 166297 - protein, 206 aa, Glycine max
  Coding DNA Sequence Number=SeqID_49519
  Gene Ontology: Mol. function=oxidoreductase activity; Cellular component=membrane
  Homolog annotation: Hit_ID=Q7WMB7; Match level="QueryCoverage=99%, HitCoverage=85%, E-value=3e-50, Identity=53%"; Hit description =Putative exported protein
MAAPDLADYKPIFFSAEEWQFILAATDRLIPAGGNGKAPGALETNVPIFIDQQLHSPEFGAEIYLQGPFDVHAPATMGYQIPFTPQQMYRTGIKLVEQWTQSTYHKAFSQLTLAEKDAVLTKVNKNDGIDFAALGEPNLKASQFFSQLLSDTKHGYLADPMYGGNKGMKAWIAIGFPGARASFTEWVKQHNVPYPLGPVSLMGERA

SEQ ID NO: 166298 - protein, 305 aa, Glycine max
  Coding DNA Sequence Number=SeqID_49520
  Gene Ontology: Mol. function=oxidoreductase activity, acting on NADH or NADPH, NAD or NADP as acceptor; Biological process=electron transport
  Homolog annotation: Hit_ID=Q2SGY7; Match level="QueryCoverage=65%, HitCoverage=99%, E-value=3e-71, Identity=62%"; Hit description=FMN -dependent NADH-azoreductase 2
  Pfam annotation: Domain name=FMN_red; Domain location=105-280; Score=- 24.3; E_value=0.0022; Accession=PF03358.6; Description=NADPH -dependent FMN reductase
  Pfam annotation: Domain name=Flavodoxin_2; Domain location=105-305; Score=113.7; E_value=5.3e-31; Accession=PF02525.7; Description =Flavodoxin-like fold
  Pfam module annotation: Pfam domain module=FMN_red::Flavodoxin_2; Domain location=105-280::105-305
MRALRGRLADEAQFIAQAQRQQAQGYRLTGIEHQGQPAVLAGYRLLENFIHGSFCYVDDLVSDPALRGQGFGAALLDGLAVLAPLRLSGARPAFLSLYRMRNLCMNVLHIKVSPDLAGSTSRIASARLIEKLRSRHHDLHETVLDLAQQPLPHLDAFTIRAFFTPPEARDEAQRNAIRTSERLVDQLLACDTLVISSPMWNLGLPSVLKAWFDHITRAGRTFAFTPEGTKVGLVSGKKVYCVMASGSVFAHGPFMQDDQFTPYVRAALAYIGISDVQFIRVDGTHDPLSRARALPEALETIERLF

SEQ ID NO: 166299 - protein, 137 aa, Glycine max
  Coding DNA Sequence Number=SeqID_49521
  Homolog annotation: Hit_ID=Q60DJ5; Match level="QueryCoverage=33%, HitCoverage=12%, E-value=2e-09, Identity=63%"; Hit description =Expressed protein
MKGRKGERDSVCVCLFVSRKRERDAVLGEEGKVGVGRVVKNSGGEETASGGDKGWGGAEGGFGRDEFVTKKRGKREREVEGVIGRGISIMVTTPPMYIYNIHHHNGIFNINNISTQCHYQHQHHLNVIFNINIISSQ

SEQ ID NO: 166300 - protein, 195 aa, Glycine max
  Coding DNA Sequence Number=SeqID_49522
  Gene Ontology: Mol. function=transferase activity, transferring nitrogenous groups; Cellular component=intracellular; Biological process=regulation of transcription, DNA-dependent
  Homolog annotation: Hit_ID=Q2SGY8; Match level="QueryCoverage=94%, HitCoverage=45%, E-value=5e-44, Identity=45%"; Hit description =Transcriptional regulator containing a DNA-binding HTH domain and an aminotransferase ...
  Homolog annotation: Hit description=domain (MocR family) and their eukaryotic orthologs
HSAVAEKGVTRGLQRDLPALPAADSCRTAPAGRPRTGDPRAGGRAAGREGHARQSAAEAGERNYATARTGDDARAAAGDRGQRRAAARHPGAGRVSAQKVAADVSESGAQPAAGRDDDTAGDGICAAAGGYRQLPEHFARPQLPAGADLHHQRLPRQPAADSGGAGAAGRQSAVRRSRLLLRPAAAEAHRTQPAL

SEQ ID NO: 166301 - protein, 85 aa, Glycine max
  Coding DNA Sequence Number=SeqID_49523
MAVGPHKKKLRTYLGIVARDKAEFDIPEASDVRTKKKILQTMVERWRQFKSTLTSKWVLAIDKDSVDDTVCEKYGISKEKWAQCC

SEQ ID NO: 166302 - protein, 59 aa, Glycine max
  Coding DNA Sequence Number=SeqID_49524
MQFHQFRKDRTFSIRVEFIPDKWLRLSLKEHFSMLVLLLHRDPAIGITDAGGAGCHDAR

SEQ ID NO: 166303 - protein, 46 aa, Glycine max
  Coding DNA Sequence Number=SeqID_49525
  Homolog annotation: Hit_ID=Q6F2U6; Match level="QueryCoverage=94%, HitCoverage=11%, E-value=6e-08, Identity=61%"; Hit description =Expressed protein
MGPSHSHYVQAQELAKEAMIVAKIANLLDCTSWSGAGPGLMDAVTQ

SEQ ID NO: 166304 - protein, 253 aa, Glycine max
  Coding DNA Sequence Number=SeqID_49526
  Gene Ontology: Mol. function=protein binding; Cellular component =ribonucleoprotein complex; Biological process=translation
  Homolog annotation: Hit_ID=P49199; Match level="QueryCoverage=81%, HitCoverage=94%, E-value=2e-94, Identity=83%"; Hit description=40S ribosomal protein S8
  Pfam annotation: Domain name=Ribosomal_S8e; Domain location=35-232; Score=361.6; E_value=1.3e-105; Accession=PF01201.12; Description =Ribosomal protein S8e
MRIRDNKGYFCSYEPELAAPPPAPPPAPFYSSSTMGISRDSMHKRRATGGKKKSWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVEVGRKKKSAAASVKKEGEDGEAATEEVKKSNHVVRKLEKRKQNRVLDPHIEEQFGGGRLLACISSRPGQCGRADGYILEGKELEFYMKKLQKKKGKGAA

SEQ ID NO: 166305 - protein, 88 aa, Glycine max
  Coding DNA Sequence Number=SeqID_49527
  Gene Ontology: Mol. function=transferase activity; Cellular component= integral to membrane
  Homolog annotation: Hit_ID=Q4VWQ6; Match level="QueryCoverage=80%, HitCoverage=14%, E-value=9e-28, Identity=76%"; Hit description=Beta 1,2 xylosyltransferase
MVSIYYAHRAEFIISKNRIMGGKDFECDEWIEEPALLVTRFEYANLFHTVTDWYSAYVSSRVTGLPNRPHLIFVDGHSKNLDAFCFLP

SEQ ID NO: 166306 - protein, 360 aa, Glycine max
  Coding DNA Sequence Number=SeqID_49528
  Gene Ontology: Mol. function=transcription cofactor activity; Cellular component=nucleus; Biological process=transcription from RNA polymerase II promoter
  Homolog annotation: Hit_ID=Q9LPS9; Match level="QueryCoverage=96%, HitCoverage=95%, E-value=8e-92, Identity=52%"; Hit description =Putative pirin-like protein At1g50590
  Pfam annotation: Domain name=Pirin; Domain location=30-188; Score =112.5; E_value=1.3e-30; Accession=PF02678.6; Description=Pirin
  Pfam annotation: Domain name=Pirin_C; Domain location=241-346; Score =138.2; E_value=2.3e-38; Accession=PF05726.3; Description=Pirin C -terminal region
  Pfam module annotation: Pfam domain module=Pirin::Pirin_C; Domain location=30-188::241-346
MPQRKGCSSLNEPRLVARKFLARPQIEGVGTVVRRSIGGFELKYLIPSLCWMNSQNVKFCDIAVTAPAGFPDHPHRGFETVTYMLQASSHAQFSRWQTSHAACITVCHHWTNLFIGYLLLWKSFSKLETYCFNGLMAIIKGAIMHEDFEGHKGTIEAGDLQWMTAGRGIVHSEMPAAQGTQKGLQLWINLASKYKMIEPRYQEVLSKDIAEAEDDGIKVRVIAGEALGIKSPIYTRTPTMFLDFSLKPGGHLQQPIPNSWNAFVYILEGEGIFGNMISQPSNSHHILLLGPGDGLEAWNKSSKLLRFILVGAEPLGEPLVQFGPFVMNSQEEIDQTIDDFENFANGFEKARHWTSESQIN

SEQ ID NO: 166307 - protein, 370 aa, Glycine max
  Coding DNA Sequence Number=SeqID_49529
  Gene Ontology: Mol. function=transferase activity; Cellular component= integral to membrane
  Homolog annotation: Hit_ID=Q4VWQ6; Match level="QueryCoverage=85%, HitCoverage=63%, E-value=1e-127, Identity=68%"; Hit description=Beta 1,2 xylosyltransferase
MNKRTTLLIRTLLFLFVLNSLYLSLYFTHKPSSSSEEEQEKSELEPDTYLTPFSHEPHFSKPWPIVPSHIPWTTTSARSHSCEAYFGNGFTRRRDVLLPRGGAGWFRCHHSDTLRNSVCEGGRLRMAPEKITMAKGGEDLAAVMGRTEDEEMPVFQNGAFQVDGGEVVVDRELLVDQEFLDEYVPRGGIDRHTMRELIAKIRIVRGKDFQCDEWIEEPTLLVTRFEYANLFHTVTDWYSAYVSSRVTGLPNRPHVVFVDGHCKAPLEETWKALFSSVRYAKSFSGSVCFRHAILSPLGYETAMFRGLSEHIDCHGAPAQELLQKPDDQKTARLSEFGEMVRAAFGLPLNIHRDGNHSLDIMSSLFVVKII

SEQ ID NO: 166308 - protein, 60 aa, Glycine max
  Coding DNA Sequence Number=SeqID_49530
MEAVTYLNRGRDELVCGSCSFSDSGSFSSAVSGSHRVRKKEKGERRKGFERGGGGVGGRK

SEQ ID NO: 166309 - protein, 178 aa, Glycine max
  Coding DNA Sequence Number=SeqID_49531
  Homolog annotation: Hit_ID=Q69V30; Match level="QueryCoverage=83%, HitCoverage=13%, E-value=4e-09, Identity=32%"; Hit description =Hydroxyproline-rich glycoprotein-like
MPCIIQHDEVDDVHAIRNDHDEGSWEHLQRPRRIPMTKFDIPKASNAKKKVMPMMATRWRQFKSSLTTKFVYANIDEEEKEDPSIKYGIDQQTWDEFAASRVLQEIRKKVQQIQKNNDCPHVLSRGGYDLLEKKLIDEKREKRKEEAMLTEKTPLLKDPPSPIERDVKWKMARTKRYG

SEQ ID NO: 166310 - protein, 230 aa, Glycine max
  Coding DNA Sequence Number=SeqID_49532
  Gene Ontology: Mol. function=nucleic acid binding; Biological process= DNA integration
MTHIVGLQSELEVLVKSMAYLANLIKTLVFAYVCEISLIPFRIPIATANSWYQMALKSRAKFEVEKFNGSGNFILLQGELRICWHYKVLYHVMELKSSGEEDSNLQQHVNAFNQIVNDLTRLNVKVEDEDKACILLCSLPSSYKHLVITLTYEKDSIILEMIHVALMSHSQQRQNVVESMQGDDLDCLELKKSGEERFHLANVAEIDDSDYYTEGDVYYSARDVLSSLCS

SEQ ID NO: 166311 - protein, 266 aa, Glycine max
  Coding DNA Sequence Number=SeqID_49533
  Gene Ontology: Mol. function=copper ion binding; Biological process =electron transport
  Homolog annotation: Hit_ID=Q9SW88; Match level="QueryCoverage=82%, HitCoverage=33%, E-value=3e-61, Identity=53%"; Hit description=Amine oxidase
  Pfam annotation: Domain name=Cu_amine_oxidN2; Domain location=50-136; Score=76.8; E_value=7e-20; Accession=PF02727.6; Description=Copper amine oxidase, N2 domain
  Pfam annotation: Domain name=Cu_amine_oxidN3; Domain location=130 -217; Score=23.4; E_value=5.8e-05; Accession=PF02728.6; Description =Copper amine oxidase, N3 domain
  Pfam module annotation: Pfam domain module=Cu_amine_oxidN2::Cu_amine _oxidN3; Domain location=50-136::130-217
MEVKKLRPFLLVLPISVALVLLVAWLHLTSFSIYHNQLHHEYSEIIIPEHSLDPLTIHEFNKNRTILSNHPFFKSPFSYTIKYVVLEEPEKQLVLKWKKGDPPLPRKASMVVVDDDIFRELIVDPKTDLVTIHETKLSFGVPYYNLNGPDGKEERKGHSWFGTPVEENKRLIKVKCYSKEGIVNFYMKPVEGFSALVDMHKKEVLVVSNNGQNIPVAKGINNTSTTKYHCSIQKLNRELRMLNPISLEQPKGPSFIIDGHLVKWAN

SEQ ID NO: 166312 - protein, 81 aa, Glycine max
  Coding DNA Sequence Number=SeqID_49534
MRNESKEFSLSVDLDLEHSWKPTILVKHNVFHLLLNQEDMEQKQPLEVIRCWNSKESFKPEYAWSINRYKRSTSKAGDYEI

SEQ ID NO: 166313 - protein, 146 aa, Glycine max
  Coding DNA Sequence Number=SeqID_49535
  Homolog annotation: Hit_ID=Q9MAX8; Match level="QueryCoverage=46%, HitCoverage=26%, E-value=2e-18, Identity=67%"; Hit description =Epsilon1-COP
MEEDETGDEPQCGVVSDNEIDKPFLETHDGEIEGEEFDGLRRCGSVVLDLRDDELGLVEGDLAAVDKRIEGEDRDAIMTNYSLDLVVQHQIWYFQPQIYLAKVRMMASTAVWDGRREGTRDRSESVRENERVRLRECDNNETFDFY

SEQ ID NO: 166314 - protein, 116 aa, Glycine max
  Coding DNA Sequence Number=SeqID_49536
MWKTPQQNGVVKRMNSYLIERVPCLRLQVGLSKGYSKGVKGFKFWDPISKKMVINKDAVFEKQSMLPKIVDTTMPVSDRASLNSMEVQVDLEHLTVIPKRAEPCNPRLEATPYTCA

SEQ ID NO: 166315 - protein, 265 aa, Glycine max
  Coding DNA Sequence Number=SeqID_49537
ILTTTIGKLEYPGRVRGVGGSMGIRKYFGPPTHHGSISITISMRYLRLLQNGSLSKSCGSKASKLILMMPKTQVKNQDSRKFQESKSHSIKNQDSSKESRVDSRYARTSRKASNIRGSYVDVDPSGEDNHIDIHQLCELYVDVDPPLLMAIGKMYNLRSIIHHKKIEDDNARVVVEEWPRRLSKAITTKAVERCSKDVPHKKVEPELDPLEHLLMIASQNKNPIQLPWDPNVLSRPSSMPFYIHQKHLLEVYLGTKVFNILVMQL

SEQ ID NO: 166316 - protein, 55 aa, Glycine max
  Coding DNA Sequence Number=SeqID_49538
MVNNTSEFNIHRKVEIPKFQLKITVKTSAKARGNWKEDWCHPLKNLSQEERGQPP

SEQ ID NO: 166317 - protein, 249 aa, Glycine max
  Coding DNA Sequence Number=SeqID_49539
  Gene Ontology: Mol. function=binding; Cellular component =intracellular; Biological process=metal ion transport
  Homolog annotation: Hit_ID=Q10PA0; Match level="QueryCoverage=59%, HitCoverage=25%, E-value=9e-26, Identity=35%"; Hit description =Pentatricopeptide, putative, expressed
  Pfam annotation: Domain name=PPR; Domain location=101-135; Score=9.5; E_value=0.56; Accession=PF01535.11; Description=PPR repeat
  Pfam annotation: Domain name=PPR; Domain location=65-99; Score=14.8; E_value=0.13; Accession=PF01535.11; Description=PPR repeat
  Pfam module annotation: Pfam domain module=PPR::PPR; Domain location =101-135::65-99
MKLRRNVSRYVGDGQQKASSHGRQRDGESLDAEHEEDEESASKIGRNAIETFNGMIHRGLKPNAVTFVNLSKGCSHAGMVEDGLNYFNSMEKIYGVVPKEEHYSCAIDLLGRAGKLKEAEDFINNMSLAADKLMKAEPKNSVAHVWLSNIYAKEKQWEDVRNWSHPQKKEIYEKLDSLLDQIKRIGLRKEISAGFIISPMVHVPVEITGTKPIMTLEKRVAKDVGLASGSKITEVLMFQLLGTKEKCKG

SEQ ID NO: 166318 - protein, 90 aa, Glycine max
  Coding DNA Sequence Number=SeqID_49540
MEHYLSMWFASKRPTTTDRCSCISASTSSASASRFGATIAWPADWPDAQTGAGPAGAPGAEDEAQEDEDMADLFDFLGGGRSMRSGSPDS

SEQ ID NO: 166319 - protein, 76 aa, Glycine max
  Coding DNA Sequence Number=SeqID_49541
MGHLRFVILFGRNNQHENTEKGVPMNPKRIKVIPEWPAPPSVLRKKAQRFKNLGDLRSNPFQGGGNDAILLRKGIG

SEQ ID NO: 166320 - protein, 91 aa, Glycine max
  Coding DNA Sequence Number=SeqID_49542
MVTKGSIKLLTSFNTEKDGYKYVIFKYMFSAGDGSRVTIHADQKVAWECYMASLKLTPIQEVQRTQAINVVTWLGMDMVEALDLDPRTVED

SEQ ID NO: 166321 - protein, 109 aa, Glycine max
  Coding DNA Sequence Number=SeqID_49543
PTGCPSPPARSCHRDIGIAPARHPVDPEKSNRVLGFPALITSLHQIYEVPVTPSKVIKPSTNRAFIKKDGRQRATDAPSPPPKPLSSSTKPGALPTTRGRPVGDQVQSQ

SEQ ID NO: 166322 - protein, 92 aa, Glycine max
  Coding DNA Sequence Number=SeqID_49544
  Gene Ontology: Mol. function=carbon-sulfur lyase activity; Cellular component=vacuole
  Homolog annotation: Hit_ID=Q9FE98; Match level="QueryCoverage=67%, HitCoverage=13%, E-value=3e-12, Identity=50%"; Hit description =Alliinase, putative; 28821-30567
  Pfam annotation: Domain name=EGF_alliinase; Domain location=31-87; Score=128.0; E_value=2.6e-35; Accession=PF04863.4; Description =Alliinase EGF-like domain
MAKRTSPIYIGFVIVLCASSMFVICMGEWESTWSTRAAEEAEAVAAIPCSGHGRAYLDGLILKGHEPVCECNPCYGGSDCSNLLSDCAANAG

SEQ ID NO: 166323 - protein, 59 aa, Glycine max
  Coding DNA Sequence Number=SeqID_49545
MDDSGREGDEFQKCRGSFAVQCGVMFCQGSLMSIGHRWQALKHVHGLHGFGCEIHDVRE

SEQ ID NO: 166324 - protein, 46 aa, Glycine max
  Coding DNA Sequence Number=SeqID_49546
MAAASGERWMDRLQFSSLFWPPPLDDQQRKLGLYPYYPCSVLLFAF

SEQ ID NO: 166325 - protein, 149 aa, Glycine max
  Coding DNA Sequence Number=SeqID_49547
  Homolog annotation: Hit_ID=Q6CQE5; Match level="QueryCoverage=37%, HitCoverage=51%, E-value=3e-11, Identity=64%"; Hit description =Protein TAR1
MLLRGVYADLPRAPASWLVEIWVHGRLRRDKMVDEPRSRPITCEPVSSGPIDDPLRARTLPTRPQSGEASSVADRAQVPWKGAPERVRAPSCPDPVAPRGAVGESGCLGMQPQSGGKFRPRLNTGERPIANKYREGKMKRTLFGESKSA

SEQ ID NO: 166326 - protein, 270 aa, Glycine max
  Coding DNA Sequence Number=SeqID_49548
  Gene Ontology: Mol. function=carbon-sulfur lyase activity; Cellular component=vacuole
  Homolog annotation: Hit_ID=Q9FE98; Match level="QueryCoverage=95%, HitCoverage=57%, E-value=1e-81, Identity=54%"; Hit description =Alliinase, putative; 28821-30567
  Pfam annotation: Domain name=Alliinase_C; Domain location=1-259; Score=355.6; E_value=8e-104; Accession=PF04864.4; Description =Allinase, C-terminal domain
MINFLPQVYRAQTQFFNSRDFSYEGDTSLWKNSTDSNSRFIEFVTSPNNPDGKLNKGVLKGPNVKTIYDRAYYWPHFTAIPSPADDDLMLFTISKLTGHAGSRFGWAIIKDEAVYQTMLTYLQLNTFGVSRDAQLRALKLLDVVLEGDGKELFQFAYSTLKDRWRRLKQIISESKRFSLQNLSPQYCTFFKRVKDPSPAYAWLKCERQQDKNCYEILEAAGIIGRQGSDYSADNRYLRLSLIRSEDDFEILINKLKNLVPTEKETKDFNN

SEQ ID NO: 166327 - protein, 290 aa, Glycine max
  Coding DNA Sequence Number=SeqID_49549
  Gene Ontology: Mol. function=carbon-sulfur lyase activity; Cellular component=vacuole
  Homolog annotation: Hit_ID=Q9FE98; Match level="QueryCoverage=92%, HitCoverage=59%, E-value=1e-81, Identity=51%"; Hit description =Alliinase, putative; 28821-30567
  Pfam annotation: Domain name=Alliinase_C; Domain location=90-290; Score=172.0; E_value=1.5e-48; Accession=PF04864.4; Description =Allinase, C-terminal domain
  Pfam annotation: Domain name=EGF_alliinase; Domain location=32-88; Score=128.2; E_value=2.3e-35; Accession=PF04863.4; Description =Alliinase EGF-like domain
  Pfam module annotation: Pfam domain module=Alliinase_C::EGF _alliinase; Domain location=90-290::32-88
MGHFISQKSQSSTEKLLEYYYFIRKTTGEWEPTWSSRAAEEAEAVAAIPCSGHGRVYLDGLILKGHEPVCECNPCYGGSDCSKLLSDCAANAAGGDPYFMEPFWMRHAASSAILVSGWHRMGYSYSDKSYISQLLVEYIKKLHAIVGNAITKGKYIVFGSGSTQLLNAAVYALSPNSSMSPAKVVATAPYYPVYRTQTQFFNSRDFSYEGETSSWKNKTDKNSIFIEFVTSPNNPDGKLTKEVLEGPNVKSIYDRAYYWPHFTAIPSPADDDLMIFTISKLTGHAGSRFG

SEQ ID NO: 166328 - protein, 78 aa, Glycine max
  Coding DNA Sequence Number=SeqID_49550
  Gene Ontology: Mol. function=magnesium ion binding; Cellular component=membrane; Biological process=photosynthesis, light harvesting
  Homolog annotation: Hit_ID=Q43437; Match level="QueryCoverage=98%, HitCoverage=37%, E-value=1e-36, Identity=79%"; Hit description =Photosystem II type I chlorophyll a/b-binding protein precursor
MGAVEGYRIAGGPLGEVTDPIYPGGSFDPLGLADDPEAFAELKAIVTGKGPLENLADHLADPVNNNAWAYATNFVPGK

SEQ ID NO: 166329 - protein, 293 aa, Glycine max
  Coding DNA Sequence Number=SeqID_49551
  Gene Ontology: Mol. function=carbon-sulfur lyase activity; Cellular component=vacuole
  Homolog annotation: Hit_ID=Q9FE98; Match level="QueryCoverage=88%, HitCoverage=57%, E-value=5e-83, Identity=53%"; Hit description =Alliinase, putative; 28821-30567
  Pfam annotation: Domain name=Alliinase_C; Domain location=93-293; Score=174.3; E_value=3e-49; Accession=PF04864.4; Description =Allinase, C-terminal domain
  Pfam annotation: Domain name=EGF_alliinase; Domain location=35-91; Score=128.7; E_value=1.6e-35; Accession=PF04863.4; Description =Alliinase EGF-like domain
  Pfam module annotation: Pfam domain module=Alliinase_C::EGF _alliinase; Domain location=93-293::35-91
MGTREEKGVKYGVKSTHDFRMQGVVHAVMEGEWEPTWSSRAAEEAEAVAAIPCSGHGRAYLDGLILKGHEPVCECNPCYGGSDCSKLLSDCAANAGSGDPYFMEPFWMRHAAGSAILVSGWHRMGYSYSDGSYISQLLVEYIKKLHGIVGNAITEGKYIVFGSGSTQLLNAAVYALSPNSSMSPAKVVATAPYYPVYRTQTQFFNSRDFSYEGETSSWKNKTDKNSIFIEFVTSPNNPDGKLTKEVLEGPNVKSIYDRAYYWPHFTAIPSPADDDLMIFTISKLTGHAGSRFG

SEQ ID NO: 166330 - protein, 470 aa, Glycine max
  Coding DNA Sequence Number=SeqID_49552
  Gene Ontology: Mol. function=protein serine/threonine kinase activity; Cellular component=mitochondrion; Biological process =protein amino acid phosphorylation
  Homolog annotation: Hit_ID=Q1SMD3; Match level="QueryCoverage=98%, HitCoverage=91%, E-value=0.0, Identity=40%"; Hit description=TonB box, N-terminal; Tetratricopeptide-like helical
  Pfam annotation: Domain name=PPR; Domain location=11-45; Score=29.9; E_value=8.7e-06; Accession=PF01535.11; Description=PPR repeat
  Pfam annotation: Domain name=PPR; Domain location=116-150; Score =46.9; E_value=6.6e-11; Accession=PF01535.11; Description=PPR repeat
  Pfam annotation: Domain name=PPR; Domain location=151-185; Score =41.8; E_value=2.3e-09; Accession=PF01535.11; Description=PPR repeat
  Pfam annotation: Domain name=PPR; Domain location=186-220; Score =41.9; E_value=2.1e-09; Accession=PF01535.11; Description=PPR repeat
  Pfam annotation: Domain name=PPR; Domain location=221-255; Score =44.1; E_value=4.7e-10; Accession=PF01535.11; Description=PPR repeat
  Pfam annotation: Domain name=PPR; Domain location=256-290; Score =51.6; E_value=2.7e-12; Accession=PF01535.11; Description=PPR repeat
  Pfam annotation: Domain name=PPR; Domain location=291-325; Score =45.0; E_value=2.6e-10; Accession=PF01535.11; Description=PPR repeat
  Pfam annotation: Domain name=PPR; Domain location=326-360; Score =45.7; E_value=1.6e-10; Accession=PF01535.11; Description=PPR repeat
  Pfam annotation: Domain name=PPR; Domain location=361-395; Score =40.1; E_value=7.5e-09; Accession=PF01535.11; Description=PPR repeat
  Pfam annotation: Domain name=PPR; Domain location=396-430; Score =49.6; E_value=1e-11; Accession=PF01535.11; Description=PPR repeat
  Pfam annotation: Domain name=PPR; Domain location=431-465; Score =17.2; E_value=0.06; Accession=PF01535.11; Description=PPR repeat
  Pfam annotation: Domain name=PPR; Domain location=46-80; Score=25.2; E_value=0.00024; Accession=PF01535.11; Description=PPR repeat
  Pfam annotation: Domain name=PPR; Domain location=81-115; Score=31.9; E_value=2.2e-06; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=11-45::116 -150::151-185::186-220::221-255::256-290::291-325::326-360::361 -395::396-430::431-465::46-80::81-115
MEVKGIRANFVTLNILINCFCHLGQMAFSFSVLGKILKLGYQPNTVTLNTLMKGLCLKGEVKKSLHFHDKVVAQGFQMDHVSYGTLLNGLCKIGETRCAVKLLRMIEDRSTRPNVVMYNTIIDGLCKDKLVNEAYDLYSEMNARGIFPDAITYTTLIYGFCLLGQLMGAFGLLNEMILKNINPDVYTFSILIDALCKEGKVKEAKNLLAVMTKEGIKPGVVTYSTLMDGYCLVGEVQNAKQIFHAMVQMGVNPNVYSYNIMINGLCKCKRVDEAMNLLREMLHKNMVPDTVTYNSLIDGLCKSGRITSALNLMNEMHHRGQPADVVTYTSLLDALCKNQNLDKATALFMKMKERGIQPTMYTYTALIDGLCKGGRLKNAQELFQHLLVKGCCIDVWTYTVMISGLCKEGMFDEALAIKSKMEDNGCIPNAVTFEIIIRSLFEKDENDKAEKLLHEMIAKGLLGFRNFHGE

SEQ ID NO: 166331 - protein, 81 aa, Glycine max
  Coding DNA Sequence Number=SeqID_49553
MKNGSKLIGGGCMNENAIHGAPNKRRGWRIALSNHYAWLQTHGWRIHERKRNSWGSEKGLRMENCTKQSLRMAPNSWVEDA

SEQ ID NO: 166332 - protein, 128 aa, Glycine max
  Coding DNA Sequence Number=SeqID_49554
  Gene Ontology: Mol. function=calcium ion binding; Cellular component =Golgi stack; Biological process=protein amino acid phosphorylation
  Homolog annotation: Hit_ID=Q1S4R3; Match level="QueryCoverage=86%, HitCoverage=69%, E-value=2e-37, Identity=38%"; Hit description =Tetratricopeptide-like helical
  Pfam annotation: Domain name=PPR; Domain location=30-64; Score=32.7; E_value=1.3e-06; Accession=PF01535.11; Description=PPR repeat
  Pfam annotation: Domain name=PPR; Domain location=65-99; Score=41.6; E_value=2.7e-09; Accession=PF01535.11; Description=PPR repeat
  Pfam module annotation: Pfam domain module=PPR::PPR; Domain location =30-64::65-99
MKGLCLKGEVKKLLHFHDKVVAQAFQTNQVSYGTLLNGLCKTGETRCAIKLLRMIEDRSTRPNVVMYSAIIDGLCKDKLVNEAYDLYSEMDAREIFPNVITYNTLICAFCLAECKTDVSWYNPNESKS

SEQ ID NO: 166333 - protein, 72 aa, Glycine max
  Coding DNA Sequence Number=SeqID_49555
MERVTNNIGDEVTTIQATEEWTRFYDSLAMNIEMESSNVKNKSSGKRKMSSEDTRSYFTWNLEMDRVLADVL

SEQ ID NO: 166334 - protein, 181 aa, Glycine max
  Coding DNA Sequence Number=SeqID_49556
MGDQEETREQMKADMSALKEQMVSMMEAMLGMRQLMENNMATAVAVSSAAEADPTLPAIAHHPLPNAVGRESSTLGRIINPHLGYNRVAYPYGLPPNYTPPVMRDDAGHGPAPNTLPQHNLTAQPIFLSERPPPVAEERRKHDIIEVGLRDVEGFGDYPFADMTDSLLGTGRRHPPKIQGT

SEQ ID NO: 166335 - protein, 507 aa, Glycine max
  Coding DNA Sequence Number=SeqID_49557
  Gene Ontology: Mol. function=protein serine/threonine kinase activity; Cellular component=mitochondrion; Biological process =protein amino acid phosphorylation
  Homolog annotation: Hit_ID=Q1SMD3; Match level="QueryCoverage=91%, HitCoverage=92%, E-value=1e-168, Identity=42%"; Hit description=TonB box, N-terminal; Tetratricopeptide-like helical
  Pfam annotation: Domain name=PPR; Domain location=101-135; Score =30.4; E_value=6.2e-06; Accession=PF01535.11; Description=PPR repeat
  Pfam annotation: Domain name=PPR; Domain location=136-170; Score =23.6; E_value=0.00069; Accession=PF01535.11; Description=PPR repeat
  Pfam annotation: Domain name=PPR; Domain location=171-205; Score =31.9; E_value=2.2e-06; Accession=PF01535.11; Description=PPR repeat
  Pfam annotation: Domain name=PPR; Domain location=206-240; Score =47.6; E_value=4.3e-11; Accession=PF01535.11; Description=PPR repeat
  Pfam annotation: Domain name=PPR; Domain location=241-275; Score =39.3; E_value=1.4e-08; Accession=PF01535.11; Description=PPR repeat
  Pfam annotation: Domain name=PPR; Domain location=276-310; Score =43.0; E_value=9.9e-10; Accession=PF01535.11; Description=PPR repeat
  Pfam annotation: Domain name=PPR; Domain location=311-345; Score =44.1; E_value=4.7e-10; Accession=PF01535.11; Description=PPR repeat
  Pfam annotation: Domain name=PPR; Domain location=346-380; Score =51.6; E_value=2.7e-12; Accession=PF01535.11; Description=PPR repeat
  Pfam annotation: Domain name=PPR; Domain location=381-415; Score =45.0; E_value=2.6e-10; Accession=PF01535.11; Description=PPR repeat
  Pfam annotation: Domain name=PPR; Domain location=416-450; Score =45.7; E_value=1.6e-10; Accession=PF01535.11; Description=PPR repeat
  Pfam annotation: Domain name=PPR; Domain location=451-485; Score =40.1; E_value=7.5e-09; Accession=PF01535.11; Description=PPR repeat
  Pfam annotation: Domain name=PPR; Domain location=66-100; Score=6.7; E_value=1.2; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=101-135::136 -170::171-205::206-240::241-275::276-310::311-345::346-380::381 -415::416-450::451-485::66-100
  Subcellular localization annotation: CTP_CleavageSite=46; ConfidenceScore=5.55e-01
MSFSFSLSRRLSSSPSLPIPNFPPFLPNPTFPLCFHSQPPSIDNVVDDTVSQFSGMLLVRHTPPIIEFNKILGSLAKMKQYLTAISLSKQMEVKGIRANFVTLNILINCFCHLGQMAFSFSVLGKILKLGYQPDTITLNTLMKGLCLKGEVKKSLHFHDKVVAQGFQMDHVSYGTLLNGLCKIGETRCAVKLLRMIEDRSTRPNVVMYNTIIDGLCKDKLVNEAYDLYSEMDARGIFPDAITYTTLIYGFCLLGQLMGAFSLLDEMILKNINPGVYIYNILINALCKEGNVKEAKNLLAVMTKEGIKPGVVTYSTLMDGYCLVGEVQNAKQIFHAMVQMGVNPNVYSYNIMINGLCKCKRVDEAMNLLREMLHKNMVPDTVTYNSLIDGLCKSGRITSALNLMNEMHHRGQPADVVTYTSLLDALCKNQNLDKATALFMKMKERGIQPTMYTYTALIDGLCKGGRLKNAQELFQHLLVKGCCIDVWTYTVMISGLCKEGMFDEALAI

SEQ ID NO: 166336 - protein, 105 aa, Glycine max
  Coding DNA Sequence Number=SeqID_49558
MAMERVSEFPHTYMDRRPRKRVPKVVDLVKFAYIGYICFSFCGSLNHGDGTRLRISSQEGSSRKVTLILPIECSFPIEKTHLFLFQFSSAWWLCNVMMKKHPTGK

SEQ ID NO: 166337 - protein, 559 aa, Glycine max
  Coding DNA Sequence Number=SeqID_49559
  Gene Ontology: Mol. function=protein serine/threonine kinase activity; Cellular component=mitochondrion; Biological process =protein amino acid phosphorylation
  Homolog annotation: Hit_ID=Q1RSC2; Match level="QueryCoverage=91%, HitCoverage=93%, E-value=0.0, Identity=62%"; Hit description =Pentatricopeptide repeat
  Pfam annotation: Domain name=PPR; Domain location=126-160; Score =22.4; E_value=0.0016; Accession=PF01535.11; Description=PPR repeat
  Pfam annotation: Domain name=PPR; Domain location=161-195; Score =31.8; E_value=2.5e-06; Accession=PF01535.11; Description=PPR repeat
  Pfam annotation: Domain name=PPR; Domain location=196-230; Score =48.7; E_value=2e-11; Accession=PF01535.11; Description=PPR repeat
  Pfam annotation: Domain name=PPR; Domain location=231-265; Score =44.7; E_value=3.2e-10; Accession=PF01535.11; Description=PPR repeat
  Pfam annotation: Domain name=PPR; Domain location=266-300; Score =47.0; E_value=6.5e-11; Accession=PF01535.11; Description=PPR repeat
  Pfam annotation: Domain name=PPR; Domain location=301-335; Score =45.7; E_value=1.6e-10; Accession=PF01535.11; Description=PPR repeat
  Pfam annotation: Domain name=PPR; Domain location=336-370; Score =40.5; E_value=5.9e-09; Accession=PF01535.11; Description=PPR repeat
  Pfam annotation: Domain name=PPR; Domain location=371-405; Score =42.4; E_value=1.6e-09; Accession=PF01535.11; Description=PPR repeat
  Pfam annotation: Domain name=PPR; Domain location=406-440; Score =48.9; E_value=1.7e-11; Accession=PF01535.11; Description=PPR repeat
  Pfam annotation: Domain name=PPR; Domain location=441-475; Score =39.1; E_value=1.6e-08; Accession=PF01535.11; Description=PPR repeat
  Pfam annotation: Domain name=PPR; Domain location=476-510; Score =53.1; E_value=9.2e-13; Accession=PF01535.11; Description=PPR repeat
  Pfam annotation: Domain name=PPR; Domain location=511-545; Score =17.4; E_value=0.053; Accession=PF01535.11; Description=PPR repeat
  Pfam annotation: Domain name=PPR; Domain location=56-90; Score=17.4; E_value=0.054; Accession=PF01535.11; Description=PPR repeat
  Pfam annotation: Domain name=PPR; Domain location=91-125; Score=27.3; E_value=5.4e-05; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=126 -160::161-195::196-230::231-265::266-300::301-335::336-370::371 -405::406-440::441-475::...
  Pfam module annotation: Domain location=476-510::511-545::56-90::91 -125
  Subcellular localization annotation: CTP_CleavageSite=62; ConfidenceScore=5.43e-01
LSSSLSPSIPKFPPFLPNPTFLPCFHSQPSSIDNIVVDAVCQFNSMLLVRDTPPIMEFNKIVGSLVKMKHYPTAISLFKQMQVKGIEPDLFTLNILINCFCHLGQMTFSFTVLGKILKLGYQPNTITLNTLMKGLCLKGEVKKSLHFHDKVVAQGFQMDQVSYATLLNGLCKIGETRSALKLLRMIEDRSTRPNVVMYNTIIDGLCKDKLVNEAYDLYSEMDARGIFPNVITYSTLIYGFCLAGQLMEAFGLLNEMILKNINPNVYTYTILMDALCKEGKVKEAKNLLAVMTKEGVKPNVVSYNTLMDGYCLIGEVQNAKQMFHTMVQKGVNPNVYSYNIMIDRLCKSKRVDEAMNLLREVLHKNMVPNTVTYSSLIDGFCKLGRITSALDLLKEMYHRGQPADVVTYTSLLDALCKNQNLDKATALFMKMKERGIQPNKYTYTALIDGLCKGGRHKNAQKLFQHLLVKGCRINVWTYNVMISGLCKEGMLDEALAMKSKMEENGCIPDAVTFEIIIRSLFEKDQNDKAEKLLHEMIAKDLLRFRDFHGERSPVTNKLL

SEQ ID NO: 166338 - protein, 143 aa, Glycine max
  Coding DNA Sequence Number=SeqID_49560
LVDLSSFWQDGDLDLNASPQALDKLLGHVLAFKVRIQSKFKNAVVLRYSNDLDLINAILKMLADSEACCKIDPSNVDCNNTTHAECQSLSITTDHDSVAGFPLTPKKRMSSDEVDDDLGSSQISPAQLSFNKLTRHSHKSQFS

SEQ ID NO: 166339 - protein, 149 aa, Glycine max
  Coding DNA Sequence Number=SeqID_49561
  Gene Ontology: Mol. function=metal ion binding; Cellular component =periplasmic space; Biological process=electron transport
  Homolog annotation: Hit_ID=P0ABL3; Match level="QueryCoverage=76%, HitCoverage=76%, E-value=8e-47, Identity=71%"; Hit description =Diheme cytochrome c napB precursor
  Subcellular localization annotation: CTP_CleavageSite=8; ConfidenceScore=5.06e-01
MMPPAKPRISSVPSARRLGRRHQRQIRISFCFIATSLPKAVSRLKGVFHHRFGIGLRHVTLQAEVATRRYRAAHHAVAVGKVRRTDARRAGGQIALGAVTLQAAVHVLRHLVALHAVRDHRRLINIVQRLAALLFGLMNGALLRCRHFR

SEQ ID NO: 166340 - protein, 107 aa, Glycine max
  Coding DNA Sequence Number=SeqID_49562
MVFHLRHVMSLPKELIQGRLIWLEAYKNKMPKSSPNMHVKQEVSTRVKPRLMCKQQMGQNTLNKIDDDGSNSHQGRCPLSYLNFVRGPLLDDMRLLFGPCKVLGTHH

SEQ ID NO: 166341 - protein, 340 aa, Glycine max
  Coding DNA Sequence Number=SeqID_49563
  Gene Ontology: Mol. function=zinc ion binding; Cellular component =integral to membrane; Biological process=ubiquitin cycle
  Homolog annotation: Hit_ID=Q1SCX5; Match level="QueryCoverage=97%, HitCoverage=100%, E-value=8e-75, Identity=47%"; Hit description=Zinc finger, RING-type
  Pfam annotation: Domain name=C1_4; Domain location=117-161; Score= -7.5; E_value=0.019; Accession=PF07975.2; Description=TFIIH C1-like domain
  Pfam annotation: Domain name=zf-C3HC4; Domain location=118-159; Score= 33.0; E_value=1e-06; Accession=PF00097.15; Description=Zinc finger, C3HC4 type (RING finger)
  Pfam module annotation: Pfam domain module=C1_4::zf-C3HC4; Domain location=117-161::118-159
MDFVSQRHLLQLSHATPPSSSNNYSFLVILVIGIMFTSFFLIGYYMLVVKCCLNWSHVDHVRIFSLSRLHEDPSAPYSTASEPRGLEEAVIKLIPVIQYKPEEGNTEFGERSLISSECSVCLSEFEQDEKLRVIPNCSHVFHIDCIDVWLQNNAHCPLCRRTVSLTSQVHRHVDQVNLLITPRPSHQGQSQNNENLTDEGGFVVIDLDGEHDRDQGRQEELPTTCPIISLSSGIKLLEEKKARKLQKVTSLGDECIGVRAKGERLSVQAMKRSFSMDSSVDRKFYGAVQEALHQQQQNGNVFEVSTIEASGESDRVKRSFFSFGHGSKSRSAVLPVYLDP

SEQ ID NO: 166342 - protein, 63 aa, Glycine max
  Coding DNA Sequence Number=SeqID_49564
MVSMDACSQITCVNTEVDIPGDAAACQENTKKRGHADSSCQVGSKACREKLRRERLNERHACF

SEQ ID NO: 166343 - protein, 114 aa, Glycine max
  Coding DNA Sequence Number=SeqID_49565
MEAIDPAAKMNCEILRTSPRTVPGVPEKSFIFLFQIKSMLRNPQIPNNENPSSDSSPMQQKQITKEPQKVRLLTTTSQPHHTHHTKSQANRKIRHRNREPEWKKKTNQRFQDEF

SEQ ID NO: 166344 - protein, 88 aa, Glycine max
  Coding DNA Sequence Number=SeqID_49566
  Gene Ontology: Mol. function=transcription regulator activity; Cellular component=nucleus; Biological process=regulation of transcription
  Homolog annotation: Hit_ID=Q1SCX7; Match level="QueryCoverage=94%, HitCoverage=33%, E-value=2e-34, Identity=83%"; Hit description=Helix- loop-helix DNA-binding
MSGVAEKNELREEKLVLKADKERIEKQLKALPVAPAGYMTPPVAAAAYQAGVNKMALYPNYGYIPMWQYLPQSVRDTSHDHELRPPAA

SEQ ID NO: 166345 - protein, 224 aa, Glycine max
  Coding DNA Sequence Number=SeqID_49567
  Gene Ontology: Biological process=nodulation
  Homolog annotation: Hit_ID=P08961; Match level="QueryCoverage=99%, HitCoverage=95%, E-value=4e-30, Identity=39%"; Hit description =Nodulin 22 precursor
  Pfam annotation: Domain name=Nodulin; Domain location=7-223; Score =239.0; E_value=1e-68; Accession=PF02451.6; Description=Nodulin
MEKMRVILMTLFLYIGTLVAEDADIDKAINNARDADIGKAINPTEDADIGLLSEPEAYESPVFKKYVTQCTPHVATTCSITSRTDLKIESEAILGLCLFDSMERCLVQHEIGNVNYRLFRPPSPPPGRGPPIEPIDPIPPWIPSPPIVPRTKLDNHQHLQYYQTLLTETTKFRTVLRRCTHVSAQSCLTAPNVASSTLLAACLIPSMNQCVYPARAQSASSPQI

SEQ ID NO: 166346 - protein, 114 aa, Glycine max
  Coding DNA Sequence Number=SeqID_49568
  Gene Ontology: Mol. function=protein serine/threonine kinase activity; Cellular component=mitochondrion; Biological process =protein amino acid phosphorylation
  Homolog annotation: Hit_ID=Q1SDW8; Match level="QueryCoverage=95%, HitCoverage=25%, E-value=9e-44, Identity=80%"; Hit description =Protein kinase
  Pfam annotation: Domain name=Pkinase_Tyr; Domain location=24-114; Score=-151.4; E_value=0.0035; Accession=PF07714.7; Description =Protein tyrosine kinase
GHESSTIESLQFNLPTIVAATNNFSYENKIGKGGFGEVYKGILSDERPIAVKRLSRTSKQGVEEFKNEVLLIAKLQHRNLVTFIGFCLEEQEKILIYEYVPNKSLDYFLFGLIL

SEQ ID NO: 166347 - protein, 314 aa, Glycine max
  Coding DNA Sequence Number=SeqID_49569
  Gene Ontology: Mol. function=isomerase activity; Biological process =metabolic process
  Homolog annotation: Hit_ID=Q2HUF7; Match level="QueryCoverage=75%, HitCoverage=100%, E-value=3e-61, Identity=52%"; Hit description =Enoyl-CoA hydratase/isomerase
  Pfam annotation: Domain name=ECH; Domain location=86-262; Score=63.1; E_value=9.1e-16; Accession=PF00378.10; Description=Enoyl-CoA hydrataseisomerase family
MSSCTKVQHARNARDCIGLPSYSAIENNTFHEEVPKAWQSQRCESNSRNALLIWHGYLLKKRHELMTHTLARNNTMCTLEKRGPLFVLTLTSEFDDQHRLNPTLLSSLLAALSEVKSQATAGSALLTAAHGRFFCNGFDFRWAQAAGDQPSARLRLRRMSDALRPVLAALLSLPIPTVAAVSGHAAAAGAIFALAHDYVLMRADRGVIYFPEVDLGITLPEYFAAVAGAKIPAAALRDVVLAGRKVRAEGAVEMGIVHSAHDSAEGTVEAAMRLGEELARRKWVGDAYAEIRKSLYPEVCAALGLTPKTIVSKI

SEQ ID NO: 166348 - protein, 357 aa, Glycine max
  Coding DNA Sequence Number=SeqID_49570
  Gene Ontology: Mol. function=oxidoreductase activity; Cellular component=proton-transporting two-sector ATPase complex; Biological process=ATP synthesis coupled proton transport
  Homolog annotation: Hit_ID=Q1S826; Match level="QueryCoverage=99%, HitCoverage=99%, E-value=1e-118, Identity=56%"; Hit description=2OG -Fe(II) oxygenase
  Pfam annotation: Domain name=2OG-FeII_Oxy; Domain location=206-305; Score=139.7; E_value=7.9e-39; Accession=PF03171.10; Description=2OG -Fe(II) oxygenase superfamily
MADSDREKELKAFDDTKLGVKGLVDAGITKIPRIFHHPPDNFKKASDLGYKDYTIPVIDLASIREDLRERERVVERIKEASETWGFFQIVNHGIPVSTLEEMVDGVLRFFEQDSEVKKEFYTRELRPFFYTSNYNLYTTAPTTWKDSFYCNLAPNAPKPEDLPAVCRDILVEYSNEVLKLGTLLFELLSEALGLDPTYLTNIGCTEGLFAFSHYYPACPEPELTMGTAKHSDMDFITVLLQGHIGGLQVFHKDMWIDLPPLTGALVVNIGDFLQLISNDKFKSAQHRVLANPIGPRVSIACFFSTGLNPTSRIYGPIKELLSEDNPAKYREFTVPKFLAHHRTKCLNGTSPLLHFRI

SEQ ID NO: 166349 - protein, 189 aa, Glycine max
  Coding DNA Sequence Number=SeqID_49571
  Gene Ontology: Mol. function=nucleic acid binding; Cellular component= nucleus; Biological process=response to DNA damage stimulus
  Homolog annotation: Hit_ID=Q9FIY7; Match level="QueryCoverage=92%, HitCoverage=16%, E-value=4e-49, Identity=52%"; Hit description =Putative SWI/SNF-related matrix-associated actin-dependent regulator of chromatin subfamily A member 3-like 3
  Pfam annotation: Domain name=Helicase_C; Domain location=79-152; Score=31.8; E_value=2.4e-06; Accession=PF00271.21; Description =Helicase conserved C-terminal domain
LWGTSAGGKCPIRRQLLQKDDLITYSSESPFKLDVKNNVTESSKVSKLFEFLQRILNTSSEKSIVFSQWASFFYLLENSLRRKGIGFLRYDGKLTQKQREKVLDEFNQTREKRVMLMSLKDGGVGLNLTAASNVFIMDTVEDRLQQVQARKQRLISGTLTDDEVRTARIQDLKMLFTREFIYLEGDLFV

SEQ ID NO: 166350 - protein, 319 aa, Glycine max
  Coding DNA Sequence Number=SeqID_49572
  Gene Ontology: Mol. function=hydrolase activity; Cellular component =nucleus; Biological process=protein amino acid dephosphorylation
  Homolog annotation: Hit_ID=Q1T5K1; Match level="QueryCoverage=97%, HitCoverage=96%, E-value=1e-166, Identity=88%"; Hit description =Serine/threonine-specific protein phosphatase and bis(5-nucleosyl)- tetraphosphatase
  Pfam annotation: Domain name=Metallophos; Domain location=53-248; Score=154.2; E_value=3.3e-43; Accession=PF00149.18; Description =Calcineurin-like phosphoesterase
MERGVLDGIINRLLQVRGRPGKQVQLSEAEIRQLCAVSRDIFLKQPNLLELEAPIKICGDIHGQYSDLLRLFEHGGFPPRSNYLFLGDYVDRGKQSLETMCLLLAYKIKYPENFFLLRGNHECASVNRVYGFYDECKRRFNVRLWKIFADCFNCMPVAAIIEEKIFCMHGGLSPELHNLSQISSLPRPTEVPESGLLCDLLWSDPSKDIEGWGENDRGVSYTFGASRVTEFLGKHDLDLICRAHQVVEDGYEFFANRQLVTIFSAPNYCGEFDNAGAMMSVDETLMCSFQILRPAEHRKPKFAFGSKTTFKASTSNKNL

SEQ ID NO: 166351 - protein, 295 aa, Glycine max
  Coding DNA Sequence Number=SeqID_49573
  Gene Ontology: Mol. function=binding; Cellular component =intracellular; Biological process=protein kinase C activation
  Homolog annotation: Hit_ID=Q6Z996; Match level="QueryCoverage=97%, HitCoverage=42%, E-value=9e-66, Identity=43%"; Hit description =Putative pentatricopeptide (PPR) repeat-containing protein
  Pfam annotation: Domain name=PPR; Domain location=168-202; Score =12.9; E_value=0.22; Accession=PF01535.11; Description=PPR repeat
  Pfam annotation: Domain name=PPR; Domain location=203-237; Score =16.3; E_value=0.088; Accession=PF01535.11; Description=PPR repeat
  Pfam annotation: Domain name=PPR; Domain location=85-119; Score=34.8; E_value=3e-07; Accession=PF01535.11; Description=PPR repeat
  Pfam module annotation: Pfam domain module=PPR::PPR::PPR; Domain location=168-202::203-237::85-119
MTIHSSILHMEQGSGVDVFFLSQAMTSCGSKRDLSGGIQHHCLAITTGLIASVYVGSSLISLYTRYALLGDAYRVFKEMPVRNVVSWTTIIAGFAQEWSLDVCLELFQQMRGSDSRPNCFTYTSLLSACMGSGVLGHERCAHCQIIQMDFHSYLHINNALVAIEQGCCHMEHHDHGYAQHGLAHEAIILFEEMIKRGVNPDTVTHLGVLSSCRHGGLVKEGQVYFNSMVEHGVQPELDHYSCIVDLLGWPGLLLGARDFIQNMPIFPNAVIWGSLLSFSRLHGNVQIGIQAAESR

SEQ ID NO: 166352 - protein, 193 aa, Glycine max
  Coding DNA Sequence Number=SeqID_49574
  Gene Ontology: Mol. function=hydrolase activity, acting on ester bonds; Biological process=lipid metabolic process
  Homolog annotation: Hit_ID=Q1R548; Match level="QueryCoverage=94%, HitCoverage=85%, E-value=2e-35, Identity=42%"; Hit description =Hypothetical protein yhjY
MASGVLMPGKQEYIANDTKSNTSERYTWDSDHQPRYEDILAERMRASEAPAGLALNQALAPPDLSHGMSVGWNYSLASGVTSGPVASLRSDLNPPPATRRAGESIYVNTLGWRMDYQQLWGVHPWAQVSYNQSISIDNNASISRGKDGSWGDVTLGADMPLGSHLAAWATLSQADKVRRGENTLYLMGVSANF

SEQ ID NO: 166353 - protein, 120 aa, Glycine max
  Coding DNA Sequence Number=SeqID_49575
MDEIHKVQEQIKADTEALKEKMATIVEAMMSIKEIVEVSAAYQTRARARVMGEVEKVQEQMKADMEAMKEKMAKMMEAIISMKKIKEVDMVAVATTNVVAKVNPMPPSGLNQMNHPTSNM

SEQ ID NO: 166354 - protein, 104 aa, Glycine max
  Coding DNA Sequence Number=SeqID_49576
  Gene Ontology: Mol. function=nucleic acid binding
MPLRDRIASLYMKERSNRLNLIVIKKILLEHLLSDLPEKVIAKEFLDALGKRYQVPDNVESRCLMKQLTNTRYDNVKGVREFIMKMFHIQTKLKSHRIDLNEHS

SEQ ID NO: 166355 - protein, 118 aa, Glycine max
  Coding DNA Sequence Number=SeqID_49577
MTQSDIRVKSCCRLNLLRASTFNFERFDILRESIEHPSKNLLSFEFAQSFGIPFRASRYITGLNQTSKASEFHFEKLDILRDSIGHPSKKLLSFEFAQSFGIQFRASRHITGLNQTSE

SEQ ID NO: 166356 - protein, 167 aa, Glycine max
  Coding DNA Sequence Number=SeqID_49578
  Gene Ontology: Mol. function=transcription factor activity; Cellular component=nucleus; Biological process=regulation of transcription, DNA-dependent
  Homolog annotation: Hit_ID=Q9LTC5; Match level="QueryCoverage=62%, HitCoverage=80%, E-value=3e-33, Identity=67%"; Hit description =Nicotiana EREBP-3-like protein
  Pfam annotation: Domain name=AP2; Domain location=49-114; Score =145.5; E_value=1.5e-40; Accession=PF00847.10; Description=AP2 domain
MAPFLSSLIEDWVRDGLEDFVEVRESPYMVDIRTQKEKHDKLKEKGRKEVRYRGVRRRPWGKYAAEIRDPSKQGSRLWLGTFETGEEAARAYDHAAFTMRGHVAILNFPNEYHSHHVRGYSPNLASSSSSITHAGGGQQRQVFEFEYLDDKVLEELLEFEENKVQKG

SEQ ID NO: 166357 - protein, 200 aa, Glycine max
  Coding DNA Sequence Number=SeqID_49579
  Gene Ontology: Mol. function=aspartic-type endopeptidase activity; Cellular component=lysosome; Biological process=sphingolipid metabolic process
  Homolog annotation: Hit_ID=Q9FRW9; Match level="QueryCoverage=76%, HitCoverage=38%, E-value=3e-53, Identity=55%"; Hit description =Aspartic proteinase 1
  Pfam annotation: Domain name=Asp; Domain location=8-195; Score=-40.4; E_value=3.2e-11; Accession=PF00026.14; Description=Eukaryotic aspartyl protease
MLKRNTDSEGATLTEARPFGSSAKIHYGTEHISGFFTLDHVKVRDLVVYDQDFIEAIREPSITFLGAKFDGILGIGFQVYNMLNQHVLAQPIFSFWLNRNTNEEKSGEIVFGGIDSDHYKGEHTYVPVTQKGYWQDAIAQINHAIEAVGVMSQECKAVVCQYGKTILDKLINEVLSVSAVRDNILEVVKVLIGTLNFSLK

SEQ ID NO: 166358 - protein, 267 aa, Glycine max
  Coding DNA Sequence Number=SeqID_49580
  Gene Ontology: Mol. function=signal transducer activity; Cellular component=membrane; Biological process=signal transduction
  Homolog annotation: Hit_ID=UPI00005F7523; Match level="QueryCoverage =68%, HitCoverage=28%, E-value=2e-61, Identity=65%"; Hit description =COG2200: FOG: EAL domain
  Subcellular localization annotation: CTP_CleavageSite=90; ConfidenceScore=5.45e-01
MPVTTVQKITGAMIILISLTKPSPRGFISAPRSGEKWPSRIPSVIARRNSDFRTGKSTGKVTRRLRRRAAKLGFERCARQRPGEQESLPAANAVLQQAVALLGVFHAFGHHRQRQHFGDRTDDAHHRIVGRQPLNEAAVDFNQIDRQGFQAVQVFQTGVAHAEVVKRDRQSQIVQLAQQRQRAVEIVDAHRLGDLQQQLARVYPILRQQVFQMRDERLMLHLYTGNVDRQRQRNAALLPIRQDAAGLFQHPVAERHDHAQLFRERDN

SEQ ID NO: 166359 - protein, 114 aa, Glycine max
  Coding DNA Sequence Number=SeqID_49581
  Gene Ontology: Mol. function=ribonuclease H activity; Biological process=RNA-dependent DNA replication
MAYGHGFFYPLTILEEIRAFNKELLGKWRWDMLQQSNKLWSKILHSKYGGWRSLVEGSRRNNESGWWKDLMEVTHDQQMNSILQDGTTWRVGCGDKIKFWEDSWAGHGKAQKIK

SEQ ID NO: 166360 - protein, 110 aa, Glycine max
  Coding DNA Sequence Number=SeqID_49582
MLHSKIHQETDDEEITAFPSAVLDSWKYFFRNFSTTSSQSYLLSSPTNDNEKMLSLIASSACTSGRAILVKNCSTECRSKYRDDDSSSFDDDKKSKRMISRLSQQVQDQD

SEQ ID NO: 166361 - protein, 172 aa, Glycine max
  Coding DNA Sequence Number=SeqID_49583
  Gene Ontology: Mol. function=DNA binding; Cellular component=oxygen evolving complex; Biological process=DNA integration
  Homolog annotation: Hit_ID=Q1S1E0; Match level="QueryCoverage=98%, HitCoverage=15%, E-value=9e-40, Identity=42%"; Hit description =Integrase, catalytic region
MDEIVLSSNDLAEIQSITHLLDNAFKIKDLGDLKFFIGFEVARTPTGINLCHRNYALDIPNDTDMLSFKLVSTPSNYTTRLHQHLDITYVVQNLSQLVAEPTSAHQEAASRIPRYIKGSPSVGNFLFSNSSIHLKGLSDSDWASCIDTRRSIIGYAIYLGSSFISWKSKETS

SEQ ID NO: 166362 - protein, 108 aa, Glycine max
  Coding DNA Sequence Number=SeqID_49584
  Homolog annotation: Hit_ID=Q1RWS5; Match level="QueryCoverage=77%, HitCoverage=21%, E-value=6e-08, Identity=46%"; Hit description=SBP
MAMSTAGCALSLLSSGSGSRDHHNWLSHHADFSTRCSAALRELIAENRAALMTRQQQQLVYDRVWPHLVVAPHHDADAAVEEEDFEDLQQQQQPESNYFPQHMFPQTQ

SEQ ID NO: 166363 - protein, 87 aa, Glycine max
  Coding DNA Sequence Number=SeqID_49585
  Gene Ontology: Mol. function=protein serine/threonine kinase activity; Biological process=protein amino acid phosphorylation
  Homolog annotation: Hit_ID=Q1SK93; Match level="QueryCoverage=67%, HitCoverage=11%, E-value=2e-16, Identity=71%"; Hit description=EPS15 homology (EH); Protein kinase
MELKGTYEDCHSVNLIMELCGIGEFFDRIIVKGYYSECVAANLYCQIVTVIHDCHTMEITSKLCENVLMNSESNVHGCILTGKFLSP

SEQ ID NO: 166364 - protein, 79 aa, Glycine max
  Coding DNA Sequence Number=SeqID_49586
  Gene Ontology: Mol. function=nucleic acid binding
  Homolog annotation: Hit_ID=Q1S1G2; Match level="QueryCoverage=77%, HitCoverage=4%, E-value=4e-10, Identity=48%"; Hit description =Integrase, catalytic region; Zinc finger, CCHC-type; Peptidase aspartic, catalytic
MSGEQPQQDQSLNIHSPYYLHLGENPATALVSPVLDSSNYNLWSRSMLTALSVKNKVEFVDGSIQGYASNHALHTLEEV

SEQ ID NO: 166365 - protein, 148 aa, Glycine max
  Coding DNA Sequence Number=SeqID_49587
  Homolog annotation: Hit_ID=A0EJF3; Match level="QueryCoverage=27%, HitCoverage=5%, E-value=9e-09, Identity=70%"; Hit description=Beta -glucan-binding protein 4
  Pfam annotation: Domain name=Dabb; Domain location=52-141; Score =18.9; E_value=0.00068; Accession=PF07876.3; Description=Stress responsive AB Barrel Domain
MDWTRKNNKLLLLQGMVLMISMMDLGAVMAGGLTEIGDGRNQPSTSEATNAYYVVGLMGLAYGKADSIASAPIGGFNAARKGRGKDIESHDMLRQGFTHVFLMAFNGKDEFNAFQTHPYDLEFTGVFSPAIKKIVVLDFPSNLVKALA

SEQ ID NO: 166366 - protein, 104 aa, Glycine max
  Coding DNA Sequence Number=SeqID_49588
LAAGVSLNEACSLSENHALSEALSPLSELGESGGNSDKHLCAQRIISLLSEAFVFSRAKLGKIKHYSSGEANSECREQNRGKNQNKEAKNLSFQEDLRFRSNFQ

SEQ ID NO: 166367 - protein, 147 aa, Glycine max
  Coding DNA Sequence Number=SeqID_49589
MWHDRRSFHGDGQSSLFFTNFPETFKVKEMWDNFRNCRQISEIRSSFMAKKIIVNLPRLSRGSWKEQRPIIGDKRGKAGKKPVIKGSGANLVQKDVSYASVTRKVVPNEVIKNKGHLNEGKFFNMSFTPNQKELQRLQQAFIGWVLR

SEQ ID NO: 166368 - protein, 68 aa, Glycine max
  Coding DNA Sequence Number=SeqID_49590
MELVRVREKMKMVKMKLKDGSRLEFGKLDESIRFKVGSPVAKKCGEWRANTLLGGFLGGGEITKANLS

SEQ ID NO: 166369 - protein, 137 aa, Glycine max
  Coding DNA Sequence Number=SeqID_49591
  Subcellular localization annotation: CTP_CleavageSite=41; ConfidenceScore=5.16e-01
MDMDLGNMISSQITHIAQSNSSRLGFLALMTTLCDAKGRVRAGAAPDAPLVVPPPLSAPLSLVSTQPEQLPPCYRVSIRSLGQGSSLPLLGEGGDTSGVGADADVSDDDVADGGDDEDHVVDVTAAQGVWDPWATQD

SEQ ID NO: 166370 - protein, 111 aa, Glycine max
  Coding DNA Sequence Number=SeqID_49592
MAKDRPKRMTLGDFSSFATPQYFTSIARLDVQVANIIYPHSFIQLIQGNLFHGLLSEDRNSLWTWEKVVEKFLKKYFPESKTAEGKVEISSFHQHPDESLSEALDHFHGLL

SEQ ID NO: 166371 - protein, 426 aa, Glycine max
  Coding DNA Sequence Number=SeqID_49593
  Gene Ontology: Mol. function=RNA-directed DNA polymerase activity; Cellular component=intracellular; Biological process=RNA-dependent DNA replication
MTLQLADCSIAELDGLVEDVLVKVRLFNFPVDFVIMDIEEDLDIPLILGHPFMLTAKCVVDMGNVEQEADLAMQRLTIHSPLEKALMNAIDCLTNEEEKDLRAWEYAFQELKKDNVVEKPKVELKVFPAHLEYVFIEENDAKLVMISIDLTSDEEARLVEVLRKYKATIVRQPQRRLNPSMKEEKGDMIVVRNDKNDLIPTRTITGWRMCIDYRMLNDATRNDHFPLPFLNQLLEQLTRHAFYYFLDGYLGYNEIAVDPEEQENTDFTRPFGIFAYRKMPFGLCNSPATFQRCMLAIFADMVEKCIEVFMDDFVVFGPSFDYCLTNLESVLQHCVETNLMLKWEKCHFMVHEGIVLGHKISARGIEIDRAKIDVIEKLPPPVNVKGIRGFLGHVGFYRLKFDEEYLTTFQTLKERLVYAPVIVAPD

SEQ ID NO: 166372 - protein, 58 aa, Glycine max
  Coding DNA Sequence Number=SeqID_49594
MAKEGGFPLRDKLKLSKTRCVFPFYFIFLIEAPSTLGFNVGFLRVKPGVHAKPGLHAE

SEQ ID NO: 166373 - protein, 69 aa, Glycine max
  Coding DNA Sequence Number=SeqID_49595
MSSTGPLCVDSEVERTTRRNNSLTRKTKTLEMLARQEPNSPISPNLPLPSIQEEEHTMVEEEPGHQPPR

SEQ ID NO: 166374 - protein, 420 aa, Glycine max
  Coding DNA Sequence Number=SeqID_49596
  Gene Ontology: Mol. function=RNA-directed DNA polymerase activity; Biological process=RNA-dependent DNA replication
MAILPTTMLLIKVGGTTKTMVGSKMSIPPIDYHLMDSLNQFVQIFITSQNNIDASIKKLEIQLGQVAKDVVELKNVVFSANTQTNPKEHCNFITTRRGTLVGDLNREKNEQEVIVEEVKDDEEGSFTIPITIGDLKAGRYLLDLGASINVMPCSYLAKNVDKFIFPADFVVMDMKEDLEVPLILGRAFMNIARILVNVHDGQIKLGVCDEEITFNVFESLNQLKDEEPCSRVDVLDEVIVDTKKQLHNSSPLEKVLIDAFEDLNNEEENEIEQCLSSLDGLKEIPPHKVNMKEMKVENKIEKVKNELSMLSPSLKCVSFKEDVQKQVVMSNSLSKVKKRRLKFLDLSRMRLPVYKSFRFYNSIAKKLKSKFSKHFTIQNAKPYGVVELEEPNWVVNGQRLKLYLGGEVEELTTIVLLNDP

SEQ ID NO: 166375 - protein, 110 aa, Glycine max
  Coding DNA Sequence Number=SeqID_49597
MQGDNDANSKKQFDPCSKEMNKETNVEPGDVSNKKDDMCPTNVEHEHAEQRDVPNEKDDMECTTNLNIHASDNNVRRLPMMINNNFASKDNQMTKLWDYYTKYKRFNKDQ

SEQ ID NO: 166376 - protein, 120 aa, Glycine max
  Coding DNA Sequence Number=SeqID_49598
  Subcellular localization annotation: CTP_CleavageSite=50; ConfidenceScore=5.42e-01
MALSAVTATLTSVIFALGVGAHPTYVQCDRTTRTSSGATGSDVAQRSRIMGMTVQTRLVQCEYDGDADADGARYGGVPARNGWDVEWTELAVEFGTMRGGVTAHKIVEWVVLRSELDGAK

SEQ ID NO: 166377 - protein, 191 aa, Glycine max
  Coding DNA Sequence Number=SeqID_49599
  Gene Ontology: Mol. function=histone-lysine N-methyltransferase activity; Cellular component=nucleus; Biological process =multicellular organismal development
  Homolog annotation: Hit_ID=Q32SG3; Match level="QueryCoverage=55%, HitCoverage=40%, E-value=5e-25, Identity=51%"; Hit description =ASYMMETRIC LEAVES2
  Pfam annotation: Domain name=DUF260; Domain location=3-104; Score =131.4; E_value=2.5e-36; Accession=PF03195.5; Description=Protein of unknown function DUF260
MSTCGACKYQRRRCYSDICMFAPYFPAENIQRFACVHHVFGGGNVGSMLNITKPKLRGWVVKTLAYQAEARVRDPVHGCVGLIRELEENHRKVKEDLAKAQMELARYMGPEFVRKLSPNYGGESSLKGKFVAHLQPTTMELDFAPSIAIDVDDLDKWDPFPPWETSFQNVGPSSSHAHGEGGNRKGKGVAP

SEQ ID NO: 166378 - protein, 134 aa, Glycine max
  Coding DNA Sequence Number=SeqID_49600
MRRRTWRKELEYPEAWSVVGFYSKNLCASLMLLWLVLLWSSPTVVTPLLSASVATTGAHTMLPPSSSASMLSPFTVLVAVESPSTSSRPRVSLYHLYTSSDADSLWDATYKLEQKTLVDFVSAFDKNLIRSTGV

SEQ ID NO: 166379 - protein, 43 aa, Glycine max
  Coding DNA Sequence Number=SeqID_49601
MDRPKVANATVAFVEAVRSNRQLSSKVSGREEGPRRLGGECGG

SEQ ID NO: 166380 - protein, 321 aa, Glycine max
  Coding DNA Sequence Number=SeqID_49602
  Gene Ontology: Mol. function=carbon-nitrogen ligase activity, with glutamine as amido-N-donor; Cellular component=intracellular; Biological process=translation
  Homolog annotation: Hit_ID=Q1GYD4; Match level="QueryCoverage=95%, HitCoverage=68%, E-value=1e-120, Identity=68%"; Hit description =Glutamyl-tRNA(Gln) amidotransferase, B subunit
  Pfam annotation: Domain name=GatB; Domain location=120-188; Score =110.5; E_value=4.8e-30; Accession=PF01162.10; Description=PET112 family, C terminal region
  Pfam annotation: Domain name=GatB_N; Domain location=1-103; Score =13.0; E_value=2.1e-15; Accession=PF02934.6; Description=PET112 family, N terminal region
  Pfam annotation: Domain name=GatB_Yqey; Domain location=190-320; Score=75.4; E_value=1.8e-19; Accession=PF02637.8; Description =GatBYqey domain
  Pfam module annotation: Pfam domain module=GatB::GatB_N::GatB_Yqey; Domain location=120-188::1-103::190-320
MSGIDLNRAGTPLLEIVTEPDMRSAAEAVAYAKKLHELVQWIGICDGNMQEGSFRCDVNVSVRPKGSEKFGTRREIKNLNSFKFMQQAIEYETQWQIETLEDGGTIQQATVLFNPDTGETRAMRTKEEANDYRYFPDPDLLPLEVTEADKARVRAAMPELPQALQARFISDYQLSSYDASTLTASRSLADYFVAVVNAGAEPKQAANWIMGALSAKLNAEEKTITQSPVTATQLAALLKRITDNTISNNAAKQPKASSRCRIRAPFEAIINEVLAANQAMVDEYKAGKEKAFNALVGQCMKAFQRQGQPSASQRAVEKGTG

SEQ ID NO: 166381 - protein, 103 aa, Glycine max
  Coding DNA Sequence Number=SeqID_49603
MGKAEEVQEKMKADMEAMKEQMDTMIEAMMSIKKIMEVNAVAVATINVVAKVNPMPPIWPYPNESSNLRYEMGKLDHLEERLKDIEGGERTPTKERISQRKSL

SEQ ID NO: 166382 - protein, 320 aa, Glycine max
  Coding DNA Sequence Number=SeqID_49604
  Gene Ontology: Mol. function=protein dimerization activity; Cellular component=nucleus; Biological process=regulation of transcription, DNA-dependent
  Homolog annotation: Hit_ID=Q0GPI0; Match level="QueryCoverage=97%, HitCoverage=98%, E-value=9e-92, Identity=60%"; Hit description=BZIP transcription factor bZIP50
  Pfam annotation: Domain name=bZIP_1; Domain location=187-251; Score =30.2; E_value=7e-06; Accession=PF00170.11; Description=bZIP transcription factor
  Pfam annotation: Domain name=bZIP_2; Domain location=187-241; Score =38.6; E_value=2.1e-08; Accession=PF07716.5; Description=Basic region leucine zipper
  Pfam module annotation: Pfam domain module=bZIP_1::bZIP_2; Domain location=187-251::187-241
  Subcellular localization annotation: CTP_CleavageSite=57; ConfidenceScore=5.20e-01
MAQLPPKIPNMSPSWPDFSSHQQKMQLPPLNNNGTITNNYHQHNQNPSWVDEFLDFSSARRGVHRRSVSDSITYLDSPVKCGGNKNNNNNENEFDKFDDEQFMSMFTDEVVLSGVPLPPPTTLSSSNPSSPYDQNFINDEKEKKEEEEEHHHHHQLKNEADEVESQCKQEIMQLPNDTNTCSSSERITDPKRVKRILANRQSAQRSRVRKLQYISELERSVTSLQAEVSVLSPRVAFLDHQRLLLNVDNSALKQRIAALAQDKIFKDAHQEALKREIERLRQVYHQQSLKKMENAAGSPLPSPKPICDAQTEKEATLLNA

SEQ ID NO: 166383 - protein, 363 aa, Glycine max
  Coding DNA Sequence Number=SeqID_49605
  Gene Ontology: Mol. function=DNA binding; Biological process =regulation of transcription, DNA-dependent
  Homolog annotation: Hit_ID=Q1SCZ2; Match level="QueryCoverage=94%, HitCoverage=64%, E-value=2e-57, Identity=38%"; Hit description =Transcriptional factor B3
  Pfam annotation: Domain name=B3; Domain location=15-113; Score=38.8; E_value=1.9e-08; Accession=PF02362.12; Description=B3 DNA binding domain
  Pfam annotation: Domain name=B3; Domain location=239-333; Score=70.2; E_value=6.6e-18; Accession=PF02362.12; Description=B3 DNA binding domain
  Pfam module annotation: Pfam domain module=B3::B3; Domain location=15- 113::239-333
MTSACNKNPKPIAVRFFKNIFRASLAHGLLSLQKLPTIFTKKYGDGMSNPVSLKSPDSTRWKIYWTKHDGEIWFQKGWKEYATYYGLDHGHLLFFEYEGTSHFNVHIFDTSAVEIDYPSNGTHHGKDSSHVEISDDPVEILDEKFSCQKTREKSTVSSPQPTKKMKAGLTTNVKKRPNVVNLHRHVQIRSIKSQKAKFVKHELDEDESRGIFHTERPKGEQLTSTALNRATAFRSENPSFKLVMNPSFIYGDYLEIPPEFAEIYLKKTHAVVILEVLEGRTWPVICSAPTITGGWHKFASENHLNVGDVCVFELIQKIQGLAFKVSIFRGAEEPSCPISQASADGFCEEVFCKDELECGDVTV

SEQ ID NO: 166384 - protein, 128 aa, Glycine max
  Coding DNA Sequence Number=SeqID_49606
  Gene Ontology: Mol. function=protein binding; Cellular component =membrane; Biological process=endocytosis
  Homolog annotation: Hit_ID=UPI0000D571F2; Match level="QueryCoverage =68%, HitCoverage=39%, E-value=5e-17, Identity=47%"; Hit description =PREDICTED: similar to CG9132-PB, isoform B
  Pfam annotation: Domain name=DUF1681; Domain location=21-123; Score =39.4; E_value=2.1e-14; Accession=PF07933.4; Description=Protein of unknown function (DUF1681)
MEKEENEPHVQKSGGESEDAEPIELVLFQVPECYVYIIPPRKSAASYRADEWDVNKWAWEGILKVTSKGEECIIKLEDKSTGELYARAFLRNGEPHPVEPVIDSSRWFSLTVDSLSCLLSYFFVVQDA

SEQ ID NO: 166385 - protein, 373 aa, Glycine max
  Coding DNA Sequence Number=SeqID_49607
  Homolog annotation: Hit_ID=O82271; Match level="QueryCoverage=93%, HitCoverage=83%, E-value=9e-09, Identity=23%"; Hit description =Expressed protein
MDAKGITWVGNIFQKFEDIYVDVEDTMLELFELNPILSVSLFWGYETVKYIGNQMQTVGESVKKIYSDVMQDLLPPPLYDLDETSASELPIDQYIDAGFSNKSFQGSKKITVKDDTNQTTEDSRIKHDVDNDVIHAKSGDSDALFTSASCNSVKGNSFISHARQYVGSTDIRSNLGGDENRQNKSIPASKTVSEITLSKADTCSTSQSCELSRVNQNHAATVSKAAFAEVTTITSVDDCCNEIENASTEEIPNVLVLAAESAEEKEMHVSSYSSSDLFGDPYGVTMVGTFEPDNYSYPTTIASHPETWDLDVPKIGTIIVEQGHKTIQQDDELKLEETCVMVTRDELESVAIALEQEEATLFFVQEGCKEARV

SEQ ID NO: 166386 - protein, 95 aa, Glycine max
  Coding DNA Sequence Number=SeqID_49608
MDKSFTKENHVQMVGPDKVTNHLNCIRVCPDNSNSRNSLSLVVRCGRATIKKELGEAGWNGEERLCLLLLNMGAFFCVGLKVKSDAVAWGTQQRG

SEQ ID NO: 166387 - protein, 117 aa, Glycine max
  Coding DNA Sequence Number=SeqID_49609
  Gene Ontology: Mol. function=transcription regulator activity; Cellular component=nucleus; Biological process=regulation of transcription
  Homolog annotation: Hit_ID=Q1SVR0; Match level="QueryCoverage=64%, HitCoverage=30%, E-value=2e-19, Identity=67%"; Hit description=Helix- loop-helix DNA-binding
  Pfam annotation: Domain name=HLH; Domain location=59-116; Score=14.8; E_value=0.0039; Accession=PF00010.16; Description=Helix-loop-helix DNA-binding domain
MEAFAPHRISDGFQVSCGVIGNGYGSSSSLVLDKEKGELVEAPVKLERKGVSPERSIEALKNHSEAERRRRARINAHLDTLRSVIPVYFCPIQVIVVWPVRPPVIRLLTALILQLHA

SEQ ID NO: 166388 - protein, 194 aa, Glycine max
  Coding DNA Sequence Number=SeqID_49610
  Gene Ontology: Mol. function=protein domain specific binding; Cellular component=nucleus; Biological process=intracellular signaling cascade
  Homolog annotation: Hit_ID=Q96299; Match level="QueryCoverage=84%, HitCoverage=62%, E-value=3e-76, Identity=86%"; Hit description=14-3 -3-like protein GF14 mu
  Pfam annotation: Domain name=14-3-3; Domain location=1-151; Score =213.8; E_value=3.9e-61; Accession=PF00244.10; Description=14-3-3 protein
VELELSNICNDVMTVIDEHLIPSAAAGESTVFYYKMKGDYYRYLAEFKAGNEKKEAADQSMKAYESATTAAEADLPPTHPIRLGLALNFSVFYYEILNSPERACHLAKQAFDEAISELDTLNEESYKDSTLIMQLLRDNLTLWTSDIPEDGEDAQKVNGTAKLGGVSPIVDGIFLRIRCMRLGMKHEGRYLSVY

SEQ ID NO: 166389 - protein, 437 aa, Glycine max
  Coding DNA Sequence Number=SeqID_49611
  Gene Ontology: Mol. function=riboflavin kinase activity; Biological process=riboflavin biosynthetic process
  Homolog annotation: Hit_ID=Q109K4; Match level="QueryCoverage=94%, HitCoverage=89%, E-value=1e-41, Identity=42%"; Hit description=HAD -superfamily hydrolase, subfamily IA, variant 3 containing protein, expressed
  Pfam annotation: Domain name=Hydrolase; Domain location=16-208; Score= 79.7; E_value=9.2e-21; Accession=PF00702.16; Description=haloacid dehalogenase-like hydrolase
MSCCCEFNGCNQGAKVLAVIFDLDGTLLDTERATRGVLNEFLARYGKELDREKEEKKRLGMTQKDSAAIIVKDYELPLTPDQFIKEITPLYRERWAKAKALPGANRLIKHLQKNGVPMALASNSLQENIEAKIYHHKGWKESFSVILGSDQVKSGKPSPYLFEEAAKKMGVDAVNCLVIEDSFWQDNSNQRVITDEKATVPPVMKPIIKVYHEPTICSYPNLEAYTDICGWLLSAKGYVTASAAKFAMHILCSHVNFCHAANAAKMKVVAVPSRREADCNGLANAVLHSLLEFQPELWGLPPFDDWIDDTLPIDPLHLSGLYVTGCLQEATENATLALPDQAVGLYFGWTKVDTDENLKILVSINIDFSCVGYKKIHVYLIDANSELKHKQMMQIHLVGYIRAWDNKELTSTELEKLDEYKSIARASLDLPSFTCCL

SEQ ID NO: 166390 - protein, 136 aa, Glycine max
  Coding DNA Sequence Number=SeqID_49612
  Gene Ontology: Mol. function=protein binding
  Homolog annotation: Hit_ID=Q2QNJ0; Match level="QueryCoverage=81%, HitCoverage=55%, E-value=3e-18, Identity=39%"; Hit description =Expressed protein
  Pfam annotation: Domain name=DUF538; Domain location=1-136; Score =122.8; E_value=9.5e-34; Accession=PF04398.3; Description=Protein of unknown function, DUF538
MAEKEGGVVKKGHEEGLKLAASLLQEFELPEGLLPLADVVEVGYVKGTGYMWIVQKKKVEHEFKMISKLVSYDTEIKGYVSKKKIKKLKGVKAKELMLWPPVSEITVDDAPTGKIHFKSFAGITKTFPVEAFAAGQ

SEQ ID NO: 166391 - protein, 586 aa, Glycine max
  Coding DNA Sequence Number=SeqID_49613
  Gene Ontology: Mol. function=binding; Cellular component=thylakoid; Biological process=photosynthesis
  Homolog annotation: Hit_ID=Q9SIN1; Match level="QueryCoverage=94%, HitCoverage=83%, E-value=1e-176, Identity=55%"; Hit description =Expressed protein
  Pfam annotation: Domain name=TPR_1; Domain location=114-147; Score =25.8; E_value=0.00015; Accession=PF00515.18; Description =Tetratricopeptide repeat
  Pfam annotation: Domain name=TPR_1; Domain location=148-181; Score =12.3; E_value=0.18; Accession=PF00515.18; Description=Tetratricopepti de repeat
  Pfam annotation: Domain name=TPR_1; Domain location=306-339; Score =0.5; E_value=4.6; Accession=PF00515.18; Description=Tetratricopeptide repeat
  Pfam annotation: Domain name=TPR_1; Domain location=352-385; Score =2.8; E_value=2.5; Accession=PF00515.18; Description=Tetratricopeptide repeat
  Pfam annotation: Domain name=TPR_1; Domain location=386-419; Score =30.3; E_value=7e-06; Accession=PF00515.18; Description =Tetratricopeptide repeat
  Pfam annotation: Domain name=TPR_1; Domain location=420-453; Score =7.0; E_value=0.78; Accession=PF00515.18; Description=Tetratricopeptid e repeat
  Pfam annotation: Domain name=TPR_2; Domain location=114-147; Score =31.9; E_value=2.3e-06; Accession=PF07719.7; Description =Tetratricopeptide repeat
  Pfam annotation: Domain name=TPR_2; Domain location=148-181; Score =16.1; E_value=0.13; Accession=PF07719.7; Description=Tetratricopeptid e repeat
  Pfam annotation: Domain name=TPR_2; Domain location=306-339; Score =10.4; E_value=2; Accession=PF07719.7; Description=Tetratricopeptide repeat
  Pfam annotation: Domain name=TPR_2; Domain location=352-385; Score =11.9; E_value=1.4; Accession=PF07719.7; Description=Tetratricopeptide repeat
  Pfam annotation: Domain name=TPR_2; Domain location=386-419; Score =18.0; E_value=0.035; Accession=PF07719.7; Description=Tetratricopepti de repeat
  Pfam annotation: Domain name=TPR_2; Domain location=420-453; Score =10.4; E_value=2; Accession=PF07719.7; Description=Tetratricopeptide repeat
  Pfam annotation: Domain name=TPR_4; Domain location=114-139; Score =0.2; E_value=36; Accession=PF07721.5; Description=Tetratricopeptide repeat
  Pfam annotation: Domain name=TPR_4; Domain location=148-173; Score =15.3; E_value=0.23; Accession=PF07721.5; Description=Tetratricopeptid e repeat
  Pfam annotation: Domain name=TPR_4; Domain location=306-331; Score =7.0; E_value=5.5; Accession=PF07721.5; Description=Tetratricopeptide repeat
  Pfam annotation: Domain name=Thioredoxin; Domain location=482-583; Score=12.4; E_value=1.6e-05; Accession=PF00085.10; Description =Thioredoxin
  Pfam module annotation: Pfam domain module=TPR_1::TPR_1::TPR_1::TPR _1::TPR_1::TPR_1::TPR_2::TPR_2::TPR_2::TPR_2::TPR_2::TPR_2::TPR _4::TPR_4::TPR_4::Thioredoxin; Domain location=114-147::148-181::306 -339::352-385::...
  Pfam module annotation: Domain location=386-419::420-453::114 -147::148-181::306-339::352-385::386-419::420-453::114-139::148 -173::306-331::482-583
MSNTLQQHQQCPESKRLDPGSNARRPGHRRSVSAGAPLIYSGGATLLPSGNICPSGKILKPGLPSRGSNRTDVLGSGTVNYGRGSIVRGVSGNIPVPVGALPPTVKRALSGSDPEELKRAGNELYRGGNFAEALALYDRAVAISPGNAACRSNRAAALTALGRLAEAARECLEAVKLDLAYARAHKRLASLYLRFGQVENSRQHLCLSGVQEDKSEEQKLVLLEKHLNRCADARKVGDWKRVLRESEAAIAVGADFSPQIVACKVEAYLKLHQLEDAESSLSNVPKLEGCPPECSQTKFFGMVGEAYVPFVCAQVEMALGRFENAVAAAEKASMLDCSNVEVGRIVNVVKMVARARSRGNELFSSDKFSEACSAYGEGLKYDNSNYVLYCNRAICWSKLGLWEQSVQDCSQALNIQPNYTKALFRRAASNTKLERWVEVVKDYKALKRELPNDNEVAESLRQAQLALEKSRQMVYGTKFGVEVEQICALDKFKAALASAGVSVVYFKEASNELCEELSPFINTLCVRYPSVKFIKVDVEECLAIAKAESIRSVPTFKIYKNGEKVNDIIRPTHQLLEDSVRKSSSL

SEQ ID NO: 166392 - protein, 128 aa, Glycine max
  Coding DNA Sequence Number=SeqID_49614
  Gene Ontology: Mol. function=hydroperoxide dehydratase activity; Cellular component=membrane; Biological process=fatty acid biosynthetic process
  Homolog annotation: Hit_ID=Q7X9B4; Match level="QueryCoverage=54%, HitCoverage=16%, E-value=1e-12, Identity=46%"; Hit description =Allene oxide synthase precursor
MSHKEEGDLVEEGASENIFFVDLGVVEEDGEGFHVEENDNIWVGGEEGARTCRTRHGPGCRNSLVRTDQREAAVAGNFVDWAQGRVILVEGRERRAWWRLRMPFLGNNDDGMERERGIGIIYIPLSDH

SEQ ID NO: 166393 - protein, 225 aa, Glycine max
  Coding DNA Sequence Number=SeqID_49615
  Homolog annotation: Hit_ID=Q96299; Match level="QueryCoverage=40%, HitCoverage=34%, E-value=2e-33, Identity=76%"; Hit description=14-3 -3-like protein GF14 mu
MMIYLCSRKCLLRSNCWKKKASSAIPKTTTTLPITNKDKLQWDTWSPLTGWKSKFSLYLHALNHIPGVKFEHRKDQKGKTEKKEGTHLTFHDRVLFYGASTKKNRREKRVRVRKRERERETERNSQTLISERSAMAASKDRENFVYIAKLAEQAERYEEMVESMKNVANLDVELTVEERNLLSVGYKNVIGARRASWRILSSIEQKEETKGNELNAKRIKEYRQK

SEQ ID NO: 166394 - protein, 142 aa, Glycine max
  Coding DNA Sequence Number=SeqID_49616
  Gene Ontology: Mol. function=metal ion binding; Biological process =metal ion transport
  Homolog annotation: Hit_ID=Q5Z6Y0; Match level="QueryCoverage=99%, HitCoverage=100%, E-value=6e-23, Identity=36%"; Hit description =Copper-binding protein-like
  Pfam annotation: Domain name=HMA; Domain location=5-65; Score=59.7; E_ value=9.3e-15; Accession=PF00403.16; Description=Heavy-metal -associated domain
MTIIEMRVHMDCPGCENKVKSALQKLKGVDDIEIDMSLQKVTVNGYADQKKVLKTVRKTGRRAELWQLPYTTDSQNQYVQQHHCNGPINYYASQTSSSYNYYKHGYDSSDPRYYNYPSQSSIFGYQTGATFSDDNPHACAIM

SEQ ID NO: 166395 - protein, 69 aa, Glycine max
  Coding DNA Sequence Number=SeqID_49617
MGFGFGLGYGVYEDFVVVVVGFGSVWSEKMGKVYVSLAAPLAPLRRAAVAVNAHSSRSSLSAEDLECTQ

SEQ ID NO: 166396 - protein, 56 aa, Glycine max
  Coding DNA Sequence Number=SeqID_49618
  Gene Ontology: Mol. function=protein dimerization activity; Cellular component=nucleus; Biological process=regulation of transcription, DNA-dependent
  Homolog annotation: Hit_ID=Q0GPI0; Match level="QueryCoverage=89%, HitCoverage=16%, E-value=2e-13, Identity=70%"; Hit description=BZIP transcription factor bZIP50
MSPTHQEALKREIERLRQVYYQQSLKKMENAAGSPLPSPKPICDAQTEKEAQLLNA

SEQ ID NO: 166397 - protein, 182 aa, Glycine max
  Coding DNA Sequence Number=SeqID_49619
MDVMRFKYGIGISLAIAWKARMIAKAILDGDAIRQYSYLEAYGEELKRGIETPNKKVKRFERSTLVARITPTRIDSVKKLSKLTKGQSINDVIQRKRLQSTRLTKLNERLAFPKQATSNVVASLDKVVSNLIEPFSLIDTRVRDKAEVVRPSTIVTRSKVKRRNNLSEVNNLHVGQQGTPKK

SEQ ID NO: 166398 - protein, 77 aa, Glycine max
  Coding DNA Sequence Number=SeqID_49620
  Subcellular localization annotation: CTP_CleavageSite=59; ConfidenceScore=5.43e-01
MLKPLQFQAKRREGQATGVSLSEALNSLSVMRNPKRGSARDVLAHRTTSSPSESFVSSRAQLSKPNFTNLRLASQSR

SEQ ID NO: 166399 - protein, 169 aa, Glycine max
  Coding DNA Sequence Number=SeqID_49621
  Homolog annotation: Hit_ID=Q5YLM3; Match level="QueryCoverage=96%, HitCoverage=21%, E-value=1e-47, Identity=58%"; Hit description =Roothairless 1
MEEFIGITFSSSSEQWGQLKRPDHADLRYKCRTYARLLQHLKAREFANELRASTKASRNPTVWLEGSTGSGQNVNATDTSTVSDAYAKMLTIFIPLLVDESSFFAHFMCFEVPTLVPPGGVVNGNKAGYDDDDDLGIMDIDENDSKSGKNSAELEALNKSLKDLLDGIQ

SEQ ID NO: 166400 - protein, 112 aa, Glycine max
  Coding DNA Sequence Number=SeqID_49622
MMESHASKIEVVASIGIQKPREASPNHARGSMQRKTSHKTIPNITLQKTKKMVKELQSSPNPNATNKNFSASNTLIIPVRKINNNSDTTHYFNLSNSTNMLAYSQSRTNTRE

SEQ ID NO: 166401 - protein, 299 aa, Glycine max
  Coding DNA Sequence Number=SeqID_49623
  Gene Ontology: Cellular component=spliceosome; Biological process =mRNA processing
  Homolog annotation: Hit_ID=Q6K5F4; Match level="QueryCoverage=99%, HitCoverage=100%, E-value=4e-71, Identity=49%"; Hit description=2 coiled coil domains of eukaryotic origin (31.3 kD)-like protein
  Pfam annotation: Domain name=Isy1; Domain location=1-280; Score =572.1; E_value=5.6e-169; Accession=PF06246.3; Description=Isy1-like splicing family
MARNEEKAQSMLNRFITMKAEEKKKPKERRPFLASECRDLSEADKWRQQIMREIGRKVAEIQNEGLGEHRLRDLNDEINKLIREKSHWERRIVELGGPNYSKHSAKMTDLDGNIVDVPNPGGRGPGYRYFGAAKKLPGVKELFEKPPELRRRRTRYDIYKRIDASYYGYRDEEDGVLARLEGPAEEAMRREAAEEWRRLDEVRREARKGVVSGEVAEVTAVAREVLKEDEEEVVEEERAREREEERERREFVVHVPLPDEKEIERRVLEKKKKDLLSRYASEGLVEEQTEAKDMLNIQR

SEQ ID NO: 166402 - protein, 202 aa, Glycine max
  Coding DNA Sequence Number=SeqID_49624
  Gene Ontology: Cellular component=exocyst; Biological process=protein transport
  Homolog annotation: Hit_ID=Q5YLM3; Match level="QueryCoverage=87%, HitCoverage=20%, E-value=7e-75, Identity=76%"; Hit description =Roothairless 1
MVELRPKLGSGEGAPTGEGVRKVSIMFATLEKIAQTDPKYADIFLFENYAAFQNSLYDLANIVPTLAKFYHQASEAYEQACTRHISMIIYYQFERLFQFTRRIEDLMFTVAPEEIPFQLGLSKMDLRKMLKSSLSGVDKSIAAMYKKLQKNLTSEELLPSLWDKCKKEFLDKYESFAQLVAKIYPTETIPSVAEMRDLLASM

SEQ ID NO: 166403 - protein, 54 aa, Glycine max
  Coding DNA Sequence Number=SeqID_49625
MKGRRKRKRKKKAVGRGRMMCTMGERHFCHFILWFGCLTKNAGYTKQHHYRKMG

SEQ ID NO: 166404 - protein, 43 aa, Glycine max
  Coding DNA Sequence Number=SeqID_49626
MVYGTIRVLGGTGVFADNLLAFRFLENSSTMFSRLWKAVAGDY

SEQ ID NO: 166405 - protein, 351 aa, Glycine max
  Coding DNA Sequence Number=SeqID_49627
  Homolog annotation: Hit_ID=Q5YLM3; Match level="QueryCoverage=86%, HitCoverage=33%, E-value=1e-108, Identity=67%"; Hit description =Roothairless 1
MAKSSADDGELRRACDAAIEDPRQKIVMALRVAKSHGIFGKSSSKLGRMAKPRVLALSIVGDDVVFPAAKSKGLRTSAFLRVLKYSTGGVLEPAKLYKLKHLSKVEVVANDPSGCTFTLGFDNLRSQSVAPPQWTMRNIDDRNRLLLCILNICKDVLGRLPKVVGIDVVEMALWAKENTPSVSSQNKVRDGGPAASVVTETEITELKVNVEKELVSQAEEEDMEALLGTYVMGIGEAEEFSERLKRELQALEAANVHALLESEPLMDEVLQGLDAATSCVEDMDEWLSIFNVKLRHMREDIASVRTCARQFKNINFLDTIYSLVVMAVFAGSMIHMFSFLCSFVKARQFMH

SEQ ID NO: 166406 - protein, 266 aa, Glycine max
  Coding DNA Sequence Number=SeqID_49628
  Homolog annotation: Hit_ID=Q5YLM3; Match level="QueryCoverage=61%, HitCoverage=16%, E-value=9e-67, Identity=78%"; Hit description =Roothairless 1
MAEMRCWADPTQPYPRTYCKRAAHNGENPQNTAHNGNQQRGMAVTANGSDTPAPSRQIFWDSWFMPNIFSVGVLEKHWPLTLFCLNNFSYVQIETRNNNLEMQSVNNKSLIEELDKLLERLRVPSEYATNLTGGSFDEARMLQNVEACEWLTSALRGLGVPNLDPSYANMRAVKEKRAELEKLKSTFVRRASEFLRNYFASLVDFMISDKSYFSQEFIGITFSSSSEQRGQLKRPDHADLRYKCRTYARLLQHLKVKIWDSGAVYF

SEQ ID NO: 166407 - protein, 291 aa, Glycine max
  Coding DNA Sequence Number=SeqID_49629
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=97%, HitCoverage=81%, E-value=5e-74, Identity=65%"; Hit description =Photosystem I P700 chlorophyll a apoprotein A1
MSALGRPQDMFSDTAIQLQPVFAQWIQNTHALAPGTTAPVGGKVALLPIPLGTADFLVHHIHAFTIHVTVLILLKGVLFARSSRLIPDKANLGFRFPCDGPGRGGTCQSDVWGSISDQGIVNHITGGNFAQSSITINGWLRDFLWAQASQPRALSIVQGRAVGVTHYLLGGIAHNMGILLSKNYCTQDPTTRRIWFGIATAHDFESHDDITEERLYQNIFASHFGQLAIIFLWTSGNLFHVAWQGNFEAWVQDPLHVRPIAHAIWDPHFGQPAVEAFTRGGALGPVNIAYS

SEQ ID NO: 166408 - protein, 54 aa, Glycine max
  Coding DNA Sequence Number=SeqID_49630
QQQEEQQQPVFETSQDGAHHEQPLVQPTMANVPLSAVTKLNPPTFSSFDIYEDP

SEQ ID NO: 166409 - protein, 135 aa, Glycine max
  Coding DNA Sequence Number=SeqID_49631
MQLSRYAPHLVATEKLQVQRFLEGHGDTTCDQALNRALTVERGNRDRGENSCDLHKRFHSETSCGGHQGHGGEGLRDDTNQHHQGIGKDQQVVINVGKLGTLLEVVLCHLFNRLLAEWKHLWSRWDSLVVMNHVY

SEQ ID NO: 166410 - protein, 82 aa, Glycine max
  Coding DNA Sequence Number=SeqID_49632
MDVLIRKQYHLISFCYRLIEKILQFPLVAQLISGIILIWDLLGAPSSIAGAPSKFQMAKMPFSFFRTFFRQSQRKKVLPWVN

SEQ ID NO: 166411 - protein, 47 aa, Glycine max
  Coding DNA Sequence Number=SeqID_49633
MGHSFYTSRLIFFSICAFFPVPELSMVALDGGVEWWKQLSHMRYFSK

SEQ ID NO: 166412 - protein, 57 aa, Glycine max
  Coding DNA Sequence Number=SeqID_49634
MEGFLFEVGCPLFRFERASFICFSRYENLSSPGPSKHWNLLLVEEKLLLVRVASYLS

SEQ ID NO: 166413 - protein, 540 aa, Glycine max
  Coding DNA Sequence Number=SeqID_49635
  Homolog annotation: Hit_ID=Q39846; Match level="QueryCoverage=99%, HitCoverage=95%, E-value=0.0, Identity=67%"; Hit description=LEA protein
  Pfam annotation: Domain name=LEA_4; Domain location=182-221; Score =7.2; E_value=0.16; Accession=PF02987.7; Description=Late embryogenesis abundant protein
  Pfam annotation: Domain name=LEA_4; Domain location=233-276; Score =18.6; E_value=0.013; Accession=PF02987.7; Description=Late embryogenesis abundant protein
  Pfam annotation: Domain name=LEA_4; Domain location=277-320; Score =3.5; E_value=0.38; Accession=PF02987.7; Description=Late embryogenesis abundant protein
  Pfam module annotation: Pfam domain module=LEA_4::LEA_4::LEA_4; Domain location=182-221::233-276::277-320
MATQFEHLGKDTPQGSIEALQVGERVRETHELGAHFESLADKAPNVVGNKDNEIEARGGVRDVGKFEMKGNKDRQELEKRTREVIGREEKKKGRESGGQVVAEKGRGRVGPENEGARTTAVITCTLEKGGATQKPLREEESESTERSTWEQISNYSDQATQGVKERYDRAKQAASETLNTTAETAQEKSAQAKDLATQAKDATLEKGQQGYVATKDTISSAAKTASEKTAPVAEKAKEYTLQAAEKTKSVGGTTASYVGEKAVQAKDVTVESGKNAAGYAAKVAVDLKDKAASVGWAAAHFSAEKTVEGTKAAAHVVEGAAGYAGHKAAELASMSTGAVKGLAASAGETAKEYTTRKKEEAQRELEAKKAFQPQEAEERPSQGIGETVSSVGEKVKKPFENILGGEGKKDESGGNDQSSGGGQEQGKSIIGQTLTSIGEKLGDAKQREELIDNVTEGGSEVLGAVGETVGEIGQNTMKPAEIVQERAHVRQEGGVLDAIGETIAEIAETTRVMVAGEDKRVMPETRVTDRAKHEERSESA

SEQ ID NO: 166414 - protein, 511 aa, Glycine max
  Coding DNA Sequence Number=SeqID_49636
  Gene Ontology: Mol. function=hydrolase activity; Cellular component =integral to membrane; Biological process=aromatic compound metabolic process
  Homolog annotation: Hit_ID=Q5ZDY7; Match level="QueryCoverage=97%, HitCoverage=97%, E-value=1e-122, Identity=43%"; Hit description =Conserved transmembrane protein-like
  Pfam annotation: Domain name=Ferric_reduct; Domain location=163-295; Score=-27.0; E_value=0.087; Accession=PF01794.9; Description=Ferric reductase like transmembrane component
MEERESTEIKIARFSSCRGVAFEIDPNRSNPFAIGSPTKQEGIGTWLWLPWTRNSSFKVLPQPHNISPTRSRVSSHFCDIDIDASDVEVEFIAEVQDIEKPDKANGVKVQKLLPKTDPPRRSRLSIILLDQGFTFYKGLFLVCMALNVVALALSAAGYFPYAKTRAALFSIGNILALTLCRSEAVLRVIFWLAVKIIGRPCVSLRIKTATTSFLQSVGGIHSSCGVSSIAWLVYSLVLTLKNKDKTSPEIIGVAFIILSLILLSSLAAFPLVRHLHHNVFERIHRFSGWMALILLWLFILLSVSYEPNSHTYHLTISKVVKKQECWFTLAITVLIIIPWLSVRKVQVSVSSPSSHTSIIKFEGGVEAGLLGRISPSPLSEWHAFGIISDGKKEHMMLAGAVGDFTKSLISTPPKHLWPSKANVYLIWVAKDIELNFGREIIELVNKYSKEKVIVHDTAISGRPNVAEMSVNAAIMWNVEVVIVTSNPEGSRDVLRACKRAKIPAFGPIWDS

SEQ ID NO: 166415 - protein, 389 aa, Glycine max
  Coding DNA Sequence Number=SeqID_49637
  Gene Ontology: Mol. function=transition metal ion binding; Biological process=electron transport
  Homolog annotation: Hit_ID=Q013M5; Match level="QueryCoverage=86%, HitCoverage=90%, E-value=1e-66, Identity=40%"; Hit description =Homology to unknown gene
  Pfam annotation: Domain name=DUF455; Domain location=97-356; Score =176.6; E_value=6.3e-50; Accession=PF04305.4; Description=Protein of unknown function (DUF455)
  Subcellular localization annotation: CTP_CleavageSite=37; ConfidenceScore=5.44e-01
MQRLKVEVMVVSLSASRYSHGSALHFKSRRFSSSSCSCLKVSPWRGLNEWRESPLNENRKWGEHGPGPASEPHRHHHHRDSPFGQASTLAEIGSIVLSTSDPHWKSQLSHMAYSMWRRHNLPLGISKPPSRPARPPIPQLVSPKEIPAPKDSGLPLNAYMLHNLAHVELNAIDLAWDTVVRFSPYSEILGEGFFADFAHVADDESRHFSWCAQRLAELGFKYGDMPAHNLLWRECEKSSDNVAARLAVIPLVQEARGLDAGPRLVKKLVGFGDNRTSKIVARIADEEVAHVAVGVYWFASVCEKLNCAPDSTFKDLLKEYNVELKGPFNYSARDEAGIPRDWYDDASSTSIKDKKDKDGNQEQLSAVYKRLASIIAMEKENSSLTKPPE

SEQ ID NO: 166416 - protein, 646 aa, Glycine max
  Coding DNA Sequence Number=SeqID_49638
  Gene Ontology: Mol. function=nucleic acid binding; Cellular component= intracellular
  Homolog annotation: Hit_ID=Q1SVS0; Match level="QueryCoverage=83%, HitCoverage=55%, E-value=1e-158, Identity=55%"; Hit description =Bromodomain
  Pfam annotation: Domain name=Bromodomain; Domain location=307-396; Score=113.7; E_value=5.4e-31; Accession=PF00439.15; Description =Bromodomain
MASGPIVGDDGAKEKQRYTESKVYTRKAFKGPKNKGNAVITVNAVPPPPPPPPPPAAVATTNGGDDGSATVIAVDYNNKDNSTVDNGDVRAKDNSNNASVQPVPEDGNSARPQVNSMLDTVSDDSSSLNRPQDEPFSVPGVGERSPGPENCVRISLASRSKQEKRELRRRLQGELNRVRSLVNRIEEKLGVLGGYGNSDMMVDRGIGNGVGAKRAHSEVASAVVTPREREPTRPLHQLSVSVLENSQGVTEIVEKEKRTPTANQFYRNSEFLLGKDKFPPAESNKKSKLNGKKHVEGEMGHGMGSKLLKSCSALLEKLMKHKHGWVFNAPVDVEGLGLHDYFSIITHPMDLGTVKSRLNKNWYKSPKEFAEDVRLTFHNAMTYNPKGQDVHIMAEQLLNIFEERWAIIESNYYREIRYGLDYGAPSPVSRKAPPFRPPPIDMRRILDRSESMTQPPKIMGITPSSRTPAPKKPKAKDPHKRDMTYEEKQKLSTHLQSLPSEKLDAIVQIIKKRNSALSQHDDEIEVDIDSVDTETLWELDRFVTNYKKSLSKNKRKAELAILARERAEQNAQQKSQAPVAVEIPKETQADERNVPPSLPEQGQIPVDNGSKTSSSSSSSSDSGSSSSDSDSDSSSASGSDAGSPKT

SEQ ID NO: 166417 - protein, 386 aa, Glycine max
  Coding DNA Sequence Number=SeqID_49639
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q9SIN2; Match level="QueryCoverage=98%, HitCoverage=92%, E-value=1e-139, Identity=59%"; Hit description =Expressed protein
  Pfam annotation: Domain name=DUF231; Domain location=190-384; Score =217.6; E_value=2.9e-62; Accession=PF03005.6; Description=Arabidopsis proteins of unknown function
EEFDESLLFNGKNVSSFSSGRKLGAGRCNLFRGKWVYDPSYPLYDPSTCPFIDPQFNCQKYGRPDKQYQKYRWQPFSCPLPRFNAFDFLAKYRGKKIMFVGDSLSLNQFNSLACMIHSWVPNTRTSFIKQDALSKITFEDYGLQLFLYRTAYLVDLDRENVGRVLKIDSIKSGDAWRGMDVLVFNTWHWWTHTGSSQPWDYIQERNKLYKDMNRFILFYKGLTTWARWVNINVNPAQTKVFFLGISPVHYDVLMKHGHFTLLSCSVSDMRPCQCPTPTRYPYYVLYFGHYRGKDWNQPAKSCMSETEPFFGLKYPAGTPMAWVIVNKVLSRIKKPVQFLDVTTLSQYRKDAHPEGYSGVMPTDCSHWCLPGLPDTWNVLLHAALFD

SEQ ID NO: 166418 - protein, 125 aa, Glycine max
  Coding DNA Sequence Number=SeqID_49640
  Gene Ontology: Mol. function=hydrolase activity; Cellular component =vesicle membrane; Biological process=metabolic process
  Homolog annotation: Hit_ID=O82790; Match level="QueryCoverage=85%, HitCoverage=39%, E-value=2e-29, Identity=62%"; Hit description =Expressed protein
MRLPDSSDFGPHLREHLRSRFADAFIRELAEVTIPPERIYGLGTGSFEVASEKARAPRTDTALILTSFVEDRLATLKNVIKEPELDQWNLYLGNWGYNTQKEREEVAAIPRIHVLELSDFSKKLK

SEQ ID NO: 166419 - protein, 116 aa, Glycine max
  Coding DNA Sequence Number=SeqID_49641
  Gene Ontology: Mol. function=nucleic acid binding; Biological process= DNA integration
MTGGDNYKIWKERILRQLGWMDIDYTIRKDEPLAITDESSTTVVVLYERWERSNRLSMMFIKTKISVGIRGFVDQHEKVRDLLKAIDDQFITSDKALANSLIMKFSSLRLTSEKGV

SEQ ID NO: 166420 - protein, 940 aa, Glycine max
  Coding DNA Sequence Number=SeqID_49642
  Homolog annotation: Hit_ID=Q2QN61; Match level="QueryCoverage=30%, HitCoverage=32%, E-value=1e-08, Identity=22%"; Hit description =Expressed protein
  Pfam annotation: Domain name=DUF863; Domain location=142-927; Score= -104.0; E_value=1e-08; Accession=PF05904.2; Description=Plant protein of unknown function (DUF863)
MALLGTSANRQCNVYFPGYHCPRDFVFGTEGSPWTSSNGNSERENDCYRLGSLPLSSPCHISGHNKELLKQTILKHEAIFRDQIQELHRIYQKQRELMDEIKRIEFHKHSLRMEISSSSSSLYYSQNMPWLTSQSSVLNPERIQLPLASMQEKSRELSPTPLPAPTAIKESLDPKLSGLTYRKVGKKILDLQLPADEYIDSEGDSCENERVIKQPPLSTYTVEKPYRINSNNGFADLNLPCKLQKETGVKSDDFGASIPHRNHTFHDMPGRMTPGSHNFPNDVILNLKRKQDHEAYPDLPLSNHGQKHGWLPSGTCAGHNGSDLGFLAKFNDMESQSVSIDSVSKKLKQVKYCPCFHSIHQIVPRSRTESPAGTHDPTSGGWLRPSFASCTCAPHKLVSDSDMKNSGISPSVLWKSTTSDPNLDLQHYLLNQSFCSRSNILDLPSISTGDLNSIDNFGSSSADHELRKYVKDLVYVGTHKSINLNIMPAGCSDKTAAAFQSDQITGEEDKCQDSRLSWLKAKPVAKGKPNEESQLSTQVDSFLLNPYKSGCIHSDLMFNKVEKSDSCTEKTLAFDLNGKPQTSKVFQSLSKNHWIEEIKKISNINSACDSDPDMGEQAPASERFTKNEKKHKHLEGIFDLNSGMNEDENMPIDIDLQAPASPENKECSPPRGESDENQLEMPLQMEGQEQEDLEAREKQTKIAAEALVSISETVAYNGLQMTTCPSSESSVSSSLYWFSEIVSTIVDHSECEVKEDFSCTIKDLEDFLPADFDYFEFMSLNLTDTKDLDYGCYKSCGQNEQEVESSSPIQPRNCRTNRKRRGNDFQSEILPSLASLSRYEVTEDLQTIGGLLEAARRTHSATGCLRSACKNALAKGKKRSCASVSNNITDLLLNLKEVNIDTEIAIEKMGFISWGKICRKPRGKRVATSKPHLIFSKVHN

SEQ ID NO: 166421 - protein, 171 aa, Glycine max
  Coding DNA Sequence Number=SeqID_49643
  Gene Ontology: Mol. function=RNA-directed DNA polymerase activity; Biological process=RNA-dependent DNA replication
MVVKSRNTISHAEDLTEVLTEIRKYNMRLNSKKCKFKVQGRKFLGFMLTHRGIESNPDKCATIIAMRSLNTLKKKIKEFRASPPILSKPQPESKSEWWRLNVDGSSNEKRSRTEVILESLDEVILEQSLRFEFETTNNQGKYETLVAELRLAKEVRVKYLKCWSDSQLITS

SEQ ID NO: 166422 - protein, 229 aa, Glycine max
  Coding DNA Sequence Number=SeqID_49644
AKGHLRAVTACPGELKLNPEAVSSLRQAGPLALKLFGGPGESNVGLGELGPRKNKEKTLLPSFLGPITLNHNKRGELATHSHGGEAFDGGRIKMHPKLSPRLGSLSLSILSKVWKPRLGQKASKILPIKLIVESPLLDLDFKKDPTKHKQATQRLSAKGDDFAENDAKVLDNKVPFVGAIGDMDDEKVPPSVVKLFFQRSSYLSSMNSGEKYIKSQDTVIVEEVQEIGG

SEQ ID NO: 166423 - protein, 105 aa, Glycine max
  Coding DNA Sequence Number=SeqID_49645
MESRSRVLEEAYSVKLTHLPAKNRPPPGVDKSKYCHYHQVVMHDTEECNTLKDKIKRLIQKGHLHKFVKDKDHSCNHEHEKERSQERNKPLKHAKGTHLKLNCEK

SEQ ID NO: 166424 - protein, 459 aa, Glycine max
  Coding DNA Sequence Number=SeqID_49646
  Gene Ontology: Mol. function=oxidoreductase activity; Cellular component=intrinsic to endoplasmic reticulum membrane; Biological process=electron transport
  Homolog annotation: Hit_ID=Q9FF12; Match level="QueryCoverage=97%, HitCoverage=98%, E-value=0.0, Identity=71%"; Hit description =Dimethylaniline monooxygenase-like protein
  Pfam annotation: Domain name=DAO; Domain location=12-285; Score= -23.5; E_value=0.00019; Accession=PF01266.14; Description=FAD dependent oxidoreductase
  Pfam annotation: Domain name=FMO-like; Domain location=10-431; Score=- 216.5; E_value=5.7e-14; Accession=PF00743.9; Description=Flavin -binding monooxygenase-like
  Pfam annotation: Domain name=HI0933_like; Domain location=11-354; Score=-271.0; E_value=0.044; Accession=PF03486.5; Description=HI0933- like protein
  Pfam annotation: Domain name=Pyr_redox; Domain location=211-291; Score=4.3; E_value=0.0067; Accession=PF00070.17; Description =Pyridine nucleotide-disulphide oxidor
  Pfam annotation: Domain name=Pyr_redox_2; Domain location=12-293; Score=-24.6; E_value=0.009; Accession=PF07992.4; Description =Pyridine nucleotide-disulphide oxidor
  Pfam module annotation: Pfam domain module=DAO::FMO-like::HI0933 _like::Pyr_redox::Pyr_redox_2; Domain location=12-285::10-431::11 -354::211-291::12-293
MVSETLQSQTKNVCVIGAGPSGLVAARELRKEGHRVVLLEQNHDVGGQWLYESNVEGEDPLGKKPFLKVHSSIYESLRLTSPREIMGFTDFPFLVKKGRDMRRFPSHTELLMYLRDFCEHFGLGEMIRFNTRVDYVGMLDYGVCSNDLKWVVRSEDKKSEKTVEEVFDAVVVATGHYSQPRLPSIQGMDTWKRKQMHSHIYRTPEPFRNEIVVVVGNSLSGQDISIELVDVAKEVHMSSRSLNISEGLSKVISKHANFHLHPQIETLQEDGRVTFVDGSSILADSILYCTGYSYAFPFLDTKEMVVVDDDRVGPLYEHTFPPSLAPSLSFIGIPRKIIGFPFFESQAIWIAQLLSGKKVLPSWEEMMKSIKEFYQSREAAGIPKHCTHEIANFGYCDKYGDNVGFPRIEEWRKQLCLSALINSDANLETYRDSWDDHELLQEALQSPHFTQLGLEDSPM

SEQ ID NO: 166425 - protein, 339 aa, Glycine max
  Coding DNA Sequence Number=SeqID_49647
PCHIGLLTWTQTCHIGMLTWTEASNSRDSEGLGSHWLQQGINDEAAIGELFKVVVGQRVDVKASCNDNMERTIMSKRWVSKKKEFPPITLPSYAWVKGEKQVHMRYDDFPESFMNEDKKLNLTILDKLPRRLLAKAIVTLHKSSTLMEDLPAIPNLLGWTPSMKLTQMLVMLRLPSWQHESSSSLAKQVASLANSSSVQHSSFRARATAVAQHMVLCKSSFHQEIPKLNKSLEVMKSKKDEFLVVNLLLTTDNEGLKVEDKINNLEDALEKVERKRDSDRAIDEYEVLLRSAWMKVIEEHNAAKHQLLPPDTAMNEVASNDEVEAPKGDDEVNNQGFGQ

SEQ ID NO: 166426 - protein, 58 aa, Glycine max
  Coding DNA Sequence Number=SeqID_49648
MEWSVFCWSRIDFGSVWVLVHVSGVMEQWRTIEFQGDEETVIQVDEGDCSKNSEDEGA

SEQ ID NO: 166427 - protein, 66 aa, Glycine max
  Coding DNA Sequence Number=SeqID_49649
MPHGNYKVRCKQPPWLFESVLVKVPKTIRHSLTVGILQITTFDVLIRAKGALSAIPTKEGVALSET

SEQ ID NO: 166428 - protein, 123 aa, Glycine max
  Coding DNA Sequence Number=SeqID_49650
  Subcellular localization annotation: CTP_CleavageSite=49; ConfidenceScore=5.32e-01
MWGANTFPVRKYNSQAFHLKVRRSRLFWFFRRFPQINVGGDSARIPFVEYASRESRVALPLKGRVRQQAHVAFESYSRRNGGIAFVDNWAVGKEKEWQSQHGLLLHPHPLHLPQFSHSSKQDD

SEQ ID NO: 166429 - protein, 95 aa, Glycine max
  Coding DNA Sequence Number=SeqID_49651
MVEPSKKRKGSSSRSQRHSEAQDTTIPSSISSSPLFSSKEQCIRYKNLFSSHSIIDPKFIDMNFFSDESFECIQAFQNSNLIPFMSLKLPVYFEL

SEQ ID NO: 166430 - protein, 79 aa, Glycine max
  Coding DNA Sequence Number=SeqID_49652
  Subcellular localization annotation: CTP_CleavageSite=34; ConfidenceScore=5.19e-01
MRGYLMVTHTVRQPGANEPIGARRLTSSSAPFVVLTREVSQVTCGVTLWLPAPFVNQGQTCPLTQGEQHRLLHVCRPDP

SEQ ID NO: 166431 - protein, 79 aa, Glycine max
  Coding DNA Sequence Number=SeqID_49653
MGIADSILRHFFLCGTMPQAELETRYEIARRGLRSTDRDRPANAMRKSSSFLAQDLSWKTPDWIPSSILYPISMRALKS

SEQ ID NO: 166432 - protein, 268 aa, Glycine max
  Coding DNA Sequence Number=SeqID_49654
  Homolog annotation: Hit_ID=Q5XM22; Match level="QueryCoverage=32%, HitCoverage=57%, E-value=4e-26, Identity=66%"; Hit description =Resistance-like protein HAAS-2
DRPADEDAADVPERRRPTASARRLRVHQMTTEGRDMAEDVADMTNDVPEQPTEAPEMHADAQGVDSGEGSDDDDAAEGFPGGPRDPSVLTSFAEHVAHAERPDLKLVSHGRKVTLIGRPVPEIEGLVAAIGLSPLIDCLVITDDPGLISAFVESFHALSMEEARFLLTELLEVSAEEARAETSLTRGAYAWRWIVATRAYLLHLVGCTLFANKSATYVHVVHLDAFWDLAHSGGYDWGVAALVHMYDQLDEACRTTTRQLAGYLTLLQ

SEQ ID NO: 166433 - protein, 346 aa, Glycine max
  Coding DNA Sequence Number=SeqID_49655
  Gene Ontology: Mol. function=voltage-gated chloride channel activity; Cellular component=membrane; Biological process=chloride transport
  Homolog annotation: Hit_ID=UPI00003CCD97; Match level="QueryCoverage =97%, HitCoverage=73%, E-value=2e-81, Identity=48%"; Hit description =COG0038: Chloride channel protein EriC
  Pfam annotation: Domain name=Voltage_CLC; Domain location=12-343; Score=48.9; E_value=4.5e-13; Accession=PF00654.10; Description =Voltage gated chloride channel
MQSAVWWLPILIMPAVGIFIVWVTRTWLAGAAGSGIPQTIAALQYEEHQSINHLVSIRIAVTKMLLVTLGLAAGFSAGREGPSVQVGASIMHGFRKYFPAHFYVDPKHLILAGGAAGISAAFNTPLAGIVFAIEELSRKFEQKTNGVMITAIVLSGLVSISMQGNYTYFGSLNVGAIHTEIIIPVIICGLVCGMSGGIFSRTIIEFTERLPDRITAYRTRHPLYWTGFCGLLVAGLGIVSHGAANGSGYSMTKAMLDGTINETWYYPIIKYLSTIFTYLSGIPGGIFAPALSIGAGIGYDLSTIFHYHDIAIAISALCMAGFLAGVTQAPITSFIIVMEMIDGHEM

SEQ ID NO: 166434 - protein, 47 aa, Glycine max
  Coding DNA Sequence Number=SeqID_49656
MFLLIIAFKGFNDSQGSKSKAVARWIVVKYFTDQRSLELERMKAIRI

SEQ ID NO: 166435 - protein, 301 aa, Glycine max
  Coding DNA Sequence Number=SeqID_49657
  Homolog annotation: Hit_ID=Q1SM20; Match level="QueryCoverage=42%, HitCoverage=33%, E-value=1e-15, Identity=33%"; Hit description =Nucleic acid-binding, OB-fold
MARVADKIKLIDGSREALKLSVRITDLWFIGIPGKTEQAEMVVVDSNGDEMHVVCKQDQLKYRKADLKENLAYVMHNFKVIKNDGKFRVCDHEYKLCFTGVTVVRQCDMEQLPFRKFRFVAFSSVISVARSYSASVSNSFKASKLMINDLVLEIQEFRESLLDLGIEVRSILAPIGQGSSQVSGSSQLSSKDAFLSKTKEFVCVTVAKITTIVMDNYSWCYPACGQCYKKDDMLTVPLTCPCVKENDQPVLRYRVEVMVNHKGEQTKFLIWDRECAQLIGQSADEVNRLKIDVIVLSCNVF

SEQ ID NO: 166436 - protein, 159 aa, Glycine max
  Coding DNA Sequence Number=SeqID_49658
  Pfam annotation: Domain name=HMA; Domain location=17-79; Score=32.6; E_value=1.4e-06; Accession=PF00403.16; Description=Heavy-metal -associated domain
MAARKEEKKEDIEVITAIYKVNLHCKECGSKIKKHLTITQGVLSVEIEFEKGEINAKGKIEPLKILKLIEKKSKEKVELISPEVKPKEITSTEIKPKEIKDECLSDKKYLGSRSQEEIKDSARSDLESTRCSQKWHREFLVVIKGLISGTLQVLKEKWM

SEQ ID NO: 166437 - protein, 226 aa, Glycine max
  Coding DNA Sequence Number=SeqID_49659
  Gene Ontology: Mol. function=steroid binding; Biological process =transport
  Homolog annotation: Hit_ID=Q10KA9; Match level="QueryCoverage=82%, HitCoverage=64%, E-value=9e-46, Identity=53%"; Hit description =Transthyretin family protein, expressed
MEFSFDEKDFVSCCGSTKFAKEMASASPFGSLQDAVSVARDVWFNSVDVNGWLQAFSAHPQIGQSHAPSVASEASAQFSTSNSPLFPIRVTLFFVFWGIRIWILHDHAFRWSKGEQSTALATATGSSLQELSEWNARYREKFGFVFLICAAGRSTDEILAELKRRYTNRPIVEFEIAAREQMKITELRLAKLFSSRENISSTADKNSTARKAEVYHQPFRINHHEL

SEQ ID NO: 166438 - protein, 97 aa, Glycine max
  Coding DNA Sequence Number=SeqID_49660
MTVLRRHGPPLQWKVETLNPAIGGKGVVQPWYDFLQEMDFDDGDEISIYYRYYEKIWDIIIRRQEDWEDDDRKEDEDMQMEKAQATSNMKSFAVGDV

SEQ ID NO: 166439 - protein, 179 aa, Glycine max
  Coding DNA Sequence Number=SeqID_49661
  Gene Ontology: Mol. function=metal ion binding; Biological process =metal ion transport
  Homolog annotation: Hit_ID=Q9ZRE7; Match level="QueryCoverage=85%, HitCoverage=56%, E-value=3e-15, Identity=28%"; Hit description=ATFP3
  Pfam annotation: Domain name=HMA; Domain location=12-69; Score=15.8; E_value=0.032; Accession=PF00403.16; Description=Heavy-metal -associated domain
MCGFKPIIRIISVRVHMHCGKCEADLKSRLIKHKGIFNVKTDQKAQNVTVEGTIEVEKLISFLRKRVHKNAEIISIKEVKRDQEKKGKEEVQSSETSKEKDHSESTKEKEDGKSSETTKIMSHQGHPKEENKIKDNVPYIIHYVYAQQLFTGHMYGNIRFPDSLVCKMLVRVISNTVYN

SEQ ID NO: 166440 - protein, 269 aa, Glycine max
  Coding DNA Sequence Number=SeqID_49662
  Subcellular localization annotation: CTP_CleavageSite=10; ConfidenceScore=5.04e-01
MGAPSSKVAPAQQRPPPTFIAPKAIGAMAHITFYLFDNSLNKVFDGLRPSILGRKRRKLSPLPIWTMKFSMKHLHLPSTLIASNIKVQWPSTPTSQLKTLQEEEEVTCPSSIYKDYQVASSTTKLKPPTGIEVLPPPTWKRLHPKWPSYPLGIHIRCTTSIKFMPDLIALRLPPLDLWKKKDMHENSRLSSTSEYDKEDTSNHMRMSIHSILIRTLGFQVKEWRLNFRGTRQTQPLTDGDAEKEAEAKQQQEMLESGNSFKILHAHLGP

SEQ ID NO: 166441 - protein, 108 aa, Glycine max
  Coding DNA Sequence Number=SeqID_49663
  Gene Ontology: Mol. function=DNA binding; Biological process=DNA integration
  Homolog annotation: Hit_ID=Q1SJY5; Match level="QueryCoverage=94%, HitCoverage=12%, E-value=9e-29, Identity=62%"; Hit description =Integrase, catalytic region
MEDVTPLVDVWFLGRARNKLEDYNLFKSKIHILCDNTATIDLSKNPITHSRAKHIEIKHHFIRDHVQKGVVELQFVSTEDQLADLFTKPLTEDRLISLRERLGMFLVE

SEQ ID NO: 166442 - protein, 88 aa, Glycine max
  Coding DNA Sequence Number=SeqID_49664
MVGGGRGGLMDGGDHCCISKFMLKSTKSLKDLSKDSNVFLISRLVSIFFQVGLLKAQQFLNSLLRHTSWGKGGQGSYFVRCVGSADRC

SEQ ID NO: 166443 - protein, 195 aa, Glycine max
  Coding DNA Sequence Number=SeqID_49665
MECRVTPGSKGPPWSMKGMRGPPIRGRSLVGREVRGIGEFDFLVSSPSSLPNSKKVKEVFVGEVVKGYNYKKKLKSLIAKDQKDLGKSKKRKRVEKTNFGEGPTEETRIEKGAEIEIVSKAVEKTKAMTLQLKAMKAEAGKSKQLGLELTKSRGTVKKLQEDLDKHVAYLSSKAKENNALSNRVVDLEQQVKDIG

SEQ ID NO: 166444 - protein, 483 aa, Glycine max
  Coding DNA Sequence Number=SeqID_49666
MGPQGSNREPLNSKSSTDHAIIHPTRSVELIVESEMDKYSNKLAPNVARVRMGEVKNYFSFSVILSKNRHRAASLPINFCTSFRFYRLRMAMTALHLSGVCQISLPRLLDDRWVCGVDILQTERHDFVAKVGIFVDECVVDKLIDARKQVYILWASLVEVGVVNAHPLFLVGFLDHHDIGQPCRLLSPLCHGFGFGKNGDFVAYEIGVYVEHVRGAPCEEISIMCQHVLDPSLKVFIKSFPNLGALAFGITFTGFNLVGFDNDYVATLVGELHCEVSVSMRTYYTSNVLDNSPLPKVVARSTTPWDFPDIPISDANYNHHWVVLLGIDSYEVDIMPLPSRLGATSASEVACNGVDDFTSYPSSAAKSKCSSGSEVPSYLSMFNGFQVIGLEAAHSGYRRKVECDFLRCVSRHGRVEGMGSEVKMVVVGVAEVAGGLPPNQPSFSSVIDPSALEFPIWLMSQLSVEVRGGICKRDSNEQINGAL

SEQ ID NO: 166445 - protein, 95 aa, Glycine max
  Coding DNA Sequence Number=SeqID_49667
MEGKGTWFLTNSTICATIMEAPKFSYTWWSGPDASSIGACRPRIFFINGFLCFLKDEWQRNGERKRERRRHFKEKMSLEEAHHHKRPWIRAWRKK

SEQ ID NO: 166446 - protein, 364 aa, Glycine max
  Coding DNA Sequence Number=SeqID_49668
  Gene Ontology: Mol. function=calmodulin binding; Cellular component =integral to membrane; Biological process=response to biotic stimulus
  Homolog annotation: Hit_ID=O49621; Match level="QueryCoverage=93%, HitCoverage=75%, E-value=1e-114, Identity=54%"; Hit description=MLO -like protein 1
  Pfam annotation: Domain name=Mlo; Domain location=1-349; Score=402.9; E_value=4.6e-118; Accession=PF03094.6; Description=Mlo family
MLPCSLKDNGKEELTKTTSHFQTFFSFSDISGTARRLLAESESENEDHQPATGEKLGHCARKGKVPLLSVEALHHLHTFIFVLAVAHVTFCVLTVVFGGLKIREWKHWEDSIGNDNKNETQPVLEPTVTHVHQHAFIQNHFTGLGKDSAVLGWVKSFFKQFYGSVTKLDYVTLRLGFIMTHCKGNPKFNFHKYMIRALEDDFKKVVGISWYLWIFVVIFMLLNVHGWHAYFWISFIPLILLLAVGAKLEHVIIQLAHEVAEKHSAIEGFSWIFIQLLCSYSTLPLYAIVTQMGTHFKKAVFDEQVQARLVGWAQKAKKKGQRGDNSHSGQGSSHVGAGIQLGSVFKRPSVPEDNVIVPRNDGPE

SEQ ID NO: 166447 - protein, 151 aa, Glycine max
  Coding DNA Sequence Number=SeqID_49669
VYIYLGCNTENKRGYISCGSVQVEGTSTWLFKENKGGYIPCGSLLVKDFTRLLEISRTGGCLGTEHRHGLWLNHGNEVGRKGRADVKFGGGGRATSKKGGGVGALIKLGFHTHFVNWIMMYVTVVRFFVNVIDEGLSTLIKDAEKRCELHR

SEQ ID NO: 166448 - protein, 218 aa, Glycine max
  Coding DNA Sequence Number=SeqID_49670
MADTASKESKLDQEDEIKETNLCLENETVSKEKIVRLENFQELENKLKALQKDLKEVIELLDHVKTKRCDLERMCTFTQRYEDLEKSKHNLRVECENHKKSVKFLNKKVSKNGALEGYPQDVVKLHEEIDFLNTTLAKFVRGTKALNKILMYCRCLTNKSGKVGHMTSKCLDLTKKGKSNAFRFNKIEPKKIWVPKDKYIHVADVFDSRKNTLVMVHG

SEQ ID NO: 166449 - protein, 375 aa, Glycine max
  Coding DNA Sequence Number=SeqID_49671
  Gene Ontology: Mol. function=chromatin binding; Cellular component =chromatin; Biological process=chromatin assembly or disassembly
  Homolog annotation: Hit_ID=Q1SAV4; Match level="QueryCoverage=58%, HitCoverage=59%, E-value=4e-57, Identity=46%"; Hit description =Integrase, catalytic region
METIPPWPSLYNSYRPSKPQGELKSELAKHPVFIELQQNLLHHPKNYPDYNITPDLIMHQGRIWLPAEFKFIPLKITEFHSTPMRGHMGVMKTLVAMSFISDVATMGVPFLGFYCGATGISCKPTSWGKFLNWAEWSYNTSQHSGTWVFPYEITYGKKSLTIPQYVTRMSKVEAMDDFLANREEVMKRSTDVKHKDIVFKCGDWVMVKLRLHRQSFVSNTTHSKLAKRFYGPYQIVEQIGKVAYKLDLPIGSRIHLVFHCSILKPFKQTSPCMPLPLPANAGNNKPLISPVTVVSTKWDYVSSPPRLLVLVQCEGMSPDDAMWENWDQLKLYFNLEDKVVLDVAGNDMKSKPQQVDTTSKPKRNISAPKYLADYN

SEQ ID NO: 166450 - protein, 42 aa, Glycine max
  Coding DNA Sequence Number=SeqID_49672
MEISPGQSVRGVLRDKRSSVAGIDMKAHTVMLGMAPKSKYLE

SEQ ID NO: 166451 - protein, 255 aa, Glycine max
  Coding DNA Sequence Number=SeqID_49673
MAMLEASISRTNRIKKSSRSNTGVDKIGIINWLKASRAEEGHSKLSRINKRPVLLLVMRPYDPNIPLAFDRRNTWITLGRTFLLEVPKMLVPEGGREVGFVKRNSNLARSEAILRLHNSTGTEELHGEVIEVRQYGSQGLQPLDTENQISTAKGSSGDNHLREGGGEFLVAGEEREMGGSRRGAWTSHRTIEDNPEMRQLKRNGKGSPTMRFTSASNSKSGSPTLVETPTMTPIDHFTTSTGTAPALARPCRMMH

SEQ ID NO: 166452 - protein, 129 aa, Glycine max
  Coding DNA Sequence Number=SeqID_49674
NHSGISARQRDSKVSMTDLVSAEDDVNLRVSTGLSAAIDEGCRMTIICLCVPSDTTVSEWQRDLKKSPPEDADISGKGADDHIGLCSSITLGATSSWVMVTESGVVDKSEALAPTYPPSKRNSDLRSSG

SEQ ID NO: 166453 - protein, 99 aa, Glycine max
  Coding DNA Sequence Number=SeqID_49675
MASYGGELLLDSSSHRSGISNHLSSFSIPLSFIFKKQKTPLMKKIQGLQAPHGATSIVLFAIKMLCSIPRNIMQSGMEKEEREETPLQGEDESRRNSPP

SEQ ID NO: 166454 - protein, 113 aa, Glycine max
  Coding DNA Sequence Number=SeqID_49676
  Gene Ontology: Mol. function=DNA photolyase activity; Cellular component=mitochondrion; Biological process=DNA repair
  Homolog annotation: Hit_ID=Q1RUS6; Match level="QueryCoverage=76%, HitCoverage=20%, E-value=9e-25, Identity=63%"; Hit description =Deoxyribodipyrimidine photolyase, class 1
MHDEIGAVRLEAATEVGDGMDEEGGAIGAGLVKVRCRLAVVGGVEAVDAKDEEGVVVGDSEALIVEEAEVIAEPDEGGNVGKVARERGAWRELAEMVDLKEKEWWWREKGSIL

SEQ ID NO: 166455 - protein, 66 aa, Glycine max
  Coding DNA Sequence Number=SeqID_49677
MVWHLQSSFFHVHFDVIDLQEAKDSIDEEDLSPTSSTWSYIIKKSKSILRQPHKITGKIMRAKRMD

SEQ ID NO: 166456 - protein, 498 aa, Glycine max
  Coding DNA Sequence Number=SeqID_49678
  Gene Ontology: Mol. function=hydrolase activity, acting on ester bonds; Cellular component=membrane; Biological process=metabolic process
  Homolog annotation: Hit_ID=Q9S816; Match level="QueryCoverage=94%, HitCoverage=89%, E-value=1e-167, Identity=61%"; Hit description =Putative phospholipase
  Pfam annotation: Domain name=Phosphoesterase; Domain location=1-354; Score=473.8; E_value=2.2e-139; Accession=PF04185.5; Description =Phosphoesterase family
MLGWMKSLDPKINGITGSESNPISTSNPNSNLVQFSDQSVYVDPDPGHSIQDIYEQIFGEPWSEASTAKKLPPTMQGFAQNAGRQAVPKNATATMMETVMNGFKPDLIPVYKELVKEYAVCDCWFASVPASTQPNRLYVHSATSHGLTSNDTNKLIGGLPQKTIFDSLDENGFSFGIYYQSPPATLFYRNLRKLKYVDNFRPFDLFKKHCKEGKLPNYVVIEQRFFDLLSIPGNDDHPSHDVSEGQKFVKEVYEALRGSPQWNETLFVIVYDEHGGFYDHVPTPVEGVPSPDDIVGPEPFKFQFDRLGVRIPAIIVSPWIEPGTVLHGPSGPSPTSQYEHSSIPATVKKIFNLPEFLTKRDAWAGTFEGLLTRSSPRTDCPVKERVKLPEPVKLREAPAQEKAKLSEFQEELVQMAATLNGDHRKSIYPDKLTENMSVPDAVKYVEDAFNTFLNECEKAKQNGADESEIVDCADGCSSAPPDSKNFFYNVLSCITCNR

SEQ ID NO: 166457 - protein, 167 aa, Glycine max
  Coding DNA Sequence Number=SeqID_49679
MTFLGETSSQTIVNSRLAFIYPNGSIIHNDTGVYFQTSTPVPIRVPNRCDFASLKTRIHNTLQLSNKQFLDEIHYRKPFTDTGNQIRFECIKLINDDDVNTMLMCNDQFSCVGPIELLCTVGRTPDGIINLLERTMPRIHDAILYYNGKWNMPPQNKFVGCALMFFM

SEQ ID NO: 166458 - protein, 112 aa, Glycine max
  Coding DNA Sequence Number=SeqID_49680
MDRVTSLLRLLPNTFRTVDPLPAPLLRWTCPPIWSQPNKSSNPRYGRSGRQRVGRYERPSFSAKNKHAFPPYGLPPNYTPPNVAYTPNENVNNSTPILIQSQQPQSDHAHVS

SEQ ID NO: 166459 - protein, 137 aa, Glycine max
  Coding DNA Sequence Number=SeqID_49681
MASITEAMLKIQKTIEDNATAAASNTAREAEPRYSPQAYPYGLPPDFTPRTALDDLSQAPTFEGQLPPHADYPLQEDDEGDAHLGPLLPLKEPVPHELPQPNIVRHVPSPSAPVKELVPIAKDKGKIDLLEERLRAV

SEQ ID NO: 166460 - protein, 56 aa, Glycine max
  Coding DNA Sequence Number=SeqID_49682
  Subcellular localization annotation: CTP_CleavageSite=39; ConfidenceScore=5.23e-01
MVQRNSRMSQRARSVRYAQQLSSARLNASLALSSNPLTRAKREAGAKRNVTDSEPT

SEQ ID NO: 166461 - protein, 163 aa, Glycine max
  Coding DNA Sequence Number=SeqID_49683
  Homolog annotation: Hit_ID=Q47522; Match level="QueryCoverage=29%, HitCoverage=59%, E-value=5e-22, Identity=97%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIRPFGVVADFDQDVFHYSKWSSDGAICELECHPSGVNF

SEQ ID NO: 166462 - protein, 77 aa, Glycine max
  Coding DNA Sequence Number=SeqID_49684
MESKSGCIMMCNYRDLVGDEVTSDVWEVGMRLEKERTDAILPRKGPVTRAMSKRLQEDWARAAEEGPRVLMNLRVDF

SEQ ID NO: 166463 - protein, 119 aa, Glycine max
  Coding DNA Sequence Number=SeqID_49685
MLHSMLQSIHRVQSIIMQSLQGLGLPSIMSMDEFDVQVAWPGAQPSPSGGGGASVAQEPVPEEPAAAAEGEDELTPPEPFYFDAGVHMALEEEKSTDQIPEPSPAPIPNDAIPSAPASE

SEQ ID NO: 166464 - protein, 136 aa, Glycine max
  Coding DNA Sequence Number=SeqID_49686
  Gene Ontology: Mol. function=DNA binding; Cellular component=nucleus
  Homolog annotation: Hit_ID=Q64C99; Match level="QueryCoverage=78%, HitCoverage=65%, E-value=4e-10, Identity=36%"; Hit description =Transposase related protein
MGEGTRREAFKKISEGYKVGGGIRVNPKRKRFAVVGGITISKEGISFSYSTYKKPSLNSKDIILYLRKVIKDEKTVIVMDNARMHGNEVREFLEENGVEFVYLPPYSPDKSPAEGPWVVLKKRLYSNMYTDFETLT

SEQ ID NO: 166465 - protein, 57 aa, Glycine max
  Coding DNA Sequence Number=SeqID_49687
MGNWRRALCNNFLGLHTGRWRMHEQHLAITFMGLRKKWRMENWRTALRNNFAGLQTR

SEQ ID NO: 166466 - protein, 132 aa, Glycine max
  Coding DNA Sequence Number=SeqID_49688
MHTTTTPISPCRRVKDRPYKTLSGPGEVQQGLGVSISDYEPLIAPPGKRRARHHSSGQQTHRHHLQSPPQLIYKGWSVAYDTWPTSRQPTTWAATSRYWACDRQIVITRPAQDVKEALLGGNLVPFKFLLVI

SEQ ID NO: 166467 - protein, 73 aa, Glycine max
  Coding DNA Sequence Number=SeqID_49689
  Gene Ontology: Mol. function=nucleic acid binding; Biological process= DNA integration
MTTLDIFKSFKAKVELQLGKKIKVVKSDRGGKPSINGVAEQQNQTLKDIETSMVSHYSLPESFWGEALKTVVR

SEQ ID NO: 166468 - protein, 141 aa, Glycine max
  Coding DNA Sequence Number=SeqID_49690
MTGRLLAGSLAFESRILRYLIVRILLSRSSNLAQASRLNAPLPYPHLITLFLQHFNIPLDSEPYVPIKRSFLIGVIVISSFGYRKEHDGSWVKKGAQPIDEEGNLPVGEDSSLLQRILDRFDGLQTFVGERFDALELQVDM

SEQ ID NO: 166469 - protein, 126 aa, Glycine max
  Coding DNA Sequence Number=SeqID_49691
LVTLVLRHFQIPLDDEPFVQVKRSFSIGAGVVTFFWYRKDIDGQWIRKQDLPLRIPDERTPSPLPHRDASSTLMHEVLSELRGLRPFIDDHLDAMDAYFEGMDTQITQLEDDMGFIRRCFDPPAAP

SEQ ID NO: 166470 - protein, 73 aa, Glycine max
  Coding DNA Sequence Number=SeqID_49692
REFAKRDTQWLSARKKPEDDELSGSLSAPLQVIKHTASAHSLSERSALSHNPLMHAKRFKITLSTRARTNPPI

SEQ ID NO: 166471 - protein, 101 aa, Glycine max
  Coding DNA Sequence Number=SeqID_49693
MSRNLTDYAIVPSLASGMLRNFTDCALTLPFNSRHVAELHGLPNDGCQVPRNGQAKVTSHQTDGPRMKLGLDCLWIVKKGAGPYGFSACHWARRLWMTKDA

SEQ ID NO: 166472 - protein, 41 aa, Glycine max
  Coding DNA Sequence Number=SeqID_49694
MVEACVELTSKDKKESSSDAARNPRVCDLWLMSLLKILIDM

SEQ ID NO: 166473 - protein, 67 aa, Glycine max
  Coding DNA Sequence Number=SeqID_49695
GAVLRVSDPPGDVFQLFWVKKNCFHEENPSRGASVTLPRCFRKQIREGFPPFFSVIHCSSSILRSST

SEQ ID NO: 166474 - protein, 71 aa, Glycine max
  Coding DNA Sequence Number=SeqID_49696
  Homolog annotation: Hit_ID=P56766; Match level="QueryCoverage=40%, HitCoverage=3%, E-value=2e-09, Identity=100%"; Hit description =Photosystem I P700 chlorophyll a apoprotein A1
AIRQGDSEVAESWFNQAAEYWKQAIALTPGLFVCVVWKEEDSMIIRSPEPEVKILVDRDPIKTSFEEWAKP

SEQ ID NO: 166475 - protein, 95 aa, Glycine max
  Coding DNA Sequence Number=SeqID_49697
MTGRLLADSLAFKSHILHYLIVRILLPRSSNLAQRSFLIGATVIASFGYRKEHDGSWLQVDMRFDEMDSRITKVEGDVSYIRTCFDLPPPPPPSS

SEQ ID NO: 166476 - protein, 77 aa, Glycine max
  Coding DNA Sequence Number=SeqID_49698
MWRKPKGGVVTQSKAVASGGSNLARLGELGGKLLPYFAINRGRSERERGSAFLTLRILLKLLRKIVSVKKIQAEVLP

SEQ ID NO: 166477 - protein, 73 aa, Glycine max
  Coding DNA Sequence Number=SeqID_49699
  Subcellular localization annotation: CTP_CleavageSite=57; ConfidenceScore=5.26e-01
MKYKAKTRKRPSNHWAIRTGVWSSRSQGSKISGLSTISDKTSQKSVRLRAMWITVLRSSYVHHFDPVKQFYFL

SEQ ID NO: 166478 - protein, 117 aa, Glycine max
  Coding DNA Sequence Number=SeqID_49700
MPKFVDQASNSDKNTVSERQIQLNTVDPVEEKAKQTNPEAQNPNLNTSDLWRGLLKRCESERKTWVWIYRHRCETGVGGGCVKRRKCPYAARSELDSSLVHFPFLVSTWTVQIGSGK

SEQ ID NO: 166479 - protein, 653 aa, Glycine max
  Coding DNA Sequence Number=SeqID_49701
  Gene Ontology: Mol. function=protein-tyrosine kinase activity; Cellular component=integral to membrane; Biological process=protein amino acid phosphorylation
  Homolog annotation: Hit_ID=P33543; Match level="QueryCoverage=96%, HitCoverage=92%, E-value=0.0, Identity=70%"; Hit description =Putative kinase-like protein TMKL1 precursor
  Pfam annotation: Domain name=LRR_1; Domain location=117-139; Score =9.5; E_value=4.7; Accession=PF00560.23; Description=Leucine Rich Repeat
  Pfam annotation: Domain name=LRR_1; Domain location=141-163; Score =12.5; E_value=1.3; Accession=PF00560.23; Description=Leucine Rich Repeat
  Pfam annotation: Domain name=LRR_1; Domain location=166-189; Score =9.3; E_value=5.2; Accession=PF00560.23; Description=Leucine Rich Repeat
  Pfam annotation: Domain name=LRR_1; Domain location=193-215; Score =15.3; E_value=0.22; Accession=PF00560.23; Description=Leucine Rich Repeat
  Pfam annotation: Domain name=LRR_1; Domain location=217-239; Score =12.0; E_value=1.6; Accession=PF00560.23; Description=Leucine Rich Repeat
  Pfam annotation: Domain name=LRR_1; Domain location=240-261; Score =15.1; E_value=0.25; Accession=PF00560.23; Description=Leucine Rich Repeat
  Pfam annotation: Domain name=LRR_1; Domain location=93-115; Score =6.4; E_value=18; Accession=PF00560.23; Description=Leucine Rich Repeat
  Pfam annotation: Domain name=Pkinase; Domain location=374-646; Score =6.1; E_value=6.3e-09; Accession=PF00069.15; Description=Protein kinase domain
  Pfam annotation: Domain name=Pkinase_Tyr; Domain location=364-646; Score=-1.9; E_value=2.3e-12; Accession=PF07714.7; Description =Protein tyrosine kinase
  Pfam module annotation: Pfam domain module=LRR_1::LRR_1::LRR_1::LRR _1::LRR_1::LRR_1::LRR_1::Pkinase::Pkinase_Tyr; Domain location=117 -139::141-163::166-189::193-215::217-239::240-261::93-115::374 -646::364-646
  Subcellular localization annotation: CTP_CleavageSite=72; ConfidenceScore=5.64e-01
SSTTTSTTKSLSPPSSPSTTSSSDVELLLGKIKASLQGSNSDNLVLSSWNSSTPLCQWKGLIWVFSNGTPLSCTDLSSPQWTNLTLLKDPSLHLFSLRLPSANLSGSLPRELGGFPMLQSLYLNINSLEGTIPLELGYSSSLSEIDLGDNMLGGVLPPSIWNLCERLVSLRLHGNSLSGLVSEPALPNSSCKNLQVLDLGGNKFSGSFPEFITKFGGLKQLDLGNNMFMGAIPQGLAGLSLEKLNLSHNNFSGVLPLFGGESKFGVDAFEGNSPSLCGPPLGSCARTSTLSSGAVAGIVISLMTGAVVLASLLIGYMQNKKKKGSGESEDELNDEEEDDEENGGNAIGGAGEGKLMLFAGGENLTLDDVLNATGQVLEKTCYGTAYKAKLADGGTIALRLLREGSCKDKASCLSVIKQLGKIRHENLIPLRAFYQGKRGEKLLIYDYLPLRTLHDLLHEAKAGKPVLNWARRHKIALGIARGLAYLHTGLEVPVTHANVRSKNVLVDDFFTARLTDFGLDKLMIPSIADEMVALAKTDGYKAPELQRMKKCNSRTDVYAFGILLLEILIGKKPGKNGRNGEYVDLPSMVKVAVLEETTMEVFDVELLKGIRSPMEDGLVQALKLAMGCCAPVASVRPSMDEVVRQLEENRPRN

SEQ ID NO: 166480 - protein, 160 aa, Glycine max
  Coding DNA Sequence Number=SeqID_49702
MQGYFMVTRTIRQPGSNEPVDATRLTSSSAPFVALTRESIDMRGYPMFTCTIRQLGANETIEARRLTSSSAPFVILTREVSTVGQPVANKPVDARRLTSRGYLMVTRNFRQLGANEPIDAERLTSSSARFVVLTRSVRGKRARWRAEINIVLDTFFRLDP

SEQ ID NO: 166481 - protein, 251 aa, Glycine max
  Coding DNA Sequence Number=SeqID_49703
  Homolog annotation: Hit_ID=Q2QU14; Match level="QueryCoverage=56%, HitCoverage=58%, E-value=4e-18, Identity=40%"; Hit description =Expressed protein
  Subcellular localization annotation: CTP_CleavageSite=62; ConfidenceScore=5.39e-01
MSASTVVHNFCSVACCISNCGHNTHHQFHSPNSLLRLKKQTFLTNIYFKSSRTQKPRSSFVVSAAQSNFVKGCYELFSHVKHMHNNDSMPRIIGDRDGTKLSSLKKLNAWKVGRDGIEAGTNLVPNSVPRPIARISVTIVALSVTLFVLKAFLSTAFFILAIFAYYRRLNIERDTETGRQTESSGFVNHILAIPSYLKGTCTRKRDATIGLAYFAYLAFNKDQGPSGNGGTTSTPMDDPVEEARKIMEKYK

SEQ ID NO: 166482 - protein, 106 aa, Glycine max
  Coding DNA Sequence Number=SeqID_49704
MDWPLGPTVREGNGLIFLNSPWLYSIFRPALLNPWAMQACSISSHLLLLTVEAFLLHMIERDSCSHVTHRSLGPPRKILNMDSFEVNVDENNNESIDVDVHEKCYS

SEQ ID NO: 166483 - protein, 1135 aa, Glycine max
  Coding DNA Sequence Number=SeqID_49705
  Gene Ontology: Mol. function=protein serine/threonine kinase activity; Cellular component=integral to membrane; Biological process=protein amino acid phosphorylation
  Homolog annotation: Hit_ID=Q84RP6; Match level="QueryCoverage=93%, HitCoverage=92%, E-value=0.0, Identity=62%"; Hit description=LRR receptor-like kinase 1
  Pfam annotation: Domain name=LRRNT_2; Domain location=43-84; Score =34.3; E_value=4.2e-07; Accession=PF08263.3; Description=Leucine rich repeat N-terminal domain
  Pfam annotation: Domain name=LRR_1; Domain location=112-134; Score =8.3; E_value=8.1; Accession=PF00560.23; Description=Leucine Rich Repeat
  Pfam annotation: Domain name=LRR_1; Domain location=136-158; Score =14.9; E_value=0.29; Accession=PF00560.23; Description=Leucine Rich Repeat
  Pfam annotation: Domain name=LRR_1; Domain location=160-182; Score =16.7; E_value=0.084; Accession=PF00560.23; Description=Leucine Rich Repeat
  Pfam annotation: Domain name=LRR_1; Domain location=184-206; Score =16.6; E_value=0.089; Accession=PF00560.23; Description=Leucine Rich Repeat
  Pfam annotation: Domain name=LRR_1; Domain location=208-231; Score =8.8; E_value=6.5; Accession=PF00560.23; Description=Leucine Rich Repeat
  Pfam annotation: Domain name=LRR_1; Domain location=233-255; Score =12.5; E_value=1.3; Accession=PF00560.23; Description=Leucine Rich Repeat
  Pfam annotation: Domain name=LRR_1; Domain location=257-279; Score =10.2; E_value=3.6; Accession=PF00560.23; Description=Leucine Rich Repeat
  Pfam annotation: Domain name=LRR_1; Domain location=281-303; Score =10.8; E_value=2.7; Accession=PF00560.23; Description=Leucine Rich Repeat
  Pfam annotation: Domain name=LRR_1; Domain location=305-327; Score =6.3; E_value=19; Accession=PF00560.23; Description=Leucine Rich Repeat
  Pfam annotation: Domain name=LRR_1; Domain location=329-351; Score =14.1; E_value=0.51; Accession=PF00560.23; Description=Leucine Rich Repeat
  Pfam annotation: Domain name=LRR_1; Domain location=353-375; Score =22.1; E_value=0.002; Accession=PF00560.23; Description=Leucine Rich Repeat
  Pfam annotation: Domain name=LRR_1; Domain location=377-399; Score =13.1; E_value=1; Accession=PF00560.23; Description=Leucine Rich Repeat
  Pfam annotation: Domain name=LRR_1; Domain location=401-423; Score =3.3; E_value=68; Accession=PF00560.23; Description=Leucine Rich Repeat
  Pfam annotation: Domain name=LRR_1; Domain location=425-447; Score =18.3; E_value=0.027; Accession=PF00560.23; Description=Leucine Rich Repeat
  Pfam annotation: Domain name=LRR_1; Domain location=449-471; Score =10.3; E_value=3.4; Accession=PF00560.23; Description=Leucine Rich Repeat
  Pfam annotation: Domain name=LRR_1; Domain location=473-495; Score =13.7; E_value=0.69; Accession=PF00560.23; Description=Leucine Rich Repeat
  Pfam annotation: Domain name=LRR_1; Domain location=497-519; Score =15.5; E_value=0.19; Accession=PF00560.23; Description=Leucine Rich Repeat
  Pfam annotation: Domain name=LRR_1; Domain location=521-543; Score =16.7; E_value=0.086; Accession=PF00560.23; Description=Leucine Rich Repeat
  Pfam annotation: Domain name=LRR_1; Domain location=545-567; Score =9.7; E_value=4.3; Accession=PF00560.23; Description=Leucine Rich Repeat
  Pfam annotation: Domain name=LRR_1; Domain location=569-591; Score =9.0; E_value=5.8; Accession=PF00560.23; Description=Leucine Rich Repeat
  Pfam annotation: Domain name=LRR_1; Domain location=593-615; Score =14.2; E_value=0.47; Accession=PF00560.23; Description=Leucine Rich Repeat
  Pfam annotation: Domain name=LRR_1; Domain location=642-663; Score =17.1; E_value=0.063; Accession=PF00560.23; Description=Leucine Rich Repeat
  Pfam annotation: Domain name=LRR_1; Domain location=665-688; Score =13.6; E_value=0.7; Accession=PF00560.23; Description=Leucine Rich Repeat
  Pfam annotation: Domain name=Pkinase; Domain location=793-1076; Score= 130.1; E_value=6.1e-36; Accession=PF00069.15; Description=Protein kinase domain
  Pfam annotation: Domain name=Pkinase_Tyr; Domain location=793-1076; Score=72.2; E_value=1.6e-18; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::...
  Pfam module annotation: Pfam domain module=Pkinase::Pkinase_Tyr; Domain location=43-84::112-134::136-158::160-182::184-206::208 -231::233-255::257-279::281-303::305-327::329-351::353-375::377 -399::401-423::425-447::...
  Pfam module annotation: Domain location=449-471::473-495::497 -519::521-543::545-567::569-591::593-615::642-663::665-688::793 -1076::793-1076
MPRQALNNQNHNQMSRQAFITNHHHHLLHVLLFTLLVPISFAANDEVSALVSWMHSSSNTVPLAFSSWNPLDSNPCNWSYIKCSSASFVTEITIQNVELALPFPSKISSFPFLQKLVISGANLTGVISIDIGNCLELVVLDLSSNSLVGGIPSSIGRLRNLQNLSLNSNHLTGQIPSEIGDCVNLKTLDIFDNNLNGDLPVELGKLSNLEVIRAGGNSGIAGNIPDELGDCKNLSVLGLADTKISGSLPASLGKLSMLQTLSIYSTMLSGEIPPEIGNCSELVNLFLYENGLSGSLPREIGKLQKLEKMLLWQNSFVGGIPEEIGNCRSLKILDVSLNSFSGGIPQSLGKLSNLEELMLSNNNISGSIPKALSNLTNLIQLQLDTNQLSGSIPPELGSLTKLTMFFAWQNKLEGGIPSTLEGCRSLEALDLSYNALTDSLPPGLFKLQNLTKLLLISNDISGPIPPEIGKCSSLIRLRLVDNRISGEIPKEIGFLNSLNFLDLSENHLTGSVPLEIGNCKELQMLNLSNNSLSGALPSYLSSLTRLDVLDLSMNNFSGEVPMSIGQLTSLLRVILSKNSFSGPIPSSLGQCSGLQLLDLSSNKFSGTIPPELLQIEALDISLNFSHNALSGVVPPEISSLNKLSVLDLSHNNLEGDLMAFSGLENLVSLNISFNKFTGYLPDSKLFHQLSATDLAGNQGLCPNGHDSCFVSNAAMTKMINGTNSKRSEIIKLAIGLLSALVVAMAIFGAVKVFRARKMIQADNDSEVGGDSWPWQFTPFQKVNFSVEQVFKCLVESNVIGKGCSGIVYRAEMENGDIIAVKRLWPTTSAARYDSQSDKLAVNGGVRDSFSAEVKTLGSIRHKNIVRFLGCCWNRNTRLLMYDYMPNGSLGSLLHEQSGNCLEWDIRFRIILGAAQGVAYLHHDCAPPIVHRDIKANNILIGPEFEPYIADFGLAKLVDDGDFARSSSTLAGSYGYIAPEYGYMMKITEKSDVYSYGIVVLEVLTGKQPIDPTIPDGLHIVDWVRHKRGGVEVLDESLRARPESEIEEMLQTLGVALLSVNSSPDDRPTMKDVVAMMKEIRQEREECVKVDMLLNASSANEQQERNHLTEEPMSMISTSSTNLHLHYSPHRPQTPK

SEQ ID NO: 166484 - protein, 68 aa, Glycine max
  Coding DNA Sequence Number=SeqID_49706
LYEGSIYRAGGEGRRASSKSLSEAVAIGEFGQKKGHALAYHEIISLCTWWSGQSYALEARTVDLEDEA

SEQ ID NO: 166485 - protein, 58 aa, Glycine max
  Coding DNA Sequence Number=SeqID_49707
PNACQEGGNDVGIKAQAQAQMEAQDAIQGLEGPMTRARAKKAQEALEHMVIILRAVQM

SEQ ID NO: 166486 - protein, 86 aa, Glycine max
  Coding DNA Sequence Number=SeqID_49708
  Subcellular localization annotation: CTP_CleavageSite=63; ConfidenceScore=5.66e-01
MSAWQFQQKTSLQVTYYCSSASTNKSSRSSQAPITRYKNCKGKLGSKCRGHPVVHRQLPPTIPESQGSSKSSEMPPSTSIFSHEKL

SEQ ID NO: 166487 - protein, 796 aa, Glycine max
  Coding DNA Sequence Number=SeqID_49709
  Gene Ontology: Mol. function=transcription factor activity; Cellular component=endoplasmic reticulum; Biological process=regulation of transcription, DNA-dependent
  Homolog annotation: Hit_ID=Q6YUW7; Match level="QueryCoverage=99%, HitCoverage=99%, E-value=0.0, Identity=51%"; Hit description =Chromosome structural maintenance protein-like
  Pfam annotation: Domain name=RINT1_TIP1; Domain location=293-796; Score=454.3; E_value=1.5e-133; Accession=PF04437.4; Description=RINT- 1  TIP-1 family
MEWLQTLPPSSHISPSALSFLDHRLHTQLAVAEAPTFAAELQTQCSELDRSLDELTRRLGAGLSAYASFSGEIHGLFGAVTDRLVALSSTVVPDGGRGEGDGKGFREELATLAKEVARLETVRVYAEKALKLDTLVGDIEDAVSFTMSKNIRKHSSQNSQEMHMLAIKTLKTTEDILTSITKAHPQWKHLVSAVDHRVDRALAILRPQAIAEHRALLTSLGWPPPLSALTSSNSDASTANQVVNPLLSMHVDLKVQYSENFLALCNLQELQRQRKARQLEGHDREVALRQPLWVIEELVNPLSLASQRHFSKWVDKPEFIFTLVYKITRDYVDSMDELLQPLVDEAKLLGYSCREEWISAMVTSLTTYLAKEIFPSYISQLDGESVTGIQSSARISWLHLIDLMIAFDKRIKSLVEHSGILLSFDDDIMQKISSLSVFCDRPDWLDLWAEIELGDVLDKLKPDIQDENNWRKKVEGVVLSSYTDDHKSPLVSNAFLRHLASVIDRCRSLPSVSLRSKFLRLAGIPIIRNFFDSILIRCQEAEGLTALTDDDAVIKVTISVNAAHYFESVLKEWSEDVFFLEMGMDEDDKTELESNSNSYGEVLPESSRRVIFDDEIKKLEEFRTEWVEKISLVILRGFDSHSRDYVKNKRQWQKGEEGWAVSKTLIQALDYLQSKMSVVEVSLNGRDFIGVWRSLAAGIDQLIFNGILISNVKFHNSGVERFGSDLDVLFGVFGAWCLRPEGFFPKSSEGLKLLKMDENRLQECMGGGKRWLKENGLRRLSVTEAEKILKSRVFTS

SEQ ID NO: 166488 - protein, 66 aa, Glycine max
  Coding DNA Sequence Number=SeqID_49710
MATPMSTACYLDKDETVISEFLAGTSREVSTLKLLQMHSMAIMFGIIKAKKEEIVRDRGRYMKIKL

SEQ ID NO: 166489 - protein, 63 aa, Glycine max
  Coding DNA Sequence Number=SeqID_49711
MAIYKKSHFGAGEACPGSLEAHAWCLSLPRCRVQRKHNQSNVYSTLLVGYGTPIKRVERAISD

SEQ ID NO: 166490 - protein, 160 aa, Glycine max
  Coding DNA Sequence Number=SeqID_49712
  Gene Ontology: Mol. function=nucleic acid binding; Biological process= DNA integration
MSPYRNWFVAYGKKSSGNVLMGNNAHCKTIGIGSIQIKMHDVIVRILTNVCHVLELKKNLISVGAMDSKGLTSTVSQAGSLAFSDNSLWHKCLGRISEMRLEIMSKQGYFEITRWNLFSFNQTTKKVKRLRMNNGLKFCKDEDIARQNIVQHTPQQNEVA

SEQ ID NO: 166491 - protein, 109 aa, Glycine max
  Coding DNA Sequence Number=SeqID_49713
MPPTVPVNHYSDPEGQHNRIRILWGYPMLMYTERRLALSTLIFFKVPAPEARPGPVKDKERIAGRRDEPTRCTPEADRSTQPKDWVICAPAAFLGCGSRFSGSLSGIEP

SEQ ID NO: 166492 - protein, 143 aa, Glycine max
  Coding DNA Sequence Number=SeqID_49714
MVADRACPHLQVWDSAKKKGFELYYKEEMPIRKMKVEIVNLPLNWSPLFHGKQLIRTSNAHDARTFWSQIVWVKKFDKDVVVVVKKEVFASIQVKSFAEVVDDTIVCRVIIDLTNISIMDKTGDTSNVVVVDEVEPHILDPAS

SEQ ID NO: 166493 - protein, 82 aa, Glycine max
  Coding DNA Sequence Number=SeqID_49715
MSWTRVMIASLFFTGHYSLMSLNLGIKEVELELEVELEDEALPVPPLGGGLWTGDKICWMSIFGAIGIWRVVIRSYTNPQRN

SEQ ID NO: 166494 - protein, 74 aa, Glycine max
  Coding DNA Sequence Number=SeqID_49716
MTITHAINTIACLPWWHWRMVLPENVEELSLADMEKSSEEEEAKGRIFTDERSFTNPNLRNTLKNKKGIQRTKA

SEQ ID NO: 166495 - protein, 80 aa, Glycine max
  Coding DNA Sequence Number=SeqID_49717
MPSAVHVSSTYEFGAMRTDCLVQFSVLAFFSEPHECHCLVLFMHPAPTSLEPREEPHECHCLALFMRPPPTSLEPYVVIA

SEQ ID NO: 166496 - protein, 58 aa, Glycine max
  Coding DNA Sequence Number=SeqID_49718
MVKHVAVFQSYIWPACMVFSISSVTSFQFLEKPWYWRKGRRKLEPAPGSLHSSICSVS

SEQ ID NO: 166497 - protein, 230 aa, Glycine max
  Coding DNA Sequence Number=SeqID_49719
  Gene Ontology: Mol. function=protein-tyrosine kinase activity; Cellular component=membrane; Biological process=protein amino acid phosphorylation
  Homolog annotation: Hit_ID=Q6EPN3; Match level="QueryCoverage=100%, HitCoverage=47%, E-value=2e-50, Identity=42%"; Hit description =Mechanosensitive ion channel domain-containing protein-like
  Pfam annotation: Domain name=MS_channel; Domain location=127-230; Score=-52.8; E_value=0.0071; Accession=PF00924.9; Description =Mechanosensitive ion channel
LLDSHPYLDKVVIPVAGTLTATILAWFLLPRILRKFHKYATQGPVSLLPASVSVEPVPYEKSFWGAMEDPVRYLVTFIAFSQIYMTADFDFQWCYGGSNNYNLTISCTSLEGQSLLGLDKEKVLALDKISSIGLFVIGIMALAEACGVAVQSVVTVGGIGGVATAFAAKDILGNVFSGLSMQFSKPFSIGDTIKAGSIEGQVVEMGLTSTSLLSSEKFPVIVPNSFFSSQ

SEQ ID NO: 166498 - protein, 156 aa, Glycine max
  Coding DNA Sequence Number=SeqID_49720
MTNDEERLKIFARSPRKRFGNITEAPRLGFSSQKEFFPLILSDPETPEGKIGEELATQLAQVSQVASSRSNRLLEEHPRPKDTCFLSVRLRNLTGHVITSFLAFGMLRNLTDCVTMLPFDFWHVMELHVLCNKGCQVPRSGQTKVICHETMVPGQN

SEQ ID NO: 166499 - protein, 81 aa, Glycine max
  Coding DNA Sequence Number=SeqID_49721
MEEDGEKGVLESWENLLHSRHEWNLQGDWLPLHDEVKSFTKTYLVIAIRKNLHSKRFSFELRAPSLTTSFWWSLKDLKESF

SEQ ID NO: 166500 - protein, 75 aa, Glycine max
  Coding DNA Sequence Number=SeqID_49722
MTTLHQRRRRRRRKLLIEVWSGGARVRGGGGGGGVEHFAVRVEHYNSLTTLIDHLKSLVLNQDSKGNGFLVNGNP

SEQ ID NO: 166501 - protein, 179 aa, Glycine max
  Coding DNA Sequence Number=SeqID_49723
  Homolog annotation: Hit_ID=Q5CEG7; Match level="QueryCoverage=56%, HitCoverage=95%, E-value=2e-43, Identity=86%"; Hit description =Senescence-associated protein
  Subcellular localization annotation: CTP_CleavageSite=52; ConfidenceScore=5.25e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFPPRIDRPKPTLGPKRGAVPPLPIHGITPTYPTPSQVIFTKVGLESSSTGSSFPADFRQARFPWLWFRWIVDRDSGNLR

SEQ ID NO: 166502 - protein, 56 aa, Glycine max
  Coding DNA Sequence Number=SeqID_49724
ALNVKVKKFTQARVNGGSNYDSLKRNHSQGKRAWRKSAGKEDPVELDSSPTFVKMT

SEQ ID NO: 166503 - protein, 170 aa, Glycine max
  Coding DNA Sequence Number=SeqID_49725
MRRHFISPSLRATKREEDEEVQALRTELKQAQIVKERFKSAALKIRKENSELRDINIATTKALEQETKRARREEHGRNKFRGALWGSNNELKLRREERDQSRVDSLILKDELKACSRSKRSLSQWLCETETNMLAIITKYQEELSLATAHKHRVVDEYAQVYAEKEARGR

SEQ ID NO: 166504 - protein, 83 aa, Glycine max
  Coding DNA Sequence Number=SeqID_49726
MAQERTWMPCVLLEQVRNQPNTEGGQATDDPKASIAARSTKPSTYLRGRPAMPFRVCFMRSKPLAESLTTIAILLKEGRHPEE

SEQ ID NO: 166505 - protein, 78 aa, Glycine max
  Coding DNA Sequence Number=SeqID_49727
MEAKAQKWWPRDEKLQIPWVFAFLNEKGEFWVERNSPSLIFMFLGCLPVALSACPEPGMRRRSIDRDPGLYLRPSLST

SEQ ID NO: 166506 - protein, 51 aa, Glycine max
  Coding DNA Sequence Number=SeqID_49728
MEAQDPIQDIGGPMTRARAKKSQEAVEHKGEAKDLEAHKRELLVLYVECLE

SEQ ID NO: 166507 - protein, 177 aa, Glycine max
  Coding DNA Sequence Number=SeqID_49729
  Homolog annotation: Hit_ID=Q9AVH2; Match level="QueryCoverage=47%, HitCoverage=41%, E-value=1e-39, Identity=70%"; Hit description =Putative senescence-associated protein
GGGGAWSSVRPRHTPREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPC

SEQ ID NO: 166508 - protein, 67 aa, Glycine max
  Coding DNA Sequence Number=SeqID_49730
  Subcellular localization annotation: CTP_CleavageSite=26; ConfidenceScore=5.14e-01
MSLPSAVHVSPLSSAKLLVTGKHVILLFSRSAPSPKEKRWSGDESRHHRKGRTDEISVLSLLSSYLR

SEQ ID NO: 166509 - protein, 105 aa, Glycine max
  Coding DNA Sequence Number=SeqID_49731
MEDALVSLASPSRRRVGCDKCQMYLPKSRADLMSGLTVVGMDSDNLQRQTPRYHPFEEWDRVPAKGTPMLNEFADILCLRNEEGTYKWDFDAQMLAYQNHHGLTA

SEQ ID NO: 166510 - protein, 210 aa, Glycine max
  Coding DNA Sequence Number=SeqID_49732
  Gene Ontology: Mol. function=two-component response regulator activity; Cellular component=intracellular; Biological process=two -component signal transduction system (phosphorelay)
  Homolog annotation: Hit_ID=Q1EM00; Match level="QueryCoverage=94%, HitCoverage=91%, E-value=2e-19, Identity=33%"; Hit description =Response regulator containing CheY-like receiver,AAA-type ATPase, and DNA-binding
  Pfam annotation: Domain name=Response_reg; Domain location=2-118; Score=81.3; E_value=2.9e-21; Accession=PF00072.14; Description =Response regulator receiver domain
MIEVLVVDDEKHVRNLISKMISISFECTPDEAENVEEALQVCEKKKFDLITTDIKFGDNEELDGIEFIKRLRLRGIFTPVLIVSAYATAEKIVEVCRYFPIDYLSKPFTQDELKKKIRGLLEVRKDSFERYLREAEGFIHSNFPGDLEKAEQIVRHMFSIMPSSPMPHYLMAEILEKRGNTELAQRHREAGLALDVNKKGYRRGENVEND

SEQ ID NO: 166511 - protein, 66 aa, Glycine max
  Coding DNA Sequence Number=SeqID_49733
EAVTPHHPALSQRAFCGRARARLAGALSKGGKVDKSGAFAPTYPPSKRKSDLRSSSLSVNQAILLL

SEQ ID NO: 166512 - protein, 114 aa, Glycine max
  Coding DNA Sequence Number=SeqID_49734
MAVSKLRIMQSREPKRTVPLRSTGSSRCGVSIGNNGGLWWLMVAMGDGERAWNIGNGFGRKKEKGVAFFQSYLDYKAQNIQVTNALGKRKRRAHSCRLLKDPNAQIVSNCSVKL

SEQ ID NO: 166513 - protein, 301 aa, Glycine max
  Coding DNA Sequence Number=SeqID_49735
  Homolog annotation: Hit_ID=Q47522; Match level="QueryCoverage=16%, HitCoverage=62%, E-value=1e-21, Identity=94%"; Hit description=LacZ protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSISIVVGSFIPSIISCAGDTRDDGWFPGAAINTIAMKKRYGRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 166514 - protein, 256 aa, Glycine max
  Coding DNA Sequence Number=SeqID_49736
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=1e-40, Identity=34%"; Hit description= UPI00006A17C9 related cluster
LHVLVIKGLHAPAFVGLHTLTFRGLHVLTFRGLHALTFIGLHALTFRGLHVLIFRGLHVLTFRGLHALTFRGLHVLAFRGLQVLSFRGIHVFTIRGLHALAFVGLHALAFVGLHVLTFKGLHALAFIGLHALTIQGLHVLTFRGLHILTIRGLHALTFRGLHALAFVGLHALTFRGLHVLTFRGLHALAFVGLHALTFRGLHVLTFRGLHSLPSEDNTSSPSPSEDYMSSPSENYTSSPSKGCTPSPSEGYTPSPL

SEQ ID NO: 166515 - protein, 136 aa, Glycine max
  Coding DNA Sequence Number=SeqID_49737
LQHSISSVSIYYEPQSDIRVKSYGRLYWLRASTFNFERLDKLRDSVRHPSKKLLSFEFAQRFNIQFRASRYVTGLNQTFEDSTFNFERLDILRASIRHPSKKLWSFVLAQSFNVQFRASRYVTGLNQTSEKNVIVV

SEQ ID NO: 166516 - protein, 63 aa, Glycine max
  Coding DNA Sequence Number=SeqID_49738
MVEACAEFDKQGTKRNLQVTRRGIRGGSSTIGSLALAFGHVHTLDVVYDRGGHCALTFQGLWH

SEQ ID NO: 166517 - protein, 143 aa, Glycine max
  Coding DNA Sequence Number=SeqID_49739
DPLRGLIKYSCDIYDKPVEINFAGSCFGIVDAPTSIFITYSDVSKIIAGDKSLNISVLQLWLMYMHEWSQIFSQGSMYAFLEPQSLVVSKDTRSECQQYLKRWLKESDREVYIGPYFHHVMTKLKTTLSPETKAVAPKWIEVK

SEQ ID NO: 166518 - protein, 50 aa, Glycine max
  Coding DNA Sequence Number=SeqID_49740
MNKEKAPKTNGLKRCALRDDPSLNEHAQLILLPDSSLRSAEECCAQRMAR

SEQ ID NO: 166519 - protein, 152 aa, Glycine max
  Coding DNA Sequence Number=SeqID_49741
LAKRAYLAKRVHLLRMNTHPLAEMPVANAFRRGIRWAKRAPLAKLPYLVYFVNCMVPLSATYEELSAYPCGRRQLSELCLAKRIMASRKRARTDDIPSSSIPAPQSASIGPDLAHNRLIIPMEHFLEQVAWPEAQLPLVRPNEAATLEPAPA

SEQ ID NO: 166520 - protein, 103 aa, Glycine max
  Coding DNA Sequence Number=SeqID_49742
  Homolog annotation: Hit_ID=Q1SCP5; Match level="QueryCoverage=35%, HitCoverage=20%, E-value=5e-12, Identity=89%"; Hit description =Ribosomal L18ae protein
  Pfam annotation: Domain name=Ribosomal_L18ae; Domain location=1-100; Score=-57.8; E_value=0.0013; Accession=PF01775.7; Description =Ribosomal L18ae protein family
MKLWSTNEVRAKSKFWYFMRKLKNVKKSNDQVLAINEETSIMAFYNKVGNVLRQSVAHSIKAPVSSMLNCIRCMSSSKLFIGAIHCCWKNSCGYKPRTWSPVF

SEQ ID NO: 166521 - protein, 623 aa, Glycine max
  Coding DNA Sequence Number=SeqID_49743
  Gene Ontology: Cellular component=endoplasmic reticulum
  Homolog annotation: Hit_ID=Q01C16; Match level="QueryCoverage=21%, HitCoverage=24%, E-value=2e-10, Identity=28%"; Hit description =Homology to unknown gene
MSSEFRFVFDASLTITSFYLNDEDDLSPTHGNSSAVHVENRSWEYIGNSHIGANYGSFFYSEANFSSLVQLFKCQKQYVMVDTKKNIVYPIGHQGSMNLMKEKVFPSWLKENTVYCIDRMKSQTKSLDCLVKDMLMSWVCRLQKLSIENFIVYALDKETYQFSILQGIPVFTDPIAPSNVSFDDCHFGTKCFQRVTKVKSRIVLKILKLGYNVLLSDVDVYWFKNPVPLLHSFGPAVLAVQSDEYQKQDAYFTPEIHKLQAYEGMEDPTVLVTTNREKNVKEAGLKKGSYIIHNNWISGRLKKLERQVLSGLWEYDPATTMCLRCRHASKRDGETFRVHNNFEVQAMLKRVVHSLGLVEHRERGSRRQNHLKGHEPPSELNSQSKDFDVRVTHAGGHQEVYRHAVPASQLMRKYPGMCVARPEVFKVPHQSVLWHEEILVPGHRYILISFRHVEKLKRKLLEEEKNKEATGVVLETKTRSPSGHKDKVKVPNGVAGHETLETKITNGLSHKENEKMKETNGVSGQGVLETRLTVSPKDKVNTEETVDTNMEGSLGEGGVEESFSSARDFYVPKEKSTSTTTRPPRRKGIKGKKPFEAPLPKQRLYNRGLGWQPSLPSVKELSP

SEQ ID NO: 166522 - protein, 154 aa, Glycine max
  Coding DNA Sequence Number=SeqID_49744
  Gene Ontology: Mol. function=inorganic phosphate transporter activity; Cellular component=integral to membrane; Biological process=phosphate transport
  Homolog annotation: Hit_ID=Q38954; Match level="QueryCoverage=67%, HitCoverage=17%, E-value=7e-39, Identity=78%"; Hit description =Inorganic phosphate transporter 2-1, chloroplast precursor (H(+)/Pi cotransporter)
  Pfam annotation: Domain name=PHO4; Domain location=23-147; Score= -121.5; E_value=2.4e-05; Accession=PF01384.11; Description=Phosphate transporter family
  Subcellular localization annotation: CTP_CleavageSite=66; ConfidenceScore=5.17e-01
MALKTKVLSYATLLFGFYMAWNIGANDVANAMGTSVGSGALTLRQAVLTAAVLEFSGALMMGTHVTSTMQKGILVANVFNGKDSLLFAGLLSSLAAAGTWLQVAGKVSGCRRFLPKKRAAGDRSKWQTGQGRNCARKVMTQQQEVNSDQTSHGG

SEQ ID NO: 166523 - protein, 320 aa, Glycine max
  Coding DNA Sequence Number=SeqID_49745
  Gene Ontology: Mol. function=inorganic phosphate transporter activity; Cellular component=membrane; Biological process=phosphate transport
  Homolog annotation: Hit_ID=Q8GTR3; Match level="QueryCoverage=99%, HitCoverage=54%, E-value=1e-134, Identity=77%"; Hit description =Phosphate transporter PHT2-1
  Pfam annotation: Domain name=PHO4; Domain location=1-305; Score =276.1; E_value=7e-80; Accession=PF01384.11; Description=Phosphate transporter family
  Subcellular localization annotation: CTP_CleavageSite=57; ConfidenceScore=5.22e-01
MVGFGLAYGGAGAVFWGSLARVISSWVVSPLMGAAVSFLVYKCIRRFVYSAPNPGLAAAAAAPIAVFLGVTGISFVAFPLSKNFPLALAQALACGTVGAFLVDRIIRKQLGHLLVKSNTPEPEPKEDSVHHHNIGFLDDVAGPKGAQLEIVYGVFGYMQVLSACFMSFAHGGNDVSNAIGPLAGALAILQGGAAGTEIVIPTDVLAWGGFGIVAGLMMWGYRVIATIGKKITELTPTRGFAAEFAAASVVLFASKLGLPISATHTLVGAVMGVGFARGLNSVRSETVKEIVASWVVTIPVGATLSVLYTWILTKILSYIL

SEQ ID NO: 166524 - protein, 136 aa, Glycine max
  Coding DNA Sequence Number=SeqID_49746
MQIFANHVELLKANCRATPLGPFRPIRKLQQEATCSPGRACCFWRKPPARLGELGGKLLPYFGYKRAWEAEGKGFSTLGKHISLKISEKKEKEEENQGRGAFVMLSWRFRDQFRERSSPFFIRTSFFIRLALALRI

SEQ ID NO: 166525 - protein, 173 aa, Glycine max
  Coding DNA Sequence Number=SeqID_49747
  Gene Ontology: Mol. function=calcium ion binding; Cellular component =membrane; Biological process=homophilic cell adhesion
  Homolog annotation: Hit_ID=Q2N2B2; Match level="QueryCoverage=62%, HitCoverage=44%, E-value=9e-15, Identity=47%"; Hit description=RPGR ORF15 isoform
  Subcellular localization annotation: CTP_CleavageSite=50; ConfidenceScore=5.63e-01
MKARTLSPVKVRTLSPLKARTLSPMKAETLSPVKMRTLSPLKARTLSPMKAETLSPVKMRTLSPLKARTLSPMKVRTLSPVKARTLSPVKERTLSPLKARTLSPLKEANRLTVPFSKDVITHPTSSYLFANLFESSLRVYSFDEWWQLLIEEDGSSVRGRSLSVELGWLPNWI

SEQ ID NO: 166526 - protein, 821 aa, Glycine max
  Coding DNA Sequence Number=SeqID_49748
  Homolog annotation: Hit_ID=Q6UDM5; Match level="QueryCoverage=34%, HitCoverage=70%, E-value=2e-08, Identity=23%"; Hit description =Starmaker
MDCWTLYVFWHLTALHVNITTSSSICSGPSQGMINPSPIVYAGLFAALVISSKEALDQIQLSYSVFPLSSSSSQERHVQQSMHAPPFVSGSHSVDSTISLADQPLDFAPRFNRDSDLQMQSTYNHHDSSSSMNNWASPVTPGVSYPSVPPNLSSGQQHDPSITTPGHVAPPFGRFAGPGLPSTIPPSGAPFTLSTGTTLHPTVAFSADAYGASGVPDRPKKASVPNWLKEEIKKTVIPAPAENLKEETFVNDGIDKSYARGDEADSKSIDSSRSAEDEDEEDQVEAARTVAINQEIKRVLTEVLLKVTDELFDEIATRVLAEDDLTAEGYNNVFSVVGHKVATSNHKASASPPSATVPKASAKVLVPIKEKVENEDTSENSNSSSPGDVLGLGNYGSDADDGDNEIESSSVPTPARDAAYQSGIKKPLSDRHDLPVNGIAQLDEHDRSETNLMNNQVKTISLPSRSSNDAATDLLHDDKVTKESNHSHSSKVVTEDLKDNGLNSIERSLDRFNGFSSKDSSGVSRSELPGKNISVEKATDDLSGRESRKKSEKNDRPDRSTSEKDFVKEVHSSKTRIDEKGNENQIRKDERNQKREKTDYGSEAKERVKEHSLRHGEKAKESDSRKRSSHVDVKDDKKEAEKSHRGSATDDTSRKREHAKDKGEHKSRQKDASNHDRHRRRRSSSVSSRGRTKKDRINHADDSSGEGSDGSKSVSYHFCNAGSCIQESMTYHRLRSDLKEEIIHNCKDICTLNLRYVDNFCGLLIASILSAGILPILLLILPGEGGQDPDHLFGGRNEWMGTEMVDFAFKGFVQEDINSEA

SEQ ID NO: 166527 - protein, 107 aa, Glycine max
  Coding DNA Sequence Number=SeqID_49749
MGETHEISHRNLADFEPCLGYATEGQAVGDLPLQNTLEGPQFRPQPQPLHSTVGKIPPATVEMGKLDHLEERLRAIEGGRGYAFIDIEELFLVPKHGRSSEVQSVGV

SEQ ID NO: 166528 - protein, 70 aa, Glycine max
  Coding DNA Sequence Number=SeqID_49750
MLASLKKVQMTTLASACQSNLGSPNDEVRITERCLRMLPDSWVMRAKGGVVDKSEAFAPTYPPFVMKNSD

SEQ ID NO: 166529 - protein, 105 aa, Glycine max
  Coding DNA Sequence Number=SeqID_49751
MTKLGLCVSSDTTVSEWQRGADNHKVSPRIMGIFAYHGCRMTKLGLCVPSDTTVSEWQRGADNHKGCESHNSQGQYDKDCGAADKSKALAPTYPPMRNSDLRSSG

SEQ ID NO: 166530 - protein, 241 aa, Glycine max
  Coding DNA Sequence Number=SeqID_49752
MNGNFYLKLVKVFYTCARADLEGNMFSIVNAGVMKAVAGLDMGGVCKFEESTDGYNKMQTYKGMLLDPTRNRRNHLGVGGLTAEDKMVVYLITYILTPRSSNHAQVTDDDLQIVLIDYFNIDVSNEIVDFTKASIEITERHLKKLGMRFVDYEWIMDGEPPATANMDHMEEEAEAEAKQEPVHQWSPFKFLMIQKMDAMLHLYQKHSANVHSTLKNITTQLENIETRLTLSNLLNPNEDEA

SEQ ID NO: 166531 - protein, 205 aa, Glycine max
  Coding DNA Sequence Number=SeqID_49753
DPLWEDVRKKAQAIQKQNTTPHVLSRGGYEYLEHKLMAKKTKKKLEEAAQSRNTKGVIDPPSPIKRHMKWKMARTKKTGQMTSEATKEIADKIEQASHGSFVPHGRQDLLTAAIGQPEHPSRGPAGGVDYRKSDSAADVILQPDVVPVEITDPIIGLALPPKPEVGPSAARVSTKGSCVDPSPTNLDIGDADKCGLYIEEKSSRL

SEQ ID NO: 166532 - protein, 135 aa, Glycine max
  Coding DNA Sequence Number=SeqID_49754
  Homolog annotation: Hit_ID=O24366; Match level="QueryCoverage=48%, HitCoverage=19%, E-value=1e-09, Identity=40%"; Hit description =Hypothetical protein sam2B
MDAQLSLSLSLSEFLFFSIFLVPFRLIEGNNYAATWSDKYKDKDKKISGSVTNQLPSSKDYLGDFLVWKPPIGLRRNRAFWLAAVANGDIPSTAIATSEGAAYMDMSPLMLARHADVASMQRMPPLTMASLVTWS

SEQ ID NO: 166533 - protein, 91 aa, Glycine max
  Coding DNA Sequence Number=SeqID_49755
MDGYLLRWPKKSPLNLADFKAHLEHKISCSSLPLPSFISFFLQALIHGLLWCGVSSLSSFSISLPFIFQEAKESIDEEDPRPTSSNGAYIK

SEQ ID NO: 166534 - protein, 190 aa, Glycine max
  Coding DNA Sequence Number=SeqID_49756
MRGGGCTGARPGELLASSRSNLARTSELVTSALSFLVGPGAEKCPKSVPFALLLNILHISFRNVTKPYGLHRLCGLNLKKKKLCFFFHSLTTLSLSHELVEHANGPPPIMNSQASSPVLSKKHDVKDGADVVVSAAMGGKPDLIVGRKSTRGHTDSERVCRSPRLQRAQRCDRGEHFLDCSWWSEKGTLY

SEQ ID NO: 166535 - protein, 283 aa, Glycine max
  Coding DNA Sequence Number=SeqID_49757
  Gene Ontology: Mol. function=oxidoreductase activity, acting on the CH-CH group of donors; Cellular component=mitochondrion; Biological process=electron transport
  Homolog annotation: Hit_ID=Q7VZE8; Match level="QueryCoverage=100%, HitCoverage=46%, E-value=1e-144, Identity=87%"; Hit description =Probable acyl-CoA dehydrogenase
  Pfam annotation: Domain name=Acyl-CoA_dh_M; Domain location=160-217; Score=76.1; E_value=1.1e-19; Accession=PF02770.9; Description=Acyl -CoA dehydrogenase, middle domain
MPYLTPLQDFRFALKELAGLDDVLKLPGFEEVTPDLVDAILEENGRFVEQAIAPLNVPGDTRPPVWNDGHVTATPGYAQGFKDYAAGGWQGLQHPQAWGGQGLPKLVAAAPGENIQAASLAFSLCPMLTDGVIEAILTVGSEEQRRKFVPNLIGGKWTGTMNLTEPQAGSDLAQVATRAVRQEDGSYRLSGQKIFITYGEHDLAENIIHLVLARTPDAPPGVKGISLFIVPKFLVGADGSLGPRNDVWCASLEHKLGIHGSPTAVLLYGSGKGEAGEGAVGYL

SEQ ID NO: 166536 - protein, 122 aa, Glycine max
  Coding DNA Sequence Number=SeqID_49758
EYFLVPNIITPPKFKVLDFDKYKGTTFPKNHLKMYCRKIGAYAKDEELLIHSFQESLTGVAVTCVSIMASDWMQLQNMCKKGHESFKEYAQRWRDLAAQVAPPMMEREMINRDGGHIVSILL

SEQ ID NO: 166537 - protein, 103 aa, Glycine max
  Coding DNA Sequence Number=SeqID_49759
MQSSKCDVYLGAFLNGGHWQMVVIMPKEHLVVWFCSLYNRPDNYLKGIINSALKVLDDASQPQSKAPARWIVVKCDRQKRSTECSYYVMYWMSTIILGSFRNN

SEQ ID NO: 166538 - protein, 120 aa, Glycine max
  Coding DNA Sequence Number=SeqID_49760
AFIKKYCVPRQAQGETPQQPEDGRQRATDAPPSPLEFTSAHPQKGRKIPWICIKNTSQNVAKYLVKKREQKAYVALIGWKFCLFTKACSHFGEENTETIFSLTIIKNYVGLSSSSQIEDT

SEQ ID NO: 166539 - protein, 92 aa, Glycine max
  Coding DNA Sequence Number=SeqID_49761
MAINSWGSEYDLMVEDARIALGNQFVGLRTRWWRMHESQGNQFVGLRIIFDGGGCMNGNEFMGLRIRFDGGGCTNSARQLTCGAPDSMVEDA

SEQ ID NO: 166540 - protein, 111 aa, Glycine max
  Coding DNA Sequence Number=SeqID_49762
  Subcellular localization annotation: CTP_CleavageSite=38; ConfidenceScore=5.17e-01
TYQGNPCGVYPDLSSFTGSGIYPDLSSFTGSGVYPDLSSFTGSGVYPDLSSFTGSGVYPDLSSFTGSGVIQNLRSLYQTIRSYSGSHHTNRDAYTHRLSIVVSVEDIPNQH

SEQ ID NO: 166541 - protein, 48 aa, Glycine max
  Coding DNA Sequence Number=SeqID_49763
MVILLPLSFKSSKLSDKRAETSYGHFVPFVIHGRFYWQGDSPAKWCFA

SEQ ID NO: 166542 - protein, 64 aa, Glycine max
  Coding DNA Sequence Number=SeqID_49764
MWVQAIGLFAQATCAPEFWTSKTVQSEITRLARWWGCRKTTKRSELSRIGCWTNGLSYLKKKGG

SEQ ID NO: 166543 - protein, 161 aa, Glycine max
  Coding DNA Sequence Number=SeqID_49765
MPISSCGSISWYVPSRHRDRAPYKESLRPGEVQQVPRVPGSDHQAPINRDFIEQYCTPRQAQGEAPQQNGDGQQRVTDAPPPPQGSTSAHLQRYWAHDRQIVIMRPAQDVKEALLGGNLELAAKKLPTKRSRKGTIEEGSNATPQADTGFDKHRFQSVEHQ

SEQ ID NO: 166544 - protein, 148 aa, Glycine max
  Coding DNA Sequence Number=SeqID_49766
MVCTNQADMIGRLLGGSLAFELCIMHYLIMHILLPRSSNLAQVSEEDLIIMWVFLTGHQIDSDHLVRYRMHKALRSNAPLLYPHSITLFLQHLNVPLDSEAFVKVKRSFSIGANVISSFGYRKERDGSWVKKDAPAQAAEDRSPSPHP

SEQ ID NO: 166545 - protein, 50 aa, Glycine max
  Coding DNA Sequence Number=SeqID_49767
  Subcellular localization annotation: CTP_CleavageSite=10; ConfidenceScore=5.00e-01
MTIPNSFTIRSSSNLKTKSRTNFGTSLPLEYAKKMSETSGLRYLKKGGLN

SEQ ID NO: 166546 - protein, 71 aa, Glycine max
  Coding DNA Sequence Number=SeqID_49768
MGNNHRAKTMAEALIGDVTWTEGQTTAFDDTIVENAEVKDKRGGEPDDMQRYLMVIRAFRQLRGLNAAVSG

SEQ ID NO: 166547 - protein, 87 aa, Glycine max
  Coding DNA Sequence Number=SeqID_49769
MLTSKIPTRGGRNTTVNLAGILNTDDSAVAERKVDEDALGRRNTARRMTTTVAEAFLKEEERRVRCRRKKKNRGEKKSNAGEKKKKW

SEQ ID NO: 166548 - protein, 53 aa, Glycine max
  Coding DNA Sequence Number=SeqID_49770
MVRIKGLCRALGRVIGRALGREHSGDADESPQQRRPTTSAHLTKSLNSLSRQP

SEQ ID NO: 166549 - protein, 96 aa, Glycine max
  Coding DNA Sequence Number=SeqID_49771
MNKATYLSLKSDFRKRVWTGDSELCMSRVSRERKVQVPECFERFCCVKICRDQSMKQEPMHAVLEPFNSGNWSNSKVLDRAGLGCRAFTRNWGAII

SEQ ID NO: 166550 - protein, 657 aa, Glycine max
  Coding DNA Sequence Number=SeqID_49772
  Gene Ontology: Mol. function=methyltransferase activity; Cellular component=intracellular; Biological process=metabolic process
  Homolog annotation: Hit_ID=Q9LHH9; Match level="QueryCoverage=91%, HitCoverage=91%, E-value=1e-161, Identity=51%"; Hit description =Protein arginine N-methyltransferase 3-like protein
  Pfam annotation: Domain name=Methyltransf_11; Domain location=307 -452; Score=7.1; E_value=0.011; Accession=PF08241.2; Description =Methyltransferase domain
MAFSDKQKQEEEEEPHRMEEDDDESEEEEEEEEEEEEEVWDDWEGEDEGERESEFVCLFCDSRYSSCGSLFDHCASLHRFVFHTIRTTLSLDFYASFKLINFIRSRVAENICWSCGLTCQSNCDLQNHLHDVVDFNEIKTLWNDDRYLIPFMQDDSLLYSFGDCDEDGEDEHITRIDEDLIKDLMNIEESIHDDQDLVKKVVVDDDKHEIDSVSNNHLNKASSSKKLINGKDSKGHVLCSDKDPEGHLMVNSQNHIAKHIKKINESYFGSYSSFGIHREMLSDKVRMDAYGQAILKNPSLLNSAVVMDVGCGTGILRCPTLARNMARILLIRLGQPSSLELTFGSSPSKAGASRVIAVEASAKMAAVASQVAKDNGLLLSKSQNGVDGLQKGVIEVVHGMVEEIDKTVELQPRSVDVLLSEWMGYCLLYESMLGSVLYARDRWLKPGGAILPDTATIFVAGFGKGATSLPFWENVCDFDMSCIGNELVIDAARIPIVDVVDSQDLVTCSAILQSFDLATMKPNEVDFTATATLELKPSTSGTCCWCYGVVLWFDTGFSSRFCRETPAVLSTSPYMPRTHWSQTILTFQEPIAMGFGKENRGKPEAIGTEVYPAVKIDLRVSIVRSTEHRSIDISLEAAGVGPDSHKRSWPAQLFNLQ

SEQ ID NO: 166551 - protein, 119 aa, Glycine max
  Coding DNA Sequence Number=SeqID_49773
MTSPRLEERLLLPMIPKWQIGNSSKPMSFQAQHFQYGILIGPLCKTLKRKKVKEKESGPKNQFLGAYEKGQKVTQESLGGEASGITEWTSSKERIKEGKGKRESSKERENNYLVEGIAK

SEQ ID NO: 166552 - protein, 45 aa, Glycine max
  Coding DNA Sequence Number=SeqID_49774
  Homolog annotation: Hit_ID=Q94FN3; Match level="QueryCoverage=63%, HitCoverage=5%, E-value=6e-07, Identity=86%"; Hit description =Phosphatidylinositol transfer-like protein II
MPQGLKNFNKHARELFTRLQKIDKDNYPECCNLFEFCLVSDKNIK

SEQ ID NO: 166553 - protein, 83 aa, Glycine max
  Coding DNA Sequence Number=SeqID_49775
MEVLVEEDGSKIDYSIVLQHSSAVLMMSVKKDFHLWVSIFECERIPPRVLHRILIVGSLSSGTYTFLMAWLLHRAWINDCSKT

SEQ ID NO: 166554 - protein, 189 aa, Glycine max
  Coding DNA Sequence Number=SeqID_49776
  Homolog annotation: Hit_ID=Q1T4Y2; Match level="QueryCoverage=22%, HitCoverage=25%, E-value=2e-07, Identity=66%"; Hit description=VQ
  Pfam annotation: Domain name=VQ; Domain location=29-59; Score=48.7; E_ value=2e-11; Accession=PF05678.4; Description=VQ motif
  Subcellular localization annotation: CTP_CleavageSite=39; ConfidenceScore=5.40e-01
MLGVNNNHAVMKRKGQSKRGHKKNVKVTYISSPMKVKTSASNFRALVQELTGQASNVAEMFVEADYYYGVHHDDGVHKGNQQWSSEEAYFPESTWLKHDDYSHLNSRSSMELLTEHLELELLSFETVATCVLEFIPNMDLYIGHCRPISCQSPHTSLLAADDDDRFPKSVEVAGLLIQGFRVNNFGIKM

SEQ ID NO: 166555 - protein, 98 aa, Glycine max
  Coding DNA Sequence Number=SeqID_49777
MSAPLVYSSKHIPTKLETFTQEEVALQFPIQDTVQVTSQFYIVSLHAEKKKEGMTRDVGTQSTPPYISSHQKPSSGMHVNQLSPSVLKSEGVPVHRTV

SEQ ID NO: 166556 - protein, 95 aa, Glycine max
  Coding DNA Sequence Number=SeqID_49778
MIFVVDVVMSSMLVAVNAYCWMDFRVKYFASSLTVYHQTDRQLQNEAKVGAQFNRELKSDIDLLCQKLCAMGCYTCSGTTIFGQVMAVLTALDNA

SEQ ID NO: 166557 - protein, 91 aa, Glycine max
  Coding DNA Sequence Number=SeqID_49779
  Gene Ontology: Mol. function=hydrolase activity; Biological process =nucleotide biosynthetic process
  Homolog annotation: Hit_ID=Q9KLA6; Match level="QueryCoverage=98%, HitCoverage=55%, E-value=6e-45, Identity=95%"; Hit description =Deoxycytidylate deaminase, putative
  Pfam annotation: Domain name=dCMP_cyt_deam_1; Domain location=1-91; Score=56.0; E_value=1.2e-13; Accession=PF00383.13; Description =Cytidine and deoxycytidylate deaminas
MAELVGSWSKDPSTQVGAVITKQNRIVSVGFNGYPHGISDSANTDHRDMKYLKSLHAEENAILFAKRDLNGCEIYVTHFPCPNCAAKIIQI

SEQ ID NO: 166558 - protein, 91 aa, Glycine max
  Coding DNA Sequence Number=SeqID_49780
MKKNKVAAAGVLLSEAYALSERAFEDKKSLKVEVGKRRKEFFEERNRGIRERRNRGKTRQQSTKDLSFQEDSRFRSDYYVLRGGGDMPTTV

SEQ ID NO: 166559 - protein, 148 aa, Glycine max
  Coding DNA Sequence Number=SeqID_49781
MGCYTCSGAITFDQHRYRMGCRCCTGCKYACEGKHSSKRFLLPSSLSGVFDMASSSSSSSSFDVATITLQDVSVLLGLPVDDNPLIGSTNIDGIDMCEQYLGVRPNTNALAIGNTMKLSWLASEFANIQDYVDDEFAFSFPRGHHGGE

SEQ ID NO: 166560 - protein, 243 aa, Glycine max
  Coding DNA Sequence Number=SeqID_49782
  Gene Ontology: Mol. function=structural constituent of ribosome; Cellular component=intracellular; Biological process=translation
  Homolog annotation: Hit_ID=Q9LXF9; Match level="QueryCoverage=59%, HitCoverage=91%, E-value=8e-56, Identity=69%"; Hit description =Ribosomal protein L27-like
  Pfam annotation: Domain name=Ribosomal_L27; Domain location=138-219; Score=162.4; E_value=1.2e-45; Accession=PF01016.9; Description =Ribosomal L27 protein
MGLEETEFGEIGRGFFLVAVGFDGFEVDLGGEHNREKDEGECELVNYGSSHSRSFTHDEAVCFLMVFKVRGMGVYALWFICLFSFPGLEKLLAENIMNFAASLCRRLNIKELATNVPVYKSTSDVSGEGLSFTFRRWASKKTAGSTKNGRDSKPKNLGVKKFGGERVIPGNIIVRQRGTRFHPGNYVGLGKDHSLFALKEGWVKFERNKLTGRKWVHVEPKEGHVLHPLYAADASASELKVAV

SEQ ID NO: 166561 - protein, 145 aa, Glycine max
  Coding DNA Sequence Number=SeqID_49783
MLSPMKNKGEDVKSYGNIKARTLSPMKGKGEDIESYGNIKARIQRTLSPTKNKGEDVKSYGNIKARTLSPMKGEDVESYGNIKIKDIESYEKKRQRTLSPMKHKGKDIEFYGNIKTEGVDSYEEKGEDVESNGNIKARTLSPMEI

SEQ ID NO: 166562 - protein, 178 aa, Glycine max
  Coding DNA Sequence Number=SeqID_49784
ASLGILDYNGAISMPGRLSGSVGSKDQMTSLVLHLPFYINAIKTKWEHDDPMSSYNRFVMPVPEVVIPSKSYSSSASIKMSSTRSNLSSKDIDATFPFLMSPYSVLLESWVPLIEAEKMMTHQPPRVDMVDLVSTNEGQDLKEDASYEEDPFMDKEDLITKPKFIKEDSSQDSFEESH

SEQ ID NO: 166563 - protein, 62 aa, Glycine max
  Coding DNA Sequence Number=SeqID_49785
MKAQRNFWHLIKFGESFSLGSLLNQSQTYQGNPCGVYPDLSSFTGSGVIQISIACIKRSAPS

SEQ ID NO: 166564 - protein, 203 aa, Glycine max
  Coding DNA Sequence Number=SeqID_49786
  Gene Ontology: Mol. function=transferase activity, transferring hexosyl groups; Cellular component=Golgi stack; Biological process =metabolic process
  Homolog annotation: Hit_ID=Q6K8I3; Match level="QueryCoverage=69%, HitCoverage=33%, E-value=2e-15, Identity=28%"; Hit description =Fertility restorer homologue A-like
  Pfam annotation: Domain name=PPR; Domain location=131-165; Score =46.5; E_value=9e-11; Accession=PF01535.11; Description=PPR repeat
  Pfam annotation: Domain name=PPR; Domain location=166-199; Score =25.3; E_value=0.00022; Accession=PF01535.11; Description=PPR repeat
  Pfam annotation: Domain name=PPR; Domain location=86-119; Score=6.1; E_value=1.4; Accession=PF01535.11; Description=PPR repeat
  Pfam module annotation: Pfam domain module=PPR::PPR::PPR; Domain location=131-165::166-199::86-119
  Subcellular localization annotation: CTP_CleavageSite=15; ConfidenceScore=5.29e-01
MPSPSFSIPTDSLTTSSADSSMLLATVMTLGVQFTSSTKLIPLQEEDAFSPTQCHIGILVRANHVNIAKAIYDQVLTEAILESDVYTYTTMIRGFCKVGKVENACKKGDMDGVRKVFDRLVESQSCKPDVVSFTTLIDGYSKRGGFREALECLKEMVKRGCLLNVVTYNALIECLCLSSEVDEARKMMSRMCLNGLKDIPTPT

SEQ ID NO: 166565 - protein, 60 aa, Glycine max
  Coding DNA Sequence Number=SeqID_49787
  Gene Ontology: Mol. function=sequence-specific DNA binding; Cellular component=nucleus; Biological process=regulation of transcription, DNA-dependent
  Homolog annotation: Hit_ID=Q3Y4G8; Match level="QueryCoverage=68%, HitCoverage=15%, E-value=4e-09, Identity=69%"; Hit description=MADS -box protein
MMQLVEAYKSLTLKKSIQETTTGNHWKLVIKVCHMVVVVQRILTLKASSNHYTSKKYPRY

SEQ ID NO: 166566 - protein, 203 aa, Glycine max
  Coding DNA Sequence Number=SeqID_49788
  Gene Ontology: Mol. function=transition metal ion binding; Biological process=proteolysis
MSVKYLEAVKRRLHATKQCKVIDPRQLDDLENEASIVLFQLEMYFPPSFFDIMIHLILHLVREIWLCGLIFLQWMYPVERYIKVLKGYTKNQYQPEASIVESYAAKEAIEFCSQYIETVHSIGLPESRHDWTRGVLGFAIKYSMREKTESTKTVQNGGFNPFSFFLTFGNPIRAVEGKIGGISGNHWRCLYCCHNAQVSPLRG

SEQ ID NO: 166567 - protein, 185 aa, Glycine max
  Coding DNA Sequence Number=SeqID_49789
  Gene Ontology: Mol. function=3,4-dihydroxy-2-butanone-4-phosphate synthase activity; Cellular component=chloroplast; Biological process=riboflavin biosynthetic process
  Homolog annotation: Hit_ID=P47924; Match level="QueryCoverage=57%, HitCoverage=24%, E-value=4e-35, Identity=61%"; Hit description =Riboflavin biosynthesis protein ribAB, chloroplast precursor [Includes: GTP ...
  Homolog annotation: Hit description=cyclohydrolase-2 (EC 3.5.4.25) (GTP cyclohydrolase II); 3,4-dihydroxy-2-butanone 4-phosphate synthase (DHBP synthase)]
  Pfam annotation: Domain name=GTP_cyclohydro2; Domain location=78-185; Score=18.1; E_value=9e-12; Accession=PF00925.11; Description=GTP cyclohydrolase II
PKIPFFNSRLFPHADDPLLQETLSELTERRLGADIGGHVELHPPVRGAVIAGLSCGRGARRGGGPESGLAPLTECCGRCASAALIPIMWGPFKAYCYQSFLDGIEHIAMVKGKIGDGQDVLVRVHSECLIGDIFGATCQCGNQLELALKQIEAAGHIVRACPLEDDKQEELQLPADSREYGIGAQ

SEQ ID NO: 166568 - protein, 85 aa, Glycine max
  Coding DNA Sequence Number=SeqID_49790
MDEGVWSKDLKSRRKVEAYSFRLDNCHIQLNLNKTVETKDGKKKKEVAVQGRMRKNAINSSGGEDNRHDGDDRHVFRVFEWNKLR

SEQ ID NO: 166569 - protein, 92 aa, Glycine max
  Coding DNA Sequence Number=SeqID_49791
MKEERSAKLERSKVNGRWRYWLEQWVNTQLSKSKELEDLDSIFRSHSRAGEEYGGRKLKPRSSIQRKNPVEGFLVPNIFSRRWPQVVPTTSG

SEQ ID NO: 166570 - protein, 202 aa, Glycine max
  Coding DNA Sequence Number=SeqID_49792
MRGNPHPRALLLPIFLNWKWKLLKVEVGSGSWKWKLLEVESSKWKFEVGNESYWKLKVENGSWKLGGEVIVIIKKGENVNHAGFDDVKENLLDNERHHKKGEECGSCIVLMMLKRNHLIVIIKKGENKGFKVMQDSGNRLLEGKVEKELLKRVLNLNFQHVIDYHMSVIDLPATELWKFKFKGHDPSNYNYVIDYINIVIDY

SEQ ID NO: 166571 - protein, 96 aa, Glycine max
  Coding DNA Sequence Number=SeqID_49793
  Subcellular localization annotation: CTP_CleavageSite=56; ConfidenceScore=5.47e-01
MESSTDKKKKLDHPIMIKKFFTTVFQVSTCAKRSSRAKWTLWAQRASTTKHNFNVLSVTKESGRAQESRLRAKREISSLSKTFNFSQAQRTTSAKP

SEQ ID NO: 166572 - protein, 186 aa, Glycine max
  Coding DNA Sequence Number=SeqID_49794
  Homolog annotation: Hit_ID=Q1S7C5; Match level="QueryCoverage=55%, HitCoverage=8%, E-value=3e-18, Identity=40%"; Hit description =Integrase, catalytic region
METKADLRHPSTQSDPELEQAILGNDLNKLQEVLRLRHHQRDELKCQKEEELHKRSNRGLVAPLPHLKPYLDASSQSFSLSPSLTKCIWFYWRQHVELVIKAHKLQRFIVNPVVLPCYLMEDNRIVDCVNPEYEAWEVQDQTLLVWLHSTLSKSVLSCMLGLNHSYQVWDKIHEYFSLHTKSRASQ

SEQ ID NO: 166573 - protein, 832 aa, Glycine max
  Coding DNA Sequence Number=SeqID_49795
  Gene Ontology: Mol. function=RNA-directed DNA polymerase activity; Cellular component=chromatin; Biological process=chromatin assembly or disassembly
  Pfam annotation: Domain name=zf-CCHC; Domain location=10-27; Score =8.0; E_value=0.047; Accession=PF00098.13; Description=Zinc knuckle
  Pfam annotation: Domain name=zf-H2C2; Domain location=562-599; Score =7.9; E_value=0.032; Accession=PF09337.1; Description=His(2)-Cys(2) zinc finger
  Pfam module annotation: Pfam domain module=RVT_1::zf-CCHC::zf-H2C2; Domain location=217-390::10-27::562-599
MELASHWDRGLCFNCDEKFHRGHKCSSMVFLLISDEDDSPFEDNVTLDHPPGPPDDLDLTPAQISFHSLSGHLAPEMLSKVVGPAFAQYKPTECHGGGANLVLGVQWLKALGPILTDYNTLSMKFFHDGHLVELKGDDVSTLGLLSHPQVHRLLRKDGTSACFHIAITTIELPSSPTTTIIPSKIQPLLAKCNSLFQPPQSLPPSRPTDHHIHLQPHSEPVNSFFFPCSVSQEARWVVASLCRLSGTKRDNDKDRYHIPTIDKLLDELGGASWFFDLDLLQGYQIRMHEPDVAKTAFHTHPGHYEFKVMSFGLCNAPSSFQATMNDIFRPYLQRFFIVFFDNILIYSRTLLEHLLQLKKAFETLLHNQFVLKFSRCFFEQPQVEYLGHVVSGQGVAPVASKVQAIDQWPILKTMKALQSFLGLAGFYCRFIRVYASIVAPLIKISTREPFEWTCDVDQAFRILKEALTSVPGHPIAFFSKPFTPKLLQASTYVRELCVITIAVIQTPEQHMYLARLMGYDYCIQYRYGNTNLVADALSRRSEKTEGIPFIQTLLTECRSTLTGGHMGVPKILARLTKNLYWPGLRKDVKQFVATCVNCQQTKYETKKVVGLLCPLPVSFLEGSAPGHAANTTFYLLSRYLVHGHCRKTPWHATELGLRQGPYLRAFLHKKPSSWGKLLNSAEWSYNMSWHSSIGVSPFKVTFEQKPPDWPQYITETSKVEAMDEFLSYRESIFLELKKNLQKAQLAMKHSTNKKHKDVEFNIGDLVMVLDRIGPIAYKLQLPDDSCIHPVFHCSMLKQFHQPALVNASPALSLPPVVIDNEPVVSPLAIIST

SEQ ID NO: 166574 - protein, 157 aa, Glycine max
  Coding DNA Sequence Number=SeqID_49796
  Gene Ontology: Mol. function=helicase activity; Biological process =viral genome replication
  Homolog annotation: Hit_ID=Q1SN45; Match level="QueryCoverage=96%, HitCoverage=8%, E-value=3e-31, Identity=43%"; Hit description=AAA ATPase
  Pfam annotation: Domain name=DUF889; Domain location=1-157; Score =51.6; E_value=5.3e-15; Accession=PF05970.5; Description=Eukaryotic protein of unknown function (DUF889)
MWLQSNPSDQNNTDELKQFSDWLLDIGDGKLDQPNNGYSEIIIPEEFLIMDFDDSIQAIVDTTYPDLLQNYNNADFLQKRAILASTKDVVDKINDYVLSLIPNDEKEYCSADTVDKSDELLNPAFGVLTPEFLNSLKTSGIPNHKLRIKISTPIILL

SEQ ID NO: 166575 - protein, 114 aa, Glycine max
  Coding DNA Sequence Number=SeqID_49797
  Homolog annotation: Hit_ID=Q9SD77; Match level="QueryCoverage=40%, HitCoverage=3%, E-value=4e-07, Identity=58%"; Hit description =Putative helicase
MDPIQATNELAFRVGFSGHSCHLRLEPLSTAEECRNPLRSIPDFISVSHLIVDPYTFSLYSVFVLSSMLGFDIIDVVDLFVIGFLIVFVCLMLTCAYEKTSVALQQQQLLFNRK

SEQ ID NO: 166576 - protein, 57 aa, Glycine max
  Coding DNA Sequence Number=SeqID_49798
MDCKSLSIKAVRHSSGSTSSILETKPFSYKFHVPLGINQKKFPSSKVIYKETRRGWS

SEQ ID NO: 166577 - protein, 184 aa, Glycine max
  Coding DNA Sequence Number=SeqID_49799
MAPPNFLGCTVIYQFQEAFHVDRNYIEVPSKYHWQWAPHYPPQVLFDYNGDKHFIKIRKDGDRYYFADGLKEFRRLMGIHEGVMVHFMAPDSNITFQSTVGKTNMWKASHIHQKLCLHGNNGRRYIWRISMHNGVQCLAGPWYRYLMDNDLMAVDEVVFYFRPNQHVWELILRKHLIWDEDQPN

SEQ ID NO: 166578 - protein, 42 aa, Glycine max
  Coding DNA Sequence Number=SeqID_49800
GESMENALRACCKGIKIGKILIHREGDNGQQGIRLFKQFLSS

SEQ ID NO: 166579 - protein, 222 aa, Glycine max
  Coding DNA Sequence Number=SeqID_49801
  Gene Ontology: Mol. function=DNA binding; Cellular component=nucleus; Biological process=regulation of transcription, DNA-dependent
  Homolog annotation: Hit_ID=Q1T236; Match level="QueryCoverage=39%, HitCoverage=20%, E-value=3e-18, Identity=47%"; Hit description=IMP dehydrogenase/GMP reductase
  Pfam annotation: Domain name=Myb_DNA-binding; Domain location=130 -177; Score=27.1; E_value=6.4e-05; Accession=PF00249.21; Description =Myb-like DNA-binding domain
MPQCNLGFARPPTKFCHSRFFPSASEVLAPAVDEFLVILAPANEVLAAPAPLLDPILAPAPNRIYTYVDFVPIPPARVPTKPLEETFYSIASKQVHVPSSYPHHLLSQNTESNHVMLSSGSSQSIHSKKYIHWTKEEHRSFLLGLEEYKESRWEKISEKFVPSKTPTQVVSHAKNFFKWKNAPKKERKRRSIHETTLDDIDMIVTPHIDQHNWLPPPPNFAV

SEQ ID NO: 166580 - protein, 630 aa, Glycine max
  Coding DNA Sequence Number=SeqID_49802
  Gene Ontology: Mol. function=nucleic acid binding; Cellular component= beta-galactosidase complex; Biological process=DNA integration
IVVEMARSMIKARGVPNRFWYEAVATAVYIFNVSHTKAVMNMTPLEAWRRKKLSVSHLRIFGCTTYALVDLWTKLDDKSIKCVFIGYATQSKAYRLYNPLTGKIIVSTNVVFDEDAGWVWEECEISQSVQQKSVNFDGLEEVSNVPQNDHTPSPPSMPSSQGSLTPSSQVSSSSSKVEWKNAMKEEIKSIEKNATWQLLNLPEGKNVIGLKWVFRTKFKTDGSIQKHKARLVAKGYAQQEGIDFEETFSLVARFETVRVMLALAAQWKLKVFQLDVKSAFLNGDLQEEVFVEQPLGFVKAGEEGKVYKLQKALYGLKQAPRAWYSKIDSFFLQNEFERSENEPTLYVKKGTNGFIVVCLYVDDIIYFSSSPKLLEEFKAAMMNQFEMTDLGLLQYFLSLEVKQGEDGIFLCQRKYAEDLLKKFHMEKCEAIRTPMNTNEKLQRDDARSVSVVSRYLHSPTKQHLGATRRVLKYVAGSIKLGVLYESVDNFKLVGYSDSDWSSKKQDTVALSSSKVEYVVVGAAARQAIWLRKLLKDLYCEQEGAIELWCDNRSSIAMTKNPAFHARTKHIEVQQHFIRQLVAEEKLVLKFCGTDEQNADLFTKALAQAKHQFFLEKIGMHELELRGGVAI

SEQ ID NO: 166581 - protein, 151 aa, Glycine max
  Coding DNA Sequence Number=SeqID_49803
  Gene Ontology: Mol. function=transferase activity, transferring glycosyl groups; Cellular component=cytoplasm; Biological process =nucleoside metabolic process
  Homolog annotation: Hit_ID=Q1S4Q9; Match level="QueryCoverage=58%, HitCoverage=15%, E-value=4e-28, Identity=75%"; Hit description =Phosphoribosyltransferase; AAA ATPase; Phosphoribulokinase/uridine kinase
MERKKREVGENNKMGEEENERPCIGIGTASVTPKHRGKLDNWLCDTLALTMPRQHCQGLVCIMIDEKGVPKSNIIFLNLISFKWFSFDAAPFQAAKGVHVVCKSFPRIKIVTSEIEIGLNEDFRVIPGMGEFGDRYFGTNDDDEQVAVSSQ

SEQ ID NO: 166582 - protein, 408 aa, Glycine max
  Coding DNA Sequence Number=SeqID_49804
  Gene Ontology: Mol. function=nucleic acid binding; Biological process= DNA integration
MKSLFKSQELWSSVESGFEDDGTEEPDQALREKRKKDAKALFIIQQALDDEVFPRIAAASTTKEAWCILNQEYVGDKKVVNVRLQSLGREFESFQMKEKENVQECLSRISSTVQQMRTLGEEIKESQVVSKALFIHMKKEYAKVMTRKKRRLFRQKESLQTRREQSKVQAEAEVEAPEGEVVEEGRVMSKGINLLKITRAHSNATTKEEDEQKGRDQKSNFVEQEEKLFLAQHISNNDAEGGVWYVDSGCSNHMSNAKSIFRTLDETAKTKVRLGDGKQLEVEGRGTIAITTEQGITKLLCDVQYVPRLAHNLLSVGQLLNSGYSVLFENGACLIQDRSSKETIVKIAMGKNKMFPLDFSSHRWHLRYGHLNMQGLKLLHSKDMVQGLPKTEKLELCECYIYGKQSRG

SEQ ID NO: 166583 - protein, 94 aa, Glycine max
  Coding DNA Sequence Number=SeqID_49805
MQFQLGQRIKGQMTILLGSPLPHSLSDSSPQDILSAYSPTIDIRSIPYEWILVTKELVLGHLKRQNNKQKQAKGSKPGFRKDSLRITMNIQYVF

SEQ ID NO: 166584 - protein, 993 aa, Glycine max
  Coding DNA Sequence Number=SeqID_49806
  Homolog annotation: Hit_ID=Q10NT0; Match level="QueryCoverage=99%, HitCoverage=98%, E-value=2e-61, Identity=34%"; Hit description =Expressed protein
  Pfam annotation: Domain name=DUF593; Domain location=625-718; Score =180.6; E_value=3.8e-51; Accession=PF04576.6; Description=Protein of unknown function, DUF593
MAANKFATMLHRNTNKITLVLVYAILEWILIILLLLNSLFSYLIIKFADYFGLKRPCIWCTRIDHILEPGKYKSSCKDLVCEAHASEISKLGFCSNHHKLAESQDMCEDCSSSSQPDYVKLSQSFGFFPWMKQIGMIQGEGADAGDKAIVKVEEALRCSCCGVNLYNRFYPPCILIKPSLNVLEYDQKQNSVTERGVGLEIDEDHTGSDIVLDHHHDEKESEENKGSHMVFEVDQGLDRKDEEAEKSCDCSVCDASVEILCDEICKLDLGVEKGKETIEEESLNVPNPKVDDGDDDVVVADDDDQACEKSSAQVDCTREITVETPPIHLEFFIHGDDCRLIPIELVDSPAPENRNQSRYKLGGEDLNSNEDFILDFDKSADAEAEPVVENWHISGDVVAEFPTQGNENVSKSNGGESVQLRTRGQSSELLQVEEESLEQNCEDVRFVQTADDLTNDDNVEANMERRVAELCSDVSLASEDASQMQGEEYEAEVSIGTEIPDQEQMDEYESQDVLLYTNQQIQEDASTSAVRFNVQDEIGDDKGEDFVEFKTMSLEVKMPTVNNHLPSLLELNENEEEKVPYTPTSLESLHQLHKKLLLLERKESGTEESLDGSVISDIEGGEVTIDKLKSALKSERKALSTLYAELEEERSASAIAANQTMAMINRLQEEKAAMQMEALQYQRMMEEQSEYDQEALQLLNELMMKREKEKLELEKELEVYRKKVHEYEVREKMMMSRRDGSMRSRTSSPSCSNAEDSDGLSIDLNHGAKEENGFYSHQDQECSNQNTPVDAVLYLEESLANFEEERLQILEQLKVLEEKLVILNYEEDRCSDDAKLVEHLCEENGNGYHHDHDDHNGQVNGFSNGHAKKINGKHQGRKLMGAKGKRLLPLFDAMSSEAEDVELSGDELDFPHLQNNSVEKVNPDKKNIALEDEVDNFYERLQVLEADREFLKHCISSLRKGDKGLHLLQEILQHLRELRSVELRVKNMGDLAV

SEQ ID NO: 166585 - protein, 89 aa, Glycine max
  Coding DNA Sequence Number=SeqID_49807
MRVHCYQASRRPSRTTDSPPLLMFPWTIRRSFDFERRETLRRWTINDLLVFESRETLRHWTINDLLGWLTKARLLLLCILNCDEELRPT

SEQ ID NO: 166586 - protein, 44 aa, Glycine max
  Coding DNA Sequence Number=SeqID_49808
  Homolog annotation: Hit_ID=Q1SSC0; Match level="QueryCoverage=83%, HitCoverage=15%, E-value=2e-07, Identity=68%"; Hit description =Thaumatin, pathogenesis-related
RDYGGSLFCNNIDESPLATLAEFTMGNEYNFYDMSLVDGEDEES

SEQ ID NO: 166587 - protein, 101 aa, Glycine max
  Coding DNA Sequence Number=SeqID_49809
  Homolog annotation: Hit_ID=Q9FIC0; Match level="QueryCoverage=96%, HitCoverage=16%, E-value=3e-27, Identity=61%"; Hit description =Arabidopsis thaliana genomic DNA, chromosome 5, P1 clone:MYH9
MAWKVVDMTAARMNSSQRRKVPHHSLICDVYCWKGLRLSARQDLEGFSKFTDHGIEGVVPLELLPPDVRSKYQAKPNDRSKRSKKEETKGTAHQIEENQVY

SEQ ID NO: 166588 - protein, 130 aa, Glycine max
  Coding DNA Sequence Number=SeqID_49810
  Homolog annotation: Hit_ID=Q9FIC0; Match level="QueryCoverage=88%, HitCoverage=15%, E-value=1e-32, Identity=59%"; Hit description =Arabidopsis thaliana genomic DNA, chromosome 5, P1 clone:MYH9
MQLAWKEEITSWEERVKKLLELTPPKGTEFLHKIEHILEREKNWVWWKRDGCLPYEKQRIEKKAVPDGPKKRYDYYYYTDAFVNAMIVSLTLFYLAICSRPRWRLGNKELSQLWKWADQNPKLVIVDAEH

SEQ ID NO: 166589 - protein, 77 aa, Glycine max
  Coding DNA Sequence Number=SeqID_49811
MAIIVLIVVILAIGAKEQLLKLLSKIKVKKNHTFLVVYECEYCDGSAGSAARENDWEGALEGLKGELVEQSDVFGKS

SEQ ID NO: 166590 - protein, 118 aa, Glycine max
  Coding DNA Sequence Number=SeqID_49812
  Gene Ontology: Mol. function=protein binding; Cellular component=Cul3- RING ubiquitin ligase complex
  Homolog annotation: Hit_ID=Q1SJY8; Match level="QueryCoverage=71%, HitCoverage=25%, E-value=9e-31, Identity=69%"; Hit description =BTB/POZ; TRAF-like
MSDSKVETIARLAQWKIDNFGPCSFKRSDPFKLGIWNWFMSIERNRYLYIHIFPEPSRLSKEQPPVARFILRVSNSSGPTRKVYISPVFGSQRKILWAHKKKLQTNVADGFRDLVIGA

SEQ ID NO: 166591 - protein, 121 aa, Glycine max
  Coding DNA Sequence Number=SeqID_49813
MVKTRGLRQASGRNIRRRRRPTASARRQRAVAPVVKDVEHVDHAANEIHEQPQEVVADYVVVDAQGFLSGPYDTSILMDYVHHVVVTVWNGEERPELKLSSHGRKIEKFDRPAPEIEGLKA

SEQ ID NO: 166592 - protein, 171 aa, Glycine max
  Coding DNA Sequence Number=SeqID_49814
  Homolog annotation: Hit_ID=Q1S092; Match level="QueryCoverage=42%, HitCoverage=41%, E-value=7e-15, Identity=63%"; Hit description=TIR
  Subcellular localization annotation: CTP_CleavageSite=41; ConfidenceScore=5.38e-01
MKSLMAFTSSAQTSSFLDRVVYVGFNAVSAESSMKMASEVRASILSSKADENIIFFGNSKSGGRSRTNNSRTSRSHGCAIARGLQMKMLFSAVNIGKNHKNAETQIAVITKTREIYKALQVKETTKQEGIDHLPVNLHSLISAVHNFLNMYFPFLQQQSDHVSLSVQTLEP

SEQ ID NO: 166593 - protein, 417 aa, Glycine max
  Coding DNA Sequence Number=SeqID_49815
  Gene Ontology: Mol. function=transmembrane receptor activity; Cellular component=membrane; Biological process=defense response
  Homolog annotation: Hit_ID=Q1T1A2; Match level="QueryCoverage=99%, HitCoverage=60%, E-value=1e-58, Identity=47%"; Hit description=TIR; Disease resistance protein; AAA ATPase
  Pfam annotation: Domain name=LRR_3; Domain location=398-417; Score =33.7; E_value=6.4e-07; Accession=PF07725.3; Description=Leucine Rich Repeat
  Pfam annotation: Domain name=NB-ARC; Domain location=85-375; Score= -99.0; E_value=0.00056; Accession=PF00931.13; Description=NB-ARC domain
  Pfam module annotation: Pfam domain module=LRR_3::NB-ARC; Domain location=398-417::85-375
MECKKQGEDIHVIPAFYKIDPSQVRKQSGSYHAAFAKHEKDRKVSEEKMQKWKNALYEATNLSGFHSNAYRTESDMIEEIARVVLQKLNHKNYPNDFRGHFISDENCSNIESLLKIESEEVRVIGIWGIGGIGKTTLAAAIFHKVSSHYEDTCFSENMAEETKRHGLNYVYNKLLSKLLKKDLHIDTPKVIPYIVKRRLMNKKVLVVTDDVNTSEVLDKLVGVGRDCLGINAFGKTYPKKGYEELSKRAVEYAGNFSADIGTRSLLDKALISITSDGDHVDMHDLIQQMGREVVRQESIENPGQRSRLWNPEEVYDGNGAVEGICLDMTQITYMNLSSNAFRKMSNLRLLAFKSYQDFEIINSVYLPKGLECLHKSLRYFEWDGYPLESLPSTFCSEKLVEFSMPYSNVKKLWHGVQ

SEQ ID NO: 166594 - protein, 119 aa, Glycine max
  Coding DNA Sequence Number=SeqID_49816
MRQREALDNLQDISHFYSVAYTSIFFTVASSIAAEDYDERKPHACSWKSRKALPMSTYRKQLDRLTSNVICVAPRKCAANYIKWFCFTSHPFMSPTQPEDPPRNPPVVHDDTFIEPDPP

SEQ ID NO: 166595 - protein, 97 aa, Glycine max
  Coding DNA Sequence Number=SeqID_49817
  Subcellular localization annotation: CTP_CleavageSite=48; ConfidenceScore=5.19e-01
METLARDKRRSVGDGAELVKSNIKTPPRPKRRRQPLKSWPVTFSPFARALALSRITSLSPPNPTPTLSAKKPQPSHIYPNRNTPSLPTRTSMYDLSS

SEQ ID NO: 166596 - protein, 58 aa, Glycine max
  Coding DNA Sequence Number=SeqID_49818
MVRTKAERVIAGRIHNPLQEIKEVVDPEFDSLVKKMSDQSEIEQLIVLNPRTCSLAFW

SEQ ID NO: 166597 - protein, 62 aa, Glycine max
  Coding DNA Sequence Number=SeqID_49819
  Homolog annotation: Hit_ID=Q84T78; Match level="QueryCoverage=71%, HitCoverage=12%, E-value=1e-07, Identity=60%"; Hit description =Putative p21 C-terminal-binding protein
LKNVEQKRKQSNGSDEAIIYIKLEDEIFHKLSSWSFCFPLQTQQLAPHEASFMFLQSQLPFL

SEQ ID NO: 166598 - protein, 55 aa, Glycine max
  Coding DNA Sequence Number=SeqID_49820
MGNERKCSLRLDLTWVIILYGMIFCLNATLEHLIGYLDSTWEIERMFFIFETSFV

SEQ ID NO: 166599 - protein, 88 aa, Glycine max
  Coding DNA Sequence Number=SeqID_49821
  Gene Ontology: Mol. function=ribonuclease H activity; Biological process=DNA integration
MSHGCLYQQRIKNAFDKKVRPRKFNEGDLVLKKISHAVKDNRGKWAPNYEGPFIVKRAFSGGALILTNMDGEELPSLVNFDVVKRYYA

SEQ ID NO: 166600 - protein, 189 aa, Glycine max
  Coding DNA Sequence Number=SeqID_49822
  Homolog annotation: Hit_ID=Q84VH5; Match level="QueryCoverage=85%, HitCoverage=27%, E-value=8e-69, Identity=73%"; Hit description =Envelope-like protein
HQIAKEITAKQVQHWPKKGKLSAGKLSVKYAILHRIGTANWVPTNHTSTVATESFAVKLPIAFPTVLCGIMLSQHPNILNNIDSVKKRDSPLSLHYKLFEGTHVPDIVSTSGKAAASGAVSKDALIAELKDTCKVLEATIKATTEKKMELERLIKRLSDNGVDDGEAAEEEEDAAEDTESDDDDSDATP

SEQ ID NO: 166601 - protein, 226 aa, Glycine max
  Coding DNA Sequence Number=SeqID_49823
  Gene Ontology: Mol. function=protein binding; Biological process =defense response
  Homolog annotation: Hit_ID=Q1S091; Match level="QueryCoverage=95%, HitCoverage=27%, E-value=7e-17, Identity=29%"; Hit description=IMP dehydrogenase/GMP reductase
  Pfam annotation: Domain name=LRR_1; Domain location=19-38; Score=5.5; E_value=27; Accession=PF00560.23; Description=Leucine Rich Repeat
  Pfam annotation: Domain name=LRR_1; Domain location=42-63; Score=8.5; E_value=7.5; Accession=PF00560.23; Description=Leucine Rich Repeat
  Pfam annotation: Domain name=LRR_1; Domain location=73-94; Score=2.9; E_value=83; Accession=PF00560.23; Description=Leucine Rich Repeat
  Pfam module annotation: Pfam domain module=LRR_1::LRR_1::LRR_1; Domain location=19-38::42-63::73-94
MGECESLSFVDPSIFSLPKLSYLDLRGCKPLMSLSSNTWPQSLRELFLEDSGLNEVPPSILHIRNVKAFSFPRLEFITVGECKMLQHISALPPFIQSFDVWNCHSLQTVLSKVGDWFHCHFTQPLVNTKDLPPNLLGFIFYLVVSQIQSCNIGHRGSIGCECYLETNRDEWINISSFFEKENVCFIPDPPLEFMEDHIMEVIKERKAVNDNTTTHHPKLIFKFCIG

SEQ ID NO: 166602 - protein, 1055 aa, Glycine max
  Coding DNA Sequence Number=SeqID_49824
  Gene Ontology: Mol. function=RNA-directed DNA polymerase activity; Cellular component=chromatin; Biological process=one-carbon compound metabolic process
  Homolog annotation: Hit_ID=Q1T2D5; Match level="QueryCoverage=97%, HitCoverage=92%, E-value=1e-113, Identity=40%"; Hit description =Chromo
  Pfam annotation: Domain name=Chromo; Domain location=946-1000; Score =15.4; E_value=0.015; Accession=PF00385.14; Description='chromo' (CHRromatin Organisation MOdifier
  Pfam annotation: Domain name=rve; Domain location=683-845; Score =53.6; E_value=6.4e-13; Accession=PF00665.16; Description=Integrase core domain
  Pfam annotation: Domain name=zf-H2C2; Domain location=624-665; Score =36.3; E_value=1.1e-07; Accession=PF09337.1; Description=His(2) -Cys(2) zinc finger
  Pfam module annotation: Pfam domain module=Chromo::RVT_1::Retrotrans _gag::rve::zf-H2C2; Domain location=946-1000::356-530::71-161::683 -845::624-665
MNLLLHNASQPHGSSPNNGSLMVQPINASLPAKEISHGFPHFDGTTPVMEWIFKMEKFFTYYNTPDASRVDIAAMHFDKDVVAWFQMSQKLSLVSTWSELTRALKSQFVPSPFDCPMAELFKLQQTSSVSDYYLKFVSLANRSLGLSNEALLNGFISGLNPDIRRDVVAMCPPTLLHAVALAKLFEEKYGLGTQEDEIVESEDHHLSFNALKGGRGVGTIKFIDYIENLPVTVLIDGGSFDNFLQPRVHAQGNTFQLPIFLLPIFGVDLILGASWLKTIGSHIADYDALQLKLLWKGKFTTLQGDCIRRMVATNSIAEVYSLQLMESDVVLKSMLDLPVMMEPELALLLHTYSVVKPYRYPYSQKEEIERLVSRMACIDYKALNAITIKDNFLIPTVDELIDEFFGASFFSKLDLRSSYHQILLNLDDKHKTTFRAHHGHYEWLIMPFDLTNAPVTFQSLMNDIFAGILRKFVLIFFDDILIDYLGHTLSGSRVAMEGTKLEAIQNVAASEAFQQLKISMTSAPVLVIPNFKEIFVLETDALGSGVGAVLSQNKHPIAYFSKKLSLRMSFMMAASTLIHSWINQVMDLTQTDSQLSKIYQNCLQGKIMLPHDVGLLNQTMEEFHSSKIGGHSGINRTTARIGAQFYWNGMRSDISKFMRECVICQQAKVDHVLPAGLLQPLPIPQQIWEDIAMDFIVQLPSSQGFTTIFTVVDRLSKFGYFIPLKSEFNSKVVAEVFITNIVKIHGFPKTIVSDRDRIFISTFWQQFFKAQGTTLVMSSSYHRQSEGQPKNLNKTIEMYLRPPLAVMHYEVDPKDPDPLKDLLQLRDQLLSKLKSNLLKAQQYINMQADKKIRDLQFKVGDMILVKLQPYRKQSVALRKHQKLGMRYFGPFLVIEKIGTIAYKVQLPESAKIHHVFHIALLKPFHGKSSPPYLPFPLTSSELGPTLCPWKALDVRVIKRLEAIVSQLLIQWEATKAKDATWEDLRDICESYPQFNLEDKVVFYEKSNHKVEEGEYKAGGLHVVGLFGGDSVADNGRGVCRDHRSSSTSLPLVFVP

SEQ ID NO: 166603 - protein, 546 aa, Glycine max
  Coding DNA Sequence Number=SeqID_49825
  Gene Ontology: Mol. function=DNA binding; Cellular component =membrane; Biological process=DNA integration
  Homolog annotation: Hit_ID=Q1SAZ0; Match level="QueryCoverage=40%, HitCoverage=18%, E-value=6e-45, Identity=39%"; Hit description =Integrase, catalytic region
  Pfam annotation: Domain name=zf-CCHC; Domain location=66-83; Score =7.1; E_value=0.068; Accession=PF00098.13; Description=Zinc knuckle
  Pfam module annotation: Pfam domain module=RVT_2::zf-CCHC; Domain location=267-435::66-83
  Subcellular localization annotation: CTP_CleavageSite=39; ConfidenceScore=5.15e-01
MDPLPSIAKVFSYVVQQERQFNSNNVMGNTSLINAVNTSSSNAGNSCTYCGKDNHIVGNSGGRGSKLCTHCGLTNHTVAECYRKHGYPHGHKLYKSQSSNINNISNVKEKGDNSVQERNQEAENEDVKLTTQQYKDLMALLQQQNTVHNNSHVNQIGTVNKKGSISITCSISKTIKDEWIFDSGLYRLKMVPLKPHGEYNSNSIFVPICPSVSSISALSCTSLYPLSSIFSYNRLSPSYHNVISSITQDVEPQSYNEASKDPNWIQAMHVEIKALELNDTWILIDLPKHKTTIGCKWVYKIKHKFNGSIERYKARIVAKGYTQVEGQDYLDAFSPVAKLTTQLDVNNAFLHGDLNEEVYMTIPQGNDLSEIQRITHLLDNAFKIKDLGDLRYFLGFEVARSSTGINLCQRKYARDIINDASMLGSKPVSTPGCIDTKRSISGYVVYIGDSLILWKSKKQAIVSRSSSEAKYWALANATWLPQELRQVLKSGVGKCTCCANNRVDLVNYDKVLKLFFVPAARNRRRFGVGEGSRRLALPFMRPRGGG

SEQ ID NO: 166604 - protein, 47 aa, Glycine max
  Coding DNA Sequence Number=SeqID_49826
MEREREYGVMMLTTQPGKGKSNGGKIRVKSEGILGMRIQTGRWERAF

SEQ ID NO: 166605 - protein, 470 aa, Glycine max
  Coding DNA Sequence Number=SeqID_49827
  Gene Ontology: Mol. function=dihydrolipoyllysine-residue acetyltransferase activity; Cellular component=chloroplast stroma; Biological process=acetyl-CoA biosynthetic process from pyruvate
  Homolog annotation: Hit_ID=Q9SQI8; Match level="QueryCoverage=85%, HitCoverage=83%, E-value=1e-133, Identity=65%"; Hit description =Dihydrolipoamide S-acetyltransferase
  Pfam annotation: Domain name=2-oxoacid_dh; Domain location=247-459; Score=188.2; E_value=2e-53; Accession=PF00198.13; Description=2 -oxoacid dehydrogenases acyltransferase (catalytic domain)
  Pfam annotation: Domain name=Biotin_lipoyl; Domain location=46-119; Score=62.9; E_value=1.1e-15; Accession=PF00364.12; Description =Biotin-requiring enzyme
  Pfam annotation: Domain name=E3_binding; Domain location=174-210; Score=63.0; E_value=9.9e-16; Accession=PF02817.7; Description=e3 binding domain
  Pfam module annotation: Pfam domain module=2-oxoacid_dh::Biotin _lipoyl::E3_binding; Domain location=247-459::46-119::174-210
  Subcellular localization annotation: CTP_CleavageSite=35; ConfidenceScore=5.80e-01
MASLPNSPALSFSSSLSTTANLLPCRRFTAFPRRRASSFSVQAKIREIFMPALSSTMTEGKIVSWIKSEGDMLSKGDSVVVVESDKADMDVETFYDGILAAIVVADGETAPVGAPIGLLADSPEEVAEAKAKAAKSVPSGSPAPASPSDPSPATPPPPPPPAKSVSEGPAKIVATPQAKKLAKQHKVDIATVAGTGPFGRITPADVEAAAGIAPSKRNVAPAAIPAPATPAPPSKAASGSAAPAPIPGSSVVPFTTMQSAVAKNMMESLSVPTFRVGYPVTTDALDALYEKVKPKGVTMTAILAKAAAMALVQHPVVNATCKDGKNFVYNGNINVAVAVAINGGLITPVLQDADKLDLYLLSQKWKELVEKARAKQLQPHEYNSGTFTLSNLGMFGVDRFDAILPPGQGAIMAVGASKPTVLADKDGFFSVKNKMLNNGQNSGEYRLFFVEIDPFSKAPESSYVAIRHKP

SEQ ID NO: 166606 - protein, 223 aa, Glycine max
  Coding DNA Sequence Number=SeqID_49828
  Homolog annotation: Hit_ID=Q10CF2; Match level="QueryCoverage=95%, HitCoverage=96%, E-value=7e-46, Identity=45%"; Hit description =Expressed protein
  Pfam annotation: Domain name=GLTP; Domain location=23-221; Score =152.4; E_value=1.2e-42; Accession=PF08718.1; Description=Glycolipid transfer protein (GLTP)
MDERVVIQQPLSAIAETFEELSKRNNANEIRLDTFCQAASLVSVLFRSLGLAFKFAELEYVAKRLNSEPQIKFATKRVNVHELHGLLEASKTCSTLPDILNLDVASDTVKTSGSFSRNLRRVRQGLDLVRAIFEQLLSTDDSSLKEVASTAYGQVCAPYHTWAVRTAVYAGMYTLPTRDQLLMKLNETEQSADKKMRRYIAASLPIIEYIDKLYLARNITLDW

SEQ ID NO: 166607 - protein, 996 aa, Glycine max
  Coding DNA Sequence Number=SeqID_49829
  Gene Ontology: Mol. function=signal transducer activity; Cellular component=membrane; Biological process=signal transduction
  Homolog annotation: Hit_ID=Q53JH6; Match level="QueryCoverage=82%, HitCoverage=84%, E-value=1e-114, Identity=35%"; Hit description =Coiled-coil protein
  Pfam annotation: Domain name=DUF869; Domain location=114-902; Score =368.6; E_value=9.9e-108; Accession=PF05911.2; Description=Plant protein of unknown function (DUF869)
  Pfam annotation: Domain name=KID; Domain location=202-212; Score=1.6; E_value=2.2e+02; Accession=PF02524.5; Description=KID repeat
  Pfam annotation: Domain name=KID; Domain location=254-264; Score=0.1; E_value=4.5e+02; Accession=PF02524.5; Description=KID repeat
  Pfam annotation: Domain name=KID; Domain location=507-517; Score=2.3; E_value=1.6e+02; Accession=PF02524.5; Description=KID repeat
  Pfam annotation: Domain name=KID; Domain location=542-552; Score=4.8; E_value=47; Accession=PF02524.5; Description=KID repeat
  Pfam annotation: Domain name=KID; Domain location=577-587; Score=6.1; E_value=24; Accession=PF02524.5; Description=KID repeat
  Pfam annotation: Domain name=KID; Domain location=612-622; Score=4.8; E_value=47; Accession=PF02524.5; Description=KID repeat
  Pfam annotation: Domain name=KID; Domain location=647-657; Score=1.8; E_value=2e+02; Accession=PF02524.5; Description=KID repeat
  Pfam annotation: Domain name=KID; Domain location=667-677; Score=0.6; E_value=3.5e+02; Accession=PF02524.5; Description=KID repeat
  Pfam annotation: Domain name=KID; Domain location=821-831; Score=4.1; E_value=64; Accession=PF02524.5; Description=KID repeat
  Pfam annotation: Domain name=M; Domain location=198-218; Score=8.5; E_ value=9.5; Accession=PF02370.7; Description=M protein repeat
  Pfam annotation: Domain name=M; Domain location=436-456; Score=5.6; E_ value=23; Accession=PF02370.7; Description=M protein repeat
  Pfam annotation: Domain name=M; Domain location=551-575; Score=1.4; E_ value=81; Accession=PF02370.7; Description=M protein repeat
  Pfam annotation: Domain name=M; Domain location=586-610; Score=1.4; E_ value=81; Accession=PF02370.7; Description=M protein repeat
  Pfam annotation: Domain name=M; Domain location=621-645; Score=0.7; E_ value=1e+02; Accession=PF02370.7; Description=M protein repeat
  Pfam module annotation: Pfam domain module=DUF869::KID::KID::KID::KID: :KID::KID::KID::KID::KID::M::M::M::M::M; Domain location=114-902::202- 212::254-264::507-517::542-552::577-587::612-622::647-657::667 -677::821-831::...
  Pfam module annotation: Domain location=198-218::436-456::551 -575::586-610::621-645
MNIISFMPSPGNKFVILEALKESPSRSNHSPDVTSKARGYAEDVNHSSFINEQLPEEVTSKSLPAAGIASDGSSENDENGENENIIDVKEGDLNDGLRNMSEKLSAALVNANAKEDLVKQHAKVAEEAIAGWEKAENEVAVLKKQLDTVILRNSVLEDRVTHLDGALKECVRQLRQTREEQEENIYDAVGKKTQELESAKIKLENKLTELQNKLDASEAKSSSIDFDMCQKVEYLEKENLALRHEILVQSEELEIRTIERDLSTKAAETASKQHLESIKKVAKLEAECRRLRSMASRTSLSNDHKSIVQSSFSVESLTDSLSDSADRLTAVETEANKINGSEPNKCEPSCSDSWASALIAELDQFKNEKCRQTPSNSVKIDLMDDFLEMERLVALPESEKETMVQESVVTNQCMNKESSLRVEFEIMNQQMDELKEKLEKVEADKAELEIALMKSEGCIEESQLQLREAQEKLEELQREVENAYKSKQRVENHLLDMVAEAETLSVKVEFLEAEVDKERAVSCEIAMKYRNLEEELERKSAKVDILEAELDKKKDLSSEIAMKCRDLEEELERKSAKVDILESELDKKKDLSSEIAIKCRDLEEELERKSAKVDILEAELDKKKDLSSEIAMKYKDLEEELERKSAKVSILEAELDKKDMPNAIAMKCKDLEEELESKSTKVDLLEAKVAKERVVSEKIAKKYMDLEEELESKFAKVELLEAQVAKERDVSDKIAKMCKDLEEELQRKSAKVELLEAEVAKERDVLDKIAKKCKDLEEVLESKSAKVELLDAEVDNERAVSDEISMKCKDLEEKLERKSAKVDLLEEELHKERANSEEIAMKCRELEEELLRSTTSSYGEKKIKQEDLALAAGKLAECQKTIASLGNQLKSLATLEDFLIDTASIPASPSLIGQAGGELWKFHSNGTFSPKRDSISSRLADGSSCPSLNKNEETSSLSSSSSTSSPALPNHVSSERSRNGFAKFFSRTKSGIRLEI

SEQ ID NO: 166608 - protein, 84 aa, Glycine max
  Coding DNA Sequence Number=SeqID_49830
  Subcellular localization annotation: CTP_CleavageSite=64; ConfidenceScore=5.86e-01
MIQVSSTAPPMVQISSIAPHVSRASSARQASYVSSPAPLGSQASSPAPPISQTSFGRSTNHNVVEFAPQTMHQSPMKRICLDVE

SEQ ID NO: 166609 - protein, 283 aa, Glycine max
  Coding DNA Sequence Number=SeqID_49831
  Gene Ontology: Mol. function=zinc ion binding
MVVGVRLQSFLGLVRGETLSSLSKGRSTVGDGGYRGRETNAWYTSRKKHKTTYFLREKHGRVELFLGFLTGGSDFVVINDNYNGKEGDVQRKGEGDVFDTNAQGKGDHVATADIEGEGDVVVVHVQGEGDHVDATDVECEGDVDGVHVQGEGDVQCECDVQGKGDANSSEDENYVAKDNSDNEYTFMENSDYGDSDVLDTPPSNGDEGRKTQKFPRFRMPEDDVEIRIEKGMILNSKIDIKVVIKTLAMVNKKNLIIQQNDLKRVVVKCIHGCPFHLRFSKSN

SEQ ID NO: 166610 - protein, 46 aa, Glycine max
  Coding DNA Sequence Number=SeqID_49832
MALQLHRQGKHDIHTLKRCEDIRATFFLQPKLVPQRRKVNLIHRQV

SEQ ID NO: 166611 - protein, 974 aa, Glycine max
  Coding DNA Sequence Number=SeqID_49833
  Gene Ontology: Mol. function=protein serine/threonine kinase activity; Cellular component=spliceosome; Biological process=protein amino acid phosphorylation
  Homolog annotation: Hit_ID=Q2QLI7; Match level="QueryCoverage=55%, HitCoverage=62%, E-value=0.0, Identity=63%"; Hit description=Protein kinase domain containing protein, expressed
  Pfam annotation: Domain name=Pkinase; Domain location=671-971; Score =132.3; E_value=1.3e-36; Accession=PF00069.15; Description=Protein kinase domain
  Pfam annotation: Domain name=Pkinase_Tyr; Domain location=671-951; Score=-102.5; E_value=3.5e-06; Accession=PF07714.7; Description =Protein tyrosine kinase
  Pfam module annotation: Pfam domain module=Pkinase::Pkinase_Tyr; Domain location=671-971::671-951
MATDARDSRRKYRRSSSPEDVDRSSKRHKHRHHSHRHRHGSKKRDEEIKFDDRTIGAVPSPTPHGHLPDDDDVEEGEILEDEALDGEVGKKETESDAEPGEIKVTGDRDVRSDNQNSGHLTKISVTRNEDIRDDKFISPAINAEDDVSPNCSSSETRDGKHAQARTDGVGNGFLDPKSSKGDKWHNGELGHFKGNEKLKGDFDDETLEANVRKAHYNRNSSSESGGGKYRMSGSSPSHGRYRSRSRSIGHTRDRSRSRSIIDEYAHSKRRRSDYDHDEERVRVRGREHGHGSVVDDRREYSTRYHNREARDRDRSRDRDVDRDLHREKKQEETSRGKEIEWEHKRGKERERSRERYRRDAEKDRSREREEDGDRRQEKERDRSWDTVFERDRRREKERDRSRDRTIGGKRDRDPENERDDKNRERRDDRYGHKDRDTANGKDRHLRHEDGNDNGDRYRKHSRHEENEYHWERKRNSDNPVKVYNSMGSTAEVDESKLTSSEVEPDDLEEDTLQLPEQEEEDLNRIKEESRRRREAIMEKYKKQHQQVEAVVGNEGNDKDADIPNDISEACDGKTDDADYVEPSFAVGKSPENVNVASKKISPAGGLGEGTPKSERSEDKFCDDIFGETPTGVRKSGKGDGLLIERVGLHDNWDDAEGYYSYRIGEILDSRYEVTAAHGRGVFSTVVRAKNLKMGNGEPEEVAIKIIRSNDTMYKAGMDELVILKKLVGADPDDKRHCVRFLSSFRYRNHLCLVFESLNMNLREVLKKFGRNIGLRLTAVRAYAKQLFIALKHLRNCGVLHCDIKPDNMLVNEAKNVLKLCDFGNAMFAGKNEVTPYLVSRFYRAPEISCCLYELYIGKVLFPGFTNNDMLRLHMELKGPFPKKMLRKGAFTEQHFDQDLNFLATEEDPVTKRTIKRLILNIKPKDIGTLITGSPGEDPKMLANFKDLLEKVFVLDPDKRLTVSQALNHPFITGK

SEQ ID NO: 166612 - protein, 553 aa, Glycine max
  Coding DNA Sequence Number=SeqID_49834
  Gene Ontology: Mol. function=malate transporter activity; Biological process=response to aluminum ion
  Homolog annotation: Hit_ID=Q5FAM2; Match level="QueryCoverage=89%, HitCoverage=88%, E-value=1e-142, Identity=51%"; Hit description =Putative expressed protein
  Pfam annotation: Domain name=UPF0005; Domain location=67-538; Score =649.2; E_value=3.3e-192; Accession=PF01027.11; Description =Uncharacterised protein family UPF0005
MAARVGSFRHSFLEKSKERLLSKKEYQDFVGFNGDHDASPKRSFLDALSDRVVSFHNWSRDFASKLYEMGRSDRRKVLFAVKAGLSLAIVSLVIYIEEEQFSKYSVWAILTVVVVFEFSIGATLNKGFNRALGTFSAGVLALGIAQLSVLVGRAFEELIIVVSIFIAGFCASYVKLYPAMKQYEYGFRVFLLTFCIVLVSGRTGLQFFSTAFYRLVLIGIGAGVSLSVNICIYPIWSGEDLHKLVVKNFIGVAASLEGCVNGYLQCVEYERIPSKILVYQASDDPLYRGYRTAVQSSTQEETLVDFALWEPPHGPYKMFNYPWRSYVKVSGALRHCAFMVMAMHGCILSEIQSPPEKRLVFYDELQKVGVEGAKVLRTLGSKVERMEKLSTGDILLDVHEAAEQLQMKIDRLSFLLVNYESWEAAREHKEKEQPENLIDVKDNENKPPEITSLNEIGDDPKLSVRIEPSMLESNLPQTANKSFLGKSHLSFFADGIVNEPESKVYESASSLSLGTFASNLIEFVARLQNLVDEFQDLSEKAKFKDPLEQPLLK

SEQ ID NO: 166613 - protein, 220 aa, Glycine max
  Coding DNA Sequence Number=SeqID_49835
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=P19023; Match level="QueryCoverage=75%, HitCoverage=44%, E-value=4e-50, Identity=49%"; Hit description=ATP synthase subunit beta, mitochondrial precursor
  Pfam annotation: Domain name=ATP-synt_ab; Domain location=116-220; Score=-53.0; E_value=0.00031; Accession=PF00006.15; Description=ATP synthase alphabeta family, nucleotide-binding domain
  Pfam annotation: Domain name=ATP-synt_ab_N; Domain location=49-107; Score=9.8; E_value=0.024; Accession=PF02874.13; Description=ATP synthase alphabeta family, beta-barrel domain
  Pfam module annotation: Pfam domain module=ATP-synt_ab::ATP-synt_ab _N; Domain location=116-220::49-107
KHERPRKDRKGWFTIFPVRRWPQLPWSCLSPLRSVWTDEFIGKGAIGQVCQVIGVVVDVKFDEGLPPIMTALEVLDHSLRLVLEVAQHLDTEHYLPIHREAPAFVEQETAQQILVIGIKVVDLLAPYQRGGKIGLFGGAGVGKIVLIMELINNVAKAHGIVVSLSLMQTESKCALVYGQMNEPPGAHARVGLTGLTVGEHFRDIKDAMTVPKCYIYKANS

SEQ ID NO: 166614 - protein, 113 aa, Glycine max
  Coding DNA Sequence Number=SeqID_49836
MFQKSCKNNYGRFSFCEEEGRIANRFDHDYNKEIEFNKRRKTDAESATGARSGASSGSELVQRSLSKFWRSSMTSSRVAVKPTMASPVASALRTSNASKVEVAKKLVSKPTLS

SEQ ID NO: 166615 - protein, 105 aa, Glycine max
  Coding DNA Sequence Number=SeqID_49837
MLIPERLNPLSSNVDCHVSTSERLLKIFSHLWHWGWGGSSGVGAKERANSRPCVYGGEKRAVGIANHALVVPDHSLFGQGTLSRTSRPNLAELHLQISASSVLGY

SEQ ID NO: 166616 - protein, 75 aa, Glycine max
  Coding DNA Sequence Number=SeqID_49838
MSHAVYALHQAPKGQQDQRPCVQLSHTLHSENVFKSCYIDSNNKSEKQDNTTGPIKEANNNYNRPTRNTTKANYL

SEQ ID NO: 166617 - protein, 44 aa, Glycine max
  Coding DNA Sequence Number=SeqID_49839
GRIILSYLLGWGPNMNNRNQPKVHGDGCKWGRGQNRLIVAPSPR

SEQ ID NO: 166618 - protein, 334 aa, Glycine max
  Coding DNA Sequence Number=SeqID_49840
  Gene Ontology: Mol. function=cation transporter activity; Cellular component=membrane; Biological process=cation transport
  Homolog annotation: Hit_ID=Q2SG04; Match level="QueryCoverage=61%, HitCoverage=97%, E-value=1e-58, Identity=57%"; Hit description =Co/Zn/Cd efflux system component
  Pfam annotation: Domain name=Cation_efflux; Domain location=153-333; Score=-92.5; E_value=0.00054; Accession=PF01545.11; Description =Cation efflux family
MRVYKKDSDGTAQFVGEDQIDHTPKNETVRLKLGNAFDVTAERVQTDFKNLSKQNQAQIYESAYTLTLHNAKKEAVTVTVQEPINGDWKILNESQPHKKTNAHQATWKINVPAEDSDIQLRLNRKPANMSAHCCPPPTPQPEHSPQKSYRRVLWIALIVNFSMFMIEVASGLHANSVSLLADSLDFFGDAANYGLSLWVLGMHVSVRARASLVKAISMGLFGLWVLGSAVSHFISGIVPSPETMSAIGLLALLANLGVAWLLYAYRHGDSNMRSVWLCTRNDAIGNVAVILAAAGVFGTGSAWPDLMVAVVMSCLALHAAWQVIAQAKSELHRH

SEQ ID NO: 166619 - protein, 191 aa, Glycine max
  Coding DNA Sequence Number=SeqID_49841
  Gene Ontology: Mol. function=calpain activity; Cellular component =intracellular; Biological process=proteolysis
  Homolog annotation: Hit_ID=Q1RTJ9; Match level="QueryCoverage=96%, HitCoverage=55%, E-value=2e-21, Identity=38%"; Hit description =Cyclin-like F-box; F-box protein interaction domain
MPGYHLVGSCNGLHCGVSEVPEGYCVCLWNKATRVISRESPTLSFSPGIGRRIMFGFGYDPSSDKYKVVAIALTMLSLDVSEKTKMKVYGAGDSSWRNLKGFPVLWTLPKVGGVYLSGTLNWVVIIGKETIHSEIVIISVDLEKETCISLFLPDDFCIFDTNIGVFRDSLCVWQDRNTNLGLWQMRKFGDD

SEQ ID NO: 166620 - protein, 101 aa, Glycine max
  Coding DNA Sequence Number=SeqID_49842
MPAGRLSRVPLILRDSIRHPSKKLLSFELAESFNIHFRASRYITGLNQTSEASTFTFERLDILRDSIRHPSKKLLSFELAESSNIQFRASRYITGLNQTSE

SEQ ID NO: 166621 - protein, 207 aa, Glycine max
  Coding DNA Sequence Number=SeqID_49843
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=1e-24, Identity=33%"; Hit description= UPI00006A17C9 related cluster
MSSPSEDFMSSPSEGLHALTSRGLPVLALRGLHALTLGLHVLTIRGLHALTSRGLHVLALRGLHALTLEGYTPSPWVLVTLTFRGLHVLTFVGLHALTFRGPHVLTFRGLHALAIRGLHVLTFVGLHALTFRGLHVLANRGLHAFTFKGLHVLANRGLHALTLRGLHAFTSRGLYILALRGLHALTFRGLRVLIFSVLHIRTLREFK

SEQ ID NO: 166622 - protein, 182 aa, Glycine max
  Coding DNA Sequence Number=SeqID_49844
  Gene Ontology: Mol. function=DNA photolyase activity; Biological process=DNA repair
  Homolog annotation: Hit_ID=UPI00006906EA; Match level="QueryCoverage =52%, HitCoverage=30%, E-value=3e-32, Identity=59%"; Hit description =probable deoxyribodipyrimidine photolyase
MWFAAYVLHWLKVDWRQAADWFEQHLLDGDLASNHLSWQWIASSFSHKPYYFNKENIIKFGGQRWCQQCRVRCPFDASYEALEQQLFTTTSGAKATPPNAVTRAAPPQQADDLLQVTKADTLVWLHDEMLSPEHPLLTNNKSVAFVFDPALYGQWPLKRLQFMADCLSEIPQAEIWMGSTNE

SEQ ID NO: 166623 - protein, 147 aa, Glycine max
  Coding DNA Sequence Number=SeqID_49845
  Homolog annotation: Hit_ID=Q8TGM5; Match level="QueryCoverage=26%, HitCoverage=58%, E-value=6e-08, Identity=74%"; Hit description =Uncharacterized protein ART3
  Subcellular localization annotation: CTP_CleavageSite=33; ConfidenceScore=5.52e-01
SVSRQYLALDGIYRPIGAAFPNNPTRRQRLVVRQGPGTTGLSPSLAPPSRGLGPGPPLRTLLQTTIRTPRATDFHGRRALGLMASGATCVQRLDGSRDSAIHTKYRISLRSSSMQEPRYPLPRVIVCKCCVVTTPAGHRLRAPGSRT

SEQ ID NO: 166624 - protein, 74 aa, Glycine max
  Coding DNA Sequence Number=SeqID_49846
MAQPPILRTYQMNTRLVGSKSMIVILTPFPGLKEVTCLHPTKQYSDGIVITLRIEFKLAIFNLPTFTTIGDMVT

SEQ ID NO: 166625 - protein, 114 aa, Glycine max
  Coding DNA Sequence Number=SeqID_49847
MYIYVLGTSSKIFESIQRLTNWNGENVTGLGGIDGDSVLRGTRIKATWEYVSSIEGGQLGMVELCVICGRGKSTCTIARPPPRTTCDGVVPGDMSRGSGDLGDVRWDAIAQNQA

SEQ ID NO: 166626 - protein, 79 aa, Glycine max
  Coding DNA Sequence Number=SeqID_49848
MKLISKRFQELDVCGKVTLNSKLRKIVYPDLNSMCAPPEKVKTKGMCEDSWSLVRNHLLKELAKWSNEYINMLGGIDRF

SEQ ID NO: 166627 - protein, 89 aa, Glycine max; identical to SEQ ID NO: 138707
  Coding DNA Sequence Number=SeqID_49849
  Gene Ontology: Mol. function=nucleic acid binding

SEQ ID NO: 166628 - protein, 143 aa, Glycine max
  Coding DNA Sequence Number=SeqID_49850
  Gene Ontology: Mol. function=catalytic activity; Biological process =alkaloid metabolic process
  Homolog annotation: Hit_ID=Q8LCI0; Match level="QueryCoverage=93%, HitCoverage=51%, E-value=1e-44, Identity=60%"; Hit description =Putative acetone-cyanohydrin lyase
MNRRKHYVLVHGACHGAWCWHKLKPRLESAGHKVTVLDLAASGINMKKLEDVDTFSQYSEPLLHLMATIPQNEKVVLVGHSFGGMSIALAMDKFPEKVVVGVFLAAFAPDTEHSPSYVLEQFTIAAKIFRMRGAEIQLSQYST

SEQ ID NO: 166629 - protein, 215 aa, Glycine max
  Coding DNA Sequence Number=SeqID_49851
  Gene Ontology: Mol. function=catalytic activity; Biological process =alkaloid metabolic process
  Homolog annotation: Hit_ID=Q94G63; Match level="QueryCoverage=55%, HitCoverage=44%, E-value=1e-42, Identity=64%"; Hit description =Ethylene-induced esterase
MGSQNCMDRKHYVLVHGACHGAWCWYKLKPRLESAGHKVTVLDLAASGTNMKKIEDVDTFSEYSAPLLQLMATIPSNEKLVLVGHSLGGLNIALAMEKFPEKVAVGVFLTAFAPDTEHHPSYVLEKLEMTSFQFQAMLILQTLSFLTQFRSISSLRLLTSSSFLTVSFLPLAHSLFLGLSQPHLLHHYWPTANLSFLPLALPLVVPNIGFLSPVN

SEQ ID NO: 166630 - protein, 150 aa, Glycine max
  Coding DNA Sequence Number=SeqID_49852
  Gene Ontology: Mol. function=catalytic activity; Biological process =alkaloid metabolic process
  Homolog annotation: Hit_ID=Q6RYA0; Match level="QueryCoverage=98%, HitCoverage=48%, E-value=2e-26, Identity=57%"; Hit description =Salicylic acid-binding protein 2
MNLPQVETKHHFSLVPSTCPRSNTSALPLSYITIWRICWKLIEVFNKNKNNKEWILQDLELAKTLVRPSSLFIEDLSKQKNFSKHGYGSVPRAYIVCTEDLAIPLEFQLWMIHNAGINEVLKIKGADHAAMISKPRELYNSLQKIATKYA

SEQ ID NO: 166631 - protein, 107 aa, Glycine max
  Coding DNA Sequence Number=SeqID_49853
MVKGILALSPTLLGAPTKLLGAQNFPMGDCFVHGKGHHACMARCMAIWHVVVAKGHRLWCRGQGFVQRAEGADFNGGHGLCWCRHHGWRFVEHKSPLTLAICVVVCL

SEQ ID NO: 166632 - protein, 57 aa, Glycine max
  Coding DNA Sequence Number=SeqID_49854
MGLFFMRVDAWKKKIASPIGSRAPQLFQGCSSSFSGLQQGCRHAWRQQEQQLNRRLH

SEQ ID NO: 166633 - protein, 92 aa, Glycine max
  Coding DNA Sequence Number=SeqID_49855
  Subcellular localization annotation: CTP_CleavageSite=52; ConfidenceScore=5.62e-01
MLSTKVVGTILRAQAPTLNFGKSGKTSLSKYQRSRSKRVPKTKGTAKPLGASSSKRRSEEEECENIKKRLGWGVKSDCKISSCKNGASVKSD

SEQ ID NO: 166634 - protein, 38 aa, Glycine max
  Coding DNA Sequence Number=SeqID_49856
MSPSMALTTSFIHVALDMDRSPEANRTVVVEVENTLEL

SEQ ID NO: 166635 - protein, 82 aa, Glycine max
  Coding DNA Sequence Number=SeqID_49857
MGGTEEESDADMTRPKSEVRPNYCYPRCPTLIILSLLFAPTPPSLSLSQSHAILCYCCYAIIKNRTSMLVDGIDGVANHPTA

SEQ ID NO: 166636 - protein, 109 aa, Glycine max
  Coding DNA Sequence Number=SeqID_49858
MLESFKQQEQMSVLELYIEKDVVGGSMFHSANSLTSCENYLSNDETQPTTNMSNLHIDEDDDDDDDDYLVSNSYVEESLDEDDSVDGISDTDDEVTNIPQPVRIVHPAE

SEQ ID NO: 166637 - protein, 373 aa, Glycine max
  Coding DNA Sequence Number=SeqID_49859
  Gene Ontology: Mol. function=hydrolase activity, acting on ester bonds; Cellular component=cellular_component; Biological process =lipid metabolic process
  Homolog annotation: Hit_ID=O80470; Match level="QueryCoverage=93%, HitCoverage=90%, E-value=1e-163, Identity=78%"; Hit description =Putative GDSL-motif lipase/hydrolase
  Pfam annotation: Domain name=Lipase_GDSL; Domain location=36-354; Score=180.9; E_value=3.2e-51; Accession=PF00657.12; Description=GDSL- like LipaseAcylhydrolase
MAFLNCFDMLVLLLLLVNMSFYGNVDAQKNGLGASFIFGDSLVDAGNNNYLSTLSKANIPPNGIDFKASGGNPTGRYTNGRTIGDLVGEELGQPNYAVPFLAPNATGKTILSGVNYASGGGGILNATGRIFVNRIGMDVQIDYFSITRKQIDKLLGKSKAKEYIMKKSIFSITVGANDFLNNYLLPVLSIGARISQSPDSFIDDMITHFRAQLTRLYQMDARKFVIGNVGPIGCIPYQKTINQLNEDECVDLANKLALQYNARLKDLVAELNDNLPGATFVLANVYDLVLELIKNYDKYGFKTASRACCGNGGQFAGIIPCGPTSSMCTDRYKHVFWDPYHPSEAANLILAKQLLDGDKRYISPVNLRQLRDL

SEQ ID NO: 166638 - protein, 148 aa, Glycine max
  Coding DNA Sequence Number=SeqID_49860
MMTYSTSKFINQDSMRYVLGWIVLVVLGGLSKVEHDGIEWLGRRGSFVCLGLFEGEGSTKRGTRSNCLKSVMVNFIEPTPLWMRLNHCGYSPIPKRQLLPASYLKCKNLHSELHSKKANLEYAKSIYEGASSNWPQKKHTRELKPEGV

SEQ ID NO: 166639 - protein, 77 aa, Glycine max
  Coding DNA Sequence Number=SeqID_49861
MTRMKQTSYIIGHGPPMKEWLELKLPSASTVTHPQRGGEDPAGGSSGHFDKDRGYNSDKRKRKGEVDMAGRPLSLLC

SEQ ID NO: 166640 - protein, 106 aa, Glycine max
  Coding DNA Sequence Number=SeqID_49862
MAENDEGVTGELKNVNVNAMESVHHDVAALSNSVVESIFYTRKEAQKNFKCHIYLEALPDSIPKHVCSKIKSLEVKVTNAGMFLAVFAYDKIRDVLRAPEWKFAPS

SEQ ID NO: 166641 - protein, 254 aa, Glycine max
  Coding DNA Sequence Number=SeqID_49863
  Gene Ontology: Mol. function=guanyl-nucleotide exchange factor activity; Cellular component=integral to membrane; Biological process=signal transduction
  Homolog annotation: Hit_ID=Q7EYZ3; Match level="QueryCoverage=88%, HitCoverage=71%, E-value=4e-81, Identity=62%"; Hit description =Putative placental protein 6
  Pfam annotation: Domain name=DUF1751; Domain location=11-108; Score =157.0; E_value=4.9e-44; Accession=PF08551.1; Description=Eukaryotic integral membrane protein
  Pfam annotation: Domain name=Rhomboid; Domain location=12-165; Score=- 9.8; E_value=0.0017; Accession=PF01694.12; Description=Rhomboid family
  Pfam module annotation: Pfam domain module=DUF1751::Rhomboid; Domain location=11-108::12-165
MLQQLQQPYLSKTIPFAWNLITAGYVEQSIYGVVVSTLSLLFIGKLLEPIWGSREFFKFIFVVNLLTSVCLFITAIALYYITRLETYLYMPLSGFHGVVSGFLVGVKQIIPDQELPFIKIKTKWLPSITVLLSIAISFWTLEATAYLPTIISGTYISWIYLRYWQRKPETKHRGDLSEDFAFSTFFPEFLRPVIDPIASIFHRMLCGRYDASNDDGYSLENEPLPGSDSIEASRRRCSSTQEACYEIFHVLLQH

SEQ ID NO: 166642 - protein, 194 aa, Glycine max
  Coding DNA Sequence Number=SeqID_49864
  Homolog annotation: Hit_ID=Q1T614; Match level="QueryCoverage=43%, HitCoverage=16%, E-value=7e-19, Identity=58%"; Hit description =Cyclin-like F-box; Agenet
MASTVPQPHGLREVVNLHQLRTLPPPEKHQEFKFRDKVGAFHNDSLWEGHITQKLGNGRFCVYFPVSEENMVFSKNKLRTHYKWINHNWVLPITNHKVWVRALDVFIEYVMLHNVQQLTMHIGLSSRPNLDSLPLVFCRSLISQFNDASIPCFFRLESLKVKNQLRQLSDGDINKVMEYLLQNSPKARVDIISA

SEQ ID NO: 166643 - protein, 147 aa, Glycine max
  Coding DNA Sequence Number=SeqID_49865
  Gene Ontology: Mol. function=calmodulin binding; Cellular component =integral to membrane; Biological process=cell death
  Homolog annotation: Hit_ID=Q56BA5; Match level="QueryCoverage=94%, HitCoverage=25%, E-value=3e-35, Identity=56%"; Hit description=MLO1
  Pfam annotation: Domain name=Mlo; Domain location=7-147; Score= -249.2; E_value=2.9e-07; Accession=PF03094.6; Description=Mlo family
MAENTQVYERTLEETPTWAVAVVCFVLLSVSIVIEHIIHGIGKWFKKKHKNALFEALEKVKGELMLLGFLSLLLTVLQDPISKICVSKNVASTWHPCANPKAPKTSQSEDESEDFQINSRKLLQYYDIIPRRVLATKGYDKCDEKAS

SEQ ID NO: 166644 - protein, 373 aa, Glycine max
  Coding DNA Sequence Number=SeqID_49866
  Gene Ontology: Mol. function=calmodulin binding; Cellular component =integral to membrane; Biological process=cell death
  Homolog annotation: Hit_ID=Q56BA4; Match level="QueryCoverage=97%, HitCoverage=67%, E-value=1e-130, Identity=65%"; Hit description=MLO1
  Pfam annotation: Domain name=Mlo; Domain location=1-295; Score=380.7; E_value=2.3e-111; Accession=PF03094.6; Description=Mlo family
MDPERFRFARDTTFGRRHLNSWSQSTISLSIVSFFRQFFGSVNKVDYLTLRHGFITAHLAPGSHARFDFQKYIERSLEEDFKVVVGISPIIWFFAVLFLLTNTHGWYSYYWLPFIPLVIILLVGAKLQMIITKMGLRITDRGEVVKGAPVVEPGDDLFWFNRPRLLLFLIHLVLFQNAFQLAFFSWSTYEFSVKSCFHETTEDNVIRLVTGVVIQVLCSYVTLPLYALVTQMGSTMRPTIFNQRVASALKNWHNTAKKHVKNSKHTTPFSSRPSTPQYGMSPTHLLHKHLAGRSESAQTSPRTSNYENEQWGVEGSPSPSHHAVAADETQMQVLEPGSGCSGSAPELPISSQLDIRVSSSEFSFEKRHIPGSD

SEQ ID NO: 166645 - protein, 80 aa, Glycine max
  Coding DNA Sequence Number=SeqID_49867
MSGIVANGNSYPTYRILQTFKKTLGLNVSIVCESDRSGNVYIAEVHQCVDISGTMQKDVTMTPSFPIWDFNQIKIPSMMC

SEQ ID NO: 166646 - protein, 262 aa, Glycine max
  Coding DNA Sequence Number=SeqID_49868
  Gene Ontology: Mol. function=calmodulin binding; Cellular component =integral to membrane; Biological process=cell death
  Homolog annotation: Hit_ID=Q56BA5; Match level="QueryCoverage=97%, HitCoverage=54%, E-value=1e-70, Identity=50%"; Hit description=MLO1
  Pfam annotation: Domain name=Mlo; Domain location=6-262; Score=48.1; E_value=2e-20; Accession=PF03094.6; Description=Mlo family
MAEDKIYERSLEDTPTWAFAVVCFVLLAISIIIEHVIDAIGKWFKKKHKSALYESLEKVKGELMMLGFISMLLVVFQGPLSKICISQNVASTWHPCSNPKKALSKSDGKSDSDTNGRKLLEYLDPIPRRVLAAKGYDKCADKAKVQACKGHNIWTKALEYVESVINFLMDINFKVPNAFVLCSNQVSFFRQFSGSVKKVDYFALRHGFITAHLAPGSDARFDFQKYIKRSLDEDFKVVVGISPIIWFFAVLFLLANTHGKPD

SEQ ID NO: 166647 - protein, 1433 aa, Glycine max
  Coding DNA Sequence Number=SeqID_49869
  Gene Ontology: Mol. function=RNA-directed DNA polymerase activity; Cellular component=chromatin; Biological process=chromatin assembly or disassembly
  Pfam annotation: Domain name=rve; Domain location=1021-1177; Score =84.6; E_value=3.1e-22; Accession=PF00665.16; Description=Integrase core domain
  Pfam module annotation: Pfam domain module=RVT_1::Retrotrans _gag::rve; Domain location=618-791::175-265::1021-1177
RRHEVNALNLVELSHGQCDNQYPNACCVLERWGCDSITGTQVQLADSGAEQAKIIFVSTYHLGALVAFAAMVDPPKTSNPLEDALLKLTAQNLTLGETLQTVTLQLNEILHRLPLTTTSTPVPTPILSTASSPPALTHRIKLDVPKFDGTDPLGWIFKITQFFEYHGTPEIERLTVASFYMEGRALSWFQWMSGNDQFTSWPAFLQALQTRFAPSQYEDPTGALFKLTQRGTVAQYLADFEDRANRIIGLPAPFLPSCFISGLNANIRYEVQAHQPLTLVQAAGLARLQEEKFLDSRQNPHPPPPRPRHNPPPPSTPITPTPHVSSLSIHPVSTPSLLPLPPRNPGPSVKRLSPEEIASRRERGLYFNCDEKYHRGHRCASRVFLIVAEDDEPYPSIIEPADPKPDPMPPDPIDPYPTQISFNSLAGQVAPETLRFMGVIVDHQIILLVDATTPLRVMVGNGQQLECNSLCEAITVTIQATSFVVDLHVLPIAGNLVELNGDTESTLSSLSSSQLLCLRQKQPDSLYFHVAIIPDPPDSTTNPDTSPLVQALIAKFPSLFKPPQTLPPPRDTDNRIHLIPQATPVNVRPYRYPHYQKQEIEAQVESMLQKGLIQLSNSPFSSPVLLVKKQDTSWRFCVDYRALNALTIKDRFPIPTVDELLVELGGASYFSKLDLLQGYHQICMHSGDIPKIAFRTHHDHYEFCVMPFGLYNAPSSFQATMNVVFHPYLRRFIIVFFDDILVYSASMADHLTHLEATFQGVQPVASKVDVVLHWPTPQSSRAMRSFLGLAVFYRCFIKGYATIAAPLGALSSAPVLALPDFDIPFTVETDASGISMGVVLTQKGHPIAFFSKPFTLRLLNASTYVRELFAITTVVKKWCQYLLGHRFIIIIDHRSLKELLTQVIQTPEQHTYLARLMGYDYQIIHHSGAQNQAVDALSRIPEPTSSSCLTLSVPCLTFLEELRRQLEASSAYVEHRDAITQSPSTHSDYTDVTDFVTNCLPCQQTKYETKKIAGLLCPLPVPQRPWEDLSLDFILGLPSFHGNSVILVVVDRFSKGIHLGMLPAAHTAHVVASLFIEIVGKIHGLQRSLVSDRDHLFLSLFWRELFQLSGTQLRMSSTYHPQSDGQIEVMYRVVEQYLRAFVHHRPHTWGKLLPWVEWCHNTSWNVAIGTTPYEITFGRKPFNFPDYIVGSSNLDAVDDMLKDREETFQVIRKKLLKAQAAMKLFADYKRREATYQVGDWVLLKLRPRRQGSAKGSSAKEGKLAKRFYGPFKVLEHIGSVAYRLQLPQTARIHPVFHCLVLKRFHGSPSEQETSVQLPTSFLQDQPVISPLAILDQRRSNPIGPWQVLDWEQIRRDYHLEGKVNLKGSPDDSITGTQVQLADSCAEQARIILVSTYQVGSNVKCTLIVTKEMQDDDMRLKDQQEDKQAIVAHK

SEQ ID NO: 166648 - protein, 271 aa, Glycine max
  Coding DNA Sequence Number=SeqID_49870
  Gene Ontology: Cellular component=integral to membrane; Biological process=autophagy
  Homolog annotation: Hit_ID=Q9C7C1; Match level="QueryCoverage=99%, HitCoverage=95%, E-value=1e-111, Identity=66%"; Hit description =Senescence-assocated protein, putative; 28418-29806
  Pfam annotation: Domain name=Tetraspannin; Domain location=4-232; Score=230.0; E_value=5.3e-66; Accession=PF00335.10; Description =Tetraspanin family
MQRFSNTVIGFLNFFTLLASIPIIGAGLWMARSTLTCENFFQTPLLVIGFVVLVISLTGLIGACFHVAWALWVYLVIMVFIIATLLGFTIFGFVVTEQGGGVEVPGRAYKEYRLERYSPWLRNRIQDPQYWSTIRSCILGSNTCAKLAFWTPLDYVQRDMSPIQSGCCKPPTACMYNEETVVVTPDSDCYRWNNAPTLLCYDCNSCKAGVLENIRRDWHNISVLNVVVLVFLIGIYSIACCAFRNARRAQTDYPHGENRMTKVKPRWDYYW

SEQ ID NO: 166649 - protein, 150 aa, Glycine max
  Coding DNA Sequence Number=SeqID_49871
  Gene Ontology: Mol. function=nucleic acid binding
MEKSDKKNFKDKKAKKAYITWEDNDIDSSGDSENEVVNLSLMAKNYDSEEEDFLKKSWYIDNGCSKLMMRDASKFTHISPKKSGHVTYGENNKYKTSNHAQCFLSKYDDFWLWHRRIANINMKHLNKLISKDLVIGFPKLKFEKDRLCDA

SEQ ID NO: 166650 - protein, 118 aa, Glycine max
  Coding DNA Sequence Number=SeqID_49872
MVALNLDILIRKLRAILMVVQFGMVVWDNGLNNDRCVMKVQVRKIMTSCNHGEEEWCKKQYHPIYLHIKSLLDGTKTMANHKNNSNLTLGPGDLDITHTFFKSIMNATPFPPTKHLNN

SEQ ID NO: 166651 - protein, 62 aa, Glycine max
  Coding DNA Sequence Number=SeqID_49873
MAASMVPPVLLARQPGTANVVGETAAYVEGAASEAGETPPRWICFFCWRYSIVKGVLQIFED

SEQ ID NO: 166652 - protein, 131 aa, Glycine max
  Coding DNA Sequence Number=SeqID_49874
MVIRHHPSPLCKVDNVIVTHDLPLLWNANIKGFKFISTDILFTKADSEMMDYDGANNSLDSTKKIVDHEKMVSMKDVENEKLLKAIESLNKNFGTVVKDLAETKNIVKALNDQMTIKEEKKKALKIEKIIC

SEQ ID NO: 166653 - protein, 61 aa, Glycine max
  Coding DNA Sequence Number=SeqID_49875
MSMKNLIGRLGVHDKTDHTLGYQSGSLCFERTLQPYESVFTPKAYTPKSPSGLLPPNSGPT

SEQ ID NO: 166654 - protein, 136 aa, Glycine max
  Coding DNA Sequence Number=SeqID_49876
MVYFMVELPSKSSSSDRGDWWMLYVVGASNPNGSGTGITLEGPGDISLKLKLAKEFRVKKNRCRIDFKLVTGCKEKPLAKITAHKVKKFTWRSLICRHGLPFAIVTNNGIQFMEKGYEQFLRLLGIKHLVSFMEHP

SEQ ID NO: 166655 - protein, 205 aa, Glycine max
  Coding DNA Sequence Number=SeqID_49877
  Subcellular localization annotation: CTP_CleavageSite=63; ConfidenceScore=5.72e-01
LLFENFFHDPKLLLPPSISSSSSTTQSFFTFEFFFFRDQSSTRPTVFSPRPGLLLRARRPPLLAFEALKHSCYALQGRRNVWSGLVFHGFGCARLKTSFLPRKVRFFRACLGVVGGRAEDCFFRRLQRKMEDMALPWDSAEEPSSACVKDVPFPSRGRWFFHKLSRKSHIFHLPMESAEERFFRGSVFPSCGRTFFRKMINEAKL

SEQ ID NO: 166656 - protein, 58 aa, Glycine max
  Coding DNA Sequence Number=SeqID_49878
MEFLKGMVKLVLATAVVCLVVALSFYQKLGLELEMVVAIVRAYDQNPLAKLFLPQNKG

SEQ ID NO: 166657 - protein, 77 aa, Glycine max
  Coding DNA Sequence Number=SeqID_49879
MEDMKVGAVKYKGMGYQKNMRKSLEQKLKELDSLLSAQPRLSAHPCYAGTLGLRQRRPMRKPKGSLSMKARAKREVA

SEQ ID NO: 166658 - protein, 56 aa, Glycine max
  Coding DNA Sequence Number=SeqID_49880
MVNETGIVVLPRQLWVSTGKKNATMRGVFLLAQTFDYLREKERVLGEEERKNEIGR

SEQ ID NO: 166659 - protein, 84 aa, Glycine max
  Coding DNA Sequence Number=SeqID_49881
MLNPTQFQAKEEKVQAADDSLSKADPLKEDNSKMCSPSTQPARPARLLSLLVLSAPSLAKLRFTYSRLAGSLSDPSEAERSKSL

SEQ ID NO: 166660 - protein, 234 aa, Glycine max
  Coding DNA Sequence Number=SeqID_49882
  Subcellular localization annotation: CTP_CleavageSite=52; ConfidenceScore=5.85e-01
MTKSSKKRKGSSSFTTTTGQRRHGASNDSPTPLNPSFSSPCSLTLFSSDDQRQRYYSSFSNRVILDSKFLNFDFFEGETFDCYQVFQNSELVDIRTLKLSYYPELVRVLYNNLEICDGVIFSEHFNIPLVNEPFVKVKRSFAIGAAVVASFGYRKDLDGQWIHKQDLPSNAPDEHTPSPPPMDPSSSLLNDVLSELRDLRTFVEGRFDSMDSCITRFEDDMIFICCCFDPPTDP

SEQ ID NO: 166661 - protein, 172 aa, Glycine max
  Coding DNA Sequence Number=SeqID_49883
MEIHVGKSYSMENCQWEQELQPYNQYEEERICNLDNFLMQHKESSESTQHTIKNLEIQFEVEAHEESLVEEHDLREKDEERSEKRTQQQWEKCSQVKNKQESILQVNTPPHQLIVKEERHGKHDMEDILSLITSTTLAMIWKAFSGYMSFMESLAKRQKCKENMFYVNFMTP

SEQ ID NO: 166662 - protein, 57 aa, Glycine max
  Coding DNA Sequence Number=SeqID_49884
MASGRNVVFVVPQFSRESYHIWVVKMRSCLNSFGLCEYVDQDKQVPTLGTNPTMAQI

SEQ ID NO: 166663 - protein, 86 aa, Glycine max
  Coding DNA Sequence Number=SeqID_49885
MSSFKAPKKFFLWAYVTNIFDAIEVANRLKGDSMYTDKKLAIPDKDYRLIVIYQSTNSSYASALIQNGLIVVSGRNTSALFQNGIL

SEQ ID NO: 166664 - protein, 45 aa, Glycine max
  Coding DNA Sequence Number=SeqID_49886
MELDSPLMLVFAGGWVLSAPDENMHLPTPNKFIPIDLPLKVVQEK

SEQ ID NO: 166665 - protein, 213 aa, Glycine max
  Coding DNA Sequence Number=SeqID_49887
  Gene Ontology: Mol. function=cysteine-type endopeptidase activity; Cellular component=endoplasmic reticulum; Biological process =proteolysis
  Homolog annotation: Hit_ID=Q1SPP4; Match level="QueryCoverage=94%, HitCoverage=59%, E-value=3e-70, Identity=64%"; Hit description =Peptidase C1A, papain
  Pfam annotation: Domain name=Inhibitor_I29; Domain location=14-71; Score=93.0; E_value=8.9e-25; Accession=PF08246.2; Description =Cathepsin propeptide inhibitor domain (
  Pfam annotation: Domain name=Peptidase_C1; Domain location=104-212; Score=36.9; E_value=2.8e-14; Accession=PF00112.13; Description =Papain family cysteine protease
  Pfam module annotation: Pfam domain module=Inhibitor_I29::Peptidase _C1; Domain location=14-71::104-212
MSRRLFEACTSERHENWMAQYGKVYKDAAEKKKRFQIFKNNVHFIESFNTAGDKPFNLSINQFADLHDEEFKALLTNGNKKVRSVVGTATETETSFKYNRVTKLLATMDWRKRGAVTPIKDQRRCGSCWAFSAVAAIEGIHQITTSKLVSLSEQELVDCVKGESEGCNGGYMEDAFEFVAKKGGIASESYYPYKGKDKSCKVKKETHGVSQIK

SEQ ID NO: 166666 - protein, 114 aa, Glycine max
  Coding DNA Sequence Number=SeqID_49888
  Gene Ontology: Mol. function=cysteine-type endopeptidase activity; Cellular component=endoplasmic reticulum; Biological process =proteolysis
  Homolog annotation: Hit_ID=Q6ZJ18; Match level="QueryCoverage=52%, HitCoverage=15%, E-value=4e-17, Identity=62%"; Hit description =Putative cysteine proteinase
KCGTNTDHAITVVGYGKSRGGTKYWLVKNSWGAGWGEKGYIRMKRDIRAKEARFQMDREGSRNNVGRFCIERVVVGSGRSRGIEVVHGGHWNGSAGKITHSKGKNKDQARKRTS

SEQ ID NO: 166667 - protein, 187 aa, Glycine max
  Coding DNA Sequence Number=SeqID_49889
MLIEDGVPPLEWEVSDEEKKVQPKLELGRAAGGKDAAAAVDCAKEKRRNKQLLCGLLLLLLLLPMLPASDYLPFPHRHCLPYQIRFSQTRVESFIFFIRLPSRSRSGSGTGTSSLFDMVSFHQSPNIDSTGSASLRNLFLLSFRGHEMNPEGAAPYYPIPVFGTTGIGDFLRWPSTSLGKVKGNNKP

SEQ ID NO: 166668 - protein, 217 aa, Glycine max
  Coding DNA Sequence Number=SeqID_49890
MPSIMEDHEVDDVHANHNDHDESLWENIPTVMATLPGSPSHSSDPSESMSRRSRQSTRLRSVTVRNLDQPRPMVNVNPTIGKGLGLHKKKFHNYLGVVAQEKISIVHFNWKVVPESLSNLIWDDILGQDNQAPSKKYGLDPETWEEFDVSRKTPNWQKLMEKKKKKRQEEAMLIEDSAMVVDPLSPIARHASHASNNFFALISPQQLVEIIKNLKEE

SEQ ID NO: 166669 - protein, 210 aa, Glycine max
  Coding DNA Sequence Number=SeqID_49891
  Gene Ontology: Mol. function=transition metal ion binding
  Pfam annotation: Domain name=Transposase_21; Domain location=71-201; Score=-65.4; E_value=5.1e-09; Accession=PF02992.5; Description =Transposase family tnp2
MPTVSYTESVDVDIGDHIEDMIPDLGQERFRQDDDYSDDAITTNGRPTKVLWYLPIIPRFKRLFANENDAKHLRWYADGRKTDGLLQHPIDSPQWNTIDRLYPDFKEEPRNLRLGLASDGMNPFDKLSTNQKYTKIVKPVGLPQTRHDWRRGDAILGDDNASKTLRLLVVGPNLNNSGVSLEADSEHFCSASNNNPIQEFMPYFGVIEEI

SEQ ID NO: 166670 - protein, 222 aa, Glycine max
  Coding DNA Sequence Number=SeqID_49892
MIHKKGGRIRTYGRPAPDLLGWVAGLAPLVAPVPETDALRYPARNLVSPTPLLGSPRKPSSFTGLGKTRRLWIPLMEWDYNHTSMAFQLAIVPEIAISPSSSLELVLGPKGNGGKRIWMIVGIPGRRASQEKEVAAHPFFLSDLSLAAHANAHGYGAITAATVILPHSKRVLPSAHLLSKTSSMRGCLKVFSQQEDARTIVPKIGESREPEKRNLVRKNVKQ

SEQ ID NO: 166671 - protein, 178 aa, Glycine max
  Coding DNA Sequence Number=SeqID_49893
MDPEGAAASSGGSNSISVGGRSEMGGSSRGSGWTSFDINVLGEPFPNEEGEEVAQPDAQNAPANPVASPGGAQEQAPLPQAPAPAQEAHPAEVSELKAEIKALISDQVREESEKGVGPLTILFPEQREINSSVALLIMDQLEITSEIDVENLREWINRIKEDKSLLKGLIREYLPPKK

SEQ ID NO: 166672 - protein, 155 aa, Glycine max
  Coding DNA Sequence Number=SeqID_49894
  Homolog annotation: Hit_ID=Q71DJ5; Match level="QueryCoverage=33%, HitCoverage=13%, E-value=8e-13, Identity=69%"; Hit description =Triacylglycerol lipase 1 precursor
MAESDLEPHPCPVSINNANEANPDDSEEVFMDNVFLEKTLNSKTLTLSPIPLTLNSPLTRPSLPLSSLTFFVVDVLTSFLGLQLDDVGVQVCNTFHHICDGTIISFAAFTQPEIVEKVEVATLLSPISYLDHVGAPLVLRMVKMHIDQMFLTLFY

SEQ ID NO: 166673 - protein, 59 aa, Glycine max
  Coding DNA Sequence Number=SeqID_49895
MGCIASTKKGCRASMEKRRERGREIQVRRELGSSSESDGNQVNFLPTTGASSNSMSPMK

SEQ ID NO: 166674 - protein, 69 aa, Glycine max
  Coding DNA Sequence Number=SeqID_49896
  Gene Ontology: Mol. function=signal recognition particle binding; Cellular component=signal recognition particle, endoplasmic reticulum targeting; Biological process=SRP-dependent cotranslational protein targeting to membrane
  Homolog annotation: Hit_ID=Q1SSS8; Match level="QueryCoverage=98%, HitCoverage=10%, E-value=3e-24, Identity=81%"; Hit description=GTP -binding signal recognition particle SRP54, G-domain
MEEALVHILTPRCSIDILWDVHATKEQRKPCVVMFDGVNGVGKSPDLTKVAYWLLQHNVNVMMATCDTF

SEQ ID NO: 166675 - protein, 53 aa, Glycine max
  Coding DNA Sequence Number=SeqID_49897
MVLTSVPSLKNVYFQRWCLPQQRLRMPTFKDVVECTSHPVGILMMLDHWKQRD

SEQ ID NO: 166676 - protein, 303 aa, Glycine max
  Coding DNA Sequence Number=SeqID_49898
  Gene Ontology: Mol. function=receptor activity; Biological process =protein amino acid phosphorylation
  Homolog annotation: Hit_ID=Q84KS6; Match level="QueryCoverage=67%, HitCoverage=61%, E-value=2e-24, Identity=34%"; Hit description =Membrane located receptor-like protein
MWREGALLVVLLLLLLLVQQNCATKDEQEHGCPPSSCGKITSITYPFRLKGDPKSCGHNRYELACENNVTVLYLYSGKYHVQAINYNNFTVRVVDPGVQQQNYSSLPRYFLSQSNFSDSYSDATDPYQAGLKPINNWAWLIFQHVVFMNCSHPVTYNRKYVDTAPCVNSDSKGYYIYSIAGDLKAHDFEVGCHVKLVALTSWWGFDTNNHSYTAMHTGLVYGFEISWMHLAYMDMEMEIDTAISTIPSRTFDALCVIANVPALYVEYWKYCYSLPVECKELKRDDPLSVLFFSLDFHFVFLPH

SEQ ID NO: 166677 - protein, 298 aa, Glycine max
  Coding DNA Sequence Number=SeqID_49899
  Gene Ontology: Mol. function=protein kinase activity; Cellular component=cell surface; Biological process=protein amino acid phosphorylation
  Homolog annotation: Hit_ID=Q1S8T9; Match level="QueryCoverage=96%, HitCoverage=44%, E-value=1e-106, Identity=66%"; Hit description =Protein kinase
  Pfam annotation: Domain name=Pkinase; Domain location=3-273; Score =166.3; E_value=7.7e-47; Accession=PF00069.15; Description=Protein kinase domain
  Pfam annotation: Domain name=Pkinase_Tyr; Domain location=5-273; Score=111.1; E_value=3.2e-30; Accession=PF07714.7; Description =Protein tyrosine kinase
  Pfam module annotation: Pfam domain module=Pkinase::Pkinase_Tyr; Domain location=3-273::5-273
MTGGFKEKLGEGGYGYVFKGKLCSGSCVAIKMLGKSKGNGQDFISEVATAGRIHHQNVVQLIGFCVQGSKRALVYEFMPNGSLDKLIFSKDGSIHLSYDKIYNISIGVARGIAYLHHGCEMQILHFDIKPHNILLDENFTPKVSDFGLAKLYPIDNSIVTMTTTRGTIGYMAPELFYNNIGGISHKADVYSYGMLLMEMASKRKNLNPHAERSSQLFFPFWIYNHIGDEEDIEMEDVTEEEKKIAKKMIIVALWCIQLKPNDRPSMNKVVEMLEGDIENLEIPPKPSLYPASTTSNNV

SEQ ID NO: 166678 - protein, 88 aa, Glycine max
  Coding DNA Sequence Number=SeqID_49900
  Gene Ontology: Mol. function=structural constituent of ribosome; Cellular component=ribonucleoprotein complex; Biological process =translation
  Homolog annotation: Hit_ID=P51425; Match level="QueryCoverage=57%, HitCoverage=100%, E-value=3e-24, Identity=100%"; Hit description=60S ribosomal protein L39
  Pfam annotation: Domain name=Ribosomal_L39; Domain location=46-88; Score=100.6; E_value=4.7e-27; Accession=PF00832.10; Description =Ribosomal L39 protein
MGKILGAERKSSVNEEGLVIRVFADRCAVEPPEDESKMPSHKTFRIKKKLAKKMRQNRPIPYWIRMRTDNTIRYNAKRRHWRRTKLGF

SEQ ID NO: 166679 - protein, 77 aa, Glycine max
  Coding DNA Sequence Number=SeqID_49901
MTLLFIWVSGLNGSGGGSPLAYEMVGVGRGSTGKVSVGVEGSVVINPGAIQLELNTWPCVMAISVHPLMIFWLKLGI

SEQ ID NO: 166680 - protein, 83 aa, Glycine max
  Coding DNA Sequence Number=SeqID_49902
MAWPPTEWVFDLYKRWVVRSTCNRQLELLLMGKNKGRQSHSAAKQIMVKSITSGSGKSQTFATSGLAGCLDVVQANQNAYTAS

SEQ ID NO: 166681 - protein, 86 aa, Glycine max
  Coding DNA Sequence Number=SeqID_49903
MSESVTVDCLRKMEVSFVCKLVALSEKRVLSARSSTHAERAARAKCANQNTSAEREELAKRDIQSALSEEELAKRAYEGPSPLQQL

SEQ ID NO: 166682 - protein, 147 aa, Glycine max
  Coding DNA Sequence Number=SeqID_49904
  Gene Ontology: Mol. function=nucleic acid binding
  Homolog annotation: Hit_ID=Q1SKJ3; Match level="QueryCoverage=87%, HitCoverage=14%, E-value=5e-09, Identity=26%"; Hit description=Zinc finger, CCHC-type; Endonuclease/exonuclease/phosphatase
AWGHNLIGYVAGRFPGKKVLLDCCQKWGVKFSYSAHESGWLMYKFESEDDLNQVLSVGPYFIFQRPLLLKVMPTFFDFGNEELNKIHVWVKLRNLPLELWNPQALGKILSKIGSPIQFDHLTASKGSISFARTLVEVNASLELTDEV

SEQ ID NO: 166683 - protein, 122 aa, Glycine max
  Coding DNA Sequence Number=SeqID_49905
MEGVQPLVPGVGASAVLAFQFTGEHHAKEEALHGRLCRNVVEIVVVAALLVPLAAVEGEAPLLIMHTNYLRKFPNRILFCITVHSSRGFFYRPMKDIIASWNTTILGYAQVGLIGEVRLGTP

SEQ ID NO: 166684 - protein, 378 aa, Glycine max
  Coding DNA Sequence Number=SeqID_49906
  Homolog annotation: Hit_ID=Q1RV51; Match level="QueryCoverage=99%, HitCoverage=94%, E-value=1e-106, Identity=56%"; Hit description =HCNGP-like
  Pfam annotation: Domain name=HCNGP; Domain location=215-300; Score =128.5; E_value=1.9e-35; Accession=PF07818.3; Description=HCNGP-like protein
MASKKKHSEGIALLSMYNDEEDDEMEDAEDEDDEEEGDAGMRMEEDAAGDARFAAEEDSANRTAIVDSGNEGGADEGFIPAEKSRVGTSTPQTNNLISPPLEQPRIGRKGALTIVDYGHDEVAMSPEPEEGEIYGSVRVVIGDQLHATNGDFQDRTPLGTVQVLTPSNQANTPQFSEPLKSDTMNNDAVIRSEDAELGEADQEEQKYVDPLDKFLPPPPKAKCSEELQAGKSFNAEVRNRKDYRNPDFLLHAVRYQDIDQIGSCFSKDVFDPHGYDQSDFYDELEADMRRESERKEQEKKKAQKVEFISGGAQPGIVASAPRISMPVAGVSAVTAGGLPLVPATSDSINRDGQDSVSTIGAHAAILSAANAGGGYMQF

SEQ ID NO: 166685 - protein, 408 aa, Glycine max
  Coding DNA Sequence Number=SeqID_49907
  Gene Ontology: Mol. function=transporter activity; Cellular component= membrane; Biological process=transport
  Homolog annotation: Hit_ID=Q6DXT0; Match level="QueryCoverage=99%, HitCoverage=99%, E-value=1e-170, Identity=62%"; Hit description =Putative permease
  Pfam annotation: Domain name=Xan_ur_permease; Domain location=31-323; Score=39.7; E_value=1.4e-09; Accession=PF00860.11; Description =Permease family
MAAPKPEEISHPPMDQLQGLEYCIDSNPSWVETIVLGFQHYILALGTAVMIPSFLVPLMGGSDDDKVRVVQTLLFVEGINTLLQTLFGTRLPTVIGGFFSPLGMVPVIALAGFGLFDRGFPVVGHCVEIGIPMLILFVVFSQHLELLPMTLEHVAYRIKIPYPLEWGAPTFDAGHAFGMMAAVLVSLIESTGAYKAASRLASATPPPAHVLSRGIGWQGIGILLNGLFGTLTGLLGSTRVGSRRVIQISAGFMIFFSMLGKFGALFASIPFPIFAAVYCVLFGLVASVGLSFLQFTNMNSMRNLFIVGVALFLGFSVPEYFREYTSKALHGPTHTRAGWFDDFLNTIFFSSPTVALIVAVFLDNTLDYKDSAKDRGMPWWARFRTFNGDSRNEEFYTLPFNLNRFFPP

SEQ ID NO: 166686 - protein, 380 aa, Glycine max
  Coding DNA Sequence Number=SeqID_49908
  Gene Ontology: Mol. function=RNA-directed DNA polymerase activity; Cellular component=chromatin; Biological process=chromatin assembly or disassembly
  Pfam annotation: Domain name=rve; Domain location=131-248; Score=6.9; E_value=0.0016; Accession=PF00665.16; Description=Integrase core domain
  Pfam annotation: Domain name=zf-H2C2; Domain location=76-113; Score =12.9; E_value=0.007; Accession=PF09337.1; Description=His(2)-Cys(2) zinc finger
  Pfam module annotation: Pfam domain module=rve::zf-H2C2; Domain location=131-248::76-113
MLLLSIPCLIFLEELKKKLSDDPIFIEFRQNIVANPDNYPDCTVVNDFILKWGRIWLPQGSTIIPMLLTEYHLTPMGGHMGVAKTLARLTKNFDWPRLRKDVADFVVACIDCQHTKYETKRVARLLCPLTVPCRPWEDLSLDFITGLPPFCDNIVILVVALFKGHSLGKLHGMPRSLVSDHDPLFISRFWRELFRLSGIRLRMSSTYHPQTDRKSEPTTWGKFLSWVEWSYNTSHHSRTGISPYEITFGKKPITFPQYLTGTSNVDVVDDLLTNRDAVFKQVQHKLLKAPQVMEQYADNKRRDIHFQIGDLWTDLSPDDTSWEDWDQLKVAYHLEDKVLSEVLGNDSNQQNTQAHQNTQALTRARPTRQSISHAYLKDFV

SEQ ID NO: 166687 - protein, 114 aa, Glycine max
  Coding DNA Sequence Number=SeqID_49909
MTLSRREKKMRESGRNLMFSYGGEIESVGNLNSEGGSFEVGVEGGKRDWKKIEGKDDQNGKTMTMDVPIADISENKDVYGRVPEENRSIISARKRKFEVETSNPSVRAESSTHA

SEQ ID NO: 166688 - protein, 381 aa, Glycine max
  Coding DNA Sequence Number=SeqID_49910
MEVWPKDGIHGSLKRRGSIAQSEGHHFEFIVALVRAKGSFTNILFMHANLMIALKKVQFGELASATKFIQKFINGGNRKAILDGRTLTSSELGRRCIWWLVGLDGGRDWGGWNKDWYFVRMWEIAGGGWVNSFWSNGGSMGMIEIWNTNRTRDEKLNPWVTAFEGYRGLEFRKARQQGGLTDDRGIFPPEGELSLPLAPTSMAEEPGPPVGAKRIWRAWMKDDHDVNWPLLSRVVLKKLLNLEDPTNGVRAYKVRNVQFQAMVDKLVKFVGHVLEGITQGKLMGGELGDGVLKPIGIGSRTGQNLHNKRKKGGKRAKWQTRIAIGQQDCQLNTKSVKRNLSSMQGKCFVSLVLLWLMLVYSAVLVYSAGYYQITFLERLTQ

SEQ ID NO: 166689 - protein, 81 aa, Glycine max
  Coding DNA Sequence Number=SeqID_49911
  Subcellular localization annotation: CTP_CleavageSite=37; ConfidenceScore=5.45e-01
MAAVDPSVYVLPFDSLLPTGGSLFPQNASVMGKTKALAGRRGGSRRVFLMVGVVGWVLFPHVNMCLIYNVAQCSAVPFLVK

SEQ ID NO: 166690 - protein, 90 aa, Glycine max
  Coding DNA Sequence Number=SeqID_49912
MDQHRSEVLDPVHDGNLSHSAEGVAIARDNISGEAGTSGEVGEDLGSDKEPKEEVKGQDKRDQENISDNLPGVDQGTSYNSRHMAKSGSD

SEQ ID NO: 166691 - protein, 94 aa, Glycine max
  Coding DNA Sequence Number=SeqID_49913
METWDVTYEMDDLTHQGNKPQRDGVYLKILNSTDQFKPDMFQSNPRQNLEFFHSRVSCHSRLSGKTVCNEQHKWCRNQSLQLKAVLKYENFHGP

SEQ ID NO: 166692 - protein, 60 aa, Glycine max
  Coding DNA Sequence Number=SeqID_49914
  Subcellular localization annotation: CTP_CleavageSite=43; ConfidenceScore=5.37e-01
MAWPPFSFQVSISNKVGFRWRKTGTTARIRSAGFIRTSPSELRSDAKMICTKMLEPYRGV

SEQ ID NO: 166693 - protein, 114 aa, Glycine max
  Coding DNA Sequence Number=SeqID_49915
  Gene Ontology: Mol. function=calcium ion binding
  Homolog annotation: Hit_ID=Q1SH11; Match level="QueryCoverage=90%, HitCoverage=22%, E-value=2e-32, Identity=63%"; Hit description =Calcium-binding EF-hand
MQGKILRLEFAHYDYQSRQTISAKDFALSMVASADMSHLGRLLERVDGLNDDPRLKDARLTFEDLKNFAELRKKLLPFSLALFSFGEVNGLLTRDDFQRAASHVWHLSLILCST

SEQ ID NO: 166694 - protein, 83 aa, Glycine max
  Coding DNA Sequence Number=SeqID_49916
MCETLFISFNKAIMRIFIRCSNYGKCCPKALTEPDYGSDASALKTTTTKKYSIMSIVPIFNNVFLLCIEMGGGWILDGQKRWI

SEQ ID NO: 166695 - protein, 298 aa, Glycine max
  Coding DNA Sequence Number=SeqID_49917
  Gene Ontology: Mol. function=DNA binding; Cellular component =mitochondrion; Biological process=DNA integration
  Homolog annotation: Hit_ID=Q1SIP9; Match level="QueryCoverage=99%, HitCoverage=31%, E-value=1e-102, Identity=60%"; Hit description =Integrase, catalytic region
MYQVDVNNAFLQGLLKEDVFMAQPRGFKDSQHPDYVCKLHKAIYGLRQALRAWHDALKSFITSYGFTTRRSNPSLFIYISGNITVYFLVYVDDLLLTGNNTTFIDTFIEFLSNRLSLKNMGAPYYFMGIELIPMNSSMFLSQHKYIKDVLEKFEMQDVKSSPTPLASTTTLMLHDGTPTNNATQYQRIIGALQYLTLTRPGLSFSINKLSIFMHKPTSLHLPHLRRLLEYLKSTINFAIVIRKPHSFNMIAYTDANWGEIVDDNTLTLAYIIFFGGNPISWLSKKQRTMDKSSSKAKY

SEQ ID NO: 166696 - protein, 94 aa, Glycine max
  Coding DNA Sequence Number=SeqID_49918
MTLEDYSSSAAPQYFTNIAKLDVQVANITYPHSLIQLIQGNLFHGLSSVDPYAHLATYIEIYNMAVVAARPKTKQKAQDYLQFAHLQIVPTLLL

SEQ ID NO: 166697 - protein, 127 aa, Glycine max
  Coding DNA Sequence Number=SeqID_49919
  Gene Ontology: Mol. function=DNA binding; Biological process=DNA integration
  Homolog annotation: Hit_ID=Q1SIP9; Match level="QueryCoverage=57%, HitCoverage=10%, E-value=2e-18, Identity=50%"; Hit description =Integrase, catalytic region
MTSEGKCEDDFNSLRPNNRCKHLLKVDTRTLCKALGHKLRLYQRSGSIFCNCIKLIKDFLMPMCMLHGLPDIGRFKVGIASTEGGHVGDDTTVDVSCGTISIMSGGGGDMVVLYRFLVYEIRTNMGR

SEQ ID NO: 166698 - protein, 545 aa, Glycine max
  Coding DNA Sequence Number=SeqID_49920
  Gene Ontology: Mol. function=threonine ammonia-lyase activity; Cellular component=chloroplast; Biological process=branched chain family amino acid biosynthetic process
  Homolog annotation: Hit_ID=Q9ZSS6; Match level="QueryCoverage=86%, HitCoverage=81%, E-value=0.0, Identity=71%"; Hit description =Threonine dehydratase biosynthetic, chloroplast precursor
  Pfam annotation: Domain name=PALP; Domain location=114-396; Score =303.2; E_value=4.7e-88; Accession=PF00291.15; Description=Pyridoxal -phosphate dependent enzyme
  Pfam annotation: Domain name=Thr_dehydrat_C; Domain location=408-497; Score=95.5; E_value=1.6e-25; Accession=PF00585.9; Description=C -terminal regulatory domain of Threonine dehydratase
  Pfam module annotation: Pfam domain module=PALP::Thr_dehydrat_C; Domain location=114-396::408-497
  Subcellular localization annotation: CTP_CleavageSite=53; ConfidenceScore=5.03e-01
MEALRVAPTTPPLLRRHHPLRQMARHPLTARPRRAPLIAATLSTPPEAAHSSVAAAVAEDPSEAAPPPRPRVLPDSLQYPPGFVGAIPARSRSDGGGGGIDAMTYLTNILSSKVYDVAIESPLQLAPKLSARLGVKVWLKREDLQPVFSFKLRGAYNMMAKLPRELLERGVICSSAGNHAQGVALAAKRLNCSAVIAMPVTTPEIKWKSVEALGATVVLVGDSYDEAQAYAKKRGVEEGRTFVPPFDHPDVIMGQGTVGMEIVRQMQGPIFAIFVPVGGGGLIAGIAAYVKRVNPEVKIFGVEPTDANAMALSLHHDQRVILDQVGGFADGVAVKEVGEETFRICKELIDGVVLDMFEEKRNILEPAGALALAGAEAYCKHHGVQGKDIVVITSGANMNFDKLRVVTELANVGRKQEAVLATVLPEEPGSFKQFCELVGQMNITEFKYRYNSNEKAVVLYSVGIHTVSELRAMQERMESSQLKTYNLTESDLVKDHLRYLMGGRSNIQNEVLCRFTFPERPGALMKFLDPFSPRWNISLFHYRGE

SEQ ID NO: 166699 - protein, 164 aa, Glycine max
  Coding DNA Sequence Number=SeqID_49921
MASIVSRHSSTMSKILCYFFLETNKQNHRRIIFFRNSPYYGIELNNAANLPLPPEAPVALPLLCTVPLSAASVGNTHWVRVIFVREQNLVSARATFVGGFHERRARLDGQCSLLVRLQRVPQETQWKREIGCNTWSSSMAEMTSWNSISSELDMKHARYFYKRN

SEQ ID NO: 166700 - protein, 731 aa, Glycine max
  Coding DNA Sequence Number=SeqID_49922
  Gene Ontology: Mol. function=binding; Cellular component=thylakoid; Biological process=photosynthesis
  Homolog annotation: Hit_ID=Q6K378; Match level="QueryCoverage=98%, HitCoverage=99%, E-value=1e-127, Identity=50%"; Hit description =Tetratricopeptide repeat protein-like
  Pfam annotation: Domain name=PB1; Domain location=278-356; Score =66.5; E_value=8.4e-17; Accession=PF00564.15; Description=PB1 domain
  Pfam annotation: Domain name=TPR_1; Domain location=125-158; Score =14.1; E_value=0.11; Accession=PF00515.18; Description=Tetratricopepti de repeat
  Pfam annotation: Domain name=TPR_1; Domain location=51-84; Score =11.3; E_value=0.24; Accession=PF00515.18; Description=Tetratricopepti de repeat
  Pfam annotation: Domain name=TPR_1; Domain location=89-124; Score =13.1; E_value=0.15; Accession=PF00515.18; Description=Tetratricopepti de repeat
  Pfam annotation: Domain name=TPR_2; Domain location=125-158; Score =19.1; E_value=0.016; Accession=PF07719.7; Description=Tetratricopepti de repeat
  Pfam annotation: Domain name=TPR_2; Domain location=51-84; Score =23.1; E_value=0.001; Accession=PF07719.7; Description=Tetratricopepti de repeat
  Pfam annotation: Domain name=TPR_2; Domain location=519-552; Score =1.2; E_value=24; Accession=PF07719.7; Description=Tetratricopeptide repeat
  Pfam annotation: Domain name=TPR_2; Domain location=89-124; Score =8.4; E_value=3.5; Accession=PF07719.7; Description=Tetratricopeptide repeat
  Pfam module annotation: Pfam domain module=PB1::TPR_1::TPR_1::TPR _1::TPR_2::TPR_2::TPR_2::TPR_2; Domain location=278-356::125-158::51 -84::89-124::125-158::51-84::519-552::89-124
MGKPTGKKKDPSTPPKANGHHHNPSKSLDDSNNNKRAAALDDDTAMFINMSQELREEGNRLFQKKDHEGAMLKYEKALKLLPKSHIDVAHLHTSMAMCYMQLGLGEYPRAINECNMALQVSPRYTKALLKRAKCYEALNRVDLAMRDVRVVLNLEPNNSTALEVLDSLRMTMEEKGIVVDETEIALAALQHQPEPASARLRKIVREKIKKKKEHKGGEDGGKAKKIIIEEKVKVENVKKKDNKDKDHKVHKDKEKRVVKEEKEKLGKEEKEKDKGVVTRTVKLIYGEDIRWAQLPVNCGMRLVRDVIRDRFPGLKGVLVKYRDREGDLVTITSTAELRLAETCHVLGSIRLYVTEIEPDQELCYDDGVAGVEDGGRMRMKVVENGGGDGGKGVGKGVSTVEDWLVQFARLFKNHVGFDSDAYLDIHGIGMKLYSEAMEDAVTSEGAQELFDIAADRFQEMAALALFNWGSVHMSRARKRVSIPEDGSRESEFEFVKAGYEWARKEYMNAEKRFEEAVKIKSDFYEGLLALGHQQFEQARLCWSYLIANNKDLEAGPSDEVLQFYNKAEDSMEKGMLMWEEIEEQRLNGLSKSDKYKEQLEKMGLHGLFRDVSSDEADDQAARMRLQVYLLWGTLLYERSVVEYKLGLPTWEECLEVAVEKFELAGASTTDIGVMIKNHCSNETAMEGFKIDEIVQAWNEMYDGWQFDVPSFRLEPLFRRRVPKLHYILEQF

SEQ ID NO: 166701 - protein, 92 aa, Glycine max
  Coding DNA Sequence Number=SeqID_49923
KKVEFRACSKCKLLPLLLTHHTQEFCSSRCSQALIMGSVGAIGLGPSSSYSHHLMGVKVKKLNVIFAVAGRIQGGKDHFSSPIGALFSKNPF

SEQ ID NO: 166702 - protein, 97 aa, Glycine max
  Coding DNA Sequence Number=SeqID_49924
MCDPIDATSRRFIWGNASNHWVNWNTITQPRKNEGLGVRRARDSNVVMLGKKATPIPDWLKHELESVVLNDNVEDIVIWDNACDGEYSAKSAYCCLT

SEQ ID NO: 166703 - protein, 192 aa, Glycine max
  Coding DNA Sequence Number=SeqID_49925
  Subcellular localization annotation: CTP_CleavageSite=71; ConfidenceScore=5.17e-01
MRGFKLTERFKSTEVHALSSSSSETNHGNSSKASVAATTKPHNYLNRNKIMLPSWSKTKSRTTNNNSTSLVANLAPSDVCVVETFDELEEEMPQGQKLQGVLTAQEVHEVLTHRRAVVGHDNSEKGNTVACGGATRRDAETKDARQCMLPSFSRGHGGAMEMQANGKGHGEVTVEISDKRGGSSSEVGVFIT

SEQ ID NO: 166704 - protein, 523 aa, Glycine max
  Coding DNA Sequence Number=SeqID_49926
  Gene Ontology: Mol. function=transferase activity; Cellular component= membrane; Biological process=metabolic process
  Homolog annotation: Hit_ID=Q9FFN2; Match level="QueryCoverage=75%, HitCoverage=97%, E-value=1e-162, Identity=67%"; Hit description =Similarity to limonene cyclase
  Pfam annotation: Domain name=Exostosin; Domain location=188-476; Score=224.3; E_value=2.6e-64; Accession=PF03016.6; Description =Exostosin family
MVGSSRWINCCAWWGSEASSTMRIFLFMVPLLVLAGFASIKGSSVYNGRDSIAKRYALSSSLITRSNFSSQTFLPPPNSSLQTIYPSSNSSLQTLHQSNETEVNVSIPKSNSAPANESDESHPREKQKRKPSFLDRTEVVLAQARATIREAKNWNLTQDSDYVPIGPMYWNAKEFHRSYLEMEKQFKVFVYEEGELPVFHDGPCSSIYSTEGSFIHAIEMNEHFRTRDPKKANVFFLPFSIAWMVRYVYIRNSYDFGPIKRTVRDYVNVIATRYPYWNRSLGADHFMLSCHDWGPETSKSIPYLRKNSIRVLCNANTSEGFDPIKDASFPEINLQPGLKDSFVGGPPASKRSILAFFAGGNHGPIRPILLEHWENKDEDIQVHKYLPKGVSYYGMLRNSKFCLCPSGYEVASPRVVEAIYTGCVPVLISEHYVPPFSDVLNWKMFSVNVSVKEIPNLKDILTSISPRQYIRMQKRVGQIRRHFEVHSPPKRYDVFHMILHSVWLRRLNFRVHDDINDFLSGNN

SEQ ID NO: 166705 - protein, 271 aa, Glycine max
  Coding DNA Sequence Number=SeqID_49927
  Homolog annotation: Hit_ID=Q0KIM7; Match level="QueryCoverage=13%, HitCoverage=9%, E-value=4e-11, Identity=89%"; Hit description =Arginine/serine-rich splicing factor RSP41, putative
PGAAVKLCLGDLLVMGSNPETTSLHMQGKQLPNMLFQIKPNVSIQNNMHALSVVAYVKHDDQIDHHESLISSFKKNLYPALKEDIHQNSSHPSAFTSGTPRRSDNQWTSSWWEKFRVLLKRGKMRPIFCGNFEYDARQSELERLFSRYGKVDRVDMKSAMNPFAYFCWLDWDSGIILEQIFEIELGLLVRHVFQNSLLLQMIASEDIGRQVLTYGERGKLDGFKDAGTNVSPALSRRDMAMQMSPEGSSCSSPSLRPSLWCRCSMLLLANA

SEQ ID NO: 166706 - protein, 153 aa, Glycine max
  Coding DNA Sequence Number=SeqID_49928
  Gene Ontology: Mol. function=RNA-directed DNA polymerase activity; Biological process=RNA-dependent DNA replication
  Homolog annotation: Hit_ID=Q1S4N5; Match level="QueryCoverage=57%, HitCoverage=17%, E-value=2e-19, Identity=48%"; Hit description =Peptidase M, neutral zinc metallopeptidases, zinc-binding site
MTRSRSNRPVQSDFQNSAFKSPGTDGSQLVFFQTYWDVVGSEVWEMIAQNFNIGNINSALVETLIFLIPKIDSPVSLGDCRPIGLCNVLLKVISKAKTSKVKMVHKVLDIFCKASGLKINVQKSRIMVSKNIPRRKSNKFADVLGFQATKNID

SEQ ID NO: 166707 - protein, 55 aa, Glycine max
  Coding DNA Sequence Number=SeqID_49929
MERGRKERPKEVKYYFSPLSRKSKCTGEKFLWRKVQVFLWKKSMCYEIYDSPRMI

SEQ ID NO: 166708 - protein, 84 aa, Glycine max
  Coding DNA Sequence Number=SeqID_49930
MTVRWRTYNFKVDGEQREQENMDGEEDREKEKTTRRRRNIPRYGGEGEEAETCDDARVRRTRCSDADRDGFARRRLEEEESAKA

SEQ ID NO: 166709 - protein, 147 aa, Glycine max
  Coding DNA Sequence Number=SeqID_49931
  Gene Ontology: Cellular component=membrane
  Homolog annotation: Hit_ID=Q9FFN2; Match level="QueryCoverage=62%, HitCoverage=22%, E-value=3e-25, Identity=57%"; Hit description =Similarity to limonene cyclase
MDAHQNKSCLYFANFGMFLAYRDKNETKVFNVSKPGFNLAAANESDESHPRQKQKRKLSFIDRNEVVLAQARAAIREAKNENQTQDSDYVPIGPMYWNAKTFHRSYLEMEKQFKVSVYEEGETPVFHNGPCKSIYSMGGLLLYMLLK

SEQ ID NO: 166710 - protein, 449 aa, Glycine max
  Coding DNA Sequence Number=SeqID_49932
  Homolog annotation: Hit_ID=Q39871; Match level="QueryCoverage=95%, HitCoverage=95%, E-value=1e-109, Identity=53%"; Hit description =Maturation polypeptide
  Pfam annotation: Domain name=LEA_4; Domain location=138-181; Score =71.9; E_value=2e-18; Accession=PF02987.7; Description=Late embryogenesis abundant protein
  Pfam annotation: Domain name=LEA_4; Domain location=182-225; Score =75.0; E_value=2.3e-19; Accession=PF02987.7; Description=Late embryogenesis abundant protein
  Pfam annotation: Domain name=LEA_4; Domain location=226-269; Score =76.0; E_value=1.2e-19; Accession=PF02987.7; Description=Late embryogenesis abundant protein
  Pfam annotation: Domain name=LEA_4; Domain location=270-320; Score =18.7; E_value=0.012; Accession=PF02987.7; Description=Late embryogenesis abundant protein
  Pfam annotation: Domain name=LEA_4; Domain location=321-371; Score =21.1; E_value=0.004; Accession=PF02987.7; Description=Late embryogenesis abundant protein
  Pfam module annotation: Pfam domain module=LEA_4::LEA_4::LEA_4::LEA _4::LEA_4; Domain location=138-181::182-225::226-269::270-320::321-371
MASRQQKEDRAEAAAKVAAKELEQLNREKDRDFSVGVADQHQQEEHQLDQQKRGVIGSMFKAVQDTYENAKEAVVGKKEPSTTTNSYSTREVIHDVDIQPDDAAAAREVRDKSASKSPGIYNSATADNKTGSKVGEYADYGSQKAKETKDATKEKAGEYTDYASQKAKETKDKTMEKAGEYTDYASQKAKETKDKTMEKAGEYTDYASQKAKEAKDKTMEKGGEYKDYAAEKAKEGKDATVNKMGEYKDYTAEKAKEGKDTTLGKLGELKDSAADAAKRAVGYLSGKTEETKEKVSETAEATANKAAEMKEATREKAAGTAEAAKNKAAEVKDRAAETAEAAKNKTAETAEAAKQKTAQAKDNAKENVSGADEGARRKMEDLRLRGKGYGSHESAGGRGDKVVVKVEESRPGAIAETLKAADQIAGQTFNDVGRFDEEEGVVNVERRKK

SEQ ID NO: 166711 - protein, 276 aa, Glycine max
  Coding DNA Sequence Number=SeqID_49933
  Gene Ontology: Mol. function=transferase activity; Cellular component= membrane; Biological process=metabolic process
  Homolog annotation: Hit_ID=Q9FFN2; Match level="QueryCoverage=98%, HitCoverage=65%, E-value=1e-114, Identity=70%"; Hit description =Similarity to limonene cyclase
  Pfam annotation: Domain name=Exostosin; Domain location=5-237; Score =158.8; E_value=1.4e-44; Accession=PF03016.6; Description=Exostosin family
MVRFVYQRDSRDFGPIRKTVIDYINLIAARYSYWNRSLGADHFMLACHDWVNTLGPEASLSLPYLHKNSIRVLCNANTSEGFKPAKDVSFPEINLQTGSINGFIGGPSASKRSILAFFAGGVHGPIRPILLEHWENKDEDIQVHKYLPKGVSYYDKLRNSKFCLCPSGYEVASPRVVEAIYTGCVPVLISEHYVPPFSDVLNWKSFSVELSVKDIPNLKDILMSISPRQYIRMQRRVIQIQRHFEVHSPPKRFDVFHMILHSVWLRRLNFRMTLNL

SEQ ID NO: 166712 - protein, 148 aa, Glycine max
  Coding DNA Sequence Number=SeqID_49934
MAARGGHWWSWVMENKVLGFRWAFSEEERGKIVFFTLKNTSLGGRGHAVRPVSGVLRTQSFDEGVKDVYGPRWESIVPGRCCSLERCREDATQGRIVVGVKVYLCQEGVQMLVWIGCLVVPLEVEWLPPQGQGVGGLLVALGTSDMSL

SEQ ID NO: 166713 - protein, 363 aa, Glycine max
  Coding DNA Sequence Number=SeqID_49935
  Gene Ontology: Mol. function=nucleic acid binding; Cellular component= intracellular; Biological process=regulation of transcription
  Homolog annotation: Hit_ID=Q1SK20; Match level="QueryCoverage=56%, HitCoverage=40%, E-value=1e-91, Identity=76%"; Hit description=Zinc finger, C2H2-type
  Pfam annotation: Domain name=RS4NT; Domain location=134-171; Score =16.3; E_value=0.023; Accession=PF08071.2; Description=RS4NT (NUC023) domain
  Pfam annotation: Domain name=zf-C2H2; Domain location=149-171; Score =20.2; E_value=0.0077; Accession=PF00096.16; Description=Zinc finger, C2H2 type
  Pfam annotation: Domain name=zf-C2H2; Domain location=176-197; Score =16.9; E_value=0.075; Accession=PF00096.16; Description=Zinc finger, C2H2 type
  Pfam annotation: Domain name=zf-C2H2; Domain location=73-95; Score =26.4; E_value=0.0001; Accession=PF00096.16; Description=Zinc finger, C2H2 type
  Pfam module annotation: Pfam domain module=RS4NT::zf-C2H2::zf -C2H2::zf-C2H2; Domain location=134-171::149-171::176-197::73-95
MFPAVMSNSNSLSEEATVSCGTRIAGLNHVITTTISPEQPLKIKKKRNLPGNPDPDAEVIALSPKTLLATNRFVCEICNKGFQRDQNLQLHRRGHNLPWKLKQRSNKEVKKKAYVCPEPSCVHHNPSRALGDLTGIKKHYCRKHGEKKWKCEKCSKIYAVQSDWKAHSKTCGTREYRCGCGTLFSRKDNFITHRAFCDALAEESARLSANQLATNTTNPLVQSLFLFPTQQHNNNFINPWDPNPNPNPNPNPSNLTTLHNNIKPESHNFHIPNTTTTSTANNNISSSFLHHHQHPNKSMITSPFRDLHERTQPPSNAATSAHLSATALLQKAATVGAAAITGPTHVTQLSMAELGTETTHLDS

SEQ ID NO: 166714 - protein, 111 aa, Glycine max
  Coding DNA Sequence Number=SeqID_49936
MLDFEPVLNKFVREHPPRPNKHVVYHHEFVYVRQDNDQGIVGAYFTSASASYKDQGRHNEMNNAEKTNLQVVEATVGWIQWEKAFQRDSKSLAVVGSVSYLRIRMDQDSIA

SEQ ID NO: 166715 - protein, 63 aa, Glycine max
  Coding DNA Sequence Number=SeqID_49937
  Homolog annotation: Hit_ID=Q5ZC07; Match level="QueryCoverage=79%, HitCoverage=9%, E-value=4e-16, Identity=72%"; Hit description =Transcription factor jumonji (JmjC) domain-containing protein- like
MEVAQKVIFQAGDALFIPEGWFHQADSDGLTIAINFWWRSNIMSCMLEHMDAYYLRRILRRYW

SEQ ID NO: 166716 - protein, 78 aa, Glycine max
  Coding DNA Sequence Number=SeqID_49938
  Homolog annotation: Hit_ID=Q5ZC07; Match level="QueryCoverage=82%, HitCoverage=12%, E-value=1e-12, Identity=57%"; Hit description =Transcription factor jumonji (JmjC) domain-containing protein- like
MNSDSQANVQLETLREDIQMPQILASKELSSINLWMNNAQARSSTRYDPQSTPQSSVHSFWLQTSDGDATLQDMLSVT

SEQ ID NO: 166717 - protein, 284 aa, Glycine max
  Coding DNA Sequence Number=SeqID_49939
  Homolog annotation: Hit_ID=Q5ZC07; Match level="QueryCoverage=34%, HitCoverage=18%, E-value=6e-25, Identity=55%"; Hit description =Transcription factor jumonji (JmjC) domain-containing protein- like
MGEGCCTQPYPCICKEAVSGFEPMTNKSPRHNFTAAPGFALNPLRKYILEKRKRLSRIDARQDQLLLKLGMGKTKLPNNGQADHADENYGQMLKGMDLREKKLKERNTLLELEPAASQDGQSPSTSITDYELAGNDKCEKIVTADLKDDPLAKILWDVEPQTLQCVFLAMAHNLPRTLEALVLHVLSPVGVEVLTRKFDEMEQQTLEEDRNRFYEVFYGAFDDQSAAMNSILKGKELFTEQLLLLVASFNISKMIFHSLELLPLFDCPGLLIMTYLDGVVLGSL

SEQ ID NO: 166718 - protein, 79 aa, Glycine max
  Coding DNA Sequence Number=SeqID_49940
  Subcellular localization annotation: CTP_CleavageSite=52; ConfidenceScore=5.54e-01
MVQRSKGKTMKWVTLLKDFKEKVGLTQSPPSAPPPPPPSSSSRDNNNNNAFSASQSSSSSPTRFWLMQSVELGGVARSY

SEQ ID NO: 166719 - protein, 2200 aa, Glycine max
  Coding DNA Sequence Number=SeqID_49941
  Homolog annotation: Hit_ID=Q10D20; Match level="QueryCoverage=99%, HitCoverage=58%, E-value=0.0, Identity=60%"; Hit description=WD-40 repeat family protein, putative, expressed
MLVGNRAFVTDIEKLKISSKTRSLDVAPVLKFFSEVTKIFPSMQDGISPGANLLTSVEILVSGPIDKQSLLDSGIFCCLIQVLNALLDPDVTIQRPNSTTDHEDNLVLQKVYDEVGPNRRLEVEGSVVHIMKALASHPSAAQSLIEDDSLQLLFQMVAKGSLIVFSRYKEGLVPLHSIQLHRHAMQILGLLLVNDNGSTAKYIRKHHLALAQGVGWCGFRIYCDKRISFGFLLFQSHIKVLLLSVKDFDPDCGDAAFTVGIVDLLLKCVELSYRAEAASVRLREDIHNAHGYQFLVQFALTLSNMTKNQGFQSTHYDTFDEQEIASDGSKNSRGQNSNEQEHSSIQYLSPTLSRLLDVLVSLAQTGPNESPRNYGGKGSKSTQNKGGGHSKSRTSSSDWLGDELWEKENDKIKDLEAVQMLQDILIKADSWKLQAEVLNRLFKIFSGHIENYSLCQQLRTVPLLILNMAGFPSHLQEIILKILEYAVTVVNCVPEQELLSLCCLLQQPITSALKQTILSFFVKLLSFDQQYKKVLREVGVLEVMLDDLKQHRILGPDQQTVNSDQLERKNSSNNFKKHLDNKDVIITSPKLMESGSGKFPIFDVEATIAIAWDCMVSLLKKAEVNQASFRSASGVTVMLPFLVSDVHRSGVLRILSCLIIEDTSQAHPEELGVLVEILKSGMVTSASGSQYRLTLDAKCDTMGAMWRILGVNNSAQKVFGEATGFSLLLTTLHGFQSDSGDLDQSSLNAYIKVFTYLLRVVTAGVSDNAVNRMKLHAIISSQTFLDLLSESGLLCVDHENQVIQLMLELALEIVIPPFLASEGLTKSNAIENESSHNLLLTPSGPINPDKERVYNAGAVRVLIRSLLLFTPMVQLKLLDLIEKLARAGPFNQESLTSVGCVELLLETIHPFLLGSSSLLSYALKIVEVLGSYRLSASELRMLIRYVLQMRMKNSGHIIVEMMEKLILMGDVASENISLAPFVEMDMSKIGHAAIQVSLGERSWPPAAGYSFVCWFQFRNFLKSQSKDTDVSKFASSKKRSGSSGLHERHILRIFSVGATNNDNATYAELYLQEDGVLTLATSNSSFLSFSGLELEEGRWHHLAVIHSKPNALAGLFQASFAYVYLNGKLRHTGKLGYSPCPPGKQLQVTIGTSVGNARVSDLTWKLRSCYLFEEVLSPGCICFMYILGRGYRGLFQDTDLLQFVPNQACGGGSMAILDSLDADVTLAANGQRLDAASKQGDLKADGSGIVWDLERLGNLSLQLSGKKLIFAFDGTSTEFIRSSGSFSMLNLVDPMSAAASPIGGIPRLGRLCGDIYICKQGVIGETIRPIGGMELVLALVEAAETRDMLHMALTLLACALHQNPQNLKDMQIYRGYHLLALFLRRRMSLFDMQSLEIFFQIAACEASFSEPKKLETSQTTLSPASSLLETSLEDNFLSKFHDENSSVGSHGDMDDFSVQKDSFSHISELENTDVAAETSNCIVLSNADMVEHVLLDWTLWVTAPVSIQIALLGFLENLVSMHWYRNHNLTILRRINLVQHLLVTLKRGDVEVPVLEKLVVLLGVILEDGFLPSELENVVTFVIMTFDPPGLVPQRPIMRESMGKHVIVRNMLLEMFIDLQVTIKSEELLELWHKIVSSKLITYFLDEAVHPTSMRWVMTLLGVCLTSSPTFAFKFRTGGGYLGLVRVLPSFYDSPDIYYILFCLIFGKPVYPRLPEVRMLDFHALMPSDGSYTELKFVELLDSVIAMAKTTFDRVSMQAMLAHQTGNLSQVGASLVAELVEGNSDMAGELQGEALMHKTYAARLMGGEASAPAAATSVLRFMVDMAKMCPPFTAVCRRAEFLESCIDLYFSCVRAAHAVKTAKDLSAVPEEKTLNDCDDTCSSQNTFSSLPLDQDQSVKTSISVGSFPQGQVSTSSDDMAAAPNSMAGERPQNNLTVSELESNKSVREDMQTVQSLDGDNADQGSVASCAHEFSFQSIKGNLDLLPPTDSQSSASFAALDSPVFSEKSSSRVPLTPSLSPVVALTSWLGSANHNEAKSSLTATPSFDSSMSAAEFDTSSNLKSSSQGPSSTNAYFAVTSKLLLDVDDSGYGGGPCSAGATAVLDFIAEVLSDFVTEQVKASQLIENILESVHLYVDGESVLVFQGLCLSRFINFLERRLLRDDEEDEKKLDKIRWSTNLDALCWMIVDRVYMGSFPQPSG

SEQ ID NO: 166720 - protein, 805 aa, Glycine max
  Coding DNA Sequence Number=SeqID_49942
  Gene Ontology: Mol. function=metal ion binding; Cellular component =membrane; Biological process=actin cytoskeleton organization and biogenesis
  Homolog annotation: Hit_ID=Q9ZQX5; Match level="QueryCoverage=95%, HitCoverage=22%, E-value=0.0, Identity=73%"; Hit description =Putative transport protein
  Pfam annotation: Domain name=Beach; Domain location=542-789; Score =548.1; E_value=9.3e-162; Accession=PF02138.8; Description=BeigeBEACH domain
RAALEDLLVSRPNQGQQLDVLHGGFDKLLTRSLSEFFEWYQNIEQVVNKVLEQCAGIMWVQYIAGSAKFPGVRIKGMEGRRKKEMGRKSREAAKLDLRHWEQVNERRYALDLVRDTMSTELRVVRQDKYGWILHAESEWQCHLQQLVHERGIFPLSKSSFSEEPEWQLCPIEGPYRMRKKLECCKLKIDTIQNILDGQFELEKPELSKGKFENGPDSSESKPYFQLLTDGGKQNGSDGEPFDEPFFDKLDSVKDAVSAKNEWNDDKASSINEASLHSALELGAKSSAVSVPIEESTQGRSDMGSPRQSSMKIDDVKIADDKSDKELHDNGEYLIRPFLEPFEKIRFKYNCERVISLDKHDGIFLIGEFSLYVIENFYIDDSGCFCEKECEDELSVIDQALGVKKDVSGSVDFQSKSTLSWSTPAKSLVGGRAWAYSGGAWGKEKVHSSGNLPHPWRMWKLDSVHEILKRDYQLRPVAIEIFSMDGCNDLLVFHKKEREEVFKNLVAINLPRNSMLDTTISGSSKQESNEGSRLFKIMAKSFSKRWQNGEISNFQYLMHLNTLAGRGYSDLTQYPVFPWVLADYESENLDLSNPKTFRRLDKPMGCQTPEGEDEFRKRYESWDDPEVPKFHYGSHYSSAGIVLFYLLRLPPFSTENQKLQGGQFDHADRLFNSIRDTWLSAAGKGNTSDVKELIPEFFYMPEFLENRFNLDLGEKQSGEKVGDVVLPLWAKGSAREFISKHREALESNYVSENLHHWIDLIFGYKQRGKVLLYNLMSLSLIVYMHLFMWKSLIWLVVGHGHYGLPR

SEQ ID NO: 166721 - protein, 1323 aa, Glycine max
  Coding DNA Sequence Number=SeqID_49943
  Gene Ontology: Mol. function=hydrolase activity; Cellular component =intracellular; Biological process=metabolic process
  Homolog annotation: Hit_ID=Q9ZQX5; Match level="QueryCoverage=23%, HitCoverage=9%, E-value=1e-144, Identity=75%"; Hit description =Putative transport protein
  Pfam annotation: Domain name=Beach; Domain location=1-54; Score= -197.5; E_value=0.00073; Accession=PF02138.8; Description=BeigeBEACH domain
  Pfam annotation: Domain name=PPR; Domain location=1031-1065; Score =34.3; E_value=4.3e-07; Accession=PF01535.11; Description=PPR repeat
  Pfam annotation: Domain name=PPR; Domain location=1066-1100; Score =7.0; E_value=1.1; Accession=PF01535.11; Description=PPR repeat
  Pfam annotation: Domain name=PPR; Domain location=1168-1202; Score =0.7; E_value=6.2; Accession=PF01535.11; Description=PPR repeat
  Pfam annotation: Domain name=PPR; Domain location=525-559; Score =37.2; E_value=5.5e-08; Accession=PF01535.11; Description=PPR repeat
  Pfam annotation: Domain name=PPR; Domain location=628-662; Score =37.1; E_value=6.1e-08; Accession=PF01535.11; Description=PPR repeat
  Pfam annotation: Domain name=PPR; Domain location=729-763; Score =40.2; E_value=7.3e-09; Accession=PF01535.11; Description=PPR repeat
  Pfam annotation: Domain name=PPR; Domain location=764-798; Score=1.9; E_value=4.5; Accession=PF01535.11; Description=PPR repeat
  Pfam annotation: Domain name=PPR; Domain location=830-864; Score =29.5; E_value=1.2e-05; Accession=PF01535.11; Description=PPR repeat
  Pfam annotation: Domain name=PPR; Domain location=930-964; Score =40.7; E_value=4.9e-09; Accession=PF01535.11; Description=PPR repeat
  Pfam annotation: Domain name=WD40; Domain location=131-168; Score =24.0; E_value=0.00054; Accession=PF00400.22; Description=WD domain, G-beta repeat
  Pfam annotation: Domain name=WD40; Domain location=180-218; Score =42.0; E_value=2.1e-09; Accession=PF00400.22; Description=WD domain, G-beta repeat
  Pfam annotation: Domain name=WD40; Domain location=265-308; Score =1.1; E_value=27; Accession=PF00400.22; Description=WD domain, G-beta repeat
  Pfam annotation: Domain name=WD40; Domain location=341-379; Score =7.7; E_value=4.6; Accession=PF00400.22; Description=WD domain, G -beta repeat
  Pfam module annotation: Pfam domain module=Beach::PPR::PPR::PPR::PPR:: PPR::PPR::PPR::PPR::PPR::WD40::WD40::WD40::WD40; Domain location=1 -54::1031-1065::1066-1100::1168-1202::525-559::628-662::729-763::764 -798::830-864::...
  Pfam module annotation: Domain location=930-964::131-168::180 -218::265-308::341-379
AAEESVNVFYHYTYEGSVDIDSVTDPAMKASILAQINHFGQTPKQLFLKPHVKRRTDRKLPPHPLKHSSHLAAHEIRKSSSPITQIVTLNDKILIAGTNNLLKPRTYTKYVAWGFPDRSLRFISYEQDKLLSTHENLHGGNQIQCASVSHDGHILVTGADDGLVNVWRVSKFGPRALRRLKLEKPLCGHTAKITCLQVSQPYMLIVSGSDDCTVIIWDLSSMAFVRQLPEFPASVSAIYVNDLTGEIVTAAGILLAVWSINGDCLALIKASQLPSDSILSVTSSTFSDWLDTKWYATGHQSGAVKVWQMVHCSNPDSSLSKSGFGGSGGLNLDGIEPEYKLVLRKVLKFHKHPVTALHLTTDLKQLLSGDSGGHLLSWTLPEESLRGSLNQGLLACMRSLFRCGTVHLHACTITMSTSILTPLPLKPISVNTLNKGTLKPAFQSLTLLSTHPLATPSRLEHAHSLLLDLCVAAKALPQGQQLHALLLKSHLSAFLATKLVLMYGKCGSLRDAVKVFDEMSERTIFSWNALMGAFVSSGKYLEAIELYKDMRVLGVAIDACTFPSVLKACGALGESRLGAEIHGVAVKCGYGEFVFVCNALIAMYGKCGDLGGARVLFDGIMMEKEDTVSWNSIISAHVAEGNCLEALSLFRRMQEVGVASNTYTFVAALQGVEDPSFVKLGMGIHGAVLKSNHFADVYVANALIAMYAKCGRMEDAGRVFESMLCRDYVSWNTLLSGLVQNELYSDALNYFRDMQNSGQKPDQVSVLNLIAASGRSGNLLKGKEVHAYAIRNGLDSNMQIGNTLVDMYAKCCCVKYMGHAFECMHEKDLISWTTIIAGYAQNEFHLEAINLFRKVQVKGMDVDPMMIGSVLRACSGLKSRNFIREIHGYVFKRDLADIMLQNAIVNVYGEVGHIDYARRAFESIRSKDIVSWTSMITCCVHNGLPVEALELFYSLKQTNIQPDSIAIISALSATANLSSLKKGKEIHGFLIRKGFFLEGPIASSLVDMYACCGTVENSRKMFHSVKQRDLILWTSMINANGMHGCGNKAIALFKKMTDQNVIPDHITFLALLYACSHSGLMVEGKRFFEIMKYGYQLEPWPEHYACMVDLLSRSNSLEEAYHFVRNMPIKPSSEIWCALLGACHIHSNKELGELAAKELLQSDTENSGKYALISNIFAADGRWNDVEEVRLRMKGNGLKKNPGCSWIEVDNKIHTFMARDKSHPQTDDIYLKLAQFTKLLEKKGGYIAQTKFVFHNVSEEEKTQMLYGHSERLALGYGLLVTPKGSIILKEDSVHVEISGEYLDYVKIDYSTLLWFLPVTGSH

SEQ ID NO: 166722 - protein, 799 aa, Glycine max
  Coding DNA Sequence Number=SeqID_49944
  Homolog annotation: Hit_ID=Q9LS59; Match level="QueryCoverage=85%, HitCoverage=87%, E-value=8e-75, Identity=37%"; Hit description =Genomic DNA, chromosome 3, P1 clone: MYF24
  Subcellular localization annotation: CTP_CleavageSite=22; ConfidenceScore=5.28e-01
MELSEEWKPFFPTGASTVSPILQSHSRNSLPLGPLVFNPNPNPNPNSLSLLFSSPSLLPSLHLPPHLLPSRFLLTSHPHSIPPSTASSVASLFSSPNQNDAASLLLCNRLHLLHYPNSPNAIVFFPTGANDDKLGFFILRVKDSRLDIQLEANGDVFCVYTGSAHRILNISVNPVAEFDRLDDSNVIGYLLASTLYSVHWFAVKHNSILDRPSVFYLGGKTFKTCPVAHACWSPHVMEESLVLLENGQLFLFDLESHDTTGTAFKGTRLKVPWNGLGFSGNNMVWLSCEFSWHPRVFVVAHSNAVFLVDLRLKECSVSCLMKIEMLRMYAPGANERFLALSRAGPDDLYFAVASTSLLLLCDVRKPLVPVLQWMHGIEGPCFVSVLSLSDLRSHSRDDAFKLASESGFCIMLGSFWNCEFNIFCYGSILPFRKGSITSKVNPNVCAWELPFEINLSGHECHCGSCLLRKEFSKDALPEWVDWQLKKEIVLGFGVLSNDLAALLCEPDENGGFTLIRLMSSGSQSKSCPAVTSVFNDVKLPASLHEVALRRLWADLPMELLQLAFLSYVECHKVVGDLHQNKVALEFLAVPDLPQLPPFFLRKSSPHSNDDIVGPVIPFPVLLVLNEFRNGYSNLEGDEFSVEAELGLKYKEVMQVAGEIADSAYGPAHLDDHVVSLAEDGEETWVGSSKPKSFLLYHPVAFNSSATDLAQEKFVYSNTIYDTFISHVPEKKSNEKTESVGQEIFDDLCPVELRFDASVKKLEPQGLKACNLLKRQMSKWQNSFDSYKEFCIQSRFEKSS

SEQ ID NO: 166723 - protein, 149 aa, Glycine max
  Coding DNA Sequence Number=SeqID_49945
  Gene Ontology: Mol. function=calcium ion binding; Cellular component =plasma membrane; Biological process=G-protein coupled receptor protein signaling pathway
  Homolog annotation: Hit_ID=Q39890; Match level="QueryCoverage=97%, HitCoverage=97%, E-value=1e-44, Identity=59%"; Hit description =Calmodulin
  Pfam annotation: Domain name=efhand; Domain location=12-40; Score =34.9; E_value=2.8e-07; Accession=PF00036.22; Description=EF hand
  Pfam annotation: Domain name=efhand; Domain location=121-149; Score =38.6; E_value=2.2e-08; Accession=PF00036.22; Description=EF hand
  Pfam annotation: Domain name=efhand; Domain location=48-77; Score =4.3; E_value=5; Accession=PF00036.22; Description=EF hand
  Pfam annotation: Domain name=efhand; Domain location=85-113; Score =39.1; E_value=1.6e-08; Accession=PF00036.22; Description=EF hand
  Pfam module annotation: Pfam domain module=efhand::efhand::efhand::efh and; Domain location=12-40::121-149::48-77::85-113
MANAWTEDQIAIFHEAFDVVDKDSDGFISVDELLSIVRSLEGNSTKEEIREMISEVDIDGNGRSVNFENFLKIMGRTMKENQTEELKDSFKVFDRDNDGYISATELRQVMVKLGERLTDEEVEQMIREADLDGDGRVSYEEFVRFMTLN

SEQ ID NO: 166724 - protein, 187 aa, Glycine max
  Coding DNA Sequence Number=SeqID_49946
  Gene Ontology: Mol. function=methyltransferase activity; Cellular component=chloroplast; Biological process=metabolic process
  Homolog annotation: Hit_ID=Q2XV88; Match level="QueryCoverage=89%, HitCoverage=45%, E-value=2e-78, Identity=81%"; Hit description =MPBQ/MSBQ methyltransferase 1
MPIDMYPQEGGDYDELLFLSIEYWPDPQRGIKEAYRVLKLGGKACLIGPVYPTFWLSRFFADVWMLFPKEEEYIEWFQKAGFKDVQLKRIGPKWYRGVRRHGLIMGCSVTGVKPASGDSPLQAVVHLCLKMTGHILLGPKEEDVEKPVNPFVFALRFVLGALAATWFVLVPIYMWLKDQVVPKGQPI

SEQ ID NO: 166725 - protein, 158 aa, Glycine max
  Coding DNA Sequence Number=SeqID_49947
  Homolog annotation: Hit_ID=Q10D20; Match level="QueryCoverage=50%, HitCoverage=2%, E-value=7e-16, Identity=57%"; Hit description=WD-40 repeat family protein, putative, expressed
AHPEELGMLVEVLKSGMVTSASGSQYRLSLDAKCDYGNIGGSWELIILLRRFYVKPPVFLFCLQHFMGSKVMVGTWTNLHSMFTLRGDMKAVKILFHWFTVLATPAICHGETLNIRSVKPNTVLQPGIFKNFNVLNQLRLNLRKSPYNSHITILSGST

SEQ ID NO: 166726 - protein, 53 aa, Glycine max
  Coding DNA Sequence Number=SeqID_49948
MAHKKTVASSSSASTLLKGGVIDHNHESLYEHGLWSVHEACSHVLNPPMKCPQ

SEQ ID NO: 166727 - protein, 44 aa, Glycine max
  Coding DNA Sequence Number=SeqID_49949
MAITHIFTLNFILPVDLVHGPVNLLWDRWFEGPQDPQACRCWIL

SEQ ID NO: 166728 - protein, 77 aa, Glycine max
  Coding DNA Sequence Number=SeqID_49950
MDHNFDDMSCEMIFGEDPPESTDDPALNQPCFKLWFEVSKEETIMAHLSYADKAETHHASFFYLIIIRKTAKWSNAL

SEQ ID NO: 166729 - protein, 738 aa, Glycine max
  Coding DNA Sequence Number=SeqID_49951
  Gene Ontology: Cellular component=cytosol
  Homolog annotation: Hit_ID=Q2R1Y3; Match level="QueryCoverage=94%, HitCoverage=87%, E-value=1e-56, Identity=31%"; Hit description =Expressed protein
MTTGIVRDQNLEKHIHKQMGCMAGFLQIFDRHQMLTGKRIYSPKRLPPASPEPENPAVSPARSTPSPAREVTSSEPQANVPTLPVLEFKEGTRSSWKFSREAPRLSLDSRAIVDAKGTLHLHPREIPPENDADKQRRSTSVIAKLMGLEPLPDSEPGPGPGPVAKLQRSASESRVPRDPPLPLTTQCRFFDPNNFFSAQFTTNVVYENNNNNNAAIESRFVNSRVAADPPKQRLKKSFYDSADFFPEPKHTVSVYGEIERRLRMRGINEPSKDLHTLKHILEALQLKGLLHSNNKPNQSPIVVMKPVRSVNRTGNDYSPRSSPRRSPRVTNEARRSEQNERNVRGQGRTLSSSPNRRKQEPQRRVGVDSRRVSPVNSPKVSPRRNANATCQHVPSGSPRMMRKNIERKEKVLLGGAEDESSTVSDNSFSTCSYPDTERYRSEEYMEGKDLLDRCDKLLNSIAEITAANELQPSPVSVLDSSFYKDEWASPSPITKRCIDYKVDSLSSPSPKIPPMWTNHLIPGMLTWHDLVGLIHLPQNCTALHCDHAAESEDDMWSAALCSSEEAASEDCDFAYVWEILRACTYLPEESDIFLLLEKQQCLKGKDTSKASTLQRRLIFDTLQEILNRNQQLPPWKAVSCGEQRQQIWSEFRRIREREEAESEDLFKVICGVLKKDMADEMRGWGEWPVEMGDVVLDIERLVFKDLVGETIRELASFSPQSQCNNKLQLPALRRKLVF

SEQ ID NO: 166730 - protein, 117 aa, Glycine max
  Coding DNA Sequence Number=SeqID_49952
MVFMDQTVCLLRFHTVMDYTHFSCFLALITFIVNSYKVQRLVPLFGNNCLLNLSHSCVVVLHMSFRTLRLLRIILNTNDGEMIMTVWEEYALQLDDAIEKHHIDRKPLVVMLTLAKI

SEQ ID NO: 166731 - protein, 419 aa, Glycine max
  Coding DNA Sequence Number=SeqID_49953
MEMEEAETIDLYELQYSDLSSPSTSSIVDSIMEALGPTGPGLLAVTNVPNASNLRSHLLPLARNLALLDRESRKLVLKEHNLGSDVPLRNPDRTVSSFAMQLKYAKSQHVQQTVSECYGMEFENLGSSFKELGLCMMELGLCLARICDKAIGGNELEQSLLDSCAAKGRLIHYHSHLDALLLKQLERSKATSKRRAGNIKPLEGLESNSIAHDANSGGIHSNLWQQWHYDYGIFTVLTTPLFILPSYLETSKTEDPFPASCFDECPSPTRHTCLQIYDPNKKRAIMVNAPPESFIIQVGEAADIISKGKLRSALHCVHRPSKFENLSRETFVVFLQPAWTKTFSISDYPHANSSFNGQCLVATDEEQQQSGQDSDNLSQEINKIVPPLSSRLKEGMTFAEFSRETTKQYYGGSGLQSNR

SEQ ID NO: 166732 - protein, 564 aa, Glycine max
  Coding DNA Sequence Number=SeqID_49954
  Gene Ontology: Mol. function=protein serine/threonine kinase activity; Cellular component=calcium- and calmodulin-dependent protein kinase complex; Biological process=protein amino acid phosphorylation
  Homolog annotation: Hit_ID=Q1SMH9; Match level="QueryCoverage=99%, HitCoverage=99%, E-value=0.0, Identity=67%"; Hit description=Protein kinase
  Pfam annotation: Domain name=Pkinase; Domain location=4-248; Score =143.6; E_value=5.4e-40; Accession=PF00069.15; Description=Protein kinase domain
  Pfam annotation: Domain name=Pkinase_Tyr; Domain location=4-256; Score=-43.4; E_value=8.3e-10; Accession=PF07714.7; Description =Protein tyrosine kinase
  Pfam module annotation: Pfam domain module=Pkinase::Pkinase_Tyr; Domain location=4-248::4-256
MEQYEILEQIGRGSFASALLVRHKHENKKYVLKKIRLARQTDRTRRSAHQEMELISKVRNPFIVEYKDSWVEKGCFVCIVIGYCEGGDMTEAIKKANGVHFPEERLCKLLVQLLMALDYLHANHILHRDVKYPILMLCMLDVGDFGLAKMLTCDDLASSVVGTPSYMCPELLADIPYGSKSDIWSLGCCVYEMAAHKPAFKALAAELLNHPHLQPYILKIHLKLNNPRRSTYPFPWSDSNYVRRTQFVEPGSVSTLSDRGKRFSFSNDRALNPSISGTELGSVCSTQRALGFSTCSKEKHYELSVGRVHKECNSNKSRDTKSSTVDRMPRLRTAKEYATPRWQTIPSKISHTGSKRELLPSTPGCKFTLPTRRASLPLPTRTTGMITSYRANVGLLRGVDSPDISVNAPRIDKIAEFPLASCEDSLFPVCGTSSTSAQCSSGSPKSADCLITQDKCTIQVVDKASVPSSGSDACPAAPVSHGNECSEHAISSHSSAESRKHRFDTSSYQQRAKALEGLLEFSARLLQQQRFEELGVLLKPFGPEKVSPRETAIWLAKSFKETVA

SEQ ID NO: 166733 - protein, 309 aa, Glycine max
  Coding DNA Sequence Number=SeqID_49955
  Homolog annotation: Hit_ID=Q75GL2; Match level="QueryCoverage=94%, HitCoverage=64%, E-value=2e-54, Identity=41%"; Hit description =Expressed protein
  Pfam annotation: Domain name=DUF828; Domain location=1-154; Score =42.4; E_value=2e-11; Accession=PF05703.2; Description=Plant protein of unknown function (DUF828)
  Pfam annotation: Domain name=PH_2; Domain location=194-304; Score =230.5; E_value=3.7e-66; Accession=PF08458.1; Description=Plant pleckstrin homology-like region
  Pfam module annotation: Pfam domain module=DUF828::PH_2; Domain location=1-154::194-304
MSGATGNATPCSGPKTVGRWLKDRREKKKEENRTHNAQLHASISVAAVAAAVAAVTAATAASSAADKDDKMAMAVASAATLVAAQCVEAAEAMGAERDHLASVVSSAVNVRSHDDITTLTAAAATALRGAATLKARALKEVWNITAVTPIESGIGIGICGKGNNSNSSTSDSGEIINGEIFLGACSQELLARGTALLKRTRKGDLHWKIVSVYLHRTGQVMLKMKSRHVAGTITKKKKNVVLDVCINLPAWPGRHLFDDSEERRYFGLKTEARGIVEFECRNQREYDTWTQGVSRLLSMVASRQNINGV

SEQ ID NO: 166734 - protein, 93 aa, Glycine max
  Coding DNA Sequence Number=SeqID_49956
MFFLCTVVYHDTENQATDAYRVLRVMVHRILAPVSSQFLYFWHNQLFWPHLVRLDTRMSMYIHNNTVIFCALSLQHLLLFTRTSSVTEDTESE

SEQ ID NO: 166735 - protein, 89 aa, Glycine max
  Coding DNA Sequence Number=SeqID_49957
  Gene Ontology: Mol. function=protein serine/threonine kinase activity; Biological process=protein amino acid phosphorylation
  Homolog annotation: Hit_ID=Q01C45; Match level="QueryCoverage=93%, HitCoverage=5%, E-value=3e-11, Identity=41%"; Hit description=[Q] KOG1208 Dehydrogenases with different specificities
MELCILIPGISRSSSSSKKYQKVGVSPASWKCSEEFFSRQIRNRDPLKIGFSNIWALRLVRHLLHWDPEDRPSIDEALQHPYFQHPPRE

SEQ ID NO: 166736 - protein, 886 aa, Glycine max
  Coding DNA Sequence Number=SeqID_49958
  Gene Ontology: Mol. function=binding; Cellular component=thylakoid; Biological process=ethylene mediated signaling pathway
  Homolog annotation: Hit_ID=Q1SMH2; Match level="QueryCoverage=99%, HitCoverage=100%, E-value=0.0, Identity=82%"; Hit description=BTB/POZ
  Pfam annotation: Domain name=BTB; Domain location=172-279; Score= -2.7; E_value=0.0072; Accession=PF00651.21; Description=BTBPOZ domain
  Pfam annotation: Domain name=TPR_1; Domain location=380-413; Score =5.1; E_value=1.3; Accession=PF00515.18; Description=Tetratricopeptide repeat
  Pfam annotation: Domain name=TPR_1; Domain location=509-542; Score =5.7; E_value=1.1; Accession=PF00515.18; Description=Tetratricopeptide repeat
  Pfam annotation: Domain name=TPR_1; Domain location=709-742; Score =29.6; E_value=1.1e-05; Accession=PF00515.18; Description =Tetratricopeptide repeat
  Pfam annotation: Domain name=TPR_1; Domain location=805-838; Score =6.2; E_value=0.97; Accession=PF00515.18; Description=Tetratricopeptid e repeat
  Pfam annotation: Domain name=TPR_1; Domain location=840-871; Score =6.0; E_value=1; Accession=PF00515.18; Description=Tetratricopeptide repeat
  Pfam annotation: Domain name=TPR_2; Domain location=380-413; Score =2.7; E_value=16; Accession=PF07719.7; Description=Tetratricopeptide repeat
  Pfam annotation: Domain name=TPR_2; Domain location=509-542; Score =7.9; E_value=4; Accession=PF07719.7; Description=Tetratricopeptide repeat
  Pfam annotation: Domain name=TPR_2; Domain location=601-634; Score =1.0; E_value=25; Accession=PF07719.7; Description=Tetratricopeptide repeat
  Pfam annotation: Domain name=TPR_2; Domain location=635-668; Score =5.4; E_value=7.7; Accession=PF07719.7; Description=Tetratricopeptide repeat
  Pfam annotation: Domain name=TPR_2; Domain location=709-740; Score =11.9; E_value=1.3; Accession=PF07719.7; Description=Tetratricopeptide repeat
  Pfam annotation: Domain name=TPR_2; Domain location=741-774; Score =13.8; E_value=0.61; Accession=PF07719.7; Description=Tetratricopeptid e repeat
  Pfam annotation: Domain name=TPR_2; Domain location=805-837; Score =5.2; E_value=8.2; Accession=PF07719.7; Description=Tetratricopeptide repeat
  Pfam annotation: Domain name=TPR_2; Domain location=838-871; Score =18.5; E_value=0.023; Accession=PF07719.7; Description=Tetratricopepti de repeat
  Pfam module annotation: Pfam domain module=BTB::TPR_1::TPR_1::TPR _1::TPR_1::TPR_1::TPR_2::TPR_2::TPR_2::TPR_2::TPR_2::TPR_2::TPR _2::TPR_2; Domain location=172-279::380-413::509-542::709-742::805 -838::840-871::380-413::...
  Pfam module annotation: Domain location=509-542::601-634::635 -668::709-740::741-774::805-837::838-871
MRTFFTAESCKETQPNALNPQSWLQVERGKLPKLSSQSSSASIESLIKVPQSPILPFFKPVDYVEVLAQIHEELESCPPQEKSNLFLLQYQVFKGLGDVKLMRRSLRSAWQRANTVHEKIIFGAWLKYEKQEELVAQLLTACGKCEKEFGPIDVESQIPFDENVRSQDRASMNGNNASEYVIFKIGDEKIVCDRQKISELSAPFHAMLKGCFRESLSETIDLSENNLSPSGMRAISYFSSTGSLLDVPPNLLVEILAFANKYCCERLKQACDRRLASLVSSREDALELMEYAVDQNSAGLAASCLQVLLRDIPNCLSDNQVVELFIHANKQQLAVMVGPGIFALFCFLSEVSMNLNSSSDTTAHFLERLVDFAENDKQRLLAFHQLGCVRLSRKEYDEAYCLFERALNVGHVYSVAGLARLDSIKGEKLLSYEKISSVISSDTPLGWMYQERSLYCDGDLRQKDLEKATELDPTLIYPYMYRTASLMKTGNVQGALAEINRILGFKLSLECLELRFFIYLALEDYKAAVRDVQAILTLCPSYKMFEGRVAASQLCTLVREHVEHWTTADCWARLYDCWSAVDDIESLSVIYQMLESDAAKGVLYFRQSLLLLRLNCPEAAMRSLQLAWQHASSEHERLVYEGWILYDTGHCEEGLQKAEESISIKRSFEAYFLKAYALADSSVDSSCSSTVISLLEDALRCPSDNLRKGQALNNLGSVYVDCGKLDLAEDCYIKALKIQHTRAHQGLARVHFLKNDKAAAYKEMTNLIEKARNNASAYEKRSEYGDRDLTKADLEMVTRLDPLRVYPYRYRAAVLMDNHKEEEAIAELSRAIAFKADLHLLHLRAAFHEHNGDVLGALRDCRAALSVDPNHQKMLELHCRVNSHEP

SEQ ID NO: 166737 - protein, 796 aa, Glycine max
  Coding DNA Sequence Number=SeqID_49959
  Gene Ontology: Mol. function=protein phosphatase type 2C activity; Cellular component=protein serine/threonine phosphatase complex; Biological process=protein amino acid phosphorylation
  Homolog annotation: Hit_ID=Q8LAY8; Match level="QueryCoverage=34%, HitCoverage=61%, E-value=4e-21, Identity=29%"; Hit description =Protein phosphatase 2C-like protein
  Pfam annotation: Domain name=PP2C; Domain location=66-433; Score =155.3; E_value=1.6e-43; Accession=PF00481.12; Description=Protein phosphatase 2C
MIPKTPSRHLLLALGFLLCATIPFVHGESSTCLTVYKNGGAPAVFQSPKCPRWKLSDYDSPPQTTARCQTAMLQGRRNSQEDRALCVLDVRIPFPGPNGIKEVAVGIVAVFDGHNGAEASEMASKLLVEYFVLHTYFLLDAAFSVISKTSTETLLHKRDRDHVNLLHRWKEILGLEWHELHFERFQNTFSPNFDDSFHLEILKEALLRAVHDIDAKFSEEASRNNLHSGSTATVVLVADDKILVANIGDSKAILCSENFQSPREAKGEKDYELQKEHDGSVSVWDREKYRLVSSHGLTHFAVKELTSDHHPDRDDERIRVETAGGQVQNWGGVPRINGQLAITRAIGDVLFKSYGVISAPEVTDWQPLTANDSFLVVASDGVFEKMSVQDVCDLLWEVHRFSNMRSECTPASSYSLADLIVNTAFKKGSMDNVAAVVIPLESAKSSANSLRGSYSGKRDADFPLFGQQETASKSSVKDGDFGCFYLSENLDEPEDSKQIAKKTDWEDYLYELPQPLPDALHQHATPGGPVNLYNSQNFCFHLGPTISEAEDQCINPEGFASFIGLLESIPLHDTGSSNGSADYSMPDLRYVLKKSFGRGSYGEVWLAFHWNCNQDSNSAKMSKDDKNTTSSSTASDCQDGSTNYTLTAFNGFSGLPLCICKHVAEITLKCTTQVERGSAVYLSGLREKYFGEIFLNASTCFEDPLSAGKSNCVLETSQFGPEKSFPNKFRLQRTTYEEGLSLSKLLYAVEDAYGTAEKERLEQAKHVQILRPSKWWHWLKTAEEGQAEMRNLIWQL

SEQ ID NO: 166738 - protein, 125 aa, Glycine max
  Coding DNA Sequence Number=SeqID_49960
MNQLFKLILFYFEVTTLIEVAGESRDDDNNENNGGVNGMVMVTMTTVVGVEECQQQCALKPGLTLIGWINLTMTERFGQYDPIEFVVKPATDPGQVMPKGGNTLGHAVQLSDNCDDNDDGGTERW

SEQ ID NO: 166739 - protein, 813 aa, Glycine max
  Coding DNA Sequence Number=SeqID_49961
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=90%, HitCoverage=55%, E-value=0.0, Identity=53%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Subcellular localization annotation: CTP_CleavageSite=40; ConfidenceScore=5.27e-01
MNLMNSVNWKVLCMMLTRPYTPQHNGATERRNRTMMNMVRCMLNGKKLPKFLWAEAVSTAVYVLNRSPTKRLNKITPEEAWSGRKPVVSHFKIVGSICYKHVPDQLRKKLDSKSEIMILLGYHATSGYKLFNPVTKEVLVSRDVVVDESKDWNWDKEMVEEPTKVVIEASIDEPSDSSAVVIDDSDQGGVRKSQRVRQPSSRLQDYELIHDSTIGEEGELVHLALFAESESVSLEEAMNDTKWTDAMKEKLKAIEKNNTWQLVALPAKKKPIAVKWVYKVKKNSKGEISKYKARLVAKGFLQKADIDFKEVFAPVARMETVRIITAITSQKGWHMHHMDVKSAFLNGPLEEEVYVSQPPGFEIKGSEEKVYRLNKALYGLKQAPRAWNMRIDGFLVKLGFLKCTTEHGVYIKGSNTTNLTVVCLYVDDLLVTGNNEIEIANFKGEMMREFEMTDLDLISYFLGIEFKRTDEGVIMHQGRYARDVLKKFRMVDCNSADTPTATGVNLVKDPNEEEVDVTLYRQMVGSLRYLCCTRPDLLYDVGLISRYMENPKLSHFRAAKRIMRYVKGTLDYGIMFPSAAKKCNVLGYSDSDWCGDKSDGKSTTCYVFFYGDAPISWSSKKEQVVALSSCEAEYIAAAMAACQAQWLDNIFGELKMKEKGAITLMVDNKSAINLAKHPVAHGRSKHIETRFHFLREQVTKGKLSVKYCPTTVQVADIFTKPLKIDQFKELRSRLGVIEVTFFQAATKQKCNKRREGCVSGSHSESWMVRMASHFGSVANLRVLASGHQMKHIRQQKWCVSRQQGERSEAWFGG

SEQ ID NO: 166740 - protein, 562 aa, Glycine max
  Coding DNA Sequence Number=SeqID_49962
  Homolog annotation: Hit_ID=Q6K796; Match level="QueryCoverage=89%, HitCoverage=11%, E-value=1e-124, Identity=49%"; Hit description =Vacuolar protein sorting 13C protein-like
MEPLPWLLAHAKVESVKSKVAAEERKIKKKSWFSFKWRDSDMEESSLDDASEEQQLREEWQAINKLLSYQPEEELMLRSAKDMQNMVQFLVTVSVGQAAARIMSVNQEEIVCGRFEQLHVSTKFKHHSVYCDVLLKFYGLSAPEGSLTQSVYSEQKVNALVASFVHLPIGENIDWRLSATIAPCHVTVLMESIDRVLEFLKRSKAVSPTVALETATALQGYAEGPESIESGVMSIFCFIDLYFCFAVCLGVIFSFSHMKFEKVTRRAQEQFQMVLEKQSRFAFDIDLDAPKVRVPLRTSGSDLCDSHFLLDFGHFTLHTAESQSDEKRNLYSRFYISGRDIAAFFTDCGSDFGSCSMVKSSVDSQVMNSPIAKKDENAYYLIDRCGMAVLVNQIKVPHPSYPSTLISIQVPNLGIHFSSERYFRIMELLSLLYETMENCSQPTTDNFQSKVVPWSPVDLATDGRILIWKGIGNSVATWNPCFLVLSGSYLYVFESAKSQNYQRYLRASVLCIFGLMFLETLSPTYLVVPLEFNGLRSELVTETWIYNNTWEKSESNLSCMDW

SEQ ID NO: 166741 - protein, 88 aa, Glycine max
  Coding DNA Sequence Number=SeqID_49963
  Gene Ontology: Mol. function=protein dimerization activity
  Homolog annotation: Hit_ID=Q1RZI3; Match level="QueryCoverage=86%, HitCoverage=96%, E-value=2e-18, Identity=56%"; Hit description=HAT dimerisation
  Pfam annotation: Domain name=hATC; Domain location=1-49; Score=0.8; E_ value=0.026; Accession=PF05699.5; Description=hAT family dimerisation domain
MIARYFLAIPISTIPSESSFSTFGRILAPYHSRLHIDTLEALMCLQGWLWTDMKSSTKLKVDKMLLQEVSEEIEVDDEQVTKVRLFEE

SEQ ID NO: 166742 - protein, 41 aa, Glycine max
  Coding DNA Sequence Number=SeqID_49964
MKLYCCVSMVQIAVTHGEVMDVMEWMVNVQDHMVVVPPPVE

SEQ ID NO: 166743 - protein, 139 aa, Glycine max
  Coding DNA Sequence Number=SeqID_49965
  Homolog annotation: Hit_ID=Q00TN0; Match level="QueryCoverage=45%, HitCoverage=6%, E-value=3e-09, Identity=50%"; Hit description =Homology to unknown gene
MIVRKNKPSAKSLLVLFIMVLAFFFVTYNLVFMIKHHKGGSWVADELGFLDPLIRNIPGKVMVLANSNSKFHVAVTATDAAYSQWQCRIMYYWYKKVKDMPGSDMGKFTRIVHSGRPDQLMDEIPTFVVDPLPAGLDRA

SEQ ID NO: 166744 - protein, 194 aa, Glycine max
  Coding DNA Sequence Number=SeqID_49966
  Gene Ontology: Mol. function=ubiquitin thiolesterase activity; Biological process=ubiquitin-dependent protein catabolic process
  Homolog annotation: Hit_ID=Q7EZJ0; Match level="QueryCoverage=66%, HitCoverage=11%, E-value=2e-15, Identity=36%"; Hit description =Putative ubiquitin-specific protease
  Pfam annotation: Domain name=MATH; Domain location=64-186; Score =56.5; E_value=8.6e-14; Accession=PF00917.16; Description=MATH domain
MKAEWGIDQFIPLRDFNLASKGYLVDDTCAFGAEVFVCKERSTGKGECLVMMKEAILYKHLYEFDNLSKLDLECYDSKPFNAGNFKWKIKLYPKGKGAELGNYLSLYLALADPSALSPCSKIYAQITLRILDQKQAKHHFGKANYWFSASSHENGAAIFMPINNFTNQNFGYVVKDSCFVEAEVIILGVVDALS

SEQ ID NO: 166745 - protein, 216 aa, Glycine max
  Coding DNA Sequence Number=SeqID_49967
  Gene Ontology: Mol. function=methionine adenosyltransferase activity; Cellular component=cytosol; Biological process=one-carbon compound metabolic process
  Homolog annotation: Hit_ID=P17562; Match level="QueryCoverage=99%, HitCoverage=72%, E-value=2e-91, Identity=85%"; Hit description=S -adenosylmethionine synthetase 2
  Pfam annotation: Domain name=S-AdoMet_synt_M; Domain location=117 -201; Score=78.7; E_value=1.8e-20; Accession=PF02772.6; Description=S- adenosylmethionine synthetase, cent
  Pfam annotation: Domain name=S-AdoMet_synt_N; Domain location=3-102; Score=217.3; E_value=3.5e-62; Accession=PF00438.10; Description=S -adenosylmethionine synthetase, N-te
  Pfam module annotation: Pfam domain module=S-AdoMet_synt_M::S-AdoMet _synt_N; Domain location=117-201::3-102
MAETFLFTSESVNEGHPDKLCDQISDAVLDACLEQDPDSKVACETCTKTNLVMVFGEITTKANVDYEKIVRDTCRNIGFVSNDVGLDADNCKVLVNIEQQSPDIAQGVHGHLTKRPEEIGAGDQGHMFGYATDETPELMPLSHVLATKLGARLTEVRKNGTCPWLRPDGKTQGPHGDAGLTGRKIIIDTYGGWGAHGGGAFSGKDPTNVDRSGAYI

SEQ ID NO: 166746 - protein, 83 aa, Glycine max
  Coding DNA Sequence Number=SeqID_49968
MSHRVSKLKGLKLELSEDLTVHLVLISLLVQYSKFKERRKRERDLRLQVVQIKRNMSLTRISVSFIRNLDIKRRIVPDITPKV

SEQ ID NO: 166747 - protein, 70 aa, Glycine max
  Coding DNA Sequence Number=SeqID_49969
MKNKKMKEGAKTTIFQTMQCITDNFILDQKQAVVSLYRNLIVSRKQSSMTENKIMASLGEQLGISKEQLM

SEQ ID NO: 166748 - protein, 131 aa, Glycine max
  Coding DNA Sequence Number=SeqID_49970
MDDRDRVDESGHLVQYSCLMYRLSNPLYSSGASSHKMINTIKIEKFTWNNSFNLRRIKMKALLKEQGIWAPPSSQSFKIDKSVLELQEKKTHSLILLSLFDEVLYEELTTIRLWLKLEKLFMTKSICKICL

SEQ ID NO: 166749 - protein, 71 aa, Glycine max
  Coding DNA Sequence Number=SeqID_49971
MDTIFYFDDIMLEEMEKQREDKAVKDVDTDPLQMVIPSSPQKRKKTKKLKSKKRILNATMTIGSSHGNRLH

SEQ ID NO: 166750 - protein, 164 aa, Glycine max
  Coding DNA Sequence Number=SeqID_49972
MVVTSSLSCLCFFGLDLLVEALRELMLLLLKALLRAKFGEQWRLALEGGIIVKGGGERVTASGREEGSDKEKKERKKEKTKLIYVLLLVESIFHVGLESPNPYAKPKKLSTELKKLDESRSCEEQGKVSEVAPCGACSPCIFFNNGFPCFFKINGSGMENKKDD

SEQ ID NO: 166751 - protein, 753 aa, Glycine max
  Coding DNA Sequence Number=SeqID_49973
  Gene Ontology: Mol. function=structural constituent of ribosome; Cellular component=intracellular; Biological process=translation
  Pfam annotation: Domain name=DUF1666; Domain location=522-751; Score =249.3; E_value=7.9e-72; Accession=PF07891.2; Description=Protein of unknown function (DUF1666)
MGSRNLVMVKTHIGSINVSFANGFVYENVLWALPSLCVFFCSYVLYSLGLILRYIFRFHVEDRKSEHLVPHDLLDQTKRYRIEDSKVDGFAEELANLFSVLKELEEEIEFSVLEEKDSDMHEDSNEREGEACESVFLETVAYVHEDVKKIGENETESFVFMEDDSNTPQDNKEKVEEEKTEESFFTDTDSVEASSLVEEPRILTFSFQQNYIAANDSDNIFSRTENIAKMEFPEKNLEKALVAQEEKEQFVQDERSITSNSTFGQIFQINAVGGSDSSNDDHLQHDNTLQYDFGSESCSSGIDDSVSHKDERVEDGEETQYSWDSEVSYNHNFHLDENKDVMEGSSYCGEEECRGSMEKTKETMWEDNLDESDFDEEEDEDEDDFEWEHDEVLEQLKMELKNARQGGLATILEEEEEEETESPKVVEDRKPLKIEEKKEFKDHIVEIQKVYRCYAEKIRKLDVLNYQTMHAIGLLELKDPLKLMLIPKSTVQSAKPLSQNLWPRKTQKQISDPMLKFVQELHGDLELVYVGQVCLSWEILCWQHKRVQVLKQCDSQWPRSYNLVAGDFQLFQVLMQRFLEDEPFQGPRIRNYVKNRCLIRNLLQVPVIKDDNTKDKKIIKLGEEHAIDSERLEQIIKESMRVFWEFVRADKDYGNVIKVFHQTGIHVKDPAISDLLGNVRTQLQKKERKLKDTVRSGNCIVRKFLKHNEEQIQLDQEQLLAQVGLRLVSREGPGGAFFFVFSLLIDSSGPATV

SEQ ID NO: 166752 - protein, 358 aa, Glycine max
  Coding DNA Sequence Number=SeqID_49974
  Gene Ontology: Mol. function=DNA binding; Cellular component=nucleus; Biological process=regulation of transcription
  Homolog annotation: Hit_ID=Q1SMW7; Match level="QueryCoverage=73%, HitCoverage=72%, E-value=4e-48, Identity=40%"; Hit description =Homeobox domain, ZF-HD class; ZF-HD homeobox protein Cys/His-rich dimerisation region; Homeodomain-related
  Pfam annotation: Domain name=ZF-HD_dimer; Domain location=60-121; Score=143.0; E_value=7.9e-40; Accession=PF04770.3; Description=ZF-HD protein dimerisation region
  Subcellular localization annotation: CTP_CleavageSite=59; ConfidenceScore=5.64e-01
MDLTSISTHNTNTTQTLDAANTTTKTTPPTPIPTTTPKSLSFANGTLKRHPTTTVAQPPSMVVSYKECLKNHAASIGGHALDGCGEFMLSSSTVPSDPRSLKCAACGCHRNFHRREPQENNLNNNLKNNNPTFLNCIYTLSAPAPLSHRAMSQSTSPSLSSSPSHSQSPISSPSPPPLSHVPPYHASAPHMLLALGSAYSAEPSDEHHHHQQQQHKSFNLSMMRSENPTKKRYRTKFSKEQKEKMHSFSEKLGWRMQKGDDGLVQEFCNDIGVSRGVFKVWMHNNKNTFRKKSEDGNGNANAPQSNDDDNANGGGGGFDSDINNPYNPNSNNNDIHMKEVDDACVNNVVHVSLNEMSS

SEQ ID NO: 166753 - protein, 89 aa, Glycine max
  Coding DNA Sequence Number=SeqID_49975
MLTNNGPQTKLGYDTPNEGRSQVQPVKSSFYSRKLRLKAYGDGDEAYASGLSVTSFAKRKKKKKGNAGKKNKVDPKDIYNYCKEPGHWK

SEQ ID NO: 166754 - protein, 159 aa, Glycine max
  Coding DNA Sequence Number=SeqID_49976
  Gene Ontology: Mol. function=nucleic acid binding; Biological process= DNA integration
  Homolog annotation: Hit_ID=Q0PEL6; Match level="QueryCoverage=83%, HitCoverage=10%, E-value=8e-20, Identity=31%"; Hit description =Putative integrase
MDFKQITFKEGASLNRPPLFDGGHFSFWQKRMKIFIQSIGLSAWNAIVKGSFISTKVVNGELVPKEWDEMKDDEERKEIWEMLEVTHEGIADVRRERKQTLVSKYEAFQMQNSEPILELQTRFTHIVNHLLDIGKMFEYDELNITILNYLQELGNQKSQ

SEQ ID NO: 166755 - protein, 203 aa, Glycine max
  Coding DNA Sequence Number=SeqID_49977
MLVSKNVNSSWVVELSELSGLSPMLDLGKYLGAVIETLPTYTMHVTLLPMSVCTKLERMAKDFVWGHDSESRRWHTIAWESFCHPKKDMRMGLKHGKYGYSSLGLPEVKGVAGCSEGWRSMPSSVVIEKLVPNFLSRQQLGHLCSLILCIKFGYRETRLSSRGRDFATILVIVQSQSVGWSLVVDNRMVNVVLMACYSNGSIM

SEQ ID NO: 166756 - protein, 117 aa, Glycine max
  Coding DNA Sequence Number=SeqID_49978
  Gene Ontology: Mol. function=RNA-directed DNA polymerase activity; Biological process=RNA-dependent DNA replication
MKPYTPESIVNEIPSRSVICLLQIHLDSYKTFLLLHPTHRMKNFLSNDNFIQTMSPQDKTTLMWRNQLVQNTLHPFSYDLCYYFGPITRTMSKRLQEDWAKAAEEGPRVLMNLRVDF

SEQ ID NO: 166757 - protein, 210 aa, Glycine max
  Coding DNA Sequence Number=SeqID_49979
  Gene Ontology: Mol. function=RNA-directed DNA polymerase activity; Biological process=RNA-dependent DNA replication
MVVIPCRYVDEDTLLAARGGSDDKEVVLDDDTLDNVESIVDDPLCPTVVISREERRKMYEPWKRVIIIKVLGRKVSLNFLRARLARMCIPKGVMKGFSMGIWLLWDSFMVDMKIVGSHHQYIHTRIRLKLFYTFVYGSPNISSMDELWEEMIQLSTDRNDPWLAIGDFNVYPHPHEKSEGGPVNVYHAGFDDDKVLLKDGCHHQKGGECE

SEQ ID NO: 166758 - protein, 287 aa, Glycine max
  Coding DNA Sequence Number=SeqID_49980
  Gene Ontology: Mol. function=zinc ion binding
  Homolog annotation: Hit_ID=Q2R1L5; Match level="QueryCoverage=78%, HitCoverage=78%, E-value=3e-67, Identity=55%"; Hit description=Zinc finger protein, putative, expressed
  Pfam annotation: Domain name=zf-C3HC4; Domain location=67-112; Score =64.1; E_value=4.6e-16; Accession=PF00097.15; Description=Zinc finger, C3HC4 type (RING finger)
MNDHLVLFVDHLVRPVPVVEPLAQQPPEPVTPVNEAAVAGPSGSSPSAEDDGDDDGEDAPLLQLAECRICQEEDSVSDLETPCSCSGSLKYAHRKCVQRWCNEKGDIICEICHKSYEPGYTAPPPRPQPEETTIDIGGGWTISGMPLDLRDTRLLAIAEAERQFLEAEYDGYAASHASGAAFCRSVALILMALLLLRHALSVTDSEAEDDPSTFFSLFLLRAAGFLLPCYIMAWAISILQRRRQRQEAAALAATQVAFVLQTGQRRGLQFAIGPGPPTMNTHQPEQV

SEQ ID NO: 166759 - protein, 229 aa, Glycine max
  Coding DNA Sequence Number=SeqID_49981
  Gene Ontology: Mol. function=RNA-directed DNA polymerase activity; Biological process=RNA-dependent DNA replication
  Homolog annotation: Hit_ID=Q1T549; Match level="QueryCoverage=27%, HitCoverage=23%, E-value=1e-11, Identity=44%"; Hit description =Polynucleotidyl transferase, Ribonuclease H fold
MVGCSRKQTFNYIKDRMWKNMNSWRGKKLSMEMREIILKFVAHAILAYAMSIYLFSRLFGRLDIKVLETRKWTSLQNDVDVEAILANPLINSSMEDMRIWGEASNKRFSVKYGYRVVMERLADMSNSRILFIIWHIKVPHLEGKNHNAKGTTTLAKQSLVDWTVARNVIWSKPTEGYFKCNIDTGFHSQDQKTSWACCVCDNVGRFLVGKTSWSRPSPSIIEGEACGML

SEQ ID NO: 166760 - protein, 184 aa, Glycine max
  Coding DNA Sequence Number=SeqID_49982
  Gene Ontology: Mol. function=RNA-directed DNA polymerase activity; Biological process=RNA-dependent DNA replication
MLRSGWNEHSISKFNEVNARLTELMVQDDTYWRQRSKTLWLKDGGDFNMKLFHASTTTRRKRNHIDKLLKDDGIEVTSQEDIKEVVAYYFRHIFNGQVGLYEPVTNSVQSFLEPLLLRNLTGLLEVVAGRLCSKLWQHKVRGFIGKCVGEEQSAFTEGRSILDNVLIAVEIIHYLKSKTRGGNG

SEQ ID NO: 166761 - protein, 180 aa, Glycine max
  Coding DNA Sequence Number=SeqID_49983
MTQAIMKQGEETKKELRAYVEQQHIENNQYKLSMQQAISSQFTPIYLRCFSKIFKWLKIIETLLFLKVQQWLAKVVSSGEVGLAAAKNELVRIMLESIQHCQHGSQNHAGTGKQEDKLNIKKRRKNCSNEKKKRRRNMRQFFCQQPPLSSTNLSKFVDSRLTPGDHGVLCLTKIYLKKRN

SEQ ID NO: 166762 - protein, 602 aa, Glycine max
  Coding DNA Sequence Number=SeqID_49984
  Gene Ontology: Mol. function=protein transporter activity; Cellular component=nuclear pore; Biological process=protein import into nucleus, docking
  Homolog annotation: Hit_ID=Q9LUT8; Match level="QueryCoverage=84%, HitCoverage=34%, E-value=1e-124, Identity=44%"; Hit description =Arabidopsis thaliana genomic DNA, chromosome 3, P1 clone: MGD8
MAVTLAFLWHMVACKMSFKFCHFLQFLREQEPEFVTSLVRTRILPLYAIAVSLPYLVASANWVLGELGSCLPEEMSTDVYSQLLMALVMPDRQGPSCYPVRISAAGAITTLLDNDYLPPDFLPLLQVIVGNIGNDENESESSILFQLLSSIMEAGDEKVAVHIPLIVSSIVGPVSKWLTSNLEPWPQVVERAIAALAVMGQTWEDSRPEESESDESREKWATGKVAIARTFAALLQQAWLTPLCTLDQQDQQAPSSSSCIEDLSTLLQSVLLSIDGNHMIQELKVSELVSVWSEMIAEWHAWEESEDLSIFEVIKEIVNLDCRYKLKNFVVKEMPPPPAPPVPERSIVEGIGAFISEAIKQYPSATLRACSCVHILLHCPTYSPETEGVKQSLAIVFSQAAFSRFIEVQSTPSALWKPLLLAISSCYLCYPDIVEGILEKGEHGGIKIWASALCHVSNRSFEPGLTAEAEMKLVVMTLGRLIEQLLKQGNSGNEIQNCFTSLLEVSIQLKEAHDGKEDEQGSDDDENEDDEDEDEDSDNDDYDEDSGSDEYEETEEEFLNRYAKAAEALENGSAIEEGDDEDLELELELGGCITATKNKCLV

SEQ ID NO: 166763 - protein, 255 aa, Glycine max
  Coding DNA Sequence Number=SeqID_49985
  Gene Ontology: Mol. function=protein transporter activity; Cellular component=nuclear pore; Biological process=protein import into nucleus, docking
  Homolog annotation: Hit_ID=Q53QC6; Match level="QueryCoverage=97%, HitCoverage=23%, E-value=4e-64, Identity=53%"; Hit description =Expressed protein
  Pfam annotation: Domain name=IBN_N; Domain location=26-95; Score =17.4; E_value=0.001; Accession=PF03810.9; Description=Importin-beta N-terminal domain
MAEDLTHIAQLLDQTLSPDATAVRTATAALDLISLTPHFPFYLLSISTGGGNQGQKIAAATYLKNLTRRTVDSTGVKPSNVSKEFKEQLMQALLQVELSVLKILVEVFRAIAAADFVKQNLWPELVPNLQSAIQNSHLTSGSNTKWSTVNALLVLHALLRPFQYFLNPKVAKEPVPPQLELISKEVLVPLLAVFHQFVEKALATHGIAEKETEKVLLTICKCLHFAVKSYMPSTLGSSTAFILSGPNEHFELSEL

SEQ ID NO: 166764 - protein, 209 aa, Glycine max
  Coding DNA Sequence Number=SeqID_49986
  Homolog annotation: Hit_ID=Q9FGR6; Match level="QueryCoverage=86%, HitCoverage=57%, E-value=1e-21, Identity=33%"; Hit description =Arabidopsis thaliana genomic DNA, chromosome 5, TAC clone:K6A12
MVIYDPSMSTCSILQPHHDFEMTQVQSAIIPPSQDTVFVLLNCSIDSPVLNHYKYLCFNFAGHTCDELYGSCNAFRVFHLLTNSSPPCCFTSYSTVKFMSMNILDCTHYTSVFNTDNLKGVGPLDWVYGIKLSFSVPDTGCQSCKESGGTCGFDTDTEGLLCLCSSFANSTRECAAGSIISKGQNNAPWTHFLLVLLVVANFLTKVRLV

SEQ ID NO: 166765 - protein, 75 aa, Glycine max
  Coding DNA Sequence Number=SeqID_49987
MGHRKLQRIAGKNLQLKGPISRVVGRTRDLVQTLLLRTGVNQVLQTRVKHLVGKKQQMVVTLLCVSCLLSDDCPS

SEQ ID NO: 166766 - protein, 479 aa, Glycine max
  Coding DNA Sequence Number=SeqID_49988
  Gene Ontology: Mol. function=zinc ion binding; Cellular component =nucleus; Biological process=regulation of transcription
  Homolog annotation: Hit_ID=Q1SLX9; Match level="QueryCoverage=99%, HitCoverage=100%, E-value=1e-125, Identity=55%"; Hit description =Zinc finger, Dof-type
  Pfam annotation: Domain name=zf-Dof; Domain location=126-188; Score =138.4; E_value=2e-38; Accession=PF02701.6; Description=Dof domain, zinc finger
  Subcellular localization annotation: CTP_CleavageSite=46; ConfidenceScore=5.36e-01
MSEVKDPAIKLFGRTISLTHTHINDSSSSSAPARAPSSSSSPREVTSSATQQQHEPEEPSRKELTSSQDDDGSHQTTEDLKSPTTSSGIFENPKTPSPETETSVPKSSTNGEQSETSASDEKTPKKPDKVLPCPRCNSMDTKFCYYNNYNVNQPRHFCKNCQRYWTAGGTMRNVPVGAGRRKNKNFPATASHYRHLMFPEGLQGATLNAPNGLHNAVLGNGAAVLTFGPDSPLCDTMASMLNIAERAQSCVPNGFQATEPNSFVSYRKEEDGSTSGHSTGVSVATTSTSSHSGSHESVDKRVEGFTPQLPYFPSGPWPYPMPPPTFCPPGYPLSFYTTPAYWGCMPPSWNNNISSISPQSSVNNSVSVLTLGKHSRDGNIIAPSNSQREMHDMEHKSSEHNVLIPKTLRIDDPSEAAKSSISMWSKLGIKDDKAGSGGLFKAFPSSKGNDMNHHMVEASPLLQANPAALSRSLTFREQT

SEQ ID NO: 166767 - protein, 114 aa, Glycine max
  Coding DNA Sequence Number=SeqID_49989
  Homolog annotation: Hit_ID=Q47336; Match level="QueryCoverage=40%, HitCoverage=52%, E-value=2e-20, Identity=100%"; Hit description=LacZ- alpha peptide
  Subcellular localization annotation: CTP_CleavageSite=23; ConfidenceScore=5.15e-01
MSKNLIPCSFAKLLNISWRPLIRSFGLGVAWSRTKATFAESHTLSLSKWDPRVPSSNSPYSESYYNSLAVVLQRRDWENPGVTQLNRLAAHPPFASWRNSEEARTDRPSQQLRS

SEQ ID NO: 166768 - protein, 101 aa, Glycine max
  Coding DNA Sequence Number=SeqID_49990
  Homolog annotation: Hit_ID=Q47522; Match level="QueryCoverage=49%, HitCoverage=62%, E-value=3e-19, Identity=88%"; Hit description=LacZ protein
AIRHSAAQLLGRAIGAGLFAITPAGERGMCCKAIKLGNARVFPVTTLVWDSAKVAFVLDHATPSPNERISGLHDMLRSFAKEQGIRFFDIGEGWDPLESTC

SEQ ID NO: 166769 - protein, 464 aa, Glycine max
  Coding DNA Sequence Number=SeqID_49991
  Gene Ontology: Mol. function=DNA binding; Biological process=DNA methylation
  Homolog annotation: Hit_ID=Q9LUU0; Match level="QueryCoverage=83%, HitCoverage=54%, E-value=2e-94, Identity=45%"; Hit description =Arabidopsis thaliana genomic DNA, chromosome 3, P1 clone: MGD8
MDLYGTAEVKVEGFSHEPPQSSQVNLEETYNDDMVKEEEGIDAFPSNVSDQYLDVVENGRGKRPKYEHDDDPVNCLEPSWVEERVDAVVAEMSRHPKPNPSRCLSSVAAKPPFFLFGNVSNISYDSWTKMSQFLYGIEPEFANAQSFSAMDRIEGYIHNLPVENRFHILPKPPMTIEDAMPQTKKWWPPWDSRKLLSSIYCETNGIAQTCDRLGNFLADSGGVLTSEQQKDILRYCRRLNLVWIGKFKLGPVEPEQLELILGYPLNHTRATEGNVAERLKSLKYCFQTDTLGYHLSVLRPIFPHGLTMLSLFSGLGGAEIALHRLAIKIKAVVSVETSETKRKILEKWWRQSGQTGTLVQIEDIQKLTSKKLEGLISKFGGFDLVIYQNPCSYSSSRLQAGVGLSALDFSVFCECVRVLQRVRVNIGDFGTFLLSFYETNVSQLARCDDGQSLNKQSSLDRLKN

SEQ ID NO: 166770 - protein, 103 aa, Glycine max
  Coding DNA Sequence Number=SeqID_49992
  Gene Ontology: Mol. function=DNA binding; Biological process=DNA methylation
  Homolog annotation: Hit_ID=Q9LUU0; Match level="QueryCoverage=76%, HitCoverage=10%, E-value=2e-14, Identity=45%"; Hit description =Arabidopsis thaliana genomic DNA, chromosome 3, P1 clone: MGD8
MAGNPNRREGKTVMVPKTENLDYELPPYTSFSGDVGDNVASSSGGKLRAFFIGMGFLPCLVDKVIEENGEENSDILLEALLRYSREDMHIHEGFKLSFYKHSP

SEQ ID NO: 166771 - protein, 709 aa, Glycine max
  Coding DNA Sequence Number=SeqID_49993
  Homolog annotation: Hit_ID=Q9LUT8; Match level="QueryCoverage=91%, HitCoverage=39%, E-value=1e-122, Identity=44%"; Hit description =Arabidopsis thaliana genomic DNA, chromosome 3, P1 clone: MGD8
  Pfam annotation: Domain name=YTH; Domain location=432-526; Score =194.1; E_value=3.4e-55; Accession=PF04146.6; Description=YT521-B -like family
MTVCSGSSSGMEMYDVSQTRNADAYLIEGTDLNSHLTSPNIQQFQAMFNDGAPEFVVDQNLYYPAATNYGYYCTGFESPGEWEDHHRIFGVDGPDIQYTGAQNESFPYIYYTPSYGFAQSPYNPYNPYIPGAMIGVDGSFGGAEQYYSLPNYQNPISSHAYIPLVQPDNFPNSSVDSLFDTRASVSRPDGKGLKPKFNSASVSFTRNSSKSLSNPTSSLPRISEGPRDYTGVKKDMTSGRGFLNMASSPVHQARSIDASTHPVDTISNGNVLSHHNQLKIASSLSSGFSDYGSNANGQSVVAKLRPKVHIGKGLSDVNGSSDVLGEQNRGPRISNCKSKFPLAVKAYTNIGDGNTQENIIISTDQYNREDFPVNYENAKFFVIKSYSEDDVHKSIKYNVWSSTPHGNKKLQSAHEDAKRIASGKFGSCPIFLFFSVNASGQFCGVAEMIGPVDFNKDMDFWQQDKWSGSFPVKWYIIKDVSNANFRHIILENNENKPVTNSRDTQEIFKGIMYSKGLEMLKIFKNHHLKTSLLDDFIYYENRQKIMLEEKTKLLIRSFENPLMLPTLEPPRKLNFVVDIPPVSVEKKAKMDDEFDSLKQTSSAGHIVSSSEVTSTASVDEKAEKGSVEKEDIASVLKIGSVTITPKQVETKPSGISVANKEPLDVITVGSMQVKVNGFAESSGLLKIGSIPLDPRTLQLDGGTRVKNGS

SEQ ID NO: 166772 - protein, 82 aa, Glycine max
  Coding DNA Sequence Number=SeqID_49994
MEACLAVKDLLQQMMDQGRLEVSNEGGEEQHIYMQSTDEECLRKPKPLVVYFTIDAAPQEPQFPSVVRPILFPYQNNHVVSW

SEQ ID NO: 166773 - protein, 83 aa, Glycine max
  Coding DNA Sequence Number=SeqID_49995
FLFGGDDNDDVNNNTNKNINGGPNDNDDSDIDGSDMVVAAVLVMTFSDGDSNVNGTSDDSNDNDNNVGDVGYNNVGIELVVMT

SEQ ID NO: 166774 - protein, 81 aa, Glycine max
  Coding DNA Sequence Number=SeqID_49996
MHEQSLAINSWGSGLNGGGWMNDNQFVGLRAINSWVSGLNGGGCIHGNQFMGLRVRFDDGGCTNSARQSICGAPYSMVEDA

SEQ ID NO: 166775 - protein, 92 aa, Glycine max
  Coding DNA Sequence Number=SeqID_49997
EFGTFLEKLCIHEGSREIKVQVPESSERFCCVKICRDASSKQKPFGELEMSLRFPDYRKLNPLLDLPYSGNWSDSKVLDSTGLSCCAITRNR

SEQ ID NO: 166776 - protein, 100 aa, Glycine max
  Coding DNA Sequence Number=SeqID_49998
MASKNRKAPSTPTQARYDRSRFTSKEAWERYTDIVVPRKLLPERNVVVYYIEFDEFKEELERRHWDEKLTDFADSSIDIAIVKELRKAFEDPREGIRAKC

SEQ ID NO: 166777 - protein, 138 aa, Glycine max
  Coding DNA Sequence Number=SeqID_49999
MERKDNKLRGSSNGIIGGYQKWLKSRTQEINCLPKLKGLSGKKAEVPEESEEMQALKAELEKTRVVKEKLKMTVTRDRKECDELRDVNMTMDEAIEQETKRARKEEWSRNKFRGALWGNNNELKLRKDERDESRMETM

SEQ ID NO: 166778 - protein, 129 aa, Glycine max
  Coding DNA Sequence Number=SeqID_50000
  Subcellular localization annotation: CTP_CleavageSite=57; ConfidenceScore=5.46e-01
MPTSSPQATCGPWNFFQPCKKPFTSKDSQGMYPPLFSLNLVDVPSTRTDPQEMYSLLFSVKPKEWEESKEFSDCVVLNSLTREKGDTKEFRQLVLPSFGKGRRKTQKEFRRLVLGELFLAKGEENGKDE

SEQ ID NO: 166779 - protein, 127 aa, Glycine max
  Coding DNA Sequence Number=SeqID_50001
  Gene Ontology: Cellular component=chloroplast
MPLKDSTETKTGCQERRGGRMGSWSDLGFLIWDPGEEDQAGPCEQLDALSPFNPLSEMWQKEKESMDRPHRLHPVELRDHPKDAFGIQGSRTDHRTLFKSGTHYLSALSWTVRVGERQSLILKNQYS

SEQ ID NO: 166780 - protein, 106 aa, Glycine max
  Coding DNA Sequence Number=SeqID_50002
  Gene Ontology: Mol. function=two-component response regulator activity; Cellular component=intracellular; Biological process=two -component signal transduction system (phosphorelay)
  Homolog annotation: Hit_ID=Q1MCE9; Match level="QueryCoverage=96%, HitCoverage=21%, E-value=2e-24, Identity=56%"; Hit description =Putative two-component response regulator transcriptional regulatory protein
  Pfam annotation: Domain name=HTH_8; Domain location=57-97; Score =47.6; E_value=4.3e-11; Accession=PF02954.9; Description=Bacterial regulatory protein, Fis family
MEVPQHLLSAVSLREWPGNVRELRNAADRFALGLETDVSDASPAFQDDGRSALAPRVAAYEKSLIAQAIAAHGGNLKSVYENLGISRKTLYEKMQKYELHRHMTEI

SEQ ID NO: 166781 - protein, 202 aa, Glycine max
  Coding DNA Sequence Number=SeqID_50003
  Gene Ontology: Mol. function=receptor activity; Cellular component =outer membrane-bounded periplasmic space; Biological process =glycolysis
  Homolog annotation: Hit_ID=Q1MCF0; Match level="QueryCoverage=99%, HitCoverage=61%, E-value=8e-82, Identity=76%"; Hit description =Conserved hypothetical exported protein precursor
  Pfam annotation: Domain name=Bug; Domain location=48-202; Score=76.3; E_value=9.3e-20; Accession=PF03401.5; Description=Bordetella uptake gene (bug) product
  Subcellular localization annotation: CTP_CleavageSite=24; ConfidenceScore=5.32e-01
MKILKTVSGLAAAAAVSLFALSASAQTYPERNITMVVPFSAGGPTDTVARLVAESMSKDLGQQIIVENVGGAGGTLGAGRVASADPDGYTILLHHIGMATSATLYRKLAYDTTSAFEYVGLVTEVPMTILSRKNLETTDLKGLIDYAKANKDKVTVANAGIGAASHLCGMLFMSAIETPLVTVPYKGTGPAMTDLLGGQVDI

SEQ ID NO: 166782 - protein, 37 aa, Glycine max
  Coding DNA Sequence Number=SeqID_50004
MAMGVKPAEAINNGPRMKLGFSLRNIPELYGFHGDGC

SEQ ID NO: 166783 - protein, 72 aa, Glycine max
  Coding DNA Sequence Number=SeqID_50005
MQFMGLRKRGRDWRIALSNHYAWLQTRCMNENAIHGAPKQGSEWRIALSNHYARVPKMGGGCMNENAIHGAP

SEQ ID NO: 166784 - protein, 169 aa, Glycine max
  Coding DNA Sequence Number=SeqID_50006
  Gene Ontology: Mol. function=nucleic acid binding; Biological process= DNA integration
  Homolog annotation: Hit_ID=Q1SKA8; Match level="QueryCoverage=85%, HitCoverage=54%, E-value=2e-11, Identity=30%"; Hit description=Zinc finger, CCHC-type
  Pfam annotation: Domain name=zf-CCHC; Domain location=97-114; Score =22.4; E_value=0.0002; Accession=PF00098.13; Description=Zinc knuckle
MSLATLFGKLQEHEMELMRLNQHEENDKKKKGIALKASSSIHEESDKEDLNEHNNIEEDDDFSLFVKRFNKFSRNKGNRRRSNFNPKKKGEDFSSVPKCYECDQLGHLRVDCPIFKRRMEKSDKKNFKDKKRKKAYITWEDNDIDSSGDSVNKVVNPSLMATNYESEEE

SEQ ID NO: 166785 - protein, 79 aa, Glycine max
  Coding DNA Sequence Number=SeqID_50007
MSEIEEVQEQMKADMEAVKEKMATMMEAMMSMKKMMEVNVATVVAASTAIEVDPTHPSGLNQVNPPVSDIVGEGGEALG

SEQ ID NO: 166786 - protein, 49 aa, Glycine max
  Coding DNA Sequence Number=SeqID_50008
MDLGIPRSCGSACHRTLGSRISFRYDHSEETLGPTKIGENHSKCINLTR

SEQ ID NO: 166787 - protein, 70 aa, Glycine max
  Coding DNA Sequence Number=SeqID_50009
MLEEKFVTIIDASSNEEKTHYKAWERSKRLSLMFMRMTVADNIKTDLPKTNNAKEFMTSGLRYLKKGGLN

SEQ ID NO: 166788 - protein, 219 aa, Glycine max
  Coding DNA Sequence Number=SeqID_50010
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=9e-42, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHILTFRGLHVLAYRGLHTLAFIRLHTLAFIGLHAVTFSGLHVITFRGLHVLAFRGIQTPTFIGLYALAFIGLHALTFKGQHVLAFRGLHVLAFRGLHALAFIGMHALAFIGLHALTFRGLHVLAFRGLHVLAYRGPHVLAFRGLHVLAFRGPHVLAFRGPHVLAFRGLHVLAFRGPHVLAFRGLHALAFRGLHVLIFTGLHALTFRGLHVLTFIGLH

SEQ ID NO: 166789 - protein, 192 aa, Glycine max
  Coding DNA Sequence Number=SeqID_50011
  Homolog annotation: Hit_ID=Q9FFL9; Match level="QueryCoverage=77%, HitCoverage=52%, E-value=2e-22, Identity=41%"; Hit description =Arabidopsis thaliana genomic DNA, chromosome 5, P1 clone:MIK22
  Pfam annotation: Domain name=Ank; Domain location=112-144; Score=1.6; E_value=19; Accession=PF00023.20; Description=Ankyrin repeat
  Pfam annotation: Domain name=Ank; Domain location=146-178; Score=6.7; E_value=3.4; Accession=PF00023.20; Description=Ankyrin repeat
  Pfam annotation: Domain name=Ank; Domain location=41-73; Score=6.3; E_ value=3.9; Accession=PF00023.20; Description=Ankyrin repeat
  Pfam annotation: Domain name=Ank; Domain location=77-111; Score=11.0; E_value=0.81; Accession=PF00023.20; Description=Ankyrin repeat
  Pfam module annotation: Pfam domain module=Ank::Ank::Ank::Ank; Domain location=112-144::146-178::41-73::77-111
MAVADSISFQEQLLQRVASAQFRKPLLHLVSTQEDKGRYLTQCVPLHKASLKGDWKEARKLLDQDGSLLKTAITKGGWATLLHIAVGANRVHFVEELLKLMQPEELELQDHKGNTAFCFAAAVGNVQIAEMMERINASLPTIRGGGGLTPLHLAVLQGRKEMAWHLFPKTKEIFEEVDWTILFINCIKSGLY

SEQ ID NO: 166790 - protein, 135 aa, Glycine max
  Coding DNA Sequence Number=SeqID_50012
  Gene Ontology: Mol. function=DNA photolyase activity; Biological process=protein-chromophore linkage
  Homolog annotation: Hit_ID=Q8LB72; Match level="QueryCoverage=63%, HitCoverage=19%, E-value=7e-22, Identity=60%"; Hit description=Blue light photoreceptor PHR2
MKKDTYNFYGFKRERRVTVENPNRPRNYIGATCLEVATKVGDGVDEEGDTAGASLIKAGGRLIVVNEVKAVDGEDGEDLFVDIDEALIVHEVEVIVEPDYCSTIESSGVGGVTGVVGSAEMVDLKEVLEGLGGRK

SEQ ID NO: 166791 - protein, 108 aa, Glycine max
  Coding DNA Sequence Number=SeqID_50013
  Homolog annotation: Hit_ID=Q1SZM6; Match level="QueryCoverage=85%, HitCoverage=30%, E-value=5e-07, Identity=50%"; Hit description =Ribonuclease H
MYKTSGLEVKQQEVKELSSSLLAGTYGKLAMRMFSWSLLLTLSRKWLRSTASSTWLSVVALNISGGRSREVSWLHPPMGSFKVNLDGSSMGNPAPSGFGGVIRDSSAN

SEQ ID NO: 166792 - protein, 69 aa, Glycine max
  Coding DNA Sequence Number=SeqID_50014
  Gene Ontology: Mol. function=protein serine/threonine kinase activity; Biological process=protein amino acid phosphorylation
  Homolog annotation: Hit_ID=Q53VM4; Match level="QueryCoverage=94%, HitCoverage=12%, E-value=7e-22, Identity=81%"; Hit description =Ser/Thr protein kinase
MDAAAGQGYCGGADLDMFLTNYKLGKTLGIGSMGKVKIAEHVLTGQKVAIKILNRRKIKNMEMEEKGLY

SEQ ID NO: 166793 - protein, 74 aa, Glycine max
  Coding DNA Sequence Number=SeqID_50015
MGAKDKIINAQEISNTGVITGDVYGVDMSNTGVVTGDTCGVVFGVASAVTGSISGSASGMNGSRIFGVASESSS

SEQ ID NO: 166794 - protein, 199 aa, Glycine max
  Coding DNA Sequence Number=SeqID_50016
  Gene Ontology: Mol. function=RNA-directed DNA polymerase activity; Cellular component=chromatin; Biological process=RNA-dependent DNA replication
MGEIIKHLAEVRHMAVEGGVVHQDVIEEHDDKTMKEWFQELVHCCLKCGGHIAQTKWHHFVFRVSLLSAECSLSNIIRRHQNLVKPLSEIQFGEPRCRAKFIKKLIYGRHWEAVLHGHYVQLAIVHTKAPFAILLFYQKDRTWRRKGGGLLEQVRILGDKFGNSWMRSGSASGAGAGVRIRPLVSSEHLHVVERDDRCN

SEQ ID NO: 166795 - protein, 323 aa, Glycine max
  Coding DNA Sequence Number=SeqID_50017
  Gene Ontology: Mol. function=RNA-directed DNA polymerase activity; Cellular component=chromatin; Biological process=chromatin assembly or disassembly
  Homolog annotation: Hit_ID=Q94HV4; Match level="QueryCoverage=97%, HitCoverage=23%, E-value=5e-59, Identity=43%"; Hit description =Putative retroelement
MFTQLQLDFLNHIVSARGVAPDPSKIEAMVNWPVPTTTHALRDFLGLTGFYRKFIKGYASIAAPLTTLLQKDNFHWGEAPQEAFDSLKRAMIEAPILSLPDFSIPFTFETDASGSAMDAFLMQRACIHLRSRIACHNLGSPQMAPVFTGPFLDHSHRSSKSKGSHKPGYNYTIQYKSGKSNVVADALSRVSPPLASHYFLLSIPNFIFLDAMCKHFTTSVTFQAILQQITLDPGSHPGFELRDGLLLFNNRVWLEPDNPFIKPLLEEFHSTPIGGHLGFAKTLHRVQSNFHWASMRRDVKHFVRHYTTCQQVKYETKCPASLL

SEQ ID NO: 166796 - protein, 235 aa, Glycine max
  Coding DNA Sequence Number=SeqID_50018
MASRKRKVSASRPQANYDTTKFTSEAAWDCYADNVLAQNILSKRNEFYANLYNPKDKSPKQVRVRGKLIKFDVDSLNLFLETPMVLELGESLPAYSRLCRLWLDPQEMATRLCIPGRGFVVNAEGLPWKLLKKDLTTLAQTWSVLSYFNLALTSHTSYLNLDRARLVYGLVMKMDMNLGALISGQISLIAQSNSSRLGFLAIITALCMATGVTLDSLTFKTLSPTINLAYIKKNF

SEQ ID NO: 166797 - protein, 117 aa, Glycine max
  Coding DNA Sequence Number=SeqID_50019
  Gene Ontology: Mol. function=chromatin binding; Cellular component =chromatin; Biological process=chromatin assembly or disassembly
  Homolog annotation: Hit_ID=Q1SAV4; Match level="QueryCoverage=99%, HitCoverage=32%, E-value=1e-38, Identity=58%"; Hit description =Integrase, catalytic region
MGVACHMLPQKGRVWWLNEWSCCNTIPQGIETDTTWKGCRARSIAGIAPRFYLGPPSDHQFADGGTSHARSVRRRWDHDWKGDCEGSHCPCRLSSEKGVPLYVPNSDREELQSGHLW

SEQ ID NO: 166798 - protein, 236 aa, Glycine max
  Coding DNA Sequence Number=SeqID_50020
  Homolog annotation: Hit_ID=Q1SAV4; Match level="QueryCoverage=46%, HitCoverage=27%, E-value=3e-22, Identity=49%"; Hit description =Integrase, catalytic region
MYPFLFLVTTTQVDVPSTCTTKDVPSNVLRQSSQVGRIKRILRLYHSEFFDKGEGIHKRIQVVSPSFFWKREKRDTKRIQAKAFAKEEDEEVQEDVQRDSKAVKEYVEKFFVKVETSNQLSERKNYGDWVYVKLQPFCQPSLARTRFNKLSKRYYGPFHIIEAIGAVAYHLALPEDSKIHNVFYYSMLKPHQGPVATTTAPLPPYATDNHPLVEPLSVLDTKWDDTTSPPSLLALV

SEQ ID NO: 166799 - protein, 168 aa, Glycine max
  Coding DNA Sequence Number=SeqID_50021
MEAIKEQMATMMKAMMSMKKIMEANAVIVAAISAVAKVNPMLPSGLKQMNHPTSNMAHISQTMGETHEIPHHNLADFEPWLGYATEGQAVGGIPFENTLEGPQFRPQPQPLHFAVGRAPPAMAEKGKADHLKERLRAIEGGEDYAFANLEKLFLIPKHGHSQVQGAGL

SEQ ID NO: 166800 - protein, 125 aa, Glycine max
  Coding DNA Sequence Number=SeqID_50022
MEMDEKLLACTIAWILVARGDNHATLMTEDLIHIHVMKERVKIDWDTCEVDNILKTKRLSDYQILYAVFLTKVNKHYEVDFTDEKFKILISINKFDKGLLSYMALVERDGRWYYREEALEPKIVA

SEQ ID NO: 166801 - protein, 45 aa, Glycine max
  Coding DNA Sequence Number=SeqID_50023
  Homolog annotation: Hit_ID=Q8RUN2; Match level="QueryCoverage=71%, HitCoverage=15%, E-value=5e-07, Identity=78%"; Hit description =Expressed protein
MMRIEYMQVERNIDLVYVGGSIGLMGLISQVVFDGGCHMLGREKE

SEQ ID NO: 166802 - protein, 312 aa, Glycine max
  Coding DNA Sequence Number=SeqID_50024
  Gene Ontology: Mol. function=nucleic acid binding; Cellular component= chromatin; Biological process=DNA integration
MQEELSQFKRNEVWDLVPRTNTQHVIGTKWVFRNKIDEIGFITKNITWLVDKGYSQEGIDYDETYAPVTTLEAIRLLLAFASLIDFKFFQMDVKSTFLNGYIKEEVYVSQPNGFINYDFPNYVYESKKTLYGLNQASRSWYERLSNFLLEQKFERGKMSKESSTPMSTSCYLDSYEKGKHVNESKYRGMIGSLLYLTPSCLDIMYNVCVCARFQANPKKSHLVVVKRILKYIKGTLKVGLWYPKGASISLVGYSDLDYASCKVDRKSTSGTCHLFGSTFVSWHSKKQASMALSIVEAQYILLPIVVVLRSFG

SEQ ID NO: 166803 - protein, 299 aa, Glycine max
  Coding DNA Sequence Number=SeqID_50025
  Homolog annotation: Hit_ID=Q1LIW0; Match level="QueryCoverage=79%, HitCoverage=62%, E-value=1e-101, Identity=78%"; Hit description =Hypothetical protein precursor
GIHAALVGVCAIAVGQGQPGSPVLRGACAAWRLERAPARPADRKPVLRAHCFVQEQGRSAGEGSAADAWGYRHRGRCDQGSVCAGVSRSQGRILGIRSGSRPDAASGRLPAGTRGRLHLRGAAASIAHRPDVVSRGSAAVSSQAALPGHHRSETRQLDPRGCGSDAHVLQLCESALGACRRESTGGADPVRGQGPCAGAVCVGRTANPGHGSQLPHRPAGRGVAATGTGGHAQAVRGAPIEHRPQGKIVAAGSAFPIRQAVGAHCVTPGRPATPIPPRAARTTRAAPARARSAPWPAAA

SEQ ID NO: 166804 - protein, 144 aa, Glycine max
  Coding DNA Sequence Number=SeqID_50026
MVGPVAGVVPPFAIEPPVEERGQPTTRVGLNDDGVIEVSPNMPSSILAKRKRDDNFGVSGRSNLLPAPSSQGLPSASLVIQASVATLAPPTPPFVPIQEVSVSSPNMVIAPISLAAPIVAPLSTVVTPLKEKRRERSLTLKCVS

SEQ ID NO: 166805 - protein, 175 aa, Glycine max
  Coding DNA Sequence Number=SeqID_50027
MACASSEADNCSKVALSTLSIMINRSLSKDLNLWQFISHDVSCQDFVKTVLEVMKHVQVKLEQLLGHVVQGDPTNLASSDGKRGRRRPSITAMPHIAETLMSPPLLLLAPQEVEWGRIMVTRMGSLSRKAAKDCTLLRRREVPSPTQHKPTILLEEKDLLLEAPWRESPPLRSCQ

SEQ ID NO: 166806 - protein, 192 aa, Glycine max
  Coding DNA Sequence Number=SeqID_50028
  Subcellular localization annotation: CTP_CleavageSite=42; ConfidenceScore=5.22e-01
MPCPSSHLRTSHPAPSSSALSSMKLKSLIHTLIVSHMCRIIRAFSKVKAVIVEILKGKKNQSNINFLHHHKKQKMTKKIIFGSFRLHYNWCSSKSSHVIPVPSRVFEGLPKASDTHHDEQYLYEDCHDDDLQLAGYLQWLEEKVHDDKKGSGNEMNEIDKLAELFIADCHEKFKLEKQDSDRRFHEMMARGM

SEQ ID NO: 166807 - protein, 96 aa, Glycine max
  Coding DNA Sequence Number=SeqID_50029
MGVKHFEVGGLELSKGVSRLRPDRVLTISEREVTGVEVGVVVRTVAMMEVGMVDPAIGIRVKHINVTSWEDLEGTKSVEVEAGVVRGSDVERGGVL

SEQ ID NO: 166808 - protein, 87 aa, Glycine max
  Coding DNA Sequence Number=SeqID_50030
  Gene Ontology: Mol. function=zinc ion binding
  Homolog annotation: Hit_ID=Q1RWM6; Match level="QueryCoverage=98%, HitCoverage=43%, E-value=1e-10, Identity=34%"; Hit description=Zinc finger, SWIM-type
  Subcellular localization annotation: CTP_CleavageSite=43; ConfidenceScore=5.14e-01
MTTNLVESINSVLKKSRNMPIIALVKSTHIRSNALFNKRGRKVATMLTSDQVYTQVLNKETINLREVRPAENFTVRLDERWCDCGKF

SEQ ID NO: 166809 - protein, 52 aa, Glycine max
  Coding DNA Sequence Number=SeqID_50031
MTGFLLPKHSIDLAPVVEDYIDDDSEEEDPSEDESEVKESTEIKEDPSEDSS

SEQ ID NO: 166810 - protein, 306 aa, Glycine max
  Coding DNA Sequence Number=SeqID_50032
MLLLEVHPIEESYNDNPSHCHRDFNASNDHVSNIPVGGVVAVEEGICPNSNDEHVFMRASPSETSFMYMYFTLLSNLHLTLTFDKFEFFIIPIAPKFLHHYSMKENEKGGWISLTGITDKGIIDPFTTSYKDFKEKEQQKEHPKDDWAPPPHPTSSPTIAIAIPRCGLFYAQPIIPEHDEGTDKIEKVDTKSQKALAKCVKIEQALDSWKSFKDTKTKLKKAETQEEALKSKLTTTKSFAKVLQEEIKCLNKEFALFKMNAEKVEEKLKSDIGKAKAKILKTHEVNFFKATPEVEGAIEEPTQPVT

SEQ ID NO: 166811 - protein, 66 aa, Glycine max
  Coding DNA Sequence Number=SeqID_50033
MVETESREQKKVNKNQGQHSSQNSEADDLHEKLRMVSARSSGEKTYSCLDNKHVRIENLGGSRVQL

SEQ ID NO: 166812 - protein, 194 aa, Glycine max
  Coding DNA Sequence Number=SeqID_50034
  Gene Ontology: Mol. function=DNA binding
  Homolog annotation: Hit_ID=Q1SWX1; Match level="QueryCoverage=94%, HitCoverage=34%, E-value=2e-17, Identity=30%"; Hit description=IMP dehydrogenase/GMP reductase
MPSLKKRFYQVKVKSLGTTSLKELGQLMGQLQRQAFRKAYGKIWDLAIVEVSTEAIASFAQYYDHPLRCFTFGDFQLSPMVEEFEEILGCPLGGRKPYLFSGFYPSLARISKIVQISAQELDHRKQVENGVVGIPRKYLEAKARILAGKGEWAPFIDILALLIIGGVLFPNVDGLVDLAAIDAFLAYHNHKESP

SEQ ID NO: 166813 - protein, 58 aa, Glycine max
  Coding DNA Sequence Number=SeqID_50035
MDDEVTLILHHNGKGGPDVETKVVGVETLPDVHDAKTEVVGVETLPDVQDVEIEVVGV

SEQ ID NO: 166814 - protein, 159 aa, Glycine max
  Coding DNA Sequence Number=SeqID_50036
  Subcellular localization annotation: CTP_CleavageSite=46; ConfidenceScore=5.01e-01
MAMVIIVEKSNRDNTLVVVGKEAPSSSTKRVYSTGRRKGNKESVPSAAMVIVVRRKHLRLQQRERILREEEKATKIASREHKKDKNQGRDTYTQSAGRQKGKKILYNKSIPMLAIKDGHVDNQFCHKFIHLFHTGYFINGDRRKLMIRKFCCIVYTFED

SEQ ID NO: 166815 - protein, 112 aa, Glycine max
  Coding DNA Sequence Number=SeqID_50037
MVNSLPYLSLPLDYDYLVIEYDGCEQGWGVILKKEKNKYEKIHDEEICKYASGKYHTKPQGYNKMKPSKVSYQNIKQKMKFGNQELHVLTNEFHYPGREAINEKFNCLIYNI

SEQ ID NO: 166816 - protein, 74 aa, Glycine max
  Coding DNA Sequence Number=SeqID_50038
MSLKLSFCDGWHLWSLVWGHHVNGVNNLEMHLPSRSHGPASCKSFNNYVDDTSQLVERLFFPSFLRSTSTPFWS

SEQ ID NO: 166817 - protein, 252 aa, Glycine max
  Coding DNA Sequence Number=SeqID_50039
KVASRETEGEDSKVRGSGKEVLVVPLSTLTSSMISSTSNEVSSTSDGVSSTSLGDEYSDFLTFINQLQEMVVDNIKVVLNIAIIAGEVLRPIDEVVDKNELGSLDPLANEELQDLAFLETLPRLLPVKQIFSLLKSPNLIWDLEAVAIAQHLQGSSDVSKLKANLKMVRNSLVSALNVNVTLVGENLDLKGLETHVTNVEALVKVLFHYEVPNQSIFDIKKDFYNRQLVLMDDISAYAMSYSEQLATPPGET

SEQ ID NO: 166818 - protein, 202 aa, Glycine max
  Coding DNA Sequence Number=SeqID_50040
MKANIKAMKEQMNTMMEAMMSMKRMMEVNMAIVFAASTATEVDPSHPFSLNQVNRLVSDMVGETYKVPRGHTLADFEPHLDMPQRGRHFLVYPRQTLWGRPQYRPQPQPLHFAMERGPLAMVEREKFDHIEERSRVIEGGGNYAFIDMTELCLVPDMVIPPKFKMPDFDKYKGTTCPKNHLKMYYKKMRAYAKDEKLLMHFF

SEQ ID NO: 166819 - protein, 62 aa, Glycine max
  Coding DNA Sequence Number=SeqID_50041
MAIYRKSHLGQGKLAQASWLLRVEGISWPRSDNRFEQSLDLALQSVLNDKSIPQTKLGSDNI

SEQ ID NO: 166820 - protein, 110 aa, Glycine max
  Coding DNA Sequence Number=SeqID_50042
MQSPPAKVSVGLCRPDVGIAPTKTPSGPEEVNRALRFPALGSCPQNTVDPEKSNGVLGLPALITGLCRFYGVPVAPSKVIRPPINQAFIKKYCAPRQAQGETPQQHWDGR

SEQ ID NO: 166821 - protein, 59 aa, Glycine max
  Coding DNA Sequence Number=SeqID_50043
MVHVDPATGKADGPHRKKLRTYLGLWRVIRWTSLIEAVPESKAILLSWVMENSSLTVNH

SEQ ID NO: 166822 - protein, 233 aa, Glycine max
  Coding DNA Sequence Number=SeqID_50044
  Homolog annotation: Hit_ID=Q40600; Match level="QueryCoverage=40%, HitCoverage=26%, E-value=9e-12, Identity=44%"; Hit description=70s mitochondrial ribosomal protein L2
  Subcellular localization annotation: CTP_CleavageSite=29; ConfidenceScore=5.14e-01
MKMTKQHVQQSPTWQNVESKWLSFHRGSRAKHLQQTVNHKRNTASSLSVVERIEYDPNRSSKTALVRWIEGVYHRHRHAASANAASPKLLRLDPAATDANSIRGIFALNWMLPHAHARPSSRELFLSVLASKGSESESISSLGILRFAVAVARALFFAQRARGEETVCHVQVHYFAKLFRQAHWRHATWTARQSLAVSPSSLATCTRCFADRADEMLTQNRSSTQNVSKRTLI

SEQ ID NO: 166823 - protein, 47 aa, Glycine max
  Coding DNA Sequence Number=SeqID_50045
MKQLEIAELLENLKKSKCRVLVHIKFLNLPENYSKPLTSYPTYVFGL

SEQ ID NO: 166824 - protein, 96 aa, Glycine max
  Coding DNA Sequence Number=SeqID_50046
MGTSHLHLTIIGDDDDDNDDDDPPFPFILSPINQTTSVRVPKSQMPPLDGEDVRGVAVEDDVKAGGDDVGAEKWPPRSRSGWAFEGVPLKMVRGSV

SEQ ID NO: 166825 - protein, 54 aa, Glycine max
  Coding DNA Sequence Number=SeqID_50047
MTQILRVGKHLRRVMGNDSCSSDWRMQFYVSPYARTRSMLLEFRQCFLNKRIIG

SEQ ID NO: 166826 - protein, 334 aa, Glycine max
  Coding DNA Sequence Number=SeqID_50048
  Homolog annotation: Hit_ID=Q9LHK2; Match level="QueryCoverage=92%, HitCoverage=24%, E-value=1e-88, Identity=57%"; Hit description =Arabidopsis thaliana genomic DNA, chromosome 3, P1 clone: MMF12
MIVIGGNYLNILLQDYLKAPATTDLAYNAILEHTIAERERSPAVVSRCVALLKRYLLRYKPSEETLVQIDRFCSTIIAECDINPTQPWSRALNRQSGASTTSTNTSPLPVSTFASESLVKSLSYVRSLVAQHIPKRLFQPASFAGPPSSGQSLPTLSSLLSKSFNSQLTPASIPETQSSASVPETLEKDSSALSVSRLSKIEKADETEELGFIAHDVLKWRWLEEPQSSSIGTENDRAVNSQDMTAHSFLEIGAAALLVGDIESKMKGQPWKFFGTDDMPYLDQLLQSSPVTPITNSDSARPHLRAITASKRTKPGSRQIWHVLLSTCIDIFLF

SEQ ID NO: 166827 - protein, 105 aa, Glycine max
  Coding DNA Sequence Number=SeqID_50049
MERRKGSGSFLTTEDLRRETGINCSGRHEELKLENIIGLVSIGFGIISISESGRRRRNYCTFELNAIERFENREIGRSKQVRSQVLRCVPLVSAFCFVLDLRFEI

SEQ ID NO: 166828 - protein, 1106 aa, Glycine max
  Coding DNA Sequence Number=SeqID_50050
  Gene Ontology: Mol. function=phospholipase D activity; Cellular component=membrane; Biological process=phosphatidylcholine metabolic process
  Homolog annotation: Hit_ID=P93733; Match level="QueryCoverage=83%, HitCoverage=94%, E-value=0.0, Identity=73%"; Hit description =Phospholipase D beta 1
  Pfam annotation: Domain name=C2; Domain location=294-400; Score=70.0; E_value=7.7e-18; Accession=PF00168.20; Description=C2 domain
  Pfam annotation: Domain name=PLDc; Domain location=617-652; Score =42.3; E_value=1.6e-09; Accession=PF00614.12; Description =Phospholipase D. Active site motif
  Pfam annotation: Domain name=PLDc; Domain location=952-979; Score =39.5; E_value=1.2e-08; Accession=PF00614.12; Description =Phospholipase D. Active site motif
  Pfam module annotation: Pfam domain module=C2::PLDc::PLDc; Domain location=294-400::617-652::952-979
MDNYGSSSPYRYPSPYMYPPNPHQPYPPPPGSAPDPYAQHVPYQPYPYLSSHSFNYSYPPPPRPSSHSGHFEYSYTPPPHPSDFPYPPPPYYAHPPSYPYPYHVPPPNHDPSKPSLSYHASFQHGSSHYYYQQPNQAYSASAPEVQPDIHSHTNSYSGPYWQENTSTAADEVSQASDSSKPSQGSAYPPLDDLMSNVRLSDGQPTAPASPPAPARQPFMHSISVPKLQQKREEFYGYSNNSFSGWGSSYHSQVDSSRLSDFSGSFNESMHSQSLQIVPVQNKGSLRVLLLHGNLDIWIHEAKNLPNMDMFHKTLGDMFGKLPGSVGNKIEGTMNKKITSDPYVSISVSNAVIGRTYVISNSENPVWLQHFYVPVAYHAAEVHFLVKDNDIVGSQLIGIVAIPVEQIYSGAVVEGTFPILNNNGKPCKQGAVLTLSIQYIPMEKLSIYHQGVGAGPEYIGVPGTYFPLRRGGTVTLYQDAHVPDGSLPNVLLDSGMYYVNGKCWQDIFDSISQARRLIYITGWSVWHKVRLVRDAAGYASDYTLGDLVKSKSQEGVRVLLLIWDDPTSRSIFGYKTDGVMATHDEETRRFFKHSSVQVLLCPRSGKRHSWIKQKEVGTIYTHHQKTVIVDADAGNNRRKIIAFVGGLDLCDGRYDTPHHPLFRTLNTIHKDDYHNPTFTGNIGGCPREPWHDLHSKIDGPAAYDVLTNFEERWLKASKPHGIKKLKISYDDALLRLERIPDVIGINDAPSVGEDNPEVWHVQIFRSIDSNSVKGFPKDPKDATSKNLVCGKNVLIDMSIHTAYVKAIRAAQHYIYIENQYFIGSSYNWSQHKDLGANNLIPMEIALKIAEKIKANERFAVYVVIPMWPEGVPTGAATQRILFWQNKTMQMMYETIYKALVEAGLEAAFSPQDYLNFFCLGNREAMNLYDNAGVTGAPPPANSPQAASRNSQRFMIYVHSKGMIVDDEYVILGSANINQRSMEGTRDSEIAMGAYQPHHTWARKQSYPHGQIHGYRMSLWAEHTGTIEECFLQPESLECVRRVKAMGEMNWKQFSAKEATEMKGHLLKYPVEVDRNGKVRPLQDCEEFPDVGGKIVGSFLAMKENLTI

SEQ ID NO: 166829 - protein, 218 aa, Glycine max
  Coding DNA Sequence Number=SeqID_50051
  Gene Ontology: Mol. function=identical protein binding; Cellular component=cytoplasm; Biological process=negative regulation of enzyme activity
  Homolog annotation: Hit_ID=Q69P78; Match level="QueryCoverage=89%, HitCoverage=34%, E-value=5e-34, Identity=35%"; Hit description =Putative serine protease
MGEVVKVAYGAGMIVLNTKNQAEEIYVDLHILLATSLGASVGKTIKTYIQSDKKPTTSVSFMGIKFSDPAPVMRAFSSKGPSIVGLDVTDPAVNILGASMSCPNVSGIATLLKYLHKDWSPAAIKSALMTTAYTLNNKGAPISYMASDNKAFATPFAFGSDHVNPKAVLHAGDLNYPSFAVLFGKSALNASVTCLQNYTFMCNFLKFNMQEITLHDLG

SEQ ID NO: 166830 - protein, 318 aa, Glycine max
  Coding DNA Sequence Number=SeqID_50052
  Homolog annotation: Hit_ID=Q9LHK2; Match level="QueryCoverage=96%, HitCoverage=25%, E-value=2e-96, Identity=59%"; Hit description =Arabidopsis thaliana genomic DNA, chromosome 3, P1 clone: MMF12
MATWYFKALRIKLFNVGYVLDSRTAAPLILSMLEDMLSSSKTACRVRAFDLILNLAVHAHLLEPIVADDASTIEEEYSQESYYDSDTQVMVQGSRKGSSQNKSDTGSAIDKFESWILNILYEILLLLVQSEEKDESVWASALSCLLYFVCDRGKIKRNRLHGLDIRALVRISRENSWAELVHCKLISMLTNMFYEVAEVAESVSGKPKFLVNQLDLIGGVQFIFIEYSLANSREERKNLYSVLFDYILHQINETCIATGVNDYSDDEIQPLAALLAQTNAPEAFYISVKLGVEGIGEILRRSIASALSRYPNSERLNM

SEQ ID NO: 166831 - protein, 456 aa, Glycine max
  Coding DNA Sequence Number=SeqID_50053
  Homolog annotation: Hit_ID=Q9LHK2; Match level="QueryCoverage=85%, HitCoverage=33%, E-value=1e-122, Identity=59%"; Hit description =Arabidopsis thaliana genomic DNA, chromosome 3, P1 clone: MMF12
LLEVVAEKFDAVISTFTHLDKEFSHMNQITKSLKFLENMEGVVMRNGIGLQAKHSWATLHSLLHSERISYRQNGYIWLGDLLIAQINGERDGNIWSSITYFQKKIAQAGTQDSSNTSDVPLPILLMCGLLKSKYNYIRWGFLFVLERLLMRCKFLLDEHEMQQTSNRDLGHGKKDWHLEKANAIIDIMSGALSLVFQINETDRINILKMCDILFSQLCLRVPPAASLPFGDDVRHGRNFNHVNLSKRFDGDNHAKQDTFHWDGHKEEANRRSGYHNNYHLDHETASMAALFQGRAVVPMQLIARVPAAILYWPLIQLAGAATDDIALGVAVGSKGRGNLPGATSDIRATLLLLLIGKCTVDPVAFRERMMTEKPEKYQHMLQNLVVKAQQLMWDLGFSQYTPRAQLFLGLARHPNTKKLCANPPLNTEPFPNIAGPEVEWSMKSFFQILKPCPAEE

SEQ ID NO: 166832 - protein, 67 aa, Glycine max
  Coding DNA Sequence Number=SeqID_50054
  Subcellular localization annotation: CTP_CleavageSite=48; ConfidenceScore=5.18e-01
MGSGVGMGVSGGGDLGEVGAGFWDKVVKPWVRRFTTSSRRSMVWRVVCSGMVTVGRAGWRQVRPIDR

SEQ ID NO: 166833 - protein, 629 aa, Glycine max
  Coding DNA Sequence Number=SeqID_50055
  Gene Ontology: Mol. function=binding; Cellular component=plastid chromosome; Biological process=positive regulation of transcription, DNA-dependent
  Homolog annotation: Hit_ID=O64624; Match level="QueryCoverage=85%, HitCoverage=83%, E-value=4e-70, Identity=25%"; Hit description =Putative salt-inducible protein
  Pfam annotation: Domain name=PPR; Domain location=137-171; Score =35.8; E_value=1.5e-07; Accession=PF01535.11; Description=PPR repeat
  Pfam annotation: Domain name=PPR; Domain location=172-206; Score =36.0; E_value=1.3e-07; Accession=PF01535.11; Description=PPR repeat
  Pfam annotation: Domain name=PPR; Domain location=207-242; Score =13.0; E_value=0.21; Accession=PF01535.11; Description=PPR repeat
  Pfam annotation: Domain name=PPR; Domain location=243-277; Score =44.4; E_value=3.9e-10; Accession=PF01535.11; Description=PPR repeat
  Pfam annotation: Domain name=PPR; Domain location=278-312; Score =26.3; E_value=0.00011; Accession=PF01535.11; Description=PPR repeat
  Pfam annotation: Domain name=PPR; Domain location=313-347; Score =38.8; E_value=1.8e-08; Accession=PF01535.11; Description=PPR repeat
  Pfam annotation: Domain name=PPR; Domain location=348-382; Score =35.1; E_value=2.4e-07; Accession=PF01535.11; Description=PPR repeat
  Pfam annotation: Domain name=PPR; Domain location=383-417; Score =35.5; E_value=1.9e-07; Accession=PF01535.11; Description=PPR repeat
  Pfam annotation: Domain name=PPR; Domain location=418-452; Score =28.1; E_value=3.2e-05; Accession=PF01535.11; Description=PPR repeat
  Pfam annotation: Domain name=PPR; Domain location=453-487; Score =21.2; E_value=0.0036; Accession=PF01535.11; Description=PPR repeat
  Pfam annotation: Domain name=PPR; Domain location=488-522; Score =39.5; E_value=1.1e-08; Accession=PF01535.11; Description=PPR repeat
  Pfam annotation: Domain name=PPR; Domain location=523-557; Score =32.9; E_value=1.1e-06; Accession=PF01535.11; Description=PPR repeat
  Pfam annotation: Domain name=PPR; Domain location=558-592; Score =23.7; E_value=0.00064; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=137-171::172 -206::207-242::243-277::278-312::313-347::348-382::383-417::418 -452::453-487::488-522::523-557::558-592
  Subcellular localization annotation: CTP_CleavageSite=59; ConfidenceScore=5.77e-01
MTITLSPSLSVPHPSPFSLTPTTTLRQLFFTNFTPSPRRRLQLQARAGKPNVLIPINPSVAVEKGKYSYDVETLINRITALPPRGSIARCLDPFKNKLSLNDFALVFKEFAQRGDWQRSLRLFKYMQRQIWCKPNEHIYTIMITLLGREGLLDKCREVFDEMPSNGVARTVYVYTAVINAYGRNGQFHASLELLNGMKQERVSPSILTYNTVINACARGGLDWEGLLGLFAEMRHEGIQPDVITYNTLLGACAHRGLGDEAEMVFRTMNESGIVPDINTYSYLVQTFGKLNRLEKVSELLREMESGGNLPDITSYNVLLEAYAELGSIKEAMDVFRQMQAAGCVANAATYSVLLNLYGKHGRYDDVRDIFLEMKVSNTDPDAGTYNILIQVFGEGGYFKEVVTLFHDMVEENVEPNMETYEGLIFACGKGGLYEDAKKILLHMNEKGIVPSSKAYTGVIEAFGQAALYEEALVVFNTMNEVGSNPTVETYNSFIHAFARGGLYKEAEAILSRMNESGLKRDVHSFNGVIKAFRQGGQYEEAVKSYVEMEKANCEPNELTLEVVLSVYCSAGLVDESEEQFQEIKASGILPSVMCYCLMLALYAKNDSAYASPIANCTIVSVALPFLMLG

SEQ ID NO: 166834 - protein, 65 aa, Glycine max
  Coding DNA Sequence Number=SeqID_50056
MVTQWHGVVERRVWWNEWEMEVVEEDGVCNRMEERTRGPVLNRVWLSGAFGGNGFLNDLQAGEMY

SEQ ID NO: 166835 - protein, 82 aa, Glycine max
  Coding DNA Sequence Number=SeqID_50057
MGHQQRLNSGTCASKLPLTKPPYLGAWTVADAMLELETRMKIGIKAILGLQWWGWLASNSWDPNGIWFQLPKSIHLEDKVKL

SEQ ID NO: 166836 - protein, 163 aa, Glycine max
  Coding DNA Sequence Number=SeqID_50058
  Homolog annotation: Hit_ID=Q1SMF0; Match level="QueryCoverage=47%, HitCoverage=16%, E-value=3e-08, Identity=35%"; Hit description =Tetratricopeptide-like helical
MKLDTNSGIRGRTLFVLIGCERSDQYRSRKKDFERRNIDSRKCGCPFKLRGKPVIGGQGWMVKLMCGSHNHEIENIFIECVHYAGKNPSRRGCVMRTNHGLPDAFTLKSKFREIAYPDLNSMCPPPENVNTKVAQKKPMTKHQRSTKFDHHLTNQFQEELCRC

SEQ ID NO: 166837 - protein, 562 aa, Glycine max
  Coding DNA Sequence Number=SeqID_50059
MEDSEKLTALKKAYADIILNTAKEAAARIMVSERKATRFQQELVSTKEEALRMLLRLKQKFDSKRDQLALLQFPNSPIYTYIWFENEAELFVTVSEAELTSLNQQKKIEELEAQLQEAEEIVRDLRAELRETQAELENVTKHQMHPPVEQNTGAEIEAQEIFLQENRLDPYDGSVYTAPGLQFESVSISDNRNPVVNGSNDSSKFCGSHDHTNNCYIHNPDFASIVIRRKEPKLYRNGCTQRIHAFERSLFDGNMSVSGNLDNVQNEMVVSVHEEGKAMTVSTNAKADTISEKEKPDELKVVKADADLVKVPVQRKKIKFGKRNAIKSRLHSNQVKETNKESHLSGAKDSSLVLDNDDPSRVSSSMTCENEAQKDLMSPFADVPTDTTATNEQSGPHSNTENGEVFLKACSIWNITKDDNEPLDKSDLTRQESLSAESVEVPACKDVEASNGSLDKMDPKVSNLDEKVSNRSTGDKFKYTFCRKRKKEAVSCDDVDCSQDNTSSKKKCGEKQDGHVEPQKSCTMTESSRDSRRLAQVARQENLVLGFSSNLKRMGWGYKGFS

SEQ ID NO: 166838 - protein, 610 aa, Glycine max
  Coding DNA Sequence Number=SeqID_50060
  Gene Ontology: Mol. function=binding; Cellular component=microtubule
  Homolog annotation: Hit_ID=Q654G4; Match level="QueryCoverage=96%, HitCoverage=93%, E-value=2e-81, Identity=36%"; Hit description =Putative potyviral helper component protease-interacting protein 2
  Pfam annotation: Domain name=HEAT; Domain location=121-157; Score =0.0; E_value=42; Accession=PF02985.12; Description=HEAT repeat
  Pfam annotation: Domain name=HEAT; Domain location=203-239; Score =27.0; E_value=6.8e-05; Accession=PF02985.12; Description=HEAT repeat
  Pfam annotation: Domain name=HEAT; Domain location=37-77; Score=4.8; E_value=11; Accession=PF02985.12; Description=HEAT repeat
  Pfam annotation: Domain name=HEAT; Domain location=82-118; Score =29.7; E_value=1e-05; Accession=PF02985.12; Description=HEAT repeat
  Pfam module annotation: Pfam domain module=HEAT::HEAT::HEAT::HEAT; Domain location=121-157::203-239::37-77::82-118
MSSTPQSLKQRVFRCLTKLSDRDTQSLAAAELESIARNLDGATLPMFLSCMYSTDDSDKPPVRKQCVQLLGFLAETHGNMLAPYLPKILGSVVRRLRDADSSVRSACVNSIAALSRHVSKPPLNAFLKPLAEALFTEQDQNAQASAAMCLAAAIDGAPDPDPARLAKLLPRFEKLLKRDGFKAKPALLTLVGSVVAAGGASGHVPLNSLVPCLVEALSSDDWATRKAAAETLVVVADVERDFLSEFKAECVRVFENRRFDKVKLVRDVMNQMLEAWKQIPDVSDEVSPPPKSQSSSKENASDGRYPQVSHNSCSPRSMMANLRRKSTPFSRFSPADSSSASNAKNSSASSSNKRRLFVSRKLNHMNWDAPIAMADQGDLQERDGIVLDRSKMDKSRVSKSEMKRVLLTKSSEDKMQKYGGSKAGSRVVPYHEDESQDSVPVSIVSKDLQRNDKESEDLSLIRDQLHQIEKQQSSLLDLLQKFMGSSQNGMRSLETRVHGLELALDEISYDLAISSGRMTKSDAQGNACCMLPGAEFLSSKFRRKTHGRDSIVRFSRSGGTPSLAAMNYPPNRNAETKLTNHRFRPDGGFITNPLAEIHTNSRNFATLEIA

SEQ ID NO: 166839 - protein, 163 aa, Glycine max
  Coding DNA Sequence Number=SeqID_50061
  Gene Ontology: Mol. function=nucleic acid binding; Biological process= DNA integration
MDVESSFSQIAHLFDGESYDLWKDYEVSSSPENPTMVQIKHHKEKKIKKAKAKACLFADISYLIFTRIMNSPKEIWDYEEYEGNEHVCGMQVLNLMREFEMQKIKKFKTIKGYSDRLFGIANKITKDLSKISLTEVIHVLQAQDQRRLMREESKVERVLPVKH

SEQ ID NO: 166840 - protein, 547 aa, Glycine max
  Coding DNA Sequence Number=SeqID_50062
  Gene Ontology: Mol. function=actin filament binding; Cellular component=intercellular junction; Biological process=actin cytoskeleton organization and biogenesis
  Homolog annotation: Hit_ID=UPI0000162EB3; Match level="QueryCoverage =66%, HitCoverage=42%, E-value=6e-32, Identity=29%"; Hit description =actin binding
  Pfam annotation: Domain name=FH2; Domain location=116-499; Score =58.8; E_value=1.8e-14; Accession=PF02181.13; Description=Formin Homology 2 Domain
  Subcellular localization annotation: CTP_CleavageSite=11; ConfidenceScore=5.06e-01
MSAPSQTIVITATATAATMLLFAVTFFYFQKFVLARYHHRYIVATSFLREAGLNNEDIKKVGGNMKGLLVEENGIDILYMMETEGGQFKTRFPNGRYNPSYEDDEEKGTDIMVQRSKRIKPQDVTVPLPCEILGSASILGKVVANVGHSTVWDQISDRSFWKSVMHSMLAKNILSAETLEKLAKIAPTQEEAKIMQFSDNPDKLVDAESFLYHILRAVPTAFIHLKALLIRSSYGCEVIQLKEHLKTLESSSNSILRAVPTAFIHLKALLIRSSYGCEVIQLKEHLKTLEMGCNEMKTSSLLLKFLKAILKAGNPMNVGTSRGNAHGFNLSALEKLSHPVAQFEARQQASNQKHNLNSSTGETSNTNEPHSDNRVQKEEVKEYLVLGGLRDELCEVKKAASIEHQNFSSMYSIPNAYVTKIRQIITCFGNSERGGFIKVMKGFPEECEVEPKVVREEQEMVMELLKKTNEYYLTGGSKDNISNPFQLFITVKEFLDMVDEVCKELRRQLEKTNAGGEAVSTPPLSPSKRAPLRLTNFNYIFGQARQE

SEQ ID NO: 166841 - protein, 149 aa, Glycine max
  Coding DNA Sequence Number=SeqID_50063
  Gene Ontology: Mol. function=RNA-directed DNA polymerase activity; Biological process=RNA-dependent DNA replication
  Homolog annotation: Hit_ID=Q2HRG4; Match level="QueryCoverage=67%, HitCoverage=7%, E-value=2e-15, Identity=46%"; Hit description =Ribonuclease H
MEMALALAPPTKVQDLSMADFAFSPCPFCRGHETLLHVLRDCPRAASVWLPLVAPQHQRAFFSYSLWNWMVTYLQKPWSIVNSNDEDCVLFAATVWLLWKDRKSWVSDGCGLCFSSERVLHRVGALADDYGGVVEVEHSAPSPSVRCVS

SEQ ID NO: 166842 - protein, 966 aa, Glycine max
  Coding DNA Sequence Number=SeqID_50064
  Gene Ontology: Mol. function=DNA binding; Cellular component=beta -galactosidase complex; Biological process=DNA integration
  Homolog annotation: Hit_ID=Q1SLU3; Match level="QueryCoverage=98%, HitCoverage=97%, E-value=1e-154, Identity=42%"; Hit description =Integrase, catalytic region
  Pfam annotation: Domain name=zf-CCHC; Domain location=246-263; Score =9.6; E_value=0.025; Accession=PF00098.13; Description=Zinc knuckle
  Pfam annotation: Domain name=zf-CCHC; Domain location=282-299; Score =12.1; E_value=0.01; Accession=PF00098.13; Description=Zinc knuckle
  Pfam module annotation: Pfam domain module=RVT_2::Retrotrans_gag::zf -CCHC::zf-CCHC; Domain location=528-721::77-192::246-263::282-299
MNEASINNTESYLYLHPSENPTIALVSPVLDSTNYHSWSRSMVTALSTKNKVEFIDGSAPKPLKTDRMHGAWRRCNNMVVSWIVHSVATSIRQSILWMDKAEEIWCDMKSRYSQGDLLRISDLQQEASTMKQGSLTITEYFTRLRMIWDEIENFRPDPIYSCNIRCSCTAFTIIAQRKLEDRAMQFLRGLNEQYANIRSHVLLMDPIPAISKIFSYVAQQERQLLGNTGPGINFEPKDISINAAKTICDFCGRIGHVESVCYKKHGVPSNYDAKNKSNNGRKTCTHCGKLGHTVDVCYRKHGYPPGYKPYDERTTMNNVVTVESKATDDQAQHHESHEFVRFSPEQYKALLALIQEPSAENTTPNQPKQVASISSCTVNTPINLVSRNVMFYEDHFPYYSEIQHLNPDNSAPSPGSFSGKNLDPPIENYPSRPTISVPSSNEPSNEQPLPHLRRSTRAKHAPTYLQDYHRDLASSTSNASAVVRYPLSSVFSYSRLSPAHRNFVLSISSTTEPSLYAEASRHDCWIKAMKVELQALQSNNTKTQSAISCKGVHPNGGLDVNNAFLHRELDEEVYMQIPPDLSVDNPQLVCRLQRSLYGLKQASRQWFTKLSSFLTSHGFQQSNADHSIFLRFTGAITTILLVYVDDIILTGNSIAEIQTIITLLDQEFRIKDLGDLKFFLGLEIARTSDGIHLCQHKYTLDILCDSGMLGCKPNSTPMDYSTKLQMNSGNLLSTESSSSYRRLIGKLIYLTNTRPDIAYAVQQLSQYMATSTNTHLQAAFRILRYLKGTPSSGLFFAATGTPQLQAFSDSDWAGCKDSRKSTTRFLVYLGSSLVSWQSKKQSTVSRNSSEAKYRALASTTCELQWLTYLLQDFRTTFIQPATLYCDNQSAIQIATNPVFHERTKHIEIDCHIVRHKINSGLVKLLPVSSSLQLADIFTKALTPAIFQHLCNKLGMMNIHSQLEGGS

SEQ ID NO: 166843 - protein, 322 aa, Glycine max
  Coding DNA Sequence Number=SeqID_50065
  Homolog annotation: Hit_ID=Q2QNG5; Match level="QueryCoverage=91%, HitCoverage=22%, E-value=3e-24, Identity=42%"; Hit description =Expressed protein
MAIKLVETAIESIDSFVYRESVKSEVNLRSAQLFALNHLRCMAALDNKECFRDLLDKYVEQYPSCIELVLASALIQKQDINVDSFMGFEEAINRWSIEVPGIQCIWNQYIENAIHNRRIDLAKAITIWWFKSIWQNDKTAACIALDKAKSTASFGGLEQCIKTYVMFLVYDAWSLKEDGSDGAIKKNLELYADGSSQALLVPKLWFGSSILPQTVSDPKHLVDFVEAIMEVVPHNFPLAIVVCKLLTKEYNSDSNSASLWFWACSSLLNAILDAMPIPPEYVWVEAAELLHNSMGIETICDRFYRRALSVYPFSIMLWKSFY

SEQ ID NO: 166844 - protein, 124 aa, Glycine max
  Coding DNA Sequence Number=SeqID_50066
  Gene Ontology: Mol. function=protein binding
  Homolog annotation: Hit_ID=Q9FKT0; Match level="QueryCoverage=90%, HitCoverage=23%, E-value=8e-45, Identity=80%"; Hit description =Similarity to actin
MLIYFLISDTESAKASRQQLKEAIYASLFDMNVPAVCAINQATLALYAAKRTSGIVVNIGFQVTSIVPILNGKVMRKVGVEVVGLGALKLTGFLREKMQLNNLSFQSLYTVRTLKEVLIFIFVV

SEQ ID NO: 166845 - protein, 206 aa, Glycine max
  Coding DNA Sequence Number=SeqID_50067
MEEGNAWRIEDGRTVDVKIDKWINRLLDQEKNSWNMELFSQPFDQPTMEAIKVMPLRWTMTTCSIFWKHTSNGYYTVKSRYFVANNKYSRLESPSFQEESTMHALVYCGEAAVFVCITIELANWGGEIRRALPASSHPRSPPESVSNNRIRWNAPLDGIFKINFDITIPKEVSQAHCRESKGHVLVATMKLLESILEPREVEAYAF

SEQ ID NO: 166846 - protein, 114 aa, Glycine max
  Coding DNA Sequence Number=SeqID_50068
MVVGNATIEKPREEWNDDERRKRFNKFLRNKGNQRRSNINPKKKGEDSYLTPKCDECDQPRHLRLNCHVLKRRMEKSDKSNFKEKKASITWEDNDMDSSSDSENKIINLGLMAH

SEQ ID NO: 166847 - protein, 521 aa, Glycine max
  Coding DNA Sequence Number=SeqID_50069
  Homolog annotation: Hit_ID=Q7F8T9; Match level="QueryCoverage=87%, HitCoverage=90%, E-value=1e-132, Identity=53%"; Hit description =Putative GAMYB-binding protein
  Pfam annotation: Domain name=WD40; Domain location=383-421; Score =27.8; E_value=3.8e-05; Accession=PF00400.22; Description=WD domain, G-beta repeat
  Pfam annotation: Domain name=WD40; Domain location=426-464; Score =6.3; E_value=6.7; Accession=PF00400.22; Description=WD domain, G -beta repeat
  Pfam module annotation: Pfam domain module=WD40::WD40; Domain location=383-421::426-464
MSRHQGGNAEDMADEFEMEDVEDDMDDESIDRERGGVESDIDDYDHSISRANIVVLVQSGKGVDTTAAQARRGQDIQGIPWDSLNITRERYRQTRLEQYKNYENIPGSGDKSGKDCKNTKKGYSFYDFRKNSRSVKSSILHFQLRNLVWATSKHDVYLISQFSIMHWSSLTCKSSEVLNVSGHVAPSERHPESLLEGFTHTQVSTLAVKEKLLVVGGFQGELIFKVYDQILLTRLDQSYSLELAFGFGFGLGSVTLPDAANLSLIGIVLGIRTINRYQDFITFFVTGMQHLDRPGVSFCTRTTYDDNAITNAIEIYDCPSGAVHFTAANNDSGVRDFDMEKFQLSKHFCFPWPVNHTSLSPNGKLLLIVGDNPECMLVDSQNGKTIVPLSGHFDYSFASSWHPDGVTFATGNQDKTCQIWDLRNLSKSVAVLQSNIGAIRSIKYTSDGRYMAVAEPADFVHVYDVKSGYENEQEIDFFGEISGISFSPDTESLFIGVWDRTYGSLLEYGRRRYYAYLDSLT

SEQ ID NO: 166848 - protein, 120 aa, Glycine max
  Coding DNA Sequence Number=SeqID_50070
MAWRFMGHSFACGDGGFSMVWRWCWVVVVVVFECNNVVGCNSHGGLGEMQLGLLGRGREFKGGKEEEVIQLLELEEDHNNGEENEEDFWLIRKVLSNSNVNPKGVLDLNDQAWKARGSRD

SEQ ID NO: 166849 - protein, 129 aa, Glycine max
  Coding DNA Sequence Number=SeqID_50071
  Homolog annotation: Hit_ID=Q1SLQ0; Match level="QueryCoverage=51%, HitCoverage=6%, E-value=9e-07, Identity=43%"; Hit description=AAA ATPase, central region
MAMFGDFNVILNKDEKDGVNSLPFCGMEDLGFKVHKFTWSKERRSGDNIKERFDRFLSNGSRVNLEMMEVLEEHFTLEEVKETLAQMHLLKASRTNGTLALFYKSFWELIRNDVTHKVLEIPNDGEDPA

SEQ ID NO: 166850 - protein, 133 aa, Glycine max
  Coding DNA Sequence Number=SeqID_50072
MELNIVRMNNEEVNFNIRDVMKHLFNLDYCLKIGVVYQLVEEDVSRHTSFTPFKHVVVNVIENLDEAKQDEKKDCLTWLESQSLEACLDEGKHDVIKEKEKTSKECNAKIDTSSLGQWIYNGEDSSYQQLLRQ

SEQ ID NO: 166851 - protein, 129 aa, Glycine max
  Coding DNA Sequence Number=SeqID_50073
MQADEEEPVAPEAVLATREGERNGKTIAEAQLVGEATWEASETETIKEKLPSLCVEENAEIREGDIDGNPVPMVLGQSTIEKPLKVYTRRPKAQVPKAEHPKKEITEANEEQCRHNFGSYTAVSLGNTK

SEQ ID NO: 166852 - protein, 81 aa, Glycine max
  Coding DNA Sequence Number=SeqID_50074
MEFRNFDTRCTGELLKHMDRQNEVLMQAYRSMFHELRKLQVEEEMLMRKMHEVMSAHDPTKSPTSEKHLKVYTRTVGDPSA

SEQ ID NO: 166853 - protein, 94 aa, Glycine max
  Coding DNA Sequence Number=SeqID_50075
MKQIRSQYKNKLYHLHQVYLKEKDRPKYVSLEYWNWLIKNKWSGSKFQEKILTNKANRSKQEIKSIIGTKSIVQKTFEMKEDSISGEWPDGVEV

SEQ ID NO: 166854 - protein, 69 aa, Glycine max
  Coding DNA Sequence Number=SeqID_50076
MPNRSGKRKENQDKDEWSEGPIERKLIIDPLAPHCKAQRKEFTRIFLGSCCLNVFLSNNYWSTKYEPKA

SEQ ID NO: 166855 - protein, 99 aa, Glycine max
  Coding DNA Sequence Number=SeqID_50077
  Homolog annotation: Hit_ID=Q6ZCC0; Match level="QueryCoverage=41%, HitCoverage=4%, E-value=3e-07, Identity=51%"; Hit description =Putative RNA recognition motif (RRM)-containing protein
MAYQTWEVEQGSLQDLESIDLVDIYPDDVVSSYQKALEMYNVGNIVRNVYSRATKNCPWVGALWVRYMLSLEHVGAFEKDLSEIFSWKQPTFIGKFPLS

SEQ ID NO: 166856 - protein, 255 aa, Glycine max
  Coding DNA Sequence Number=SeqID_50078
  Homolog annotation: Hit_ID=Q1SWX1; Match level="QueryCoverage=77%, HitCoverage=40%, E-value=3e-10, Identity=25%"; Hit description=IMP dehydrogenase/GMP reductase
EGKKGVLFSCGDYPNILLIGTRGCINYNPALAIRQLGYPMRGAPMEESLSPFLVRDFGAQSFKIVQRVHKAWESPLRKDKELRGIHNGIIGGYHEWLKVHTRGLDWLSKLKIINEQNFEAPEEDEEVRALKTELGKARLAKEKFKLVATDVRKCAELQEENAATARALEQETKRARKEEHDRDKFCGALWGSNKELKLRREERDQSRVHSMVLKEELAACSRSKRSFGPTLRSHGAKHASYNRAVQRRVKLVFDP

SEQ ID NO: 166857 - protein, 54 aa, Glycine max
  Coding DNA Sequence Number=SeqID_50079
MDKSLKVGEDEWRERKRRSTKFRASNELWFSPLIHDQVQDSLLSVLRCHEACKA

SEQ ID NO: 166858 - protein, 417 aa, Glycine max
  Coding DNA Sequence Number=SeqID_50080
  Gene Ontology: Mol. function=DNA binding; Cellular component =intracellular; Biological process=regulation of transcription, DNA -dependent
  Homolog annotation: Hit_ID=Q9LTT3; Match level="QueryCoverage=94%, HitCoverage=94%, E-value=3e-40, Identity=54%"; Hit description=High mobility group protein-like
  Pfam annotation: Domain name=ARID; Domain location=49-160; Score =38.3; E_value=2.6e-08; Accession=PF01388.11; Description=ARIDBRIGHT DNA binding domain
  Pfam annotation: Domain name=HMG_box; Domain location=341-408; Score =39.2; E_value=1.4e-08; Accession=PF00505.9; Description=HMG (high mobility group) box
  Pfam module annotation: Pfam domain module=ARID::HMG_box; Domain location=49-160::341-408
  Subcellular localization annotation: CTP_CleavageSite=23; ConfidenceScore=5.08e-01
MNVTNKPNPDGSTNGFQSQLQVQQQNGWEQGSSRLRPTKPYPAPTARYQDIVRDANLFWGTLQAFHKILGTKYKVATVGGTSLDLHRLFVEVTSRGGIEKVIVDRKWKEVILTFNFKDTITSASFVVRKSYLSMLYHYEQVYYFGRQGIPPPTPGLEIFSIGQNRVYKWGQFPHIVFGIELGLNPNSKMVAESMIMIVVGFIKPQDVQTSVRGGVIDSTLTSDLMIRGQSGQPYSSTTIPEVAAVNDSPVQTLCSSNRGTPVQAHDDMVSGTIDAKFDGGYVVTVILGSEQLKGVLFHVPDNVSQSSHAEGTSSSQNLGDGTSNSQSRKRAKYAPRDPFRPKSNRSGYNFFFAENYARLKPSYHGQERAISKRIGFLWNNLSEAERQVYQEKGMRDKERYRTELMEYKSNNSTPNAQ

SEQ ID NO: 166859 - protein, 134 aa, Glycine max
  Coding DNA Sequence Number=SeqID_50081
  Gene Ontology: Mol. function=DNA binding; Biological process=DNA integration
HFWHPFQLREEVSLKVPVEPNSDLSRLIPYGVTVTYLPSLEVVTLFVNILVSNVPPRKVHFRGQPQTRICFKLGFQPLNNAKGVFGTALVGTRFNIYTVVFSALAHKDLGRLELLSILRTMSNNVWFLLSATPF

SEQ ID NO: 166860 - protein, 395 aa, Glycine max
  Coding DNA Sequence Number=SeqID_50082
  Gene Ontology: Mol. function=transcription factor activity; Cellular component=transcription factor complex; Biological process =regulation of progression through cell cycle
  Homolog annotation: Hit_ID=Q1SSY4; Match level="QueryCoverage=99%, HitCoverage=86%, E-value=1e-110, Identity=57%"; Hit description =Transcription factor E2F/dimerisation partner
  Pfam annotation: Domain name=E2F_TDP; Domain location=1-31; Score =4.3; E_value=0.0024; Accession=PF02319.11; Description=Transcription factor E2Fdimerisation partner (TDP)
  Pfam annotation: Domain name=E2F_TDP; Domain location=166-246; Score =128.8; E_value=1.5e-35; Accession=PF02319.11; Description =Transcription factor E2Fdimerisation partner (TDP)
  Pfam module annotation: Pfam domain module=E2F_TDP::E2F_TDP; Domain location=1-31::166-246
VERRRIYDIVNVLESIGVLSRKAKNQYTWRGFAAIPLTLQDLKEEGLKENSNSLRGPGNHDKVSDDEDDEETQSNPAATGSQSDKLNPNSTLPKPLKNENECKKKKRYGWDAFKEKNIDLGWRVVRELGHHHLTKSSVPFVKRLLAATVVYLCCWQRHQLLRFENRREKSLALLTQNFVKLFVCSNVELISLDEAAKLLLGDAHNTSVMRTKVRRLYDIANVLSSMNLIEKTHTMDTRKPAFRWLGSEGKTWDETLHKSNLNDSRKRAFGSDITNISFERNKVELFTSGDLNPNPKKPRMENGSGLGEADENNLKQGIKQASKSYEFGPFAPACVPKVGASQNNNMKQVHDWGSLATAHSPQYQNEALRELFSHYMEAWKLWYSEIARKRPLQIL

SEQ ID NO: 166861 - protein, 83 aa, Glycine max
  Coding DNA Sequence Number=SeqID_50083
  Homolog annotation: Hit_ID=Q9AUH7; Match level="QueryCoverage=96%, HitCoverage=68%, E-value=9e-11, Identity=55%"; Hit description=UVI1
MDGNNYNSWADQWDDGPDPVMVGSNSYSNKNSNGNTAKYKQKLGEGFGKTKAVASTGVKKLKDGTSVGLHWIKAKYSKATQKH

SEQ ID NO: 166862 - protein, 328 aa, Glycine max
  Coding DNA Sequence Number=SeqID_50084
  Gene Ontology: Mol. function=oxidoreductase activity; Cellular component=chloroplast; Biological process=metabolic process
  Homolog annotation: Hit_ID=Q1S775; Match level="QueryCoverage=68%, HitCoverage=61%, E-value=2e-71, Identity=50%"; Hit description =Aldehyde dehydrogenase
  Pfam annotation: Domain name=Aldedh; Domain location=1-227; Score= -62.1; E_value=5e-13; Accession=PF00171.12; Description=Aldehyde dehydrogenase family
MATWKVAPALAAGCAAILKPSELPTCLELAQICQEVGLPPVDKIAFTGSSATGSKIMTAAAQLIKPVSLELGGKSPIIVFEDVDLYKGCRIGPIVSEGRAYFLFLISAYMSYSLSKVKDSYALYEKILKFISNAKSEGATILTGGSHPEHLKKGFFVEPTVITDVTTSMQIWREEVSGPVIPILASMQVFKAGIVWINCSKPCFTQAPWGGIKRSGFGRELGEWYAVAEEKECVQRKKECDGGKDLLDLLWSFLSGSSEVAMFTEAISSRGSRGGMRQWQRGGLAATEREKLATILSKQESLEGGFKRDVLSSYDGDSDGEQVNNFWC

SEQ ID NO: 166863 - protein, 46 aa, Glycine max
  Coding DNA Sequence Number=SeqID_50085
MKPCTWTEVSKEADTKEERSVMLKHKASELRREKDKNINHIFSQLK

SEQ ID NO: 166864 - protein, 64 aa, Glycine max
  Coding DNA Sequence Number=SeqID_50086
  Subcellular localization annotation: CTP_CleavageSite=20; ConfidenceScore=5.21e-01
MRVSSSTVSDPSFLGDPIVPSSEGKDGNSHPGSRFMVSSNFDSRLVERLDMMYVRVLVWPAVQG

SEQ ID NO: 166865 - protein, 490 aa, Glycine max
  Coding DNA Sequence Number=SeqID_50087
  Gene Ontology: Mol. function=RNA-directed DNA polymerase activity; Cellular component=chromatin; Biological process=chromatin assembly or disassembly
  Pfam annotation: Domain name=Chromo; Domain location=440-490; Score =27.7; E_value=4.2e-05; Accession=PF00385.14; Description='chromo' (CHRromatin Organisation MOdifier
  Pfam annotation: Domain name=rve; Domain location=215-371; Score =93.5; E_value=6.3e-25; Accession=PF00665.16; Description=Integrase core domain
  Pfam module annotation: Pfam domain module=Chromo::rve; Domain location=440-490::215-371
DMLPIPLVDDLLDELHGSKMFSKIDLWSGYNQVRMENNDIHKAAFKTHGGHFEYLVMPFGLTNAPATFQGYYRRFVRGFGGIARPLTKMLKKNNFHWSNKAKAAFQSLKDSLIQSPVLALPDFSKVFVVEVDASGYGIGAADPDIQKLIQDLQTDASSHKHHTWNHNELRRKGRLVVRKDLTLQTDLLQWIHAGPTSGHSGREATLKRLKSIVYWRGMTKDHITMDFIEGLPNSKGKQVIYVVVDKLSKAAHFMSLTHPYTAIEVAQSFLDNVFKLHGFPDSITSDRDPIFVSQFRKDLMAFQGVQLQLSSAYHPQTDGQSEVVNRCLETFLSCMCCDVPHEWSKWLPLAEWWYNTNHNTSIQCSPYEVMFGQPPPIYLPYLPGESKVEDKIGVVAYKLKLPQGSKIHDVFHVSQLKRHVGEAPVSNFLPTDSDGVMGGKEPELILDRATVKRGNRTVTKVLVKWKHQLIEYATWEFLYDLKRTYPTFNP

SEQ ID NO: 166866 - protein, 327 aa, Glycine max
  Coding DNA Sequence Number=SeqID_50088
MSGKGEILISRRQWNEEQLEENLEECHGTVRDAAITMGTHVSPLREYDKFQRELERRIWHKAFTRQPDRRINVALFKEFYANLYDPEDKSPRGALLSLFKVLLYTPRPSGACFQAMHSRGEVSLRSGDEDGYGCGLGFPALTTALYIARGVVPDSLTLESLSLAINLAYIQKKNYASAPSSSTPAPASTSAPPPPAPSGTSAQNIDVLVPMLQSLHHGLCLAMQSIHDLAQHRPIISMEDFMAQVAWPGVHPSPVGGGEAPTAQEPQPEPEATPAETPEVTLAATPMDVTEYTDYAADMAAVQSTWDPWPTSARDIHLPAQDALSSP

SEQ ID NO: 166867 - protein, 560 aa, Glycine max
  Coding DNA Sequence Number=SeqID_50089
  Gene Ontology: Mol. function=RNA-directed DNA polymerase activity; Cellular component=chromatin; Biological process=chromatin assembly or disassembly
MESNIPYIVEENGLKRSNHAERWSGEKSTTMELETERTIQLENSIDIGIVVIPSFTFISGISLDLPLAVMAEATHNQAALREQEERLEHRITSKLKARIMEITSSIHQAIDSSIDRRILETLQKNFDSEINATDRGPHRRDEHHANSNYSCGTRLAQIDFPRFSGDAIQQWIYQCEVYFGINGTPVDFRVKLVVIHFKGKALQWHTSFVKTLPEGNLPKWTEFTNILIDRFGVVYDDPMAKLMQLRQKGTVVEYHDQFDAITSRLDISVANLLSCFLGGLKKDIQMTVKMFQPQDVRKAFQLAKLYESASSSYIPTKTFPKFQKTQPSTKAILPTPNPTHKPIDSQFTLNPTQRQPNKKLTPAFMAERRSKGLSYFCDEPYSPNHALTHKKLEIHVLEVSDTEEEIVDQFDNTHEDGSTSLDPQILVNALTGIASSKTMRVTDIPILSVAVADGARVNITSTVKQFSWILENTGFTSDMLLIPLGCCDVVLGIEWLVTPGDITWNFYRLFMQFYVQDNNFLLHSLTTHATNQATPESIEELLLQFEDIFQGPTRLPPKRK

SEQ ID NO: 166868 - protein, 330 aa, Glycine max
  Coding DNA Sequence Number=SeqID_50090
  Homolog annotation: Hit_ID=Q75GI7; Match level="QueryCoverage=93%, HitCoverage=76%, E-value=2e-10, Identity=25%"; Hit description =Expressed protein
MEYQSFGRVQRPKGANIMQALKVILVLAVGAWLLYQVKHSRNDTENYSDQTEFDGAILLGRKGMPSRLDEMDFPDSGNVDSAGEANESSNGRDDGSGGAKEDKAEEEFGHIYEIFSRGKEVELEPESTQPELSSKIQHKHLSKTKSEKVGLESRSESGHKEHGNEKYPRIPIINDSKSNDKEEEVQLREQLKEVQVRKNATSDFSKMENDGDEWPKIREKETRMHKNVADNDKNAEVTEEINEVQSFHDENGVPPNVNETEIVHEENISNAGKGSWFRKHIYEVTYVEDNTVEVNWEASKNHADEEINTVSITQVDPSGIKRNSEIDGDS

SEQ ID NO: 166869 - protein, 158 aa, Glycine max
  Coding DNA Sequence Number=SeqID_50091
  Gene Ontology: Mol. function=nucleotide binding; Cellular component =membrane; Biological process=small GTPase mediated signal transduction
  Homolog annotation: Hit_ID=P28186; Match level="QueryCoverage=84%, HitCoverage=62%, E-value=9e-64, Identity=88%"; Hit description=Ras -related protein ARA-3
  Pfam annotation: Domain name=Miro; Domain location=2-73; Score=-5.3; E_value=0.018; Accession=PF08477.3; Description=Miro-like protein
  Pfam annotation: Domain name=Ras; Domain location=17-121; Score =130.5; E_value=4.5e-36; Accession=PF00071.12; Description=Ras family
  Pfam module annotation: Pfam domain module=Miro::Ras; Domain location= 2-73::17-121
MAAPPARARADYDYLIKLLLIGDSAYYRGAMGILLVYDVTDEASFNNIRNWIRNIEQHASDNVNKILVGNKADMDESKRAVPTSKGQALADEYGIKFFETSAKTNMNVEEVFFSIARDIKQRLADTDSKAEPQTIKINQPDQAATGGLAAQKSACCGS

SEQ ID NO: 166870 - protein, 289 aa, Glycine max
  Coding DNA Sequence Number=SeqID_50092
  Homolog annotation: Hit_ID=Q7XDI4; Match level="QueryCoverage=98%, HitCoverage=30%, E-value=2e-29, Identity=28%"; Hit description =Expressed protein
  Pfam annotation: Domain name=DUF810; Domain location=1-288; Score= -402.1; E_value=5.1e-07; Accession=PF05664.2; Description=Protein of unknown function (DUF810)
MYPYEAEAVIINLVKSWIKTRMDGLEECVDRNLQEEVWNPRANKECFAPSVLEILGIIDDSLEAFFLLPIPMHAALLPELMSALDKSLQQYILKAKSGCGSKFHGVFRKKGKSQVTDQRRIFHHGTTNVDSSFALPQFCVRINTMQRIGMGLKVLEKRTISRLGNSKSTKEYGIEDKFKLSKAASVEGIRQLSEAMTYKVIFQDLRYVLWDGLYFGEVSSTRIEPFLEELNQCLKIILSTVHDRVITHVITEVMKASFDGFLLVLLAGGPARAFSLEDHVIIEEDFKLD

SEQ ID NO: 166871 - protein, 354 aa, Glycine max
  Coding DNA Sequence Number=SeqID_50093
  Gene Ontology: Mol. function=metal ion binding; Cellular component =intracellular; Biological process=protein kinase C activation
  Homolog annotation: Hit_ID=Q1SRV8; Match level="QueryCoverage=95%, HitCoverage=74%, E-value=1e-141, Identity=72%"; Hit description =Tetratricopeptide-like helical
  Pfam annotation: Domain name=PPR; Domain location=175-209; Score =36.7; E_value=7.9e-08; Accession=PF01535.11; Description=PPR repeat
  Pfam annotation: Domain name=PPR; Domain location=210-244; Score=1.0; E_value=5.8; Accession=PF01535.11; Description=PPR repeat
  Pfam annotation: Domain name=PPR; Domain location=278-312; Score =44.2; E_value=4.5e-10; Accession=PF01535.11; Description=PPR repeat
  Pfam annotation: Domain name=PPR; Domain location=313-347; Score=4.1; E_value=2.4; Accession=PF01535.11; Description=PPR repeat
  Pfam annotation: Domain name=PPR; Domain location=74-108; Score=21.2; E_value=0.0038; Accession=PF01535.11; Description=PPR repeat
  Pfam module annotation: Pfam domain module=PPR::PPR::PPR::PPR::PPR; Domain location=175-209::210-244::278-312::313-347::74-108
MSMHSFRFLQLIFPCRRCFSTQNSVFRSLLDYSGNDPVALIATQLSNCATVRELNQVYAHVLTTHFLISNPAPFNWNNIVRSYTRLEAPRNALRILVFMLRNGVLPDCYTLPIALKAVCQTFDVNLGKQLHSIAIKIGLQCNEYCETGFLSLYLKAGEFGGARMVFDENPDPKLGSWNAVIGGLSQAGLARDAISVFLNMRRRGFMPDGVTMVSVMSACGNIGDLNLALQLHKCVFQAEAGARTDILMLNSLIDMYGKCGRMDLAYKVFAMMEEQNVSSWTSMIVGYGMHGHVKEALDCFWRMREAGVRPNFVTFIGMLSACVHGGAVQEGRFYFDMMKNVYGITPQLQHYGCM

SEQ ID NO: 166872 - protein, 236 aa, Glycine max
  Coding DNA Sequence Number=SeqID_50094
  Gene Ontology: Mol. function=metal ion binding; Cellular component =intracellular; Biological process=metabolic process
  Homolog annotation: Hit_ID=Q9LTV8; Match level="QueryCoverage=91%, HitCoverage=61%, E-value=8e-42, Identity=33%"; Hit description =Selenium-binding protein-like
  Pfam annotation: Domain name=PPR; Domain location=185-219; Score =47.5; E_value=4.6e-11; Accession=PF01535.11; Description=PPR repeat
  Pfam annotation: Domain name=PPR; Domain location=96-129; Score=7.3; E_value=1; Accession=PF01535.11; Description=PPR repeat
  Pfam module annotation: Pfam domain module=PPR::PPR; Domain location =185-219::96-129
MARPPVIEFYYYSVNSLHPEHFVNHGHCFNSDSFYASLIDNSTHKRHLDQIHNQLVISGLQHNGFLMTKVVNGSSNLGQICYARKLFDEFCYPDVFMWNAIIRSYSRNMFRDTVEMYRWMRWIGVHPDGFTFPHIIRYRFGSDVFVQNGLVSLYAKCGHIGVAKVIGLLCCARSFFDQMKTPNVIMRNAMISGYAKNGHAEEAVHLFRDMISRNIKPDSVTVRSAVLASAQVGSLE

SEQ ID NO: 166873 - protein, 121 aa, Glycine max
  Coding DNA Sequence Number=SeqID_50095
MHEHEHVVEFEDILPSPFAPNLSESELRETAYEMLVGACRSSGPKPLTFFSHSEQSNRGGTQRIPSPSLYRSLTVTASSRNGRAATTGELMRVQMKVTELTDTRLRRALLRVAAGQVSFSS

SEQ ID NO: 166874 - protein, 577 aa, Glycine max
  Coding DNA Sequence Number=SeqID_50096
  Homolog annotation: Hit_ID=Q9FNA6; Match level="QueryCoverage=95%, HitCoverage=97%, E-value=8e-90, Identity=38%"; Hit description =Arabidopsis thaliana genomic DNA, chromosome 5, P1 clone:MSH12
MISCDFLQSYQHKSFWMPRDAGCMAEENVGYENSSRVESKRSHKWFMDAGEPEIFSNKKQAVEAVSGRPVSGVSHANVSQWDNNSGFHSVTSQFSDRLFGSDLARTVNLVDKNVPSIVSGNLNMGRKDFEHQYGNDPSVGLSMSHSIADTSSCLNFGGIRKVKVNQVRDSDNCMPAASMGHSYSREDNSTISVGAGYNKNDGGNISLGPTYNNVNDNTIAMGSRMSKTDDNLLSMAHTFNKGDGGFMLLGHNYGKGDESILSMGQPFDKGDGNFISMGQSYEKEDGNLISLGTSYTKGHENFIPVGPTYGKSGENFITVAPYDKGTDHIISLGPTYDKVDSNIASTIPSFDRGDSSSLPVGQNHHKGQNSSISFGGFHDDPGPNIPSGIISGYDLLIGSQNSAQGMDSQNDLTETNTESLVNSIPKPNTKNDIVKNKEPKTTKKAPTNNFPSNVKSLLSTESARQKSLKGIIKGTGYLCSCDNCNQSKALNAYEFERHAGAKTKHPNNHIYFENGKTIYAVVQELKNTPQDMLFDAIQNVTGSTINQKNFRIWKASYQAATRELQRIYGKDDVVIPS

SEQ ID NO: 166875 - protein, 62 aa, Glycine max
  Coding DNA Sequence Number=SeqID_50097
MEKQGILTVEADQVARSMKVKGDDDDWMESSKEEMDGEQAEQSKSNGEPPQDLNSNVDIEEY

SEQ ID NO: 166876 - protein, 90 aa, Glycine max
  Coding DNA Sequence Number=SeqID_50098
MNEEQHVAGGEKRSQSEVKGWRWLTGWSRTGPPPPPITRSICAAVLRNVHVDERETGPIGSLPILLNGLQMKLKFQSSSLLLPFHFVHYI

SEQ ID NO: 166877 - protein, 64 aa, Glycine max
  Coding DNA Sequence Number=SeqID_50099
MDIHTVTAYPAGAQSNLAAPPPPVGYPTKDDLPSQQNVPVKTTTRGDGFWKGWSVNLYPKSYFV

SEQ ID NO: 166878 - protein, 78 aa, Glycine max
  Coding DNA Sequence Number=SeqID_50100
  Gene Ontology: Mol. function=transition metal ion binding; Cellular component=cytoplasm; Biological process=fucose metabolic process
MLKCPRCGVSRYKVKDDEECSSDENSNKGPSAKVLWYLPIVPRFKRLFAYVDDAKDLTWHANGRNYDGMLRHPSDSLQ

SEQ ID NO: 166879 - protein, 323 aa, Glycine max
  Coding DNA Sequence Number=SeqID_50101
MGTNQNGKRFYQVKIKGLDVTSLKELGRLMGPLQRQAFRKVYGKILDLTAAEVREEQRTDYTRVRFKVIARASKKEESIGDQHLAGIGGNAINWFPRWKEGKEGVLFSWYPMRGAPTEESLSPFLVRDLGVQSLKVIQRVHKAWRSPLRKDKELRCIRNGVIGGYHGWLRVHMRGLDWLSKLKVIDEENFETSEEDEEVQALKLELGKARLVKEKFKSAATHIRKECTELREENAATARALEQETKRARKEEHGRDKFRGALWGSNNELKLRREERDRSRVHGVILKEELAACARSKRSLAQHLEAMEQSMLAFIVQYKEELN

SEQ ID NO: 166880 - protein, 125 aa, Glycine max
  Coding DNA Sequence Number=SeqID_50102
MDDEKFWDKFNNLILNVNESGYLFSLKLKLHRDRFGPGPLTGLGEVSDRRCTRAGLARCEPASLAESDDSNGFENPVGGGAPVMDRRRRWLGAGCDNWVVEMGGTVVTWCLARSLCGAETLCVLG

SEQ ID NO: 166881 - protein, 392 aa, Glycine max
  Coding DNA Sequence Number=SeqID_50103
  Pfam annotation: Domain name=F-box; Domain location=4-51; Score=37.3; E_value=5.2e-08; Accession=PF00646.23; Description=F-box domain
MGKDLFSNLPDEILGRIVSFLPNESSLETSLLSTRWRDLWNEALVKHGTQEDIIGVVAGFITRFEEFDPLKHPRKLQFHFAEDSVVSATVANNNKLMLHFSPWKEEIQMGYELEFKQTKQHIATYQSFPSTFSVKTLYLKSVSCFTSNIAASIVSNLEHLQNLVVIDCKGLESLSVDSTSELHMLTILDCLELKTLHLKTSRLKSFRYRGPLPLLRPEYHFNLRDAMLDFRLGLSCSGLKTKDFDATLLTIKNCEVLTLCKWTFEELIWPSISPLSGSFIFYKLRELWWIDNYHEDEYNTDALFSFLKLCPSLEHLFVTIDPESYSAGGSNSCLMKGTKCTELEHLKLIKFMGFSSRKDEISLAKCLIHLIKGKPPKIKTSDGNCLDAVFVQ

SEQ ID NO: 166882 - protein, 94 aa, Glycine max
  Coding DNA Sequence Number=SeqID_50104
  Homolog annotation: Hit_ID=Q9M3B9; Match level="QueryCoverage=67%, HitCoverage=5%, E-value=9e-09, Identity=47%"; Hit description =Multidrug resistance protein 14
MAVGSVAAAAHGTALVLYLHYFAKIIHVLRLDPPHGTSQEQFDRFTEVFVSDSLIWFTWLAGDCRRKYPWKDDFLFDIFRVLMGLLCVAVCQGK

SEQ ID NO: 166883 - protein, 1203 aa, Glycine max
  Coding DNA Sequence Number=SeqID_50105
  Gene Ontology: Mol. function=ATPase activity, coupled to transmembrane movement of substances; Cellular component=integral to membrane; Biological process=transport
  Homolog annotation: Hit_ID=Q9M3B9; Match level="QueryCoverage=99%, HitCoverage=97%, E-value=0.0, Identity=63%"; Hit description =Multidrug resistance protein 14
  Pfam annotation: Domain name=ABC_membrane; Domain location=613-893; Score=126.7; E_value=6.6e-35; Accession=PF00664.13; Description=ABC transporter transmembrane region
  Pfam annotation: Domain name=ABC_tran; Domain location=222-405; Score= 143.2; E_value=6.9e-40; Accession=PF00005.17; Description=ABC transporter
  Pfam annotation: Domain name=ABC_tran; Domain location=968-1153; Score=200.2; E_value=4.9e-57; Accession=PF00005.17; Description=ABC transporter
  Pfam annotation: Domain name=Viral_helicase1; Domain location=971 -1151; Score=-58.2; E_value=0.054; Accession=PF01443.9; Description =Viral (Superfamily 1) RNA helicase
  Pfam module annotation: Pfam domain module=ABC_membrane::ABC _tran::ABC_tran::Viral_helicase1; Domain location=613-893::222 -405::968-1153::971-1151
MATFFSGLVIGLVNCWQIALITLATGPFIVAAGGISNIFLHRLAENIQDAYAEAASIAEQAVSYIRTLYAFSNETLAKYSYATSLQATLRYGILISLVQGLGLGFTYGLAICSCALQLWVGRFLVIHGKAHGGEIITALFAVILSGLGLNQAATNFYSFDQGRIAAYRLFEMISRSSSSVNHDGTSPDSVQGNIEFRNVYFSYLSRPEIPILSGFYLTVPAKKAVALVGRNGSGKSSIIPLMERFYDPTLGEVLLDGENIKNLKLEWLRSQIGLVTQEPALLSLSIRDNIAYGRDATMDQIEEAAKIAHAHTFISSLEKGYDTQVGRAGLSLTEEQKIKLSIARAVLLNPSILLLDEVTGGLDFEAERAVQGALDLLMLGRSTIIIARRLSLIKNADYIAVMEEGQLVEMGTHDELLALDGLYAELLRCEEAAKLPKRMPVRNYKETSAFQIEKDSSSHSFKEPSSPKMIKSPSLQRVSNASRPPDGAFNLLESPKVQSPPSEKMLENGLALDAADKEPSIRRQDSFEMRLPELPKIDVHSVHRHMSNESDPESPISPLLTSDPKSERSHSQTFSRPLSHSDDVSVKMRETKGARHRKPPSLQKLAELSFTEWLYAVLGSIGAAIFGSFNPLLAYVIGLVVTAYYRIDDPHHLEREVDRWCLIIGCMGIVTVVANFLQHFYFGIMGEKMTERVRRMMFSAMLRNEVGWFDDEENSADNLSMRLANDATFVRAAFSNRLSIFIQDSAAVIVGLLIGALLHWRLALVAFATFPILCVSAIAQKFWLAGFSRGIQEMHRKASLVLEDAVRNIYTVVAFCAGNKVMELYRLQLKKIFKQSFLHGMAIGFAFGFSQFLLFACNALLLWYTAICIKRGYMDPPTALKEYMVFSFATFALVEPFGLAPYILKRRKSLISVFDIIDRVPIIDPDDSSALKPPNVYGSLELKNVDFCYPSRPEVLVLSNFSLKVTGGQTVAIVGVSGSGKSTIISLIERFYDPVAGQVFLDGRDLKQYNLRWLRSHLGLVQQEPIIFSTTIRENIIYARHNATEAEMKEAARIANAHHFISSLPHGYDTHVGMRGVDLTPGQKQRIAIARVVLKNAPILLLDEASSAIESESSRVVQEAIDTLIMGNKTTILIAHRAAMMRHVDNIVVLNGGRIVEEGSHDTLVAKNGLYVRLMQPHFVESLVTSAPEGFFLECGVETGNWQ

SEQ ID NO: 166884 - protein, 844 aa, Glycine max
  Coding DNA Sequence Number=SeqID_50106
  Gene Ontology: Mol. function=protein tyrosine/serine/threonine phosphatase activity; Biological process=protein amino acid dephosphorylation
  Homolog annotation: Hit_ID=Q9C5S1; Match level="QueryCoverage=91%, HitCoverage=91%, E-value=0.0, Identity=50%"; Hit description=MAP kinase phosphatase
  Pfam annotation: Domain name=DSPc; Domain location=181-320; Score =119.2; E_value=1.2e-32; Accession=PF00782.11; Description=Dual specificity phosphatase, catalytic domain
VPRALPTVSFARNSIFPILLQVGMVGNDDAGHLSASREMFWRSASWSSSRTAAGNASSGEAEKGFADSGAADGPHGQNRRFGPPPLTPRSQQNCKARSCLPPLQPLSIARRSLDEWPKAGSDDIGEWPQPPTTPGGRANGSNGERLKLDLSSIQHNNPDHSRSNNGNGLVKRDRIAFFDKECSKVADHVYLGGDAVARDRDILKHNGITHVLNCVGFVCPEYFKADFVYRTLWLQDSPSEDITSILYDVFDYFEDVREQGGRVFVHCCQGVSRSTSLVIAYLMWREGQSFDDAFQLVKAARGIADPNMGFACQLLQCQKRVHAVPLSPSSLLRMYRIAPHSPYDPLHLVPKMLTDPSLAALDSRGAFIVHIPSAIYVWIGKDCEAIMERDARGAVGQIVRYEKVQGPNVIIKEGEEPVSFWDAFSSFLPLMDKDKSGNRVEEGKRLTSQVLPGERRVDSYNVDYEVFKKAITGGFVPPFASSGEHETHLPARESSWSVKVSYTGTKEFVSAPRLSFPRVYSDSMLCIYTSANANLSPSSSLSSSSSSVSSSSSPSYVSPDSISSDSSPHSKSLSEVSPDSSSIVLTSIPVSSCLSNFSNLSITSYSTPKTVSNSTDVLGVKLSHPWSQSASLPLKKSSTSLAERRGNLSKFLKLPLMNDKTQVTDKSSTSHASREYDILVNGNVSYLQQSDNKDYFCKSNNHAKDGGVNSIQKCELALCPSIAGSMDLKEFSQSTLKRTNESGLLQCNVAQTWVYHWPSLQKIETFGASHLDSKAAFVIFSPSMHVHPGNILYIWVGRSFNCDASQVHLDIDKQTDYVRIADWNQIGCDLLAQFSLPKNTVMKV

SEQ ID NO: 166885 - protein, 76 aa, Glycine max
  Coding DNA Sequence Number=SeqID_50107
MTFKYSMSWSNTLLVQYYVLGVIFPSCGVQTPLQGEDESRRSSPPQEDMDKSLKVGEDERRERERRSTKFCASKEI

SEQ ID NO: 166886 - protein, 157 aa, Glycine max
  Coding DNA Sequence Number=SeqID_50108
  Subcellular localization annotation: CTP_CleavageSite=64; ConfidenceScore=5.41e-01
MFARSIKGCRPLGTDVWGANTFPVRKYNSRAFHLKVRRSRLFRFFRRFPQINVGGDSARIPFVEHASRESRVTLPPKGRLRQRFVSKRPFRGNTGSNKIEKNHLKCINLTQEDWCHPLKNLSEEARENHLKSYWTKKHSKLSESPKREQPPKLRTFL

SEQ ID NO: 166887 - protein, 73 aa, Glycine max
  Coding DNA Sequence Number=SeqID_50109
MSFMIFWNYEGAIFKPNAITFYSYCPKGYCRNLTFCGQAKRGSRVRFPKEENARSRHQRLFVENVGKTKGNRS

SEQ ID NO: 166888 - protein, 385 aa, Glycine max
  Coding DNA Sequence Number=SeqID_50110
  Gene Ontology: Mol. function=RNA-directed DNA polymerase activity; Biological process=RNA-dependent DNA replication
  Pfam annotation: Domain name=zf-CCHC; Domain location=181-198; Score =25.7; E_value=5.7e-05; Accession=PF00098.13; Description=Zinc knuckle
  Pfam module annotation: Pfam domain module=Retrotrans_gag::zf-CCHC; Domain location=52-170::181-198
MAGIPNNMATLLLARMTQVLETLVQDCDVELIKYCKLSAFTKHNSTQEHKVTYATCMLSGEAKDWWKFASQALPSNEEVIPWAAFKESFLGNYFPRDLRKLKAKEFMELKQESMTVGEYDSKFHELMKSLIYEESVKGNQAEPKFGGPTTTINNNNNTYSLLKCCIRGGPHFQRDCPQLATVCSNCGKTGHTLKDCWSTPKKDGNLGSGAKNNYKNNNEGKLSVAWKSLDLLVSSLPYEFVVSTPTYKLVTTSIACFDCSVMVDDKTFSMNLICLPLSHLDVLLGMDWLSSNDISRVSEDKRVNNCRNLPYDGSEGEKPKKRLPKSKMRGSRHQRLFDENWAKRASTAKRSFSALSTTEESDRASASRSCAKREISALSAAVVFS

SEQ ID NO: 166889 - protein, 95 aa, Glycine max
  Coding DNA Sequence Number=SeqID_50111
  Subcellular localization annotation: CTP_CleavageSite=66; ConfidenceScore=5.18e-01
MPLLHGSHSSSLIFPGSDEFWVYCLRLIKEVLSTKNNSVSLSFRPTFSSFCMSKKCSIWMEGSLLVCMVVISRVEIISTAGELEVANAESLRVRV

SEQ ID NO: 166890 - protein, 142 aa, Glycine max
  Coding DNA Sequence Number=SeqID_50112
  Gene Ontology: Mol. function=beta-N-acetylhexosaminidase activity; Cellular component=membrane; Biological process=carbohydrate metabolic process
  Homolog annotation: Hit_ID=Q9M3C5; Match level="QueryCoverage=99%, HitCoverage=26%, E-value=2e-64, Identity=81%"; Hit description=Beta -N-acetylhexosaminidase-like protein
LQLRVDESYTLLVPKAKESSQVTIEANTVYGALRGLETFSQLCSFDYTTKTVKIYKAPWSIQDKPRFAYRGLMLDTSRHYLPINVIKQIIESMSYAKLNVLHWHIIDEQSFPLEVPTYPNLWKGSYTKWERYTVEDAYEIVK

SEQ ID NO: 166891 - protein, 69 aa, Glycine max
  Coding DNA Sequence Number=SeqID_50113
MQKLIKDRMENKVDNFVGLNKVVSGIKWMNGMKYRNGNNGSYRAPNEVIPKRGERSRFEIQFRLKNHLI

SEQ ID NO: 166892 - protein, 156 aa, Glycine max
  Coding DNA Sequence Number=SeqID_50114
  Gene Ontology: Mol. function=chlorophyll binding; Cellular component =integral to membrane; Biological process=photosynthetic electron transport
  Homolog annotation: Hit_ID=P56777; Match level="QueryCoverage=99%, HitCoverage=30%, E-value=7e-81, Identity=94%"; Hit description =Photosystem II P680 chlorophyll A apoprotein
  Pfam annotation: Domain name=PSII; Domain location=1-156; Score= -125.8; E_value=5e-05; Accession=PF00421.9; Description=Photosystem II protein
MDNGDGIAVGWLGHPVFRDKEGHELFVRRMPTFFETFPVVLVDGDGIVRADVPFRRAESKYSVEQVGVIVEFYGGELNGVSYSDPATVKKYARRAQLGEIFELDRATLKSDGVFRSSPRGWFTFGHASFALLFFFGHIWHGARIYSEMFLLVSTQI

SEQ ID NO: 166893 - protein, 102 aa, Glycine max
  Coding DNA Sequence Number=SeqID_50115
  Subcellular localization annotation: CTP_CleavageSite=72; ConfidenceScore=5.22e-01
MNCVFVHVSSTFEFGAMRSDSLVPFSILTIFRSPFNCIFVHVSSTFEFGAMHSDCLVPFSILTLFRSPMNCVFLHVSSTFEFGAMRSDCLVKFSILNLFGAP

SEQ ID NO: 166894 - protein, 63 aa, Glycine max
  Coding DNA Sequence Number=SeqID_50116
MSVKNLVGRLGVHDKTNHTLVSLVTLTRLKGALKSGIFTPKTYIPKSPSRPLPPNSGSTQKTF

SEQ ID NO: 166895 - protein, 58 aa, Glycine max
  Coding DNA Sequence Number=SeqID_50117
MPLRTLFLLPHQALIPEVSGVGSNGQIGNIKVTPETGLQNPGFHKQRNRSGGRAAQDR

SEQ ID NO: 166896 - protein, 101 aa, Glycine max
  Coding DNA Sequence Number=SeqID_50118
  Subcellular localization annotation: CTP_CleavageSite=25; ConfidenceScore=5.39e-01
MRAKILENVLIMSRLLRSFSRISFRSNSSSSSSSRNTNLLSDQDNQTQEVAPKHNLFDEEVRFEDINQNMDDWNIPEIPQDQLYVPETIKDKHNFDYIIKT

SEQ ID NO: 166897 - protein, 155 aa, Glycine max
  Coding DNA Sequence Number=SeqID_50119
  Gene Ontology: Mol. function=chitin binding; Cellular component =extracellular region; Biological process=chitin metabolic process
  Homolog annotation: Hit_ID=Q86AI8; Match level="QueryCoverage=97%, HitCoverage=41%, E-value=5e-23, Identity=37%"; Hit description =Similar to Homo sapiens (Human). Mucin 2
MTGPLNESISCFLIRVDPWVLEPIAFRGLHVLAIRGLHVLAIRGLHTLTFRGLHALTFKGLHALAFRGLHALTFRGLHALTFKGLHTLTFRGLHVLAFRGQHILAFRGLHALTFRGLHALTFRGLHVLDFRVLHVLAFRGLHVLATRGLHVLAIR

SEQ ID NO: 166898 - protein, 63 aa, Glycine max
  Coding DNA Sequence Number=SeqID_50120
MKQEMRLINCKVCKGSERGVPVSSSMRFFLVIHLFICSPEHKFKIITGSKHNNTQGVSYHIPS

SEQ ID NO: 166899 - protein, 38 aa, Glycine max
  Coding DNA Sequence Number=SeqID_50121
MAVMGGDGIAGGNGEAYGDRSNQKITYEDSPPLHLLKT

SEQ ID NO: 166900 - protein, 120 aa, Glycine max
  Coding DNA Sequence Number=SeqID_50122
  Gene Ontology: Mol. function=pyridoxal phosphate binding
  Homolog annotation: Hit_ID=Q653D6; Match level="QueryCoverage=92%, HitCoverage=32%, E-value=4e-25, Identity=53%"; Hit description =Molybdenum cofactor sulfurase protein-like
MKCHYLHITVLKAPGMKPLNICLSKQHEVTDAVTVWEWTGSAWDEGAEASQWFSDFLGKPCQLVRFNSASEVRQVDPDYVRGQHRTYFSDGYPFLLLSQYFLYSGIIGCTKRASKGTHTY

SEQ ID NO: 166901 - protein, 312 aa, Glycine max
  Coding DNA Sequence Number=SeqID_50123
  Gene Ontology: Cellular component=nucleus
LSMDDLPNVVLGQVVMEIPLELMLTISKKLPWMFFPDIIPLDHPIFDIINSTNPETDWDLRLACLLLYAFDCEGNFWQLYGDFLPSADECTSLLLASEEELLELQDSDLASTIRKQQQRALEFWESNWHSAAPLKIKRLAHDPQRFAWAVGIAQSRCINMQTRIGALNQEANMLIPYAVLLTFPTYDVFSTKDRMLEVLINAGQRIRKGDENPWDEIKFSGNARIHLDSFVSIFHISGLPEEYYHNNCLSNAGDSFVDGAVIAAARTLPSWSDGDVPPIPSVERKAAKELQDECQKMLAAFATTSKQDQKLL

SEQ ID NO: 166902 - protein, 398 aa, Glycine max
  Coding DNA Sequence Number=SeqID_50124
  Gene Ontology: Mol. function=sequence-specific DNA binding; Cellular component=nucleus; Biological process=regulation of transcription, DNA-dependent
  Homolog annotation: Hit_ID=Q66Q67; Match level="QueryCoverage=90%, HitCoverage=51%, E-value=1e-55, Identity=36%"; Hit description =Homeodomain protein HOX3
  Pfam annotation: Domain name=START; Domain location=45-263; Score =76.9; E_value=6.3e-20; Accession=PF01852.10; Description=START domain
MSQPESSLASTLAETSLVKQECDISDPVHDFASSDSEMEAKRIAKVANLAMAELLKLMRINEPLWAKSSYGVPGYVLVRERYASMFPRVDSLNSPPHTTREESSKYCRVVRIRARKLVEMLLDSEEWVNHFPTIVSKSETVKVLDVGSLENRNGALQVAISPLVSSRELFFLRYCQQVTDGTWAIAHVSIDSIEGRVLDSPVRRLPSGCVIYQMNEEFSMVIWAEHVEVNERIATCSRGGFTRDNVAYGAERWLWALNRMCERFVWTSINNMPPQASPEEVKGFNARMRAMRFSNRMVQGFFGVLYKLRDGGLAQSLEENNTEIKISLRKNTTPGMPEGIIATAITCIRLPVPQQNVCSFFMEAKNRPKWDVLSGGFAVNEFSHFTMGGRNCISILKI

SEQ ID NO: 166903 - protein, 622 aa, Glycine max
  Coding DNA Sequence Number=SeqID_50125
  Gene Ontology: Mol. function=calcium ion binding; Cellular component =integral to membrane; Biological process=protein transport
  Homolog annotation: Hit_ID=Q9FYH7; Match level="QueryCoverage=93%, HitCoverage=92%, E-value=0.0, Identity=67%"; Hit description =Vacuolar sorting receptor 6 precursor
  Pfam annotation: Domain name=EGF_CA; Domain location=508-549; Score =10.4; E_value=0.015; Accession=PF07645.6; Description=Calcium binding EGF domain
  Pfam annotation: Domain name=PA; Domain location=51-161; Score=83.1; E_value=8.8e-22; Accession=PF02225.12; Description=PA domain
  Pfam module annotation: Pfam domain module=EGF_CA::PA; Domain location=508-549::51-161
MKAFVAVALFALLLVFVDARFVVEKSSITVLSPHKLRAKRDGAIGNFGLPDYGGFIVGSVLYPTKGSHGCQVFEGDKPFKIHSYRPTIVLLDRGECYFALKVWHAEQAGAAAVLVTDSIEESLITMDSPEESSDADGYIEKITIPSALIEKSFGDSLKDALNNKDEVLLRIDWRESVPHPDNRVEYELWTNSNDECGARCDEQMNFVKNFKGHAQILERGGYTLFTPHYITWFCPPPFILSSQCKSQCINHGRYCAPDPEKDFGEGYEGKDVVYENLRQLCVHRVANESNRSWVWWDYVTDFHVRCSMKEKRYSKDCAEEVMKSLDLPVDKIKKCMGDPEADVENEVLKNEQQVQIGRGSRGDVTILPTLVINNVQYRGKLERTAVLKAVCSGFKETTEPSVCLSGDVETNECLERNGGCWQDKHANITACKDTFRGRVCECPVVNGVQYKGDGYTTCEAFGPARFMLSLYLTSLKANSIPFCIKDSKVNGCQCPVGFRGDGTNKCEDVDECKERSACQCDGCSCKNTWGSYDCKCKGNLLYIKEQDACIERSESKFGRFLAFVVIAVVVGAGLAGYVFYKYRLRSYMDSEIMAIMSQYMPLDQQNNVVHAETQPLRQQGTV

SEQ ID NO: 166904 - protein, 303 aa, Glycine max
  Coding DNA Sequence Number=SeqID_50126
  Gene Ontology: Mol. function=DNA binding; Cellular component=integral to membrane; Biological process=regulation of transcription, DNA -dependent
  Homolog annotation: Hit_ID=Q66C67; Match level="QueryCoverage=99%, HitCoverage=57%, E-value=1e-135, Identity=82%"; Hit description =Possible CorC/HlyC family of Mg+2/Co+2/heavy metal efflux pumps
  Pfam annotation: Domain name=TerC; Domain location=12-121; Score =128.7; E_value=1.6e-35; Accession=PF03741.6; Description=Integral membrane protein TerC family
MEWIADPTIWAGLATLVVLEIVLGIDNLVFIAILADKLPKQQRDKARVVGLLLALVMRLALLASISWLATLTKPMFIVAEHPFSGRDLIMLVGGIFLLFKATMELNERLEGKDEEQHGARKGARFWPVVAQIVVLDAVFSLDSVITAVGMVDHLAVMMIAVCIAIGLMLLASKPLTRFVNAHPTIVILCLSFLLMIGFSLVAEGFGYHIPKGYLYAAIGFSVMIEALNQLAQFNRRRFLSKVRPLRERTAEAVLRMLSGKHEEAEVDSHSANLLADSDSENGEIFNQQERRMIERVLGMAQRI

SEQ ID NO: 166905 - protein, 92 aa, Glycine max
  Coding DNA Sequence Number=SeqID_50127
MMGVEAAKFNFNREDVDQNRRIAANIDRRRVANGARGRRAQISTGICKPRAVACPIESLCSRCAGECSATMNWNENANKTQGSDPRCGGGIL

SEQ ID NO: 166906 - protein, 240 aa, Glycine max
  Coding DNA Sequence Number=SeqID_50128
  Pfam annotation: Domain name=Transposase_23; Domain location=67-132; Score=-5.0; E_value=0.004; Accession=PF03017.5; Description =TNP1ENSPM transposase
MTNLNFDVHAFTLNIRMCRLLALGDQKHFGRVHAAGVARCSCRYNPKGSCCLLSLSCVDPSGQDPDMGESDKCGLYVDDNPPRLVALGRVYEESTTVHNVPLGNNQVKVVVEEVQDANAYILVHTQEDKQGAEGLAKPVDRSEPDDDPLYQMALTILQLFLKTLQVSWDATMFGVYNDNFPFAYWQLVVICPKDNVVVCTLKVFNDIQGNKTKATAKWIAVKYFTGPRPLELERLKTIHI

SEQ ID NO: 166907 - protein, 103 aa, Glycine max
  Coding DNA Sequence Number=SeqID_50129
MSTRTTQQRHNDVVAVVQRDGGATTQWDGELVCKCEEEELKEKRECMCGNSSRVSKTDQVIGFSQNWTMRYGLKRVACMPDLIPQTDWIDHWFSVRSTNLVWF

SEQ ID NO: 166908 - protein, 315 aa, Glycine max
  Coding DNA Sequence Number=SeqID_50130
  Gene Ontology: Mol. function=C4-dicarboxylate transporter activity; Cellular component=integral to membrane; Biological process=C4 -dicarboxylate transport
  Homolog annotation: Hit_ID=UPI00005F71C7; Match level="QueryCoverage =99%, HitCoverage=69%, E-value=1e-142, Identity=84%"; Hit description= COG3069: C4-dicarboxylate transporter
  Pfam annotation: Domain name=DcuC; Domain location=1-312; Score =214.6; E_value=2.3e-61; Accession=PF03606.6; Description=C4 -dicarboxylate anaerobic carrier
MVGGLLLLGISALMGKTLLPSGAASTGWRATDIIEYVKILLMSRGGDLGMMIMMLCGFAAYMTHIGANDVVVKLASRPLQMINSPYLLMVAAYFVACLMSLAVSSATGLGVLLMATLFPLMVNVGISRGAAAAICASPAAIILAPTSGDVVLAAKAAEMPLVDFAFKTTLPISIAAIVCMAVAHFFWQRYLDRKSDEQHHIVDVSEIKTHAPGFYAILPFTPILGVLIFDGKWGPELHIITVLVGCILLAAAIEFVRSFSAKQVFSGLEVAYRGMADAFASVVMLLVAAGVFAQGLSTVGFISGFDRVGAVVRHR

SEQ ID NO: 166909 - protein, 204 aa, Glycine max
  Coding DNA Sequence Number=SeqID_50131
  Gene Ontology: Mol. function=nucleic acid binding; Cellular component= proton-transporting two-sector ATPase complex; Biological process=DNA integration
  Homolog annotation: Hit_ID=Q1RWN2; Match level="QueryCoverage=86%, HitCoverage=13%, E-value=4e-42, Identity=46%"; Hit description =Peptidase S8 and S53, subtilisin, kexin, sedolisin; Integrase, catalytic region; Zinc finger, CCHC-type
MEDKEEQEDELLLITFIDCIEGKKDEWFLDSGCGNHMSSNKEWFSELDENFRHNVRLGNDTHIAVKGKGSVWMVVNEIIHVITHVYYVLELKNNLLSIGLLQEKGLIITIQNNRCNVVHPKKGPVMEVNMSGNRMFVLIATMGAETTTCFQVDLEDNFQLWHNRLGYLSYDGLKTLIFKQMVKGLSSIITPRNICAHCLAGKQH

SEQ ID NO: 166910 - protein, 224 aa, Glycine max
  Coding DNA Sequence Number=SeqID_50132
  Gene Ontology: Mol. function=nucleic acid binding; Cellular component= proton-transporting two-sector ATPase complex; Biological process=DNA integration
  Homolog annotation: Hit_ID=Q1RWN2; Match level="QueryCoverage=85%, HitCoverage=16%, E-value=2e-59, Identity=53%"; Hit description =Peptidase S8 and S53, subtilisin, kexin, sedolisin; Integrase, catalytic region; Zinc finger, CCHC-type
MVKSIKYVQLAIPKFDGHYDHWAKLMENFLRSKEYWHLVEHLKDLKIKNYLYQAIDREILDTILNDETSKNIWDSMKQKFQGSTRVKRAQLQALRKDFEMLQMKEGESVDSYFARTLKIAKSMKAYGENMQESVITAKIMRSMKTKFNYMVCSIEESNNRDTMTTDELQSSLLVHEQRMMFPAEEEQVMQMVADEKSGRGKGRGRSIGSFRGRGRGRQTFNKAE

SEQ ID NO: 166911 - protein, 157 aa, Glycine max
  Coding DNA Sequence Number=SeqID_50133
  Gene Ontology: Mol. function=RNA-directed DNA polymerase activity; Biological process=RNA-dependent DNA replication
MRSKTGNMGWMVIKVDLEKAYDRLKWDFVVIHTINLVVGKNLWMPIQISRGGLTFSQLTFADNLFLFAETSVVWVDVINYALRNFCESSGAKVNEEKIRIFFLKNVNWHIKEETSAGFDFQCNENIGKYPGVPIFHKTVSSQTFNYATEKVDKRLDS

SEQ ID NO: 166912 - protein, 82 aa, Glycine max
  Coding DNA Sequence Number=SeqID_50134
MVLGLYYESEFHHRVMEKEAKSMPHLIVRLFFSSRSKSAISGGGVGEKGKKEKKKRLFSVEEVVGSGGTTRSTIVSVEEVEE

SEQ ID NO: 166913 - protein, 52 aa, Glycine max
  Coding DNA Sequence Number=SeqID_50135
  Gene Ontology: Mol. function=protein serine/threonine kinase activity; Biological process=protein amino acid phosphorylation
  Homolog annotation: Hit_ID=Q6ULS3; Match level="QueryCoverage=98%, HitCoverage=24%, E-value=7e-12, Identity=63%"; Hit description =Phosphoenolpyruvate carboxylase kinase 4
MEVYDVRALHVKGISGGSYCHLLIDGFDYIGVIGVCEGATKNDVESSSIDLL

SEQ ID NO: 166914 - protein, 69 aa, Glycine max
  Coding DNA Sequence Number=SeqID_50136
MVMTTMMVTMVMTMTVITIDDELTMTITIIMMVTIIVIMVVTTMTMKVMVTKVVIVDDVVTTTIMMVMG

SEQ ID NO: 166915 - protein, 42 aa, Glycine max
  Coding DNA Sequence Number=SeqID_50137
MVTTRIMMIIMTEMMTTVVLAAAMVKTVMSAKVVAIMATLMI

SEQ ID NO: 166916 - protein, 206 aa, Glycine max
  Coding DNA Sequence Number=SeqID_50138
MKADIEAMKEQMTTMIEAMMSMRKMMEVNTTTVIAASTAAEVDPTHPSGLNHGGKALGSIGNPHFVQVQNKHSFPPYGLPLNYTPPNVAHAPDENIDNSAPIPIESQQPQSDHAHVSQPMGETHEAPRDHNLADFEPYLGYATEGQAIGGVPLPNTLGGPQFPPQPQPLHFAVGNVPPAMMERGKFDHIEERLRVIEEGKDYTLLT

SEQ ID NO: 166917 - protein, 134 aa, Glycine max
  Coding DNA Sequence Number=SeqID_50139
MHKALRLNAPLPYPHLVTLFLQHFNIPLDSEPYVPIKRSFLIGAAVIASFGYRKEHDGSWVKKGAQPIDEEGHLQGGEDSSILQKILERFDTLELQVDMRFEEMESRITKVEEDVSYIRTSFDLPPPPPPSSSS

SEQ ID NO: 166918 - protein, 117 aa, Glycine max
  Coding DNA Sequence Number=SeqID_50140
  Gene Ontology: Mol. function=RNA-directed DNA polymerase activity; Biological process=RNA-dependent DNA replication
MTTNNKYRLRLNPAKCTFRVKSEKKLLGFIVTQKGIEVDLDKLTVTCEPLFKLLLKNQSVQWDNDCQVAFKRIKRCLMTPLVLVLPVPERPLILYMTVLDESMRCVLGQHDKSRKRE

SEQ ID NO: 166919 - protein, 72 aa, Glycine max
  Coding DNA Sequence Number=SeqID_50141
MLAIGNRLLPSGNRLPESKTLWLTAVLKVTTLCPCKGCNNRIHRALLKNKDIVSNLQNCSYESIISGSSRQK

SEQ ID NO: 166920 - protein, 109 aa, Glycine max
  Coding DNA Sequence Number=SeqID_50142
MQSQGLALPLELEVGPSAARVSTKESYIDPSRNDPDTGDSEKCGLYVEENPPCPVAIGRLYEGLTTVHNIPFHHDQVKAYDSDKYASGECRCVWIPRATVHTEIWANAI

SEQ ID NO: 166921 - protein, 74 aa, Glycine max
  Coding DNA Sequence Number=SeqID_50143
MGWLLRVRIATFARLDHLCGLPDGCAKPKDIQGVSLQPLFQRARHKLQVLSTRVLWAKLIITVLIMVLWTISTF

SEQ ID NO: 166922 - protein, 189 aa, Glycine max
  Coding DNA Sequence Number=SeqID_50144
MASQDSPTIETPDTHILVACVSTMGSCAEVAAKASIEEPSVVDVATMGLYIVGDQFYDTYAPVPFPTSKIQYVREAINTFVGWPTHFVKPISDEESHNHLPKPVGVVQRCNTIEIEKPLRELIKSLFDVYQKPVELPWDGPKFGIPNVNNSHVKYISIRFMDDKSTSLGHSSVYGFLEPQSIHNAKDRS

SEQ ID NO: 166923 - protein, 110 aa, Glycine max
  Coding DNA Sequence Number=SeqID_50145
MGIFGQSMLHAEVLSFLLAVDRPLMKSMEMSLLLWMSIGNGCRRLGTSTWVVVTENKRGYISCGSVQVEGTSTWLFKENKGGYIPCGSLLVKDFTRLKRNLKDRRSLGDW

SEQ ID NO: 166924 - protein, 197 aa, Glycine max
  Coding DNA Sequence Number=SeqID_50146
  Gene Ontology: Mol. function=ubiquitin-protein ligase activity; Cellular component=ubiquitin ligase complex; Biological process =protein ubiquitination
  Homolog annotation: Hit_ID=Q681N2; Match level="QueryCoverage=95%, HitCoverage=32%, E-value=6e-31, Identity=40%"; Hit description=Arm repeat containing protein
MEEERDVSSYELSEEKYDPLEEIHRVIQSVVQFDEYRRTQRKESHNLVRRFKFMLLLWEELHDLLQPFLEIGVTWLTKVKDVLLFTKDLLKLCSQGSKIHLALETEVVMITFQKVYDKLSQAFGDVPCDEIGILDEVKEQDTELAMDMMVVFSDNDDRNADSAIIERLAKKLELYSVKDLNIETLAIRNLAAERKGQ

SEQ ID NO: 166925 - protein, 137 aa, Glycine max
  Coding DNA Sequence Number=SeqID_50147
  Homolog annotation: Hit_ID=Q681N2; Match level="QueryCoverage=46%, HitCoverage=9%, E-value=2e-16, Identity=64%"; Hit description=Arm repeat containing protein
MKEGSPENKECVASVLLELCSSNSSFTLTALHFEVYEYLMEIKQNGTNKAQRKANAVLDLISRNYELQDLLLFNSLLDSRDWVVHVVTLTNSAPNGKLPMSILKDSILNEEAKRTKHCLSVTSTQSKALVIDSQGRM

SEQ ID NO: 166926 - protein, 53 aa, Glycine max
  Coding DNA Sequence Number=SeqID_50148
MELYQLKMEMGGDLHDHINKFIQLMWWSLSEGSSNHSRRHDGPRGRSKSQSHS

SEQ ID NO: 166927 - protein, 52 aa, Glycine max
  Coding DNA Sequence Number=SeqID_50149
MHMHHCCPVSRRIGEDLVDTTPSPRPKVRADTGPVIDRLSSYAWLKTLKKRY

SEQ ID NO: 166928 - protein, 94 aa, Glycine max
  Coding DNA Sequence Number=SeqID_50150
MTKTHQKGVRKGKRGRSLPPSSPKRARLLPPEELYKLRNDTCFLSVMSRNLTDYTIIPSLASGMLRNFTDCATMLPFDFQHVTKLHGLCNNASF

SEQ ID NO: 166929 - protein, 98 aa, Glycine max
  Coding DNA Sequence Number=SeqID_50151
MSNKVLGFPALITSLCQFYRVLIAPNKVIRPPTNRAFINKYCAPRQAQGETPQQPGDGQQRAIDAPPPPSEPLISPTKAGALPMTRGRPTGNQVQSQR

SEQ ID NO: 166930 - protein, 329 aa, Glycine max
  Coding DNA Sequence Number=SeqID_50152
  Gene Ontology: Mol. function=RNA-directed DNA polymerase activity; Biological process=RNA-dependent DNA replication
  Homolog annotation: Hit_ID=Q39558; Match level="QueryCoverage=29%, HitCoverage=36%, E-value=2e-23, Identity=59%"; Hit description=14-3 -3 protein 32kDa endonuclease
RALSVLLAVGASLELNEVPIVVFFHLEVEDLGVVGGSRGDEARVKDSITDVGEFGLNLGVVVTDDDDVVLVVVALLLLLDQGNDASGGATRPDHVLTFFTSNINPSLADTLIVPTSKVDSPKCVKEFRSISLCNVLFKTISKDWLGFLRANSNRIWLPDTIICLIMNNIRTTSLSLKWNNEISESFFPTRGLRQGDPLSPYLFVHCMDKLALLIQEEVQDNSWQPIHVTRGGPKMFGYVSSLKVNLKKSKFYCSKNVPDAKGGSRFCLILVLTMSCKMLGSPKEYVMRLKRRLDLSFGVVTTSIGPIDKQSLKPTKMVVLASALLGKSV

SEQ ID NO: 166931 - protein, 79 aa, Glycine max
  Coding DNA Sequence Number=SeqID_50153
MRGLASYFHERLYNCKGLIGREEDKEGWRWREGMTPKGAVQLGFHTTFALSAIAAHSVCGGNLALSAHSRSRLLHTFWR

SEQ ID NO: 166932 - protein, 44 aa, Glycine max
  Coding DNA Sequence Number=SeqID_50154
MDAEFTKRCVPRSLLEWLRRKTKIIQCFDKEYGKYPNGRAKGSL

SEQ ID NO: 166933 - protein, 68 aa, Glycine max
  Coding DNA Sequence Number=SeqID_50155
MQDETNIYYSTGFVTGTIYIVQNYFLPSLRKSLRLLLVGEAVGLLEDFWPDIPFTWSWPGKELVKISD

SEQ ID NO: 166934 - protein, 75 aa, Glycine max
  Coding DNA Sequence Number=SeqID_50156
MLQPYVINIGLKEHSNRVTPKAYTPKSPLPPYSGFTNVRENEKGLKPPFVLSSCDSFFSLHEYYLANPNGESVRN

SEQ ID NO: 166935 - protein, 246 aa, Glycine max
  Coding DNA Sequence Number=SeqID_50157
  Gene Ontology: Mol. function=4 iron, 4 sulfur cluster binding; Cellular component=cellular_component; Biological process=metabolic process
  Homolog annotation: Hit_ID=Q8GF11; Match level="QueryCoverage=68%, HitCoverage=37%, E-value=2e-86, Identity=89%"; Hit description=Fe-S oxidoreductase
MVSLCEQLAKLGVWVRLHYVYPYPHVDDVIPLMAEGKILPYLDIPLQHASPRILKLMKRPGAVERTLERIKRWREICPELTLRSTFIVGFPGETEEDFQMLLDFLREARLDRVGCFQYSPVEGATANQLPDQVPDDVKQARFDRFMQLQQQISAERLQEKIGREILIIVIGAQPVPARFEYGRRSGLFFFYRPRQLFAVSTVFPSALMIAVAARAGVAHLNKFARHIHTDKIILRAIRLEQLHDFF

SEQ ID NO: 166936 - protein, 261 aa, Glycine max
  Coding DNA Sequence Number=SeqID_50158
  Homolog annotation: Hit_ID=Q2HUM2; Match level="QueryCoverage=29%, HitCoverage=19%, E-value=5e-31, Identity=84%"; Hit description =Oxysterol-binding protein
DLPSQWLLFLSAVPPVQLLTGWCVTAKAPPDISAGKCSGRVPFAIQAAQLLGRAIGAGLFAITPAGERGMCCKAIKLGNARVFPEFDLFNLPKSQLQCYGESICTGSDLLSMCNNGQSPLDRLISMVAWCISTTRPVTFGVAPYNLILGETHHVSRGNLNVLLEHAFICIDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 166937 - protein, 111 aa, Glycine max
  Coding DNA Sequence Number=SeqID_50159
MGAAERLDIVGKDWLTVDEAAHYCGVSRSQFDSNIADYGIEPRNFMGKKLYEKAALYSAIYGSRQWSRSQSSGGTAPRTSTGGKAASEAVSPLVASAHAKLRAYEQRKKRN

SEQ ID NO: 166938 - protein, 189 aa, Glycine max
  Coding DNA Sequence Number=SeqID_50160
  Homolog annotation: Hit_ID=Q7WF54; Match level="QueryCoverage=46%, HitCoverage=24%, E-value=1e-35, Identity=88%"; Hit description =Arginine biosynthesis bifunctional protein argJ [Includes: Glutamate N-acetyltransferase ...
  Homolog annotation: Hit description=(EC 2.3.1.35) (Ornithine acetyltransferase) (Ornithine transacetylase) (OATase); Amino-acid acetyltransferase (EC 2.3.1.1) (N-acetylglutamate synthase) (AGS)] [Contains: Arginine ...
  Homolog annotation: Hit description=biosynthesis bifunctional protein argJ alpha chain; Arginine biosynthesis bifunctional protein argJ beta chain]
GQDRLLRLGPQPGPHPGRRGLCRHRRPGRVEDPPVARRRAGGQGRRPQPGLPGGRWPARDEAGRDHPTPSTPAISRTSTCRSTPTTVPDQDPPSARLTPGAKRRRSVARRASRDGGSNEIQWLRLTHRRSLPPGNPWHHRGPRQVTTVERRASPRRLAAGYAPSSSDDARECDAGPVPGPPVRSSRITP

SEQ ID NO: 166939 - protein, 149 aa, Glycine max
  Coding DNA Sequence Number=SeqID_50161
  Homolog annotation: Hit_ID=O75112; Match level="QueryCoverage=48%, HitCoverage=10%, E-value=2e-08, Identity=51%"; Hit description=LIM domain-binding protein 3
GGGCRPARLGELGCFHQKAPPSFATLRKAQGSEGSKQGSRTDRKYSRTKFGYDTRPRLQRTARPHLQRTTRPRLKGLHVLTFKGLYALAFRGLHALAVKGLHALALEDYTSSPLNDYTSLPSESYTPSPLEGYTPSPSEGYTPSPLEDY

SEQ ID NO: 166940 - protein, 208 aa, Glycine max
  Coding DNA Sequence Number=SeqID_50162
MEAEVTVVESLDGLNVAKEGFKVLSKAREVESEVGGNDGVSRLEDNGLRNKMKVSKGGKGKGAKNIFGVKETKNEPSTSISPQSVSTKTFTPFVPKTSNGEIKQKPVKGKVDVSSLSSVAQVESEEGRAFNACIKCSNDLRLQTKNRVKNPPVRQQILEDKGLCILPTIATYPSAGGRRGGSRVCLPREEARRVATNVYSRKTSEEPE

SEQ ID NO: 166941 - protein, 126 aa, Glycine max
  Coding DNA Sequence Number=SeqID_50163
RDSILGLTHSTVAHSSLRIETSQAIYLLSQKGSLLGLSHPMVAHSSLRIETSQAIYLLSQRGLLKLEDRNFSSYLSSLSERLSTWIDSLYGGSLKLEDKDFPSYLSSLSERLFLTLRNGFTLVLDG

SEQ ID NO: 166942 - protein, 217 aa, Glycine max
  Coding DNA Sequence Number=SeqID_50164
  Homolog annotation: Hit_ID=Q1SP02; Match level="QueryCoverage=72%, HitCoverage=34%, E-value=2e-18, Identity=33%"; Hit description=IMP dehydrogenase/GMP reductase
CWIYEHFPSVHQCVTDDAYKETSPRASRWLMTKAHMKGITGASHRACCDALTVTDVCWLPYSDHRGVRGFELISSFQGQLRWGPMVIIVRPERVLRQFGYIQSIPLSPVSASLSYDDIDDRWMHFSDHVVAMGELCVVPGQVSTDYMKWFFQISHPFMIPTQAGYEVIAKKLERVLNLRMVTVRTELHDIMQDCLKIARGVPAQMEVLGPDKDAHRA

SEQ ID NO: 166943 - protein, 199 aa, Glycine max
  Coding DNA Sequence Number=SeqID_50165
  Gene Ontology: Mol. function=helicase activity; Biological process =viral genome replication
  Homolog annotation: Hit_ID=Q1SN45; Match level="QueryCoverage=96%, HitCoverage=11%, E-value=1e-41, Identity=45%"; Hit description=AAA ATPase
MQDLFLKFVYNQKKRCWQLRKKGYTIGRLLWVPPITGELCYLRMMLTVCKRATSFEDLRTVDNVQYSKYKEACFAMGFLQDDKEFIEAIKEAKDWGSAHYIRKLFVLLLLTATMSKPKQVWDQTWHWMADDIVYNYKKSSTSPALQLDDRTLQNLVLLEIEQLLQANQRSLRDYPSMPYPEDENCPAYLDNSLILLELN

SEQ ID NO: 166944 - protein, 172 aa, Glycine max
  Coding DNA Sequence Number=SeqID_50166
MTQEAVDHDHEEDDTESCFFQDSNDRLLSSSSCSTSTSDDDTPTPQNDTLTPHNDTNATKNIASLNALPQFPFPTMCKYDAWISEPSSLSERRSRLLRQFGLPAPPPSSAAIPRSASSHHCTDTFSTTAAATIPRSKSDNTADRGTKHCKSSVVPIHDNDDVIIVVVVVLFV

SEQ ID NO: 166945 - protein, 193 aa, Glycine max
  Coding DNA Sequence Number=SeqID_50167
  Homolog annotation: Hit_ID=Q1T493; Match level="QueryCoverage=97%, HitCoverage=40%, E-value=2e-22, Identity=26%"; Hit description =Nucleic acid-binding, OB-fold, subgroup
NYCTQFLSYLNERGDDGPMVIILTHARIKDAQGSYPASVSNSFKASKLLINDPILEIQEFKERLLDLGVEAEAKTILEIDAISEDVVCVTVGTISKIVMDNHSWSYPACAQCHRKTDIQTGPFTCGCGKDNDQPVLRYKVEVMVTQNNESSTFLLWDHECAELIGETADDVNRVKIEDGDLDLDASPQALDKL

SEQ ID NO: 166946 - protein, 109 aa, Glycine max
  Coding DNA Sequence Number=SeqID_50168
  Pfam annotation: Domain name=zf-CCHC; Domain location=79-96; Score =32.0; E_value=2.1e-06; Accession=PF00098.13; Description=Zinc knuckle
TRDGTLTLNQNEENDKKKRSIALKASSSIQEENEEEDYDDEEDFSFFVKKFQKFIKKRRIDRRQNFNNGRKSQDDSQALRCYKCNQIGHIKANCPSNEEWSEKSEKEKI

SEQ ID NO: 166947 - protein, 137 aa, Glycine max
  Coding DNA Sequence Number=SeqID_50169
MTKLGLCVPSDTTVSEWQKGMTKLGLCVPTDTTVSEWQRGADNRKVSPRIIMTKLGLCVPTDTTVSEWQRGADNRKVSPRIIMTKLGLCVPTDTTVSEWQRGADNRKVSPRIIMTKLGLCVPTDTTVSDGKRVRITV

SEQ ID NO: 166948 - protein, 171 aa, Glycine max
  Coding DNA Sequence Number=SeqID_50170
GAPFERTIVDDWKFDYSSHDARRMVCIDQADMTGRLLAGSLTFNCHIMHYIIVRILMPRSFNLAQASEEDLILMWAFLTGHPIDWAHLIRYCMHKALRSSAPLPNPQLMTLFLRHFKIPLNLEPFVQVKRSFAIGAGAVTSFGYHKDMDGQWLKKDAQPPQEEHTPSPLPQ

SEQ ID NO: 166949 - protein, 53 aa, Glycine max
  Coding DNA Sequence Number=SeqID_50171
MHATGAPNPLGQRQISLTALDLLRQWSHLLLEYQWQRNGEGRKMIEDATSRRR

SEQ ID NO: 166950 - protein, 165 aa, Glycine max
  Coding DNA Sequence Number=SeqID_50172
  Gene Ontology: Mol. function=RNA-directed DNA polymerase activity; Cellular component=intracellular; Biological process=RNA-dependent DNA replication
  Pfam annotation: Domain name=G-patch; Domain location=46-90; Score =6.4; E_value=0.031; Accession=PF01585.13; Description=G-patch domain
  Subcellular localization annotation: CTP_CleavageSite=15; ConfidenceScore=5.06e-01
MDSLGGSHPLNTPPKAEIRGGRAFGHCFGGRRCFGSLLMQPRMSSATMMVAQIMLGHDYEPRMGLGKNNDGMAGLVDIKGKRGRFRLGYKPTQTDVRKNILERRNKGQGPQPRPQAREVPPCHISRSFVSAGLRHEEQVTAICNEAPQRWSDLVQPCLPDFQLGN

SEQ ID NO: 166951 - protein, 95 aa, Glycine max
  Coding DNA Sequence Number=SeqID_50173
  Gene Ontology: Mol. function=transporter activity; Cellular component= integral to membrane; Biological process=nodulation
  Homolog annotation: Hit_ID=P08995; Match level="QueryCoverage=68%, HitCoverage=24%, E-value=6e-26, Identity=87%"; Hit description =Nodulin-26
  Pfam annotation: Domain name=MIP; Domain location=1-90; Score=-119.7; E_value=0.056; Accession=PF00230.10; Description=Major intrinsic protein
  Subcellular localization annotation: CTP_CleavageSite=76; ConfidenceScore=5.28e-01
VPAYVAAQLLGSTLASGTLKLLFMGKHDQFSGTLPNGTNLQAFVFEFIITFLLMFVISGVATDNRADSMKNVTWVRSSVIKLINEVESVHRGILE

SEQ ID NO: 166952 - protein, 223 aa, Glycine max
  Coding DNA Sequence Number=SeqID_50174
  Gene Ontology: Mol. function=RNA-directed DNA polymerase activity; Cellular component=intracellular; Biological process=RNA-dependent DNA replication
MPVPQTEKQVRGFLGRLNYISRFISHMTATCGPIFKLLRKDQGVVWTEDCQKAFDSIKNYLLEPPILIPPVEGRPLIMYLTVLEDSMGCVLGQQDETGRKEHAIYYLSKKFTDCESRYSLLEKTCCALAWAAKRLRHYMINHTTWLISKMDPIKYIFEKPALTGRIARWQMLLSEYDIEYRTRKAIKGSVLADHLAHQPIEDYQPIKFDFPDEEIMHLKMKGL

SEQ ID NO: 166953 - protein, 116 aa, Glycine max
  Coding DNA Sequence Number=SeqID_50175
MHEQRLTINSWRSGLDGGGYMNDDQFMGFRIRFDDGGCTNSARQSIRGTPNSMRLAINSWGSGLDGGGCMNGNQLMELRIRFNGGGCTNSAWQSIRGATNSMVEDALTTINSWGSE

SEQ ID NO: 166954 - protein, 177 aa, Glycine max
  Coding DNA Sequence Number=SeqID_50176
  Gene Ontology: Mol. function=4 iron, 4 sulfur cluster binding; Cellular component=mitochondrion; Biological process=metabolic process
  Homolog annotation: Hit_ID=Q2KXA5; Match level="QueryCoverage=68%, HitCoverage=13%, E-value=6e-53, Identity=85%"; Hit description =Aconitate hydratase 2
RRRIRHRFVARLGFQGHPAAGGQGRHHAQLRAHPPQQPGGHGRAAAAVQGQRQRAVGGHHWRGNLRHFGPGERHQADAGRDADDHPQGWLKAGRDADVAHRHPDRGRLLPARRHPALRAAPAAGRVTPGPQRQSPWNREVPGAFSSPSRLKMKNAPSGGSKPKARRGGPFHRRAASR

SEQ ID NO: 166955 - protein, 153 aa, Glycine max
  Coding DNA Sequence Number=SeqID_50177
  Gene Ontology: Mol. function=motor activity; Cellular component =integral to membrane; Biological process=ciliary or flagellar motility
  Homolog annotation: Hit_ID=Q2T4X5; Match level="QueryCoverage=99%, HitCoverage=46%, E-value=2e-51, Identity=67%"; Hit description=OmpA family domain protein
  Pfam annotation: Domain name=OmpA; Domain location=50-146; Score =123.8; E_value=4.9e-34; Accession=PF00691.11; Description=OmpA family
MEDSSNNITPVFQQVIETKPMQTGQVKVLDMAAMQKSLAESGRVAVYGVYFDTDKAEVSAESKAALDEMGKLLNANPKLKVYVVGHTDNQGTLAGNLELSQKRADAVVKALEAGYKIPAARLSARGVASLAPVAANDAEAGRAKNRRVELVAQ

SEQ ID NO: 166956 - protein, 135 aa, Glycine max
  Coding DNA Sequence Number=SeqID_50178
MPEKGVKTPMFLLEIVMNVLSAPAALSLFIIKVHFSRGLGKYTNIVVPRKILPERNVVIYHTEFNDFKEELERRNWHEELTSFAEGSIDVAIVKEFYANLYDPEDKSPKQVRVRGHLVKFDKDALNTFLKTPMIT

SEQ ID NO: 166957 - protein, 278 aa, Glycine max
  Coding DNA Sequence Number=SeqID_50179
  Gene Ontology: Mol. function=nucleic acid binding; Biological process= DNA integration
MVEEEAIDKKKRRLALKTSIPSSDESEDNNAEGSDAENLNLLEGEPSSSNGFTCFECQKTGHVKAYIALDDNESTISSDNSDEEEKKLCLMSNNEAESEVIIFYLEDDDNYDQQLDAFNEMHQEAQNLVIANSLLKADKQLWYLDSSFSRHIIGDKSKFMSLKAKEGVFVTYGDNNKGRILVKLGMSRPQATTLRALKNLDSMSLKELAGILKVHEQELYQDKGTKREKYLALSRQKNKKASSSKEQVSRSLFKALKANDSSNDESKKDSDEENMVKQ

SEQ ID NO: 166958 - protein, 206 aa, Glycine max
  Coding DNA Sequence Number=SeqID_50180
  Gene Ontology: Mol. function=transcription regulator activity; Cellular component=nucleus; Biological process=regulation of transcription
  Homolog annotation: Hit_ID=Q8S3F4; Match level="QueryCoverage=76%, HitCoverage=39%, E-value=2e-17, Identity=37%"; Hit description =Putative bHLH transcription factor
MAMEVRTLGRLFGEEAPNCSHRKPFPVVGPHVNYAINTKTTNVFAKNTKTDKASMLDEVIEYLKQLQAQVQMMNRINMSSMMLPLTMQQQLQMSMMSPMGMGLGMGMGMGMGMGMDMNSMNRANIPGIPPVLHPSAFMPMAASWDAAVAAAAGGGDRLQGTPASVMPDPLSTIFGCQSQPMTMDAYSRLAAMYQQLHQPPTSGSKN

SEQ ID NO: 166959 - protein, 136 aa, Glycine max
  Coding DNA Sequence Number=SeqID_50181
MLHTYNRIKPNRGKQYNHSIASTSETIQSFKTSIATNQHKERERITTYLEEEELQPGRTMNHQQEEEPEARSSVREEVICLKKRQRKKENEEAEGEGEQRRRKKHKRRKIPKATTKKVISMLIGLIKNRPTKKDLA

SEQ ID NO: 166960 - protein, 118 aa, Glycine max
  Coding DNA Sequence Number=SeqID_50182
  Gene Ontology: Mol. function=transcription regulator activity; Cellular component=nucleus; Biological process=regulation of transcription
  Homolog annotation: Hit_ID=Q8S3F4; Match level="QueryCoverage=84%, HitCoverage=21%, E-value=2e-18, Identity=52%"; Hit description =Putative bHLH transcription factor
MSQCVPSWDVEDNPPPSRVSLRSNSNSTAPDVPMLDYEVAELTWENGQLSMHGLGLPRVPVKPPTAATNKYTWEKPRGSGTLESIVNQATSFSHQEKPRPLNGDSGGGGGVYGNFMVP

SEQ ID NO: 166961 - protein, 389 aa, Glycine max
  Coding DNA Sequence Number=SeqID_50183
  Gene Ontology: Mol. function=zinc ion binding; Cellular component =nucleus; Biological process=chromatin modification
  Homolog annotation: Hit_ID=Q1SJ15; Match level="QueryCoverage=80%, HitCoverage=93%, E-value=1e-121, Identity=67%"; Hit description =Nuclear protein SET; Zinc finger, RING-type; Zinc finger, FYVE/PHD- type
  Pfam annotation: Domain name=PHD; Domain location=63-111; Score=57.1; E_value=6e-14; Accession=PF00628.19; Description=PHD-finger
  Pfam annotation: Domain name=SET; Domain location=234-366; Score =58.2; E_value=2.8e-14; Accession=PF00856.18; Description=SET domain
  Pfam module annotation: Pfam domain module=PHD::SET; Domain location =63-111::234-366
MALARAWRESKLWRERASSSSSLYFKDSHITHISASAASMASSLGRRRTHAPKASSTLNDDVSCEECGGGHSPSKLILCDKCDRGYHLFCLRPILPSVPKGSWFCPSCSNHKPKSFPLVQTKIIDFFRIQRSPEALSNQDTRRKRKRGGGLVVSKKKRKLLAFVPSEDPNRRLEQMASLATALTTTKTEFSNQLTYMLGMAPRSANRPALERGGMQVVLSKEDTETLNLCKRMMERGEWPPLMVVFDPLEGFTVEADRSIKDLTIITEYVGDVDFLKNRENDDGDSIMTLLSASDPSRTLVICPDKRSNIARFINGINNHTPEGKKKQNLKCVRFDVGGECRVLLIANRDITKGERCDCILKFKIFVVLLSWRRRWPKMRGEEGRRGGK

SEQ ID NO: 166962 - protein, 165 aa, Glycine max
  Coding DNA Sequence Number=SeqID_50184
MCRVNFVDPRQYIIPPSSESILLVKEVVRCRGGSPDKFESYRSFVSDSAIGMDISDFKGSIQQPLVDREVVLNGDFSSEEIHHEAFDDESSSYKRLVDPHYVSRGTSRPHRRRNDLASRVERITEEKQDLTAIVAEFTKDVKDNELLDEEEITITEEEQDAGANV

SEQ ID NO: 166963 - protein, 597 aa, Glycine max
  Coding DNA Sequence Number=SeqID_50185
MRLPWVWRDSPRADHGFDEPLEIRPGMCLSWILARLSEGSPMEDLGFDKPLEMRDSPRADLGFDKPLEMRDSPKANLGFDKPLEMRDSPKADLRFDEPLENRPRRHPSWVLARLAKAFGESSSVCRKLARGHESHAVSLAGCILRAEMFDKGIEAVDGPWRESSVPYQCGPFDGRWENLTQDYIVVGVEINLGGECIQMQIYLNDMVEKRMSTSRPPFMAGGVLVALGRLTQASNWSWSAFSFLSSSLWHHSIFAIHVWSCWRVSLFVMVVRGGLELYRGVSCLRSNRVLTIGEKRPRGKFYHSSTVGAKCTYQNLELIDVRVDVAKMDSTISHVELHVPFTGRTKGGLAKQRTTMLKNKGGKRYGFVQFKGVNDVERLVRELDNLWIESMKLHVNISRLNKDNQHSRREVESNSRRGGRFLEMRDALMLEGCSIVSVRYLGDDRVLFSGINCDCLEALLQARADGWDFCCMVASFKPIAIHERICINGAIYDVLVKEEMVYNQTKDKYCCHLRSRSIKNGGSEAGKIDGFVREINDIMSYPGSVDRGDGEDYLQLSEEEEKEESHDVLAAMSEKKGMGRAIGKQPGNGVVQEWEGV

SEQ ID NO: 166964 - protein, 91 aa, Glycine max
  Coding DNA Sequence Number=SeqID_50186
  Gene Ontology: Mol. function=transferase activity; Cellular component= integral to membrane; Biological process=glycolysis
  Homolog annotation: Hit_ID=Q9T071; Match level="QueryCoverage=79%, HitCoverage=14%, E-value=5e-12, Identity=52%"; Hit description =Probable hexokinase-like 2 protein
MRKNVVVAVSTTLAVVVVGALIRRWKQWKEQQLRKTNQIIRKFASECATPVTKLWQVADDLVSSMKISLVSSHETTTLNMVISNVTSLPLG

SEQ ID NO: 166965 - protein, 174 aa, Glycine max
  Coding DNA Sequence Number=SeqID_50187
  Gene Ontology: Mol. function=transferase activity; Cellular component= integral to membrane; Biological process=glycolysis
  Homolog annotation: Hit_ID=Q9T071; Match level="QueryCoverage=87%, HitCoverage=31%, E-value=5e-44, Identity=54%"; Hit description =Probable hexokinase-like 2 protein
  Pfam annotation: Domain name=Hexokinase_2; Domain location=58-174; Score=-81.2; E_value=7.1e-07; Accession=PF03727.6; Description =Hexokinase
MDLTYLSYRLCTSLSLVHKGMVKELNKALTNHGMKMHVSSLVDETIGGLAGGRYYNRESVAAITLGMSTNAAYVESTEEVANDLTQSPNSSELVISMEWGKFNSPHLPLTTFDASVDAESSNPGSEIFEKLISGMYLGEVVRHVLLKLAQETDLFGSRVPPKLMTPYLLRYLNP

SEQ ID NO: 166966 - protein, 60 aa, Glycine max
  Coding DNA Sequence Number=SeqID_50188
EIIDYVATEIAKFVSSHPEIDDGAPAKKKKLGFTLSYPVDEILPFAATTFQRKSANNPVE

SEQ ID NO: 166967 - protein, 76 aa, Glycine max
  Coding DNA Sequence Number=SeqID_50189
MCAIHEYLIFHCSHYSAPAQSGNLHSHLRESRTSSTELLPPLVWINQSLIHIHFSSLASCEEEKTMVKLKKDPVIL

SEQ ID NO: 166968 - protein, 45 aa, Glycine max
  Coding DNA Sequence Number=SeqID_50190
MVVTTSANGSYMPICVYGDHKTKTNNVIYHGNHFLQVSSSGEIIV

SEQ ID NO: 166969 - protein, 82 aa, Glycine max
  Coding DNA Sequence Number=SeqID_50191
MGVVKEVLRRGLERVWQRSEEMKEKRRDLALKNLRQARRGRRRELRDDDTWVWSHQKKEKRVMGSELRGLHERMERMRERVR

SEQ ID NO: 166970 - protein, 98 aa, Glycine max
  Coding DNA Sequence Number=SeqID_50192
  Homolog annotation: Hit_ID=Q45KQ0; Match level="QueryCoverage=54%, HitCoverage=7%, E-value=6e-16, Identity=72%"; Hit description =Cellulose synthase-like protein CslE
MGKRGASPFLSLTHFFFSAHMIAKEYPGQLPRFLNSFHALLIMLYEFKIWVSNGGCDNRIVYTVLRMKISVLQPTKEGFLRFSSYYLASNTCSTQEMV

SEQ ID NO: 166971 - protein, 51 aa, Glycine max
  Coding DNA Sequence Number=SeqID_50193
MAFKLSKGVPKEEGSGGGEESESIGGLEGERRGSMSSSMIKRWIWGLQQSP

SEQ ID NO: 166972 - protein, 167 aa, Glycine max
  Coding DNA Sequence Number=SeqID_50194
  Gene Ontology: Mol. function=chromatin binding; Cellular component =chromatin; Biological process=chromatin assembly or disassembly
  Homolog annotation: Hit_ID=Q1SAV4; Match level="QueryCoverage=56%, HitCoverage=31%, E-value=7e-14, Identity=52%"; Hit description =Integrase, catalytic region
MACLQDSNGHFISSLSSCFTGILSPLEAEARAHNVALHWLSSRDQRHVIIETDCKQILDIMKARNFQNNESRIERGLMTGWLSAYKGGKEPGVMGGGPWCSFNRETWNIGCILESEGKRVVEKVDDMAGVALRPNLQLERISCGNGDRRNVSWLPMLSTGVSVIGPR

SEQ ID NO: 166973 - protein, 134 aa, Glycine max
  Coding DNA Sequence Number=SeqID_50195
MGPWSWAIMNERPKVLFKSSIENFGLVVDFRMVQENPYDSGRLKMKSKDRSSQIPARMGNGCRRRVGLQEKSETLLEAERQMDGPVIAIFCLCRIVNHGGLQNPSDPSVRHKPEEGCRDKAFAVALPVPVPGWY

SEQ ID NO: 166974 - protein, 316 aa, Glycine max
  Coding DNA Sequence Number=SeqID_50196
  Gene Ontology: Mol. function=RNA-directed DNA polymerase activity; Cellular component=chromatin; Biological process=RNA-dependent DNA replication
MPTLETFCVYGVINHQRVIIHVDGVPIPLHPGSDNSTGPCLHHRSFALPLSGADIVLGVECLKGLGPVTIDYTVLSMSFTHWGQPIQLFRDVPIRLATASTHRFKRMLHTPFLSALFHSTNVPNQTQPPTSSSPISDITTHPPITSLIAKLQFLFTEPSGLPPHRPITHHIHLLPESNQVNVKPYCYPHSQKAEFERQVSSMMDGHYEYRVMPFGLYNMPTTFQATMNEVLKPFICKYVVVFFNDILIYSSSLLEHVQHLEVVFVVLAKTPPRYLPWSTAPHLPPPLHSESQLAFDNLKQVMTQAPVMLHPGNGCL

SEQ ID NO: 166975 - protein, 612 aa, Glycine max
  Coding DNA Sequence Number=SeqID_50197
MESKQEAPSVILNLMGLDQVPTQHPIRDKQKVLSENYLQKVASIGVRKKRSSHQHHSSGMNTSEKEEFEDVLKVVKALRRGKHHNPSKGNGKENPISCKNSNLDDGLLQEIFYPKSMRLYPEMRERKKISYHMNSGKQSSRPFSKISEEISMQSGNVANGVLNTASSSFLRGNEAFASDMLKLKPASNISVNEIQFNFPFLCSDSRTKTLAQGDVAEKLRELGRCGQVCIHNQLPMISEHGNGTRDLTHQSGYYSNDKIRKNIRCKAGVNYSFARRVSIPLCAASVIADNGRTMNQDILFQRYWGLRKNASANWLSWKSKNENVNQKECMEDVNLSPGHEKLPSLSSYFHSNHTEENGINHMSEKRVYGKDLSDKVTMPPQLSSSSPSPELIDSQILQERRLMNDEVKNKTYEDSSMPMQNVVSPDSSVDFLVSDATTEVVGRSHYNPTNHQYKSTVFLSQEIDSLSYTSKKQSVAHCSGTFCSKSHHLPPYQNQCGKILDTSDFQEDSVLSLCSEADPDSISSFEEAYEPSPISVLEPLFGEDSRFSSKCGDHVYDSSEVDDEEYDLNVSSDEDCENEYVDDPEEKKDIAGLFRAEESRDFSYVVEVLTEA

SEQ ID NO: 166976 - protein, 170 aa, Glycine max
  Coding DNA Sequence Number=SeqID_50198
  Gene Ontology: Mol. function=protein binding; Cellular component =integral to membrane; Biological process=protein amino acid phosphorylation
  Homolog annotation: Hit_ID=Q9SSD1; Match level="QueryCoverage=66%, HitCoverage=56%, E-value=5e-29, Identity=55%"; Hit description =Protein TOO MANY MOUTHS precursor
  Pfam annotation: Domain name=LRR_1; Domain location=16-38; Score =19.5; E_value=0.012; Accession=PF00560.23; Description=Leucine Rich Repeat
  Pfam annotation: Domain name=LRR_1; Domain location=40-61; Score=7.5; E_value=11; Accession=PF00560.23; Description=Leucine Rich Repeat
  Pfam module annotation: Pfam domain module=LRR_1::LRR_1; Domain location=16-38::40-61
MNWHGPVPESLGKLRNLRVLHLDGNHFNGSIPKSFRDLRSLSELRLNDNGLIGSVPFDREMVWRMKRKLRLNNNSGLCYDASSGLGDSMDSTFDLGISLCDTSNPGSVRTVQHLSATQKLMPVTSDAVEALTSWKLMASAFGYTENNVEMRETVQMSRLYTLAFWSSVMK

SEQ ID NO: 166977 - protein, 58 aa, Glycine max
  Coding DNA Sequence Number=SeqID_50199
MAQQCMHGHAADTGRDHWLGLQGKDTVLFQVVEAEENGEVGSFGVEKCKQVGDFLVSG

SEQ ID NO: 166978 - protein, 164 aa, Glycine max
  Coding DNA Sequence Number=SeqID_50200
  Homolog annotation: Hit_ID=Q9SY09; Match level="QueryCoverage=46%, HitCoverage=65%, E-value=1e-34, Identity=94%"; Hit description=Small nuclear riboprotein Sm-D1
  Pfam annotation: Domain name=LSM; Domain location=53-118; Score=62.2; E_value=1.7e-15; Accession=PF01423.12; Description=LSM domain
MKLSGPNGSASDGGATTHGLHVPEILRDKDDEWELLWRRRVESAIESSSSTHHEARQLNNETVSIELKNGTIVHGTITGVDISMNTHLKTVKLTLKGKNPVTLDHLSVRGNNIRYYILPDSLNLETLLVEETPKIKPKKPTAGKPLGRGRGRGRGRGRGRGGGR

SEQ ID NO: 166979 - protein, 105 aa, Glycine max
  Coding DNA Sequence Number=SeqID_50201
  Homolog annotation: Hit_ID=Q0KIN0; Match level="QueryCoverage=89%, HitCoverage=5%, E-value=4e-14, Identity=40%"; Hit description =Integrase core domain containing protein
MASSRPIFSFSGTPTITTAKLNLKNYLSWSASVKLWFLNQGHHDHLEKASDSIPDDKRPEWEKLDYQLYVVLWKSVEPDILEIFRSFKSCRSFWKKAQEIFAYDI

SEQ ID NO: 166980 - protein, 444 aa, Glycine max
  Coding DNA Sequence Number=SeqID_50202
  Homolog annotation: Hit_ID=Q41108; Match level="QueryCoverage=81%, HitCoverage=97%, E-value=1e-145, Identity=75%"; Hit description=Pv42p
  Pfam annotation: Domain name=CBS; Domain location=101-260; Score=3.9; E_value=0.027; Accession=PF00571.18; Description=CBS domain
  Pfam annotation: Domain name=CBS; Domain location=296-433; Score =52.5; E_value=1.4e-12; Accession=PF00571.18; Description=CBS domain
  Pfam module annotation: Pfam domain module=CBS::CBS; Domain location =101-260::296-433
MARAEHACTGLHISQDYTYNHSSKEKELIRVTNIDIYMIYPIFMLALPFPISTHFCTKKHLLHLCNQRKIKSTQEVKLGGEINMQRSESMRLKEKKVKDLMVDKKRLVEVPYMASLAHTMTTLVANKVVAVPVAAPPGQWIGAGGSMIVESDKQTGTVRKHYIGMVTMLDIVVHIAGDNHLSGDDDDITKDLDQRMSGPVSSIIGHSFEGLSLWTLNPNTSLLDCMEVLSKGVHRAMVPVDGQAENVAAAGVELVESAWSYQMLTQMDVLRFLHDRAGEGDGELQSILSRSVQDLLAVTEQIYAITDRTKLVDAIKCLKAAMLNAVPIGRCRKLIGTFSSTDLRGCHIATLKSWLGISALAFTEDVASSPLYTESESDTQINRRELVTCFAESPLSEVIEKAVTRHVHRVWMVDHQGLLVGVVSLTDVIRVIRHSLLSSDSDDL

SEQ ID NO: 166981 - protein, 60 aa, Glycine max
  Coding DNA Sequence Number=SeqID_50203
MSAWKILCTNVTEYLNLGKIEPLSEYNFTGTDFNYYERLLQESDRTLVHDVGQVSSFISK

SEQ ID NO: 166982 - protein, 139 aa, Glycine max
  Coding DNA Sequence Number=SeqID_50204
  Gene Ontology: Mol. function=protein disulfide oxidoreductase activity; Cellular component=chloroplast; Biological process=cell redox homeostasis
  Homolog annotation: Hit_ID=Q6K609; Match level="QueryCoverage=95%, HitCoverage=100%, E-value=4e-42, Identity=64%"; Hit description =Glutaredoxin-like
  Pfam annotation: Domain name=Glutaredoxin; Domain location=44-112; Score=66.4; E_value=9.3e-17; Accession=PF00462.14; Description =Glutaredoxin
MRQENIMHYHQVEPAAWSYYMRVHRSMEEDQMERVARLASQSAVVIFSVSSCCMCHAMKRLFCGMGVNPTVHELDQDPKGKDMERALMRLLGIGINSTSSAVPVVFIGGKLVGPMDRVLAFHISGTLVPLLKQAGALWL

SEQ ID NO: 166983 - protein, 61 aa, Glycine max
  Coding DNA Sequence Number=SeqID_50205
MENAEEQQQQNEEVLSVELPAPSGLGLGYYGNNAVNFCAFHILLICNLALGIDMSKWSGME

SEQ ID NO: 166984 - protein, 84 aa, Glycine max
  Coding DNA Sequence Number=SeqID_50206
MVEPGYHKAPSKVVSIPVHFVGLKCTGTEFATKIQRVLRDFLVRNTLRKIAAMRVELERENLEESLKIARDAVIASGTHVSPLR

SEQ ID NO: 166985 - protein, 813 aa, Glycine max
  Coding DNA Sequence Number=SeqID_50207
  Gene Ontology: Mol. function=protein serine/threonine kinase activity; Cellular component=ubiquinol-cytochrome-c reductase complex; Biological process=protein amino acid phosphorylation
  Homolog annotation: Hit_ID=Q8RWZ5; Match level="QueryCoverage=96%, HitCoverage=96%, E-value=0.0, Identity=49%"; Hit description =Putative S-receptor kinase
  Pfam annotation: Domain name=B_lectin; Domain location=78-177; Score =84.5; E_value=3.2e-22; Accession=PF01453.15; Description=D-mannose binding lectin
  Pfam annotation: Domain name=PAN_1; Domain location=325-409; Score =6.5; E_value=0.035; Accession=PF00024.16; Description=PAN domain
  Pfam annotation: Domain name=Pkinase; Domain location=491-761; Score =183.4; E_value=5.5e-52; Accession=PF00069.15; Description=Protein kinase domain
  Pfam annotation: Domain name=Pkinase_Tyr; Domain location=492-761; Score=108.5; E_value=2e-29; Accession=PF07714.7; Description=Protein tyrosine kinase
  Pfam module annotation: Pfam domain module=B_lectin::PAN _1::Pkinase::Pkinase_Tyr; Domain location=78-177::325-409::491 -761::492-761
MGIFRCGTLFFHVLLLFRTCLAKDQHVSQIYPGFSASQPDWSDHNGFFLLSNSSAFAFGFFTTLDVSSFVLVVMHLSSYKVVWTANRGLLVGTSDKFVLDHDGNAYLEGGNGVVWATNTRGQKIRSMELLNSGNLVLLGENGTTIWQSFSHPTDTLLPGQDFVEGMTLKSFHNSLNMCHFLSYKAGDLVLYAGFETPQVYWSLSGEQAQGSSKNNTGKVHSASLVSNSLSFYDISRALLWKVVFSEDSDPKSLWAATLDPTGAITFYDLNKGRAPNPEAVKVPQDPCGIPQPCDPYYVCFFENWCICPKLLRTRYNCKPPNISTCSRSSTELLYVGEELDYFALKYTAPVSKSNLNACKETCLGNCSCLVLFFENSTGRCFHFDQTGSFQRYKRGAGAGGYVSFMKVSISSASDDGHGNKNGRNDMVLVVVIVLTVLVIVGLITGFWYLFKRKKNVAKYPQDDLDEDDDFLDSLSGMPARFTFAALCRATKDFSSKIGEGGFGSVYLGVLEDGTQLAVKKLEGVGQGAKEFKAEVSIIGSIHHVHLVKLKGFCAEGPHRLLVYEYMARGSLDKWIFKNSENTFLLNWDTRYNIAIGTAKGLAYLHEECDVRIIHCDIKPQNVLLDDNFTAKVSDFGLAKLMSREQSHVFTTLRGTRGYLAPEWITNYAISEKSDVFSYGMLLLEIIGGRKNYDQWEGAEKAHFPSYVFRMMDEGKLKEVLDPKIDIDEKDERVESALKIALWCIQDDVSLRPSMTKVAQMLDGLCPVPDPPSLSQSGTYSAFMKLSSGEATSSGQASFFSNVPMSCVQLSGPR

SEQ ID NO: 166986 - protein, 341 aa, Glycine max
  Coding DNA Sequence Number=SeqID_50208
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9LVZ9; Match level="QueryCoverage=85%, HitCoverage=83%, E-value=1e-108, Identity=62%"; Hit description=Beta- 1,3-glucanase-like protein
  Pfam annotation: Domain name=Glyco_hydro_17; Domain location=27-312; Score=267.1; E_value=3.4e-77; Accession=PF00332.9; Description =Glycosyl hydrolases family 17
MELFINKLEHSDACDAVLGDKAFTGTYGVKYGRIADNLHPQESVVTLLKAAKIKNIRIYDAGHKLLRAFKGSGIEIVVGLGNEFLKDMSVGEDKAMSWVKENVQQFLPGTKIRGIALGNEILGGTDMELWQVLLPAAKNVYNALSKLDLAKDVQEDVLPYMKPLLQFFSQIGTPFFINAYPFLAYKNDPQHIDLNYALFLKNPGIYDAKTKLHYSNMFEAQVDAAYAALEQVGFDKMDVIVSETGWASHGDGNEAGATIKNARTYNGNLRKRLLKKKGTPYRPKKVVKPGPMSERNFGLFKADGSIAYDIGFTGLVPSSSTSSFLSFKVSTMDTSSTFTIN

SEQ ID NO: 166987 - protein, 283 aa, Glycine max
  Coding DNA Sequence Number=SeqID_50209
  Homolog annotation: Hit_ID=Q47522; Match level="QueryCoverage=13%, HitCoverage=45%, E-value=8e-14, Identity=97%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSFGSGGGRGPRSRTRRGQDALVRMRLSLAEAVFGVTKSLEVESSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 166988 - protein, 222 aa, Glycine max
  Coding DNA Sequence Number=SeqID_50210
  Gene Ontology: Mol. function=aminocarboxymuconate-semialdehyde decarboxylase activity; Biological process=metabolic process
  Homolog annotation: Hit_ID=Q682E0; Match level="QueryCoverage=70%, HitCoverage=53%, E-value=5e-59, Identity=61%"; Hit description=MRNA, complete cds, clone: RAFL21-86-C08
  Pfam annotation: Domain name=Amidohydro_2; Domain location=26-221; Score=19.7; E_value=2.8e-05; Accession=PF04909.4; Description =Amidohydrolase
  Subcellular localization annotation: CTP_CleavageSite=29; ConfidenceScore=5.70e-01
MALRLSTVVSDVGPSYSGKPRFRFRIRSVAATVRNMAFSATFKAGRFPYSPGQEPTSRKCRVFALADDGSGLKQFEDLVLKDGYRAVRFNPYLWPPREKMTNKVGKEIFQRAGELNVPVGFMCMKGLDLHISEIEQLCTEFPSTVVLLDHLGFCKPPIVSRAQFPYLDLSPLLSQVVSHFGANRVMWGSDFPFVVAECGYKGAKEAMHLIAKEISLPLADLE

SEQ ID NO: 166989 - protein, 156 aa, Glycine max
  Coding DNA Sequence Number=SeqID_50211
  Gene Ontology: Mol. function=protein binding; Cellular component =cytosol; Biological process=peptidyl-diphthamide biosynthetic process from peptidyl-histidine
  Homolog annotation: Hit_ID=Q53LS8; Match level="QueryCoverage=88%, HitCoverage=34%, E-value=8e-47, Identity=72%"; Hit description =Diphthamide biosynthesis protein 2
  Pfam annotation: Domain name=Diphthamide_syn; Domain location=1-149; Score=-147.3; E_value=0.0027; Accession=PF01866.8; Description =Putative diphthamide synthesis protein
MGSKNPSVIAMEQVGLYIALEDWRGNYLRDKAWTTTCSFGLDMMIQLLLMLCSHSMPILPGVGILVGTLGVAGYLHIINQMMELITGAGKKAYTLVMGRPNPAKLANFPECDVFLYVSCAQTALLDSKEYLAPVITPFEAMIAFNSQWIISNNLYP

SEQ ID NO: 166990 - protein, 283 aa, Glycine max
  Coding DNA Sequence Number=SeqID_50212
  Pfam annotation: Domain name=BAG; Domain location=1-74; Score=22.5; E_ value=0.0015; Accession=PF02179.6; Description=BAG domain
MTGVTERIESEVRVKVMKLKREQRERMRLYETIMNLLLKLDFVKVLLHYSGLRECRKSLINKAIALQEFLDQVTILHFEEKEGECVGEENCLVEEEKSSGVETFKSGEGECVGEDNCLVKEEEDDGIETLRNGEVEKEKGRCMEEESIGLGTRLVEEEEGENRCEEQEEEDEEIEALNNEDVEEEDSEGGRGFVGEKYLVKEKDGEGKKRELLLEKMVEDNQKMMEMMVQLFQRNEMQTTLLASLKQRVEPLERALACDKLRRKKKRKDDAKNKQNHPKNGFI

SEQ ID NO: 166991 - protein, 112 aa, Glycine max
  Coding DNA Sequence Number=SeqID_50213
  Subcellular localization annotation: CTP_CleavageSite=12; ConfidenceScore=5.21e-01
MASISQGLVLTSAMLLSTTLLYVAFSRQKTTPSFQIHHSNKPTLRSCLYSEEKKRERKKKKVKFADSVKEGRERNEQRSNSRQSGGMPMPANRMALYYGILRNRVHRIECSH

SEQ ID NO: 166992 - protein, 105 aa, Glycine max
  Coding DNA Sequence Number=SeqID_50214
  Homolog annotation: Hit_ID=Q53LS8; Match level="QueryCoverage=97%, HitCoverage=20%, E-value=4e-18, Identity=45%"; Hit description =Diphthamide biosynthesis protein 2
MEVGNQEEEARFSFLKGGYVDDFENQENAEEERETLALVNATEKALQLQNNSNALMKGNARSGVEFLANRSYQGLNMSSENASPEPYLIGRRGRASGYEDEKKKQ

SEQ ID NO: 166993 - protein, 274 aa, Glycine max
  Coding DNA Sequence Number=SeqID_50215
MGQGVIGKRDSIADKGVVTNKLRMTKIQEAPTSMMQRGERTKGRCHCPRSQLWVLTLTIGALIVPLPPLLPSPLRPPQALTVRRLTSKELASRHEHELCFTCDEKFHRGHRCASRTHLDSNTVQLDPKLATPISEGPDPKLTPDPDPNPTPDLNPNPTPDPELAQTPLHVMFFHHGHFVELPGENAITSDLLPQHQFRHFCLNNKGVLHFHIAGFPEAPLESLPIETPSTLHRHKPWDPRVIGKRDSIANKGVVMNKLRMTKIQEATTSMVQRG

SEQ ID NO: 166994 - protein, 129 aa, Glycine max
  Coding DNA Sequence Number=SeqID_50216
MEARNTLVIPIEVAKLVLEKKTPSGSVLARQFHEASVMKEHHTPCSWREANSTGVSRLSVGACGGRGGEGSKGGKGTTRAPIVRPYEGEPKGLAVELPAMGFAAAVEAGESPIASAPGSSQGRRPGPQS

SEQ ID NO: 166995 - protein, 69 aa, Glycine max
  Coding DNA Sequence Number=SeqID_50217
  Gene Ontology: Mol. function=phospholipase D activity; Cellular component=membrane; Biological process=phosphatidylcholine metabolic process
  Homolog annotation: Hit_ID=Q9SSQ9; Match level="QueryCoverage=98%, HitCoverage=15%, E-value=3e-12, Identity=37%"; Hit description =Phospholipase D alpha 2
MDGARDYEVAMGGYQPYHLATKHVIMTFLNPIAISEGNVTQLQGFQFFPYTKAPVLGAKSGYMPPVLTT

SEQ ID NO: 166996 - protein, 132 aa, Glycine max
  Coding DNA Sequence Number=SeqID_50218
MTKKLWQQELESDQSSSGKCLCWRGTNQRMGVSSLNQKLSFITDHSFLKLHINFLRWKFGNKGMHIYQEKRREEKKDVGGGEQSTETGEGQSNNNQGRKQREEWWAWECNETQVLMEDVLSGEQSNETGEEG

SEQ ID NO: 166997 - protein, 262 aa, Glycine max
  Coding DNA Sequence Number=SeqID_50219
  Gene Ontology: Mol. function=polygalacturonase activity; Cellular component=cellulose and pectin-containing cell wall; Biological process=carbohydrate metabolic process
  Homolog annotation: Hit_ID=Q2HUB1; Match level="QueryCoverage=88%, HitCoverage=61%, E-value=2e-96, Identity=73%"; Hit description =Glycoside hydrolase, family 28
  Pfam annotation: Domain name=Glyco_hydro_28; Domain location=73-262; Score=-35.6; E_value=2.2e-07; Accession=PF00295.8; Description =Glycosyl hydrolases family 28
MVYVQKKAYAYTFASCAYREKKEFFFTVLIILSVITPGLSSTTTSFNVLQYGAVGNGQTNDSPAFLKAWKAACQSNSHISRLIIPAKRTFLLKPTTFSGPCKSNYTYIQLSGNIIAPKTKSEYSGFHTNTWLGFSFVNGLAISGKGTIDGRGSAWWQQPCVGNPLPAVTFNRCNRLQLKGYTSINPARSHMTLTSCKKGIISNIRLIAPGTSPNTDGIDISGSTDIQVLNSFIATGDDCIAISAGSSKIKITGITCGPGHGI

SEQ ID NO: 166998 - protein, 165 aa, Glycine max
  Coding DNA Sequence Number=SeqID_50220
  Homolog annotation: Hit_ID=Q2HUA9; Match level="QueryCoverage=92%, HitCoverage=85%, E-value=2e-58, Identity=66%"; Hit description =Lipase/lipooxygenase, PLAT/LH2
  Pfam annotation: Domain name=ATS3; Domain location=23-151; Score =227.3; E_value=3.4e-65; Accession=PF06232.2; Description=Embryo -specific protein 3, (ATS3)
  Subcellular localization annotation: CTP_CleavageSite=40; ConfidenceScore=5.24e-01
MQLLTSSNLHSQSTPTQRVFQAQPNQATECVLQNDEASSSCSYTVSIKTSCSSPPYTRDYISLAFGDAYGYQVYVPRLDGPRSGTFERCSTDTFEIYGPCTYQTCYLYLYRTGYDGWMPEKVTVYSYYYQPVTFYYNTYIPNAIWYGFDYCNGYLPSTSTTTAPQ

SEQ ID NO: 166999 - protein, 366 aa, Glycine max
  Coding DNA Sequence Number=SeqID_50221
  Homolog annotation: Hit_ID=Q9FMU1; Match level="QueryCoverage=92%, HitCoverage=90%, E-value=2e-30, Identity=33%"; Hit description =Arabidopsis thaliana genomic DNA, chromosome 5, P1 clone:MUA22
MKLLGWMHRKLRQNSSEPFKDLVIGNSCNCLSGQAPLDDEQVYQKPSLGVKLSKHAQKGHNNLRNSFAGVEAARVDEDYEGEYFPGFLAIGTLGSEPISDPSTTPSFPISVESITEKEDEVTENDLKLINDELEKVLGAETKDDVSIDSSRRTSHVSTGRSSHVSTGRSSHASIITLSGKPIEGTEANGNGAAICPLQGYLFGTAIELSETTTTAAAKKEHRTSLGELFQRSKSSEENFGAKCEKEDKRAEKEVDKSSMNLMKEKLKKRMLHAYSKNSTSINGGPIDSASAETKLNKILHMFRKKVHPESSTAAQKSGKHHKNQKKKKTINNGGYNKSDLVHPEEDSSVNREYWIKTDADYLVLEL

SEQ ID NO: 167000 - protein, 54 aa, Glycine max
  Coding DNA Sequence Number=SeqID_50222
MVRMCENEFQRSCPNFMTIQRFWVYAGIEKAQCKGHFFHHGHYLENSNNGYMWK

SEQ ID NO: 167001 - protein, 407 aa, Glycine max
  Coding DNA Sequence Number=SeqID_50223
  Gene Ontology: Mol. function=monooxygenase activity; Cellular component=endoplasmic reticulum; Biological process=electron transport
  Homolog annotation: Hit_ID=Q6J540; Match level="QueryCoverage=98%, HitCoverage=84%, E-value=1e-143, Identity=57%"; Hit description =Cytochrome P450
  Pfam annotation: Domain name=p450; Domain location=1-395; Score=20.9; E_value=6.3e-12; Accession=PF00067.12; Description=Cytochrome P450
MNTEIACIRLGNAYVIPVTCPTIASEFLRKQDATFTSRSLSMSADLITSGYSTTIFVPFGDQLKKMKKIITNDFLSSPKHLWLHDKRTEEADNLMFYVYNECKNVNDGVCMWTREYQECFKALLWYFGKGREDEWPGFEEMEHVDSIFDLLNYIYAFSVSDYMPCLRGLDLDGQEKKVKEALRIIKKYHDPIVQVRIKQWNDGLKVDAEDWLDFLISLKDASNNPSLTLEEINAQIIELMLATVDNSSNTFEWALAEMINQPELLHRAVEELDTVVGKERLVQESDIPKLNYVKACAKEAFRLHPIAPFIPLHVSMSDTMVGNYFIPKEPNLKFISFSTGRRGCPGVMLGTTMTVMLLARLLHGFTWSAPPNVSSINLAESNDDILLAEPLVAIAKPRLPSELAIPT

SEQ ID NO: 167002 - protein, 935 aa, Glycine max
  Coding DNA Sequence Number=SeqID_50224
  Gene Ontology: Mol. function=zinc ion binding; Cellular component =mitochondrion; Biological process=regulation of transcription, DNA -dependent
  Homolog annotation: Hit_ID=Q1SIQ1; Match level="QueryCoverage=90%, HitCoverage=99%, E-value=0.0, Identity=52%"; Hit description =Transcriptional factor B3
  Pfam annotation: Domain name=B3; Domain location=362-465; Score =103.2; E_value=7.5e-28; Accession=PF02362.12; Description=B3 DNA binding domain
  Pfam annotation: Domain name=zf-CW; Domain location=628-673; Score =72.3; E_value=1.5e-18; Accession=PF07496.5; Description=CW-type Zinc Finger
  Pfam module annotation: Pfam domain module=B3::zf-CW; Domain location= 362-465::628-673
MGSNICVVNGSCTHEWRKGWPLRSGGFAQLCCKCGFMEEWKGDILDPFSTIPDKVLNCGCGCGFVAIIDIAGKCRSAYENSVFCNKFHCQQTGWRECNFCNKPIHCGCIVSRSLFEYLDFGGIGCVSCVNTTQLSMMRNMENPNVTVLSIKNNAGDRHSAHFDGRLPVGGVDEGKLMQFCKIIEASESSRWNHAQRDGIIAHRGQKNQEAKSSFREVEIGFSNVMNPSVQSLTFATLENNRSTWEIKNMHESNTKPSLSMYLGNASGNNSVPPSAGEAVEGRLDGKTSPPFQGSRSIFPKPLKNGLTMNMETNKGTMSQSRVARPPADGRGKNQLLPRYWPRITDEELERLAGDLKSTVVPLFEKVLSASDAGRIGRLVLPKACAEAYFPPISQSEGVPLRMQDVKGNEWTFQFRFWPNNNSRMYVLEGVTPCIQAMQLCAGDTVTFSRIDPGGKLVMGFRKASNSTDTQDASTSAQSNSAKGTVSSGTENLPSGSNNADLLHSLTGNVECHLNGHTEHLHLGTGTAGLLKTENNEMTNSSSPQQQISVLEKKRTRNIGPKSKRLLIDNEDAMELKLTWEEAQDLLRPPPSVKPSIVTIEDQVIEEYDEPPVFGKRTIFSACSSGGKEQWAQCDDCSKWRKLPVDALLPPKWTCCENVWDSSRCSCSAPEELSSREIENLLKNNKDFKKRRIVESSKSIQEHEPSGLDALASAAVLGENLIDTAESSAGVTTKHPRHRPGCSCIVCIQPPSGKGRHKPTCTCNVCMTVKRRFKTLMLRKKKRQSEREADAAQKDQTLPKDELDTNGASRDDTSQLEKEAGLKSQHEVGGSSAGQIDLNSHPNREDMQVETTGLNMSSHLEPATNHTVGEFMNQNGLRNFNNEVQTGQNSSLHTPKSNGEGQRYFSDGRCFASIMWNQERKDEVHSQTNQSQNNLS

SEQ ID NO: 167003 - protein, 186 aa, Glycine max
  Coding DNA Sequence Number=SeqID_50225
  Gene Ontology: Mol. function=sphinganine-1-phosphate aldolase activity; Cellular component=endoplasmic reticulum; Biological process=carboxylic acid metabolic process
  Homolog annotation: Hit_ID=Q9C509; Match level="QueryCoverage=92%, HitCoverage=31%, E-value=8e-83, Identity=82%"; Hit description =Sphingosine-1-phosphate lyase
MYFLSVFWTLQHQFVAVTEWSGGLYVSPTIAGSRPGSLIAGAWAAMMSLGKEGYLKNTKAIMEGSRRIQKGIEEIAELFIVGKPDMTIVAFGSAVLDIFEVNDVMSSKGWHLNALQRPNSIHICVTLQHVPIVEDFLNDLKESVKTVKANPGPISGGLAPIYGAAGKMPDRGMVQELLVDYMDGTC

SEQ ID NO: 167004 - protein, 357 aa, Glycine max
  Coding DNA Sequence Number=SeqID_50226
  Gene Ontology: Mol. function=methyltransferase activity; Cellular component=integral to membrane; Biological process=peptidoglycan metabolic process
  Homolog annotation: Hit_ID=Q1MFT4; Match level="QueryCoverage=99%, HitCoverage=55%, E-value=1e-151, Identity=75%"; Hit description =Conserved hypothetical exported protein precursor
  Pfam annotation: Domain name=PG_binding_1; Domain location=139-210; Score=12.8; E_value=0.0074; Accession=PF01471.9; Description =Putative peptidoglycan binding domain
MGFLANAGTVGLDPADYAVNLPAADPANPDPTVRDHALTQFELELSSKVLAYVQDTVRGRIDPNKLSGYHDFKRKVVNLDPVLKLARMSPDVGAYLASRSPDGREFDILKKELAKLKAEGGDQEQITISLSGLLRPGDSSPEVANIVKAVGKHGSEALKTQHAAMLAAYTGAPEYSPDVVSLVEDFQKEHGLKPDGVIGQATVRVMTGGDSNTAKINKLVVAMEQARWLPEDLGPRYVMINQPAFMVYYHNDNKEQLSMRVVVGQPSHQTFFFEDQIQTVEFNPFWGVPQSIIINEMLPKLRADPNYLDRMGYEVAVNGRAVPSSSVDWYGSTSNVSVRQPPSGDNALGELKILFPN

SEQ ID NO: 167005 - protein, 258 aa, Glycine max
  Coding DNA Sequence Number=SeqID_50227
  Gene Ontology: Mol. function=protein dimerization activity; Cellular component=nucleus; Biological process=regulation of transcription, DNA-dependent
  Homolog annotation: Hit_ID=Q1SIQ3; Match level="QueryCoverage=77%, HitCoverage=42%, E-value=8e-52, Identity=60%"; Hit description=CAMP response element binding (CREB) protein
  Pfam annotation: Domain name=bZIP_2; Domain location=206-257; Score =8.2; E_value=0.098; Accession=PF07716.5; Description=Basic region leucine zipper
  Subcellular localization annotation: CTP_CleavageSite=30; ConfidenceScore=5.66e-01
MATQTQDPRSNPNPNPNAMSATPSSSFFIRAAGGNGPSAAPVAGSGESHSHHRRAHSEVSFRLPDDMIDLSPSDPFNGGSSTASFEEIGSEDDLFSTYIDVEKLGAGRGGNGSDQSGYGNGAGSSCYNDGEKSPSTAAARPRHRHSSSVDGSTSTSMFGEIMDAKKAMPPDKLAELWNIDPKRAKRIRMRWFKVDVTSFDLYLELLWDGNKIAIILANRQSAARSKERKARYIQELERKVQTLQTEATTLSAQLTLYQ

SEQ ID NO: 167006 - protein, 43 aa, Glycine max
  Coding DNA Sequence Number=SeqID_50228
MACSTTVRAQWRCHDNVGERMTQRCVMEAWEPRAFENHQKESH

SEQ ID NO: 167007 - protein, 305 aa, Glycine max
  Coding DNA Sequence Number=SeqID_50229
  Gene Ontology: Mol. function=zinc ion binding
  Homolog annotation: Hit_ID=Q1SIQ2; Match level="QueryCoverage=90%, HitCoverage=95%, E-value=1e-62, Identity=47%"; Hit description=Zinc finger, RING-type; Zinc finger, FYVE/PHD-type
  Pfam annotation: Domain name=FYVE; Domain location=158-215; Score= -8.1; E_value=0.0067; Accession=PF01363.12; Description=FYVE zinc finger
MGGDDQMKTLQAKPKQQQLQLEELYQGIPDESVNLTFQDLANVNSSNNTLATTKHVSEGGIINNPTNIPSPSLSTVPRLDFKKGLEASYHSHHHHDNNYNHHHQHQQHRGGGDSPWGRFSHASDGVPSRTGEYSMSYNGMKSGESFASGKGGSGRRRRPGIPHSKICTICSNYVYLFRTRCLVCGRVYCRQCVEIGMGEMTEGRKCIECLGLRFSQRYIERAGMAGCCSLRYPSTLKHVELNWAEKGPRRSGDRGYNNGHHSMASTRPRTPTNRRSPLSIASTEASFVMSATHSPFSAHHHHIPL

SEQ ID NO: 167008 - protein, 131 aa, Glycine max
  Coding DNA Sequence Number=SeqID_50230
  Gene Ontology: Mol. function=protein dimerization activity; Cellular component=nucleus; Biological process=regulation of transcription, DNA-dependent
  Homolog annotation: Hit_ID=Q1SIQ3; Match level="QueryCoverage=99%, HitCoverage=36%, E-value=4e-47, Identity=70%"; Hit description=CAMP response element binding (CREB) protein
MEQQAQLRDVLNDALMKEVERLKIATGEALNQSESFNLGMHQMPYAGSNFFSIPPHSGPSGHQNMQLPPFGHSHSTVPTHQLQQTNSHQMSDILQNDQLGRLQGLDISSKGTPVVKSEGPSISANESSTTF

SEQ ID NO: 167009 - protein, 257 aa, Glycine max
  Coding DNA Sequence Number=SeqID_50231
  Gene Ontology: Mol. function=sphinganine-1-phosphate aldolase activity; Cellular component=endoplasmic reticulum; Biological process=carboxylic acid metabolic process
  Homolog annotation: Hit_ID=Q9C509; Match level="QueryCoverage=99%, HitCoverage=40%, E-value=1e-70, Identity=56%"; Hit description =Sphingosine-1-phosphate lyase
MDSSISHFRASANSFLSQYEPLALLLAPLLSLLFALALRSFFHLLSENGLKATLLGFLINSFKLVPGVKRYIDAEKQKVVDKLQSDSKSKREGWKTELPSTGLGTTVLEKMREEKINDAVWQGKCSGTVYIGGSESDGHFSLINEACSMLCREFYIQLGFGILFKVISMLLSWVADIALCCCMFAHTNPLHLDVFKSVARFEAEVVAMTAALLGSKEKSSGGQICGNMTSGGTESILLAVKSSRDYMKSKKGITRPE

SEQ ID NO: 167010 - protein, 132 aa, Glycine max
  Coding DNA Sequence Number=SeqID_50232
MEAGILEFEQNTVRVSWHCCLVKVVSWKYDMMEAPCFEDDGCQTEKRSLFVSISGASLHCLHLWCAVYTSNSASSDNSFLCGNSKPHPIRLSHLTSHHLSVLSHKPIHPLSNTKKQSQTVDSLQLYNTLNPP

SEQ ID NO: 167011 - protein, 145 aa, Glycine max
  Coding DNA Sequence Number=SeqID_50233
  Gene Ontology: Mol. function=chromatin binding; Cellular component =chromatin; Biological process=chromatin assembly or disassembly
MELEYLGHFISREGKPVGLIQPLAIPDQGWEDVTIDFSEGLPTSQGKNAIMVVVDWLSKYDHFLMLTLPYTTNKVTTMYVEGIVKLHGMSSSIGIDPSIDDQGQTEVQPEQILKFRWMQKGLWTVEEALVRWKGPDSEEAILGKE

SEQ ID NO: 167012 - protein, 505 aa, Glycine max
  Coding DNA Sequence Number=SeqID_50234
  Homolog annotation: Hit_ID=Q5EUJ4; Match level="QueryCoverage=42%, HitCoverage=45%, E-value=1e-14, Identity=31%"; Hit description =Terminal acidic SANT 1
  Pfam annotation: Domain name=Myb_DNA-binding; Domain location=454 -504; Score=36.0; E_value=1.3e-07; Accession=PF00249.21; Description =Myb-like DNA-binding domain
MNSDISRWVMEFLLRSSVPDSLIQKTLTALPLSPAEPRLKKNLLLRTLQTLLRRATLSETALDILEDLAPVSDAQRRAYCAVAVECTVKYLAACPDVIDGEYAGAVRRIWRGRVAALQARRSGLVSGELVRWRDEIENALGEDSRAARERLAGLNSRRDAMNEVRVYLKEAWEMMGPSFLETVAATEKKNDEGACDNGSGNGNDDDHDDGACMEDVAMHYENQEPLEESVDANQEVGGSDLTPQRDKAILKRNPQLKHKHSAFRASHKGRGIKISSPEEVESTKPWRKHDPVPSAEVKKIRESLKSSSSELQALVNDPLPDALHISDVVRSKLATSDTKIEPPIENQHEDVEVQDPDVCLSIVPFQPNDVNLGKKSSVHCSNIHQPSLMERNRSARTFEDGNLVKIIFFTRKNACSPGGSSPKRITIAHGFFIAVVWEDSIDNSQQARQPRRRKRKWSSLEEETLRAGVKMFGEGNWATIRSFYSNIFENRSGVDLKDKWRNMIR

SEQ ID NO: 167013 - protein, 1070 aa, Glycine max
  Coding DNA Sequence Number=SeqID_50235
  Gene Ontology: Mol. function=RNA-directed DNA polymerase activity; Cellular component=chromatin; Biological process=chromatin assembly or disassembly
  Pfam module annotation: Pfam domain module=RVT_1::Retrotrans_gag; Domain location=584-753::111-201
MLEHYTPQVTTDKLEEAISRLSVGHTNLNMKVESIHTSLTAKIDSLLERFASLTVPPHSPSSSPVPPPPPIHRHHMKLEVPRFDGTDPLGWIFKISQFFYYQGIPDHERLTVAAFYMDGPALSWYQWMSRNGFFPSWPVMLQALESRFAPSFYEDPQGALFKLQQTGTVSDYLTDFERLANRTIGLPPSCLLNCFISGLSPELRREVQALRPLSLPQATEHARLQKDKLLDRRRGTRAPPHPNLNSHHKSLTLPTPASPKVPLKRLTSEEMAVRRDQGLCYHCDDKWSQGHRCKPRLHLLIADEDLEPSSSSSTSDSLSHIAPDPIQAPQISLNAMEGTPASQTFRLLGSLHHHQAVILVDGGSTHNFIQTRVAKFLALPTAPTAALRVMVGNGHTLDCDTMSSQVSLFIQGHEFRLDLYHLPICRVDIVLVVQWLKLLGPITTDYLNLTMTFLHMGLPITLHADAPPTPSHASAHQLKCLAQTQSISALFHITTTTTPVLSSPPPSTSPIPSQIASVLDKFPHIFAEPTQLPPNRNIQHHIHLLPQTTPVNVRPYRYPHFQKAEIERQISAMLAANLIQPSHSPFSSPILLVKKKDGSWRCCMDYRALNAVTVKDRFPMPTIDELLDDLGQASWFSKLDLRQGFHQIRMAEDDVHKTAFCTHQGHYEFRVMPFGLCNAPSTFQAAMNDTLKPFLRKYVAIFFDDILVFSSDLDTHVTHLESVLDTLSDRQFLLRRTKCLFAQNQLNYLGHIISRNGVAPDPDKISAMLAWPIPTSPTALRGFLGLTGFYRKFIKNYAAIASPLTSLLRKDQFRWSPEAHQAFLTLQQAMVQAPVLANPNFSLSFTIKTDASGSAMGVVLLQLEHPIAYFSKVLCPRLQRASAYIRELHAITSSVRKWRHYLLGTSFTILTDHRSLKDLMSQPGAANVVADALSRVVPAGATCLALIMPHFTFLDQLRRSLRQDTRYVDLMADIRAWPEAHSGFSLHQDLIINNGHIWIPFPCPFTTTLMEEFHSSPLGGHSGVAKMLHRLRQKFRFGPPSALMCAISSHNVQVCQQTKYEPSGCGVLHP

SEQ ID NO: 167014 - protein, 267 aa, Glycine max
  Coding DNA Sequence Number=SeqID_50236
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=58%, HitCoverage=48%, E-value=2e-37, Identity=51%"; Hit description =Similarity to MADS-box DNA-binding protein
  Pfam annotation: Domain name=SRF-TF; Domain location=9-60; Score =54.3; E_value=4.1e-13; Accession=PF00319.9; Description=SRF-type transcription factor (DNA-binding and dimerisation domain)
MTRKKVKLAFIGNDAARRATYKKRKKGMLKKVEELSTLCGIEACAIVYGHNDPEPEVWPSHWGVQRVVEKLRTMPELEQRKKMVNQEGFIGQKILKGNEKVMKLMKDNREKEITMFLFQCLNAGRIQPDNNMTTADLNVLSSLIDQNLKDISKRLETLSVNEMTPNQPLMQTPAYQPLVEAPSCNQSHLQTPAYQPQTQTPALAVPKNEEMALLNYGHGLDMSDNSMQRLLFMDLLNSNGDETIMPPFGDANLQLQNDFWPDLGLLP

SEQ ID NO: 167015 - protein, 68 aa, Glycine max
  Coding DNA Sequence Number=SeqID_50237
MPRLMITTAQRRLPGLGIASYSKHNRASVVKDVSVARHFFCSTQFYIQHHFMKHDLLVSGKRRDNFVI

SEQ ID NO: 167016 - protein, 328 aa, Glycine max
  Coding DNA Sequence Number=SeqID_50238
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=48%, HitCoverage=48%, E-value=5e-35, Identity=46%"; Hit description =Similarity to MADS-box DNA-binding protein
  Pfam annotation: Domain name=SRF-TF; Domain location=9-60; Score =47.4; E_value=4.8e-11; Accession=PF00319.9; Description=SRF-type transcription factor (DNA-binding and dimerisation domain)
MATGKLKLTFVANDSQRKTVCKKRKQSLLKKTEELSTLCGIEACAIVYGPNDHRPEIWPSESGVKNVLGKFMNKPQWEQSKKMMNQESFIAQSIMKSKDKLQKVVKENKEIEMSLFMAQCFQTGMFQPDINMTAADMNVLSSEIEQNLKDIDKRMEMLKANQVTPNQPDIESLTFQPQIMQTSAFQPQIQIPAFETQIQTQTYQSQMETPTFQPQMQSPALFQPQIQTASYQPHMQTQSYHPHMQATSFPTQMQAPSYQPQMQTPAYQPDIQTLAFEPQMQTPAPEEMTLMNYGYGSGMNANHMHRQKFNGNGYETIMPAFGGAKLPL

SEQ ID NO: 167017 - protein, 1452 aa, Glycine max
  Coding DNA Sequence Number=SeqID_50239
  Gene Ontology: Mol. function=RNA-directed DNA polymerase activity; Cellular component=chromatin; Biological process=chromatin assembly or disassembly
  Pfam annotation: Domain name=rve; Domain location=942-1125; Score =42.2; E_value=1.8e-09; Accession=PF00665.16; Description=Integrase core domain
  Pfam module annotation: Pfam domain module=RVT_1::Retrotrans _gag::rve; Domain location=523-702::110-200::942-1125
MADHVTRKTTTDRLENAITRLSNSQSTHLDKHADLVDKYSELSRKVDSILDHLHLRSPAREHSDPGNQFHQHNSVKLDISRFDGRDPMVWIFKILQLFEYQNTSEEERITVASFYLDGATLSWYRWMFRNGFITSWSGILQALESRFAPSYYDHPKGALFKLTQRGRVNEYLTVFERLANRVISLPPPFLLSCFVSGLTPDIRREVLALQPISLPQAMALAKLQEDKLRDRRQPSLRPHNAPSPSYHPPNRKLQSTYVQRTPDEMALRREKGLCYNCDEKWSSTHHCKGRVLLFIANNPSPIPDEPILDLPSPSSLEQEPTTSLDFDPSSNLNPPSLLDCNQVCPDTTLSLQGHQFTVTFHLLPISGADAVLGIEWLRQFEPITIDYTTFSMKFTYMGQPIELHADVTTGPKPISALQVKCLLQTGSASALFHLNLIPIPQPDPPHLPHPIPAVESLLTHFHHLFQNPSSLPPPRNIVHHINLLPNTTPINVRPYRYPQFQKSEIKKQVLELLSSSLIQPSMSPYSSLVLLVKKKDGTWRMCVDYRTLNSVTIRDRFPIPMIDELLDELGNAAWFSKLDLRQGFHQILMHGPDVEKTAFRTHQGHYEYRVMPFGLCNEPSTFQAAMNSLLMSYLRRFAIVFFDDILVYSKTLSSHLEHLEIIFQTLVQGQGVEPEPSKIHAMVQWPTPLSPKELRAFLSLTGFYRKFIKNYAMITAPLTSLLAKDAFEWSLNAQSAYEQLKAAMTSAPVLALPDFDEPFVIETDASGADMGTVLMQKGHPLAFFSKQFGPRMIHASTYVRELHAIIAAIRKWRQYLLGHSFTILINHKSLRELMSQVVQTSEQHYYLSKLLGFDYTIQYKVGSSNTVADALSRTTPRSSGELFLLSVPNLDFMNDLRHTLHSSMDFQTLLSKVREHPQDHPDYRIHNGLLLFKNRIWLNDDNPSIPNLMLEFHATPLGGHLGGMQCLSTNQDEYTTPRWLSSTTFTTNWGLGGHINGFHHSVAGIHLGALPTNHSAFKVASLFMDIVCKHHGFPKSIVSDRDPLFLSSFWHELFRLCGTRLRMSTTYHPQSDGQTKVMNQVLEQYLRSFIHEQLTTWYRYLTLAEWCYIISLHSSSGLTPFEVIYGKPPPALPHYLQGVSSNEETMKRLADDKRRDVNFTIGQWVYVIERVGQVSYRLKLPEEARIHPVFHCSLLREHHGQKPVVRPLCILDSKLDTSSSPPTRLDKVVFAGEGIVSNNLQDLEATEADKVTKVVSTVNTVRKAPDPEAEVWPSHWGVQRVLEKFMSMPELEQSKKMVNQESFTAQSIMKGRARPDNNMTIANLNFLSRMVDQNLKDIDKRMETLKVNEMTQNIQPQMQTPALNYALGSDMNTAEPMQNLWFMDFLNNGDGDERLIMPAFGDANNSTPNWLLVKPVALKKRDVLVTSPLGDHVSVEFSFAWFGYFYCPCVSM

SEQ ID NO: 167018 - protein, 198 aa, Glycine max
  Coding DNA Sequence Number=SeqID_50240
  Homolog annotation: Hit_ID=Q10KZ6; Match level="QueryCoverage=78%, HitCoverage=33%, E-value=4e-31, Identity=47%"; Hit description =Proline-rich family protein, putative, expressed
MMRLTRDFGDTMQRDVVPAVSSDVEVVARETAQLLEQHNHLSVRDLASKFEKGLAAPTKFSEEARLREAASLEKHVLLKKLRDALESLKRRLAGRNKDDVEDTIAMREGELIQEKAEVKKLANFFKQASEDAKIVDEERAFAHAESKDARAAVQRVEVALQEHERMSQASGKQVMDMEHELRALRVQLAKKTRQYLRL

SEQ ID NO: 167019 - protein, 128 aa, Glycine max
  Coding DNA Sequence Number=SeqID_50241
MDREKDESFAFRKEEGKGKNQKPQLAMYKPQEAKPRMTRSSHTTQRTHTPAWPPPEPTTWSTFGIGVHRVIILSGENPQQGRGGGASNHGEDEARRASSPSRGRCGCIDEVEQGRINMSSKINMYLHA

SEQ ID NO: 167020 - protein, 52 aa, Glycine max
  Coding DNA Sequence Number=SeqID_50242
MAKPLPQDPWAINYGACLNAAKGAGIKRNECGLHLFSGHDGDQKKGENENKI

SEQ ID NO: 167021 - protein, 316 aa, Glycine max
  Coding DNA Sequence Number=SeqID_50243
  Gene Ontology: Mol. function=chromatin binding; Cellular component =chromatin; Biological process=chromatin assembly or disassembly
  Homolog annotation: Hit_ID=Q1SAV4; Match level="QueryCoverage=87%, HitCoverage=89%, E-value=3e-70, Identity=43%"; Hit description =Integrase, catalytic region
  Pfam annotation: Domain name=Chromo; Domain location=224-274; Score =36.3; E_value=1e-07; Accession=PF00385.14; Description='chromo' (CHRromatin Organisation MOdifier
  Pfam annotation: Domain name=rve; Domain location=1-173; Score=-13.0; E_value=0.073; Accession=PF00665.16; Description=Integrase core domain
  Pfam module annotation: Pfam domain module=Chromo::rve; Domain location=224-274::1-173
DVSIDFITGLPCSHGFTVILVVVDRFSKGVYFGALPTHYTAYKVVVLFLDCVCKLHGFPRSIVSDRDPLYEAPYEHGVPPADGRQNREWSYNTAQHVGTGMSPFEGSTVVAVDDLLRSRESIHASLQRRLRKVQEAMKVAADKHRRDLAFQTSVAPSYSKLAKRFYGPFEVVERIEPVAYRLSLPASLRIHLVFHVSLLKLHKGSLPSTPMTLPATSTDNHPLVAPLAILDWRLDHAVSPPVQQVLVQWEGHAPEDSTWECWEELRCVHNLEDKVVFGDGSVDSNTQQSNTQIEDNAENSRPKRVRTRPTYLRDYA

SEQ ID NO: 167022 - protein, 160 aa, Glycine max
  Coding DNA Sequence Number=SeqID_50244
MTICVPGATPSERPTPRDRGTCGSEHPQSQKSRSCVMSERKIIALVQSQVYGSACIFFQWRPTVGPSSYCIFFLTFPNPSKTPCPQGVGRWLRWWWWIWWRRTSSPMTDGAKPSLDGEKNPNQAWMNMMLDGIVAEQDGVIAIRDFAAMVVAVMTVGSVE

SEQ ID NO: 167023 - protein, 259 aa, Glycine max
  Coding DNA Sequence Number=SeqID_50245
  Homolog annotation: Hit_ID=Q1SAJ3; Match level="QueryCoverage=87%, HitCoverage=47%, E-value=2e-86, Identity=71%"; Hit description=WD-40 repeat
MSDHDMYPLDHKDEDDFFDEIDDQNHGGGVGDAALDEYEMLTKVTDTSAAQARKGKDIQGIPWERLNISRERYRLTRLEQYRNFENILTSGDAVDKECKQMEKGGNYYEFFYNTRMVKPTILHFQLRNLVWATSKHDVYLISNYSVNHWSSLSGNLSEIINFAGHVAPTPTKEHNLNGFNSALLKYTYRYAGNLLEGFSQTQISTLAVKDNLLVAGGFQGELTCKEIMSGMPLFIFPCLFPGMWVAVNKFSRGKCRAGG

SEQ ID NO: 167024 - protein, 528 aa, Glycine max
  Coding DNA Sequence Number=SeqID_50246
  Gene Ontology: Mol. function=binding; Cellular component=protein phosphatase type 2A complex; Biological process=ethylene mediated signaling pathway
  Homolog annotation: Hit_ID=Q38950; Match level="QueryCoverage=99%, HitCoverage=81%, E-value=0.0, Identity=78%"; Hit description =Serine/threonine-protein phosphatase 2A 65 kDa regulatory subunit A beta isoform
  Pfam annotation: Domain name=HEAT; Domain location=160-194; Score =11.0; E_value=1.9; Accession=PF02985.12; Description=HEAT repeat
  Pfam annotation: Domain name=HEAT; Domain location=197-233; Score =14.4; E_value=0.41; Accession=PF02985.12; Description=HEAT repeat
  Pfam annotation: Domain name=HEAT; Domain location=236-272; Score =33.3; E_value=8.4e-07; Accession=PF02985.12; Description=HEAT repeat
  Pfam annotation: Domain name=HEAT; Domain location=275-311; Score =30.3; E_value=6.9e-06; Accession=PF02985.12; Description=HEAT repeat
  Pfam annotation: Domain name=HEAT; Domain location=376-412; Score =26.6; E_value=8.5e-05; Accession=PF02985.12; Description=HEAT repeat
  Pfam annotation: Domain name=HEAT; Domain location=43-78; Score=1.1; E_value=32; Accession=PF02985.12; Description=HEAT repeat
  Pfam annotation: Domain name=HEAT; Domain location=436-472; Score =21.9; E_value=0.0024; Accession=PF02985.12; Description=HEAT repeat
  Pfam annotation: Domain name=HEAT; Domain location=475-511; Score =22.7; E_value=0.0013; Accession=PF02985.12; Description=HEAT repeat
  Pfam annotation: Domain name=HEAT; Domain location=82-117; Score =15.9; E_value=0.15; Accession=PF02985.12; Description=HEAT repeat
  Pfam module annotation: Pfam domain module=HEAT::HEAT::HEAT::HEAT::HEA T::HEAT::HEAT::HEAT::HEAT; Domain location=160-194::197-233::236 -272::275-311::376-412::43-78::436-472::475-511::82-117
MSMVDEPLYPIAVLIDELKNDDIQLRLNSIRKLSTIARALGEERTRRELIPFLGENNDDDDEVLLAMAEELGVFIPFVGGVEHAHVLLPPLEMLCTVEETCVRDKAVESLCRIGLQMRESDLVEYFIPLVKRLASGEWFTARVSSCGLFHIAYPSAPEMSKIELRSMYSLLCQDDMPMVRRSAASNLGKYAATVEYAHLKADTMSIFEDLTKDDQDSVRLLAVEGCAALGKLLEPQDCITHILPVIVNFSQDKSWRVRYMVANQLYELCEAVGPEPTRTELVPAYVRLLRDNEAEVRIAAAGKVTKFCRILNPDLSIQHILPCVKAKILCKIFAGIVNGFFAACSLCFGFRDNGNGSSVRKVVKQDHPLGGICFKDATIEQLLPIFLSLLKDEFPDVRLNIISKLDQVNQHRAYDLMPPSIEMQSKNHITKKTFQRYVDQVILAAIVELAEDRHWRVRLAIIEYIPLLASQLGVGFFYDKLGALCMQWLQDKVHSIREAAANNLKRLAEEFGPEWAMQHIIPQVHVLA

SEQ ID NO: 167025 - protein, 191 aa, Glycine max
  Coding DNA Sequence Number=SeqID_50247
  Gene Ontology: Mol. function=nucleic acid binding; Biological process= DNA integration
  Homolog annotation: Hit_ID=Q1SEE1; Match level="QueryCoverage=88%, HitCoverage=15%, E-value=9e-10, Identity=24%"; Hit description =Integrase, catalytic region; Zinc finger, CCHC-type; Peptidase aspartic, catalytic
MEGAMTHNGDMFKLATYIYMYWKPIMEDYLYSKDLHEPITQQDKPERKIDKIRSSRIRKQAVAMIQKYIDRSLFKHVSTYTNVYELWTKLESLIQKRTPRNKAYLVKQLAKLEYKDGQNMIEHLNISKVVTLSNSTPEGKLNMDYVIDSLLIEESIRRERGLNNQFEANVAENRGSKNVENHKAGPNLALD

SEQ ID NO: 167026 - protein, 46 aa, Glycine max
  Coding DNA Sequence Number=SeqID_50248
MAQDLGAIAEDLERVINLRMVTEGTDLHDIMTRYGSLRLRQRRRID

SEQ ID NO: 167027 - protein, 175 aa, Glycine max
  Coding DNA Sequence Number=SeqID_50249
IPLRSRRHRDPSSPMDIRMFSPLLLDIQSTLDVFVLLESVSPSSNTSDRLREHPTTLPTNQGPARGVDHRKSDSTTHGIVQPDAVPVSVPNAILGTCTASEASGWSLRSSRNDPETGDSERCGLYIEANPAHLVALTIRKYTFNIDYLEHSTSVLKPILKVPMLNVSMLTSVLEN

SEQ ID NO: 167028 - protein, 319 aa, Glycine max
  Coding DNA Sequence Number=SeqID_50250
  Homolog annotation: Hit_ID=Q5Z6M5; Match level="QueryCoverage=86%, HitCoverage=81%, E-value=8e-53, Identity=42%"; Hit description =Aluminum-activated malate transporter-like
  Pfam annotation: Domain name=UPF0005; Domain location=5-301; Score =52.3; E_value=1.6e-12; Accession=PF01027.11; Description =Uncharacterised protein family UPF0005
MDTFNVLHMRGSLQKFWFIKPQMIHFTVAIEQQFNRQLDFASWEPPHGPYKTFNYPWRSYVKVSGALRHCAFMVMAMHGCILSEIQTDTKMSEVLLSCFTHNPSSMKFSLLLLAPPEKRMVFSNELQKVGNEGAEVLRQLGSKVEKMEKLSNVDILLKVHEAAEQLQMKIDQQSFRLFNSESWQDAKKPKEIENNDNCLLIDVKDNENKNSLISSLSETGADSRLNINIEPSVPELHTSQSLMSNKMSWPRLSFYGDNMLLEQDSKVYESASSLSLATFASLLIEFVARLQNLVDEFQDLGEKANFKDVFDEPMLKEAI

SEQ ID NO: 167029 - protein, 62 aa, Glycine max
  Coding DNA Sequence Number=SeqID_50251
MDELKDLIKQVAPPGIPPYGIDETQMVLIESNYWKKIGPIEILAVFSKPVPEMEDELSLSQS

SEQ ID NO: 167030 - protein, 71 aa, Glycine max
  Coding DNA Sequence Number=SeqID_50252
MDFKGGVQISQQSNGKEKATMQSELLSSLAFICIFQRKRLTTLWAEYFGEKAPRWVPLEYLSTTTRMVVNP

SEQ ID NO: 167031 - protein, 59 aa, Glycine max
  Coding DNA Sequence Number=SeqID_50253
MEEPETAKHTANVSLPLLRWKNQKQRNTQQIFSHSKFTFGRVNLDIHPNTHSVFLLGLK

SEQ ID NO: 167032 - protein, 592 aa, Glycine max
  Coding DNA Sequence Number=SeqID_50254
  Gene Ontology: Mol. function=RNA-directed DNA polymerase activity; Cellular component=chromatin; Biological process=chromatin assembly or disassembly
  Pfam annotation: Domain name=RVP_2; Domain location=316-430; Score= -48.0; E_value=0.0054; Accession=PF08284.2; Description=Retroviral aspartyl protease
  Pfam module annotation: Pfam domain module=RVP_2::Retrotrans_gag; Domain location=316-430::95-185
MAEHGTRRTTTDRLEEAIAALSERHSDLANKLEAWCERLSHLTSASPAPSQPSPHPRPPVKLDVPRFDGHNPLGWIFKVSQFFDYQGTPEEDRIMVASFYLDRPVLSWFQWMFRNGFITSWPALLQAIEARFAPSFYDDPRGTLFKLVQRGSLTDYLIEFERLANRITGLSPSVLLSCFISGLNPKIRREEDKLLDRKKHTSKASFGPSPPPNPPVPHTPTHLAPRPKAPFIKRIQEEMTFRREMGLCYNCDEKWSSSHRCKGRVLLLIADLDEPATSEPPSTDYPHFPATEPNPTPDETNPFLDPNAPHPHISLHALAGVLASDTFRLYGLINSARVTILVDSGSTYNFVQPRVAKFLSLPVKETTTLRVMVGNGSVLQCHQLCSDTQVLMQGHTFTVTLRVLPLSGADIVLEVEWLCTLGPITNDYSSFTMQFVYKDQPVNLHADVYVDNSPASATQVRQMISTNSTSGLFHISLLPVNQLESTTDPPHPIPAINKLLLRYHSIFHTPSELPPPRHHDHHINLLPVTNPVNVRPYRYPNFQKTEIEKQVSELLNFGLIRPSQSPFSSPVLLVKKKDGSWRMCVDYRALNA

SEQ ID NO: 167033 - protein, 126 aa, Glycine max
  Coding DNA Sequence Number=SeqID_50255
  Gene Ontology: Mol. function=catechol oxidase activity; Cellular component=chloroplast; Biological process=metabolic process
  Homolog annotation: Hit_ID=Q7Y249; Match level="QueryCoverage=65%, HitCoverage=14%, E-value=7e-15, Identity=46%"; Hit description =Polyphenol oxidase
MELDYHAAKSDSGHEQLRPKPRSRNENEEEEEGVEEVLVIDVEYDSTDGVRFDVFINDQGDNEIGPQDSEFAGSFVTLPHSPHVNHNNITKASFRLGVTKDDDSISVTLAPIYGNKPVTIKDVRID

SEQ ID NO: 167034 - protein, 1071 aa, Glycine max
  Coding DNA Sequence Number=SeqID_50256
  Gene Ontology: Mol. function=monophenol monooxygenase activity; Cellular component=chloroplast; Biological process=metabolic process
  Homolog annotation: Hit_ID=Q84YI1; Match level="QueryCoverage=70%, HitCoverage=77%, E-value=1e-106, Identity=45%"; Hit description =Polyphenol oxidase
  Pfam annotation: Domain name=Chromo; Domain location=169-220; Score =28.3; E_value=2.6e-05; Accession=PF00385.14; Description='chromo' (CHRromatin Organisation MOdifier
  Pfam annotation: Domain name=Tyrosinase; Domain location=579-842; Score=271.3; E_value=2e-78; Accession=PF00264.10; Description=Common central domain of tyrosinase
  Pfam annotation: Domain name=Tyrosinase; Domain location=81-421; Score=83.9; E_value=5.1e-22; Accession=PF00264.10; Description =Common central domain of tyrosinase
  Pfam module annotation: Pfam domain module=Chromo::Tyrosinase::Tyrosin ase; Domain location=169-220::579-842::81-421
MECSYNTSQHSGTGLTPYEVVYGKPPPSIHNYLRGSSHNEAVDAMLTTREEIYATLRRKLLKAQDTMKHYADRSRCEAQYEVDQLVYVKLRPYRQCSLRTQTSNKLAKRYFGPFRVLERVGNVAYRLQLPEGCQIHPVFHCSLLRSHHGPHDLQATPLPPAATHNNPILEPLAVLDLRMDTSSQPPRKLVLVQWKGMAPEESTWEDWADIHDSHHLEDKVTFPGEDIVRNVNNNDTSSNEARPRKATTRPRYLERPLDVRCNHCSMYKSLKVATIIFSLTNLPLPVPNIVFGAKRASLFHGKTFFAGKQPELGGGTVELGPHTALHRWTGDPRQPNKEDMGRFYSAARDPIFYSHHANVDRMWNIWKKIPTRKRRDFKNRDWLETTFFFYDENKNLVSVKVKDSLDLKKMGYVYQDVDIPWLQKRTKPKRTRKAKQVAFTQQFGGIREAMAAETGPSSKFPLTLLDSKVTLLVKRPKQLRSKKDKEEQEEVLVIDGIEFDGDNDVKFDVYITDEDVEEIGPENTEFAGSFATLGHSHSNMNMDKKIKTSLTLGITDLLEDLDAENDDSILVTLVPRSENVTITIQSIKIEFEKEEFLPPGTPVRVRSAAQFFNKDYLEKYEKALTRMKALPPDDPRSFIQQANIHCAYCDGGYKQVEFPKLDFKVHNSWLFFPFHRWYLYFYEKILGKLIDDPTFALRFWNWNNPDVAWDKIHQPPTLVDLNYSKNNDGSAIFLGKPFHPGEEPNNSAGSVESVPHTPGHIWTGDRNQPNGEDMGRFYSAGRDPIFYSHHANVDRMLNISKTIKETAFYFYDENKNRVRVTIKDSLDTKKLGYVYQDVDIPWLNKKPKPKKSRKAKKAAEARPSVKFPLTLNSKNKNLVRVKVKDSLDSKKMRYIYQDVDILWLKKKTKPKITRKAKKVTLLVKRPKKLRSKREKEEEEAVLVIDGIEFDGDTDVKFDVYITDEDVEEIGPKRTEFAGIFATLGHSHSNMNMDKKIKTSLTIGVTDLDAENDDSILVTLVPRCENVTITIQGIKIEFEKEEWKYVTVIYDLIMALLLAKKILLNIFRLLLL

SEQ ID NO: 167035 - protein, 136 aa, Glycine max
  Coding DNA Sequence Number=SeqID_50257
  Subcellular localization annotation: CTP_CleavageSite=60; ConfidenceScore=5.67e-01
MASSRHAPNLTPSGTSNSDASSRNTTIRRRLSPHLSSRHHTHLQIAFTSPFNLFFLFVLDLSHAEDFGGKWVLDLLFAPFVAFLLASIIWPKKVFSSTSCAFNYIHVCNSKDNTRDDKQAAIHEGSVEASFMMNQD

SEQ ID NO: 167036 - protein, 238 aa, Glycine max
  Coding DNA Sequence Number=SeqID_50258
  Gene Ontology: Mol. function=catechol oxidase activity; Cellular component=chloroplast; Biological process=metabolic process
  Homolog annotation: Hit_ID=Q7Y249; Match level="QueryCoverage=98%, HitCoverage=41%, E-value=1e-61, Identity=51%"; Hit description =Polyphenol oxidase
MGYLAWAARDPIFFAHHSNVDRIWNIWKTIPGGFRRDFNDDDWLESSFLFYDENKNLVRVKIKDCLDSRKLGYDYEYVDDTPWLNVRPRPKYAVPLPLPFPLPQPLPFPLTLNSIQRTTVKRPKKEESWSEVEKAEVLVMEVEYDMTEDVKFDVFINDQGDDEIGPEDSEFAGSFMTLAHSHGHQSKRTTTSLRLAITDLLKDLHALDDESIAVTLAPRYGNKPVTIKGIKIKLVPLV

SEQ ID NO: 167037 - protein, 212 aa, Glycine max
  Coding DNA Sequence Number=SeqID_50259
  Gene Ontology: Mol. function=monophenol monooxygenase activity; Cellular component=chloroplast; Biological process=metabolic process
  Homolog annotation: Hit_ID=Q84YH9; Match level="QueryCoverage=87%, HitCoverage=32%, E-value=6e-56, Identity=56%"; Hit description =Polyphenol oxidase
  Subcellular localization annotation: CTP_CleavageSite=40; ConfidenceScore=5.75e-01
MASISSHPSFSSLLSFSASFSIPSMFPTSQKPCQPSKPKRGRHASKVACNGNPNPRNRRDILIGLGGLYGATTLSGNSTGSAFGAPVSPPDPTNCVPPLLPGENDVNCCPPSPIVDFEFPSHKRLRHRRPAQWVDDDYLNKYKEAVRLMRALPLDDPRNFMQQAKIHCAYCHNGYRQKGFPDHNLQVHGNWLFAPFHRWYLYFHERILGSLI

SEQ ID NO: 167038 - protein, 42 aa, Glycine max
  Coding DNA Sequence Number=SeqID_50260
MAQRECGLKSQGKLVRECYVWSVRMAERERELRRELRQKFPF

SEQ ID NO: 167039 - protein, 59 aa, Glycine max
  Coding DNA Sequence Number=SeqID_50261
MQIAEAIGDFGQALTRGIGLASVTGDLRRSSFFRLKSPVELANCAVVGIASSTGELPLE

SEQ ID NO: 167040 - protein, 73 aa, Glycine max
  Coding DNA Sequence Number=SeqID_50262
MGFFSKLISDMVLFWNLFLHGAVLNVKCMKIAEAIGEFGKALTRGTGLASVTGDFSMHGTRQFNWRVVLGEPG

SEQ ID NO: 167041 - protein, 264 aa, Glycine max
  Coding DNA Sequence Number=SeqID_50263
MDWDQLLAGIGGRTISWFPRWKEGKEGVLFSCGEIPKHSAAPTEESMSPFLVRDFGAQNSKTIQRIHKAWETPLKKDQELRGIRNGIIGGYHEWLKVHIRGLDWLAKLKVVSKESFEAPEEDEEVQALKSELGKAKLAKEKFKLAATHVRKECAGLREENAITARALEQETKRARKEEYGRNKFHGALWGSNSELKLRKEERDQSRAHSMVLKEELVACSRSKRSLSQRLCKTETNMLAIIAKYQEELGLAAAHEHRIADEYAQ

SEQ ID NO: 167042 - protein, 274 aa, Glycine max
  Coding DNA Sequence Number=SeqID_50264
LNENQLNYKESLLRFVEHLGPTAKRVAAKKLEALEDQQRLNDDTTLQNLPENASGTQIIQQQTPQIPTLPELFNVQTLALAQPIFNRPLTNPGFAASLNRIVNTHVGNVNTNLSSSNAFSMVHPTHLISGPQPRPEGAVNLSDLSLMSQTRRRSSMYDMPANILTGNSLVQQHQPWPAGTSYDHAGNFQVMFDAQHFNNNICPMLASYDQVLPQAQMGPHGDGPVPLQEPDPSSSLQMVLGGAINHYGEQGQPEEALLQLPWEGDQLPNLDLGL

SEQ ID NO: 167043 - protein, 465 aa, Glycine max
  Coding DNA Sequence Number=SeqID_50265
  Gene Ontology: Mol. function=protein dimerization activity; Cellular component=nucleus; Biological process=regulation of transcription, DNA-dependent
  Homolog annotation: Hit_ID=Q9ZPJ6; Match level="QueryCoverage=92%, HitCoverage=93%, E-value=1e-118, Identity=53%"; Hit description =Transcription factor PERIANTHIA
  Pfam annotation: Domain name=bZIP_1; Domain location=177-232; Score =24.0; E_value=0.00036; Accession=PF00170.11; Description=bZIP transcription factor
  Pfam annotation: Domain name=bZIP_2; Domain location=177-227; Score =17.4; E_value=0.013; Accession=PF07716.5; Description=Basic region leucine zipper
  Pfam module annotation: Pfam domain module=bZIP_1::bZIP_2; Domain location=177-232::177-227
MQGFKTAQQPSSQQQLYCHSSFLLRGNDPNRNTTRFSDLGELHHSSSVFHHEDAADLSSSSMFSVKSNNVVGGSNIQYGTLNTLSTVNVGSAEIGTSVRGCMDTGQQLMYHKGVTTAALPLGNGQVENWDDSGLADNSQQTDHTSTDIDTDDIIQCNRVKNGTRMVVHSKDATKVKPGDQKTLRRLAQNREAARKSRLRKKAYVQQLESSRVKLVHLEQELQRARQQGIFIATPGDQGHLAVGNGALAFDIDYAHWVDEHQRLLNDLRTAINSQMSDSDLHILVDSVMAHYNELFRLKSIGAKADVLHIHNGMWKTPVERCFMWLGGLRSSELLKIIKNHLEPLTDQQLMGICNLQQSSQQAEDALNQGMEALQQSLVEILSSTSLGPNGSGNVADYMGQMALAMGKLAVLGSFLHKADLLKQETLEQLQRILTTRQTARALLVQNDYISRLRALSSLWLARPRE

SEQ ID NO: 167044 - protein, 92 aa, Glycine max
  Coding DNA Sequence Number=SeqID_50266
MSPVEPLCYTNTSRDFRTLRCTARNSFPWEQCRRRRASGDNHVFQPPPPTPKQDDTLASKNQLGDDDEAKSLRGLQLPMKSCDNLGVTSKNA

SEQ ID NO: 167045 - protein, 316 aa, Glycine max
  Coding DNA Sequence Number=SeqID_50267
  Homolog annotation: Hit_ID=O04342; Match level="QueryCoverage=72%, HitCoverage=50%, E-value=1e-55, Identity=56%"; Hit description =Expressed protein
MDKESYKFQNSNHLEDSNLKRDGPSFIKGLDAITSSLTHIGGTIGKSLEIYISILSCGQDDEGLTIVENRTSDIIQETRKHIKKKPGNSVGQNQETNHSTTLHQSQLRNQMSPKQTDQELQLKASRDVAMAMAAKAKLLLRELKTVKADLAFAKDRCAQLEEENKILRENRERGDSHDDDDLFLYASFTDIQKIRLQLESLLAEKARLAHENSVYARENRFLREVVEYHQLTMQDVVYLDESNEEVTEVNPLNLPPVPNMALDSITPSATSLLHSPEPNLGMASELTRGTSSTISGKDAKSNEITIKDSRSSEATR

SEQ ID NO: 167046 - protein, 97 aa, Glycine max
  Coding DNA Sequence Number=SeqID_50268
MVALRLATKVNKDTLVLSGGPKDEKIQVADDSLSKADPLSECYPLSEEYNSLNGLGNPRRGSEMCSPSTQPVRPARSLSLIALSVPSSLSQNSLTLA

SEQ ID NO: 167047 - protein, 320 aa, Glycine max
  Coding DNA Sequence Number=SeqID_50269
  Homolog annotation: Hit_ID=Q84YF3; Match level="QueryCoverage=88%, HitCoverage=88%, E-value=6e-59, Identity=47%"; Hit description =Hypothetical protein 4B
  Pfam annotation: Domain name=DUF1191; Domain location=26-312; Score =242.5; E_value=8.9e-70; Accession=PF06697.3; Description=Protein of unknown function (DUF1191)
  Subcellular localization annotation: CTP_CleavageSite=73; ConfidenceScore=5.07e-01
MRVGTSFLALLSLLPLLLSPQFSSAQLPPDTGISSRTLDAILQDCAFKAFLRPKTGVPYGGQVPRSLNGIRVSAMRLRSGSLRTRGVERYKEFQIPIGVVEQPYVERLVLVYHNLGNWSEKFYPLPGYTYLAPVLGLMPYSGANLSASELPELDIRASDKPILINFPHVKSAPLGSVPKCVYFDLHGSVQFDILLHGNVCSTVQQGHFSIVVESNAPSPAPAAAAVAAAAAADVRKSGSGRNKSKVWVIVASLVGGCLLLIMLSLLVAKVRRTKKGMKIQQLEWAAESNETLQIASIGGTKAPLAVGTRTRPTIENDYIP

SEQ ID NO: 167048 - protein, 471 aa, Glycine max
  Coding DNA Sequence Number=SeqID_50270
  Gene Ontology: Mol. function=RNA-directed DNA polymerase activity; Biological process=RNA-dependent DNA replication
MHADLLTHVSRTEVKDIVFFMGPYRAPASGNFNTYLVDTLIVPIPKNDNPTTLKEFSPINLCNVILKIVLKCWLTGSNPSWITLSALYKVVLFLEKVLVIMPSLLRKLSTICTRRKLTLREFGFPSQTLKIIMALTTSTSLSLKWNNESLDSFKPTGGLRQGDPLSPCFFVLCMEKLALMVQNKVKENQRQPVNISRNGPKISHPFFVDDCLLFTKAKSSQVRLVQQVLHDFCKASGLKNHFGKVSDKFHSHLFYAEFVVPKGPKNRSGLGVQTARDMNVSLLGKHVWSMLHERNKLWVELLSKKSTILHDNIKPGTSYLWIFILKAAAILELGFRFRVGEGKGLFIESNFLNEDIVDTIIWDGSFDENYSPKSAYRWITRARLACPNFQDARLWEDIFHVLRDCPKAQRIWNMIHFHFQNPLIIDNPRSSLKVNAESKVGIKFVVTCKFIWRASNMEIFQDVVEFSKMIV

SEQ ID NO: 167049 - protein, 67 aa, Glycine max
  Coding DNA Sequence Number=SeqID_50271
MSLASGTTYASCFGTCCNSKEGNYDQNCGKEGFQPKRKEKLLFSQDWTIIYQASCRHEAHFAHSFSK

SEQ ID NO: 167050 - protein, 128 aa, Glycine max
  Coding DNA Sequence Number=SeqID_50272
  Gene Ontology: Mol. function=DNA binding; Biological process=DNA integration
MQKFVKDLSRDKECKRDRKETHKEPTPITFSNEDFEGIDRCHNDPMVVKIEVANFLVCKVLLENGSSTDVLYWTIFKQLGISKSLIEPFLEQFIGFARETTDTIGYVHLVTTLEMKGVKVHHDQVPPN

SEQ ID NO: 167051 - protein, 89 aa, Glycine max
  Coding DNA Sequence Number=SeqID_50273
  Gene Ontology: Mol. function=sugar porter activity
  Homolog annotation: Hit_ID=Q1S6S0; Match level="QueryCoverage=63%, HitCoverage=24%, E-value=1e-19, Identity=78%"; Hit description =Facilitated glucose transporter; KH, type 1
MSNLYNQISLPSPQRANSPNINMRGNFDVDSQYLTELLAERQKLGPFMQVLPLCTRLINQAGSSYLGQMQVDAATIVVAETLKTLKLRF

SEQ ID NO: 167052 - protein, 209 aa, Glycine max
  Coding DNA Sequence Number=SeqID_50274
  Gene Ontology: Mol. function=RNA binding; Cellular component=nucleus; Biological process=nicotianamine biosynthetic process
  Homolog annotation: Hit_ID=Q75GR5; Match level="QueryCoverage=99%, HitCoverage=70%, E-value=2e-72, Identity=67%"; Hit description =Expressed protein
  Pfam annotation: Domain name=KH_1; Domain location=46-101; Score =12.1; E_value=0.043; Accession=PF00013.19; Description=KH domain
MTSPNSTSNFTGWKSLSHERLAGVQGLSMDWQTSPVVPSSPIVKKILRLDIPKDSYPNFNFVGRLLGPRGNSLKRVEATTGCRVFIRGKGSIKDLDKEELLRGRPGYEHLNDPLHILIEAELPASVVDVRLMQAQEIIQELLKPVLPLPLTRVWLMLKGNIDESQDFYKRQQLRELAMLNSNFREESPQLSGSVSPFTSNEIKRAKTDQ

SEQ ID NO: 167053 - protein, 1092 aa, Glycine max
  Coding DNA Sequence Number=SeqID_50275
  Gene Ontology: Mol. function=protein serine/threonine kinase activity; Cellular component=integral to membrane; Biological process=protein amino acid phosphorylation
  Homolog annotation: Hit_ID=Q1S6S4; Match level="QueryCoverage=66%, HitCoverage=66%, E-value=0.0, Identity=55%"; Hit description=Protein kinase; Adipokinetic hormone
  Pfam annotation: Domain name=Pkinase; Domain location=317-682; Score =86.6; E_value=7.5e-23; Accession=PF00069.15; Description=Protein kinase domain
  Pfam annotation: Domain name=Pkinase_Tyr; Domain location=317-682; Score=112.2; E_value=1.5e-30; Accession=PF07714.7; Description =Protein tyrosine kinase
  Pfam annotation: Domain name=Ribosomal_L10e; Domain location=873 -1048; Score=472.5; E_value=5.1e-139; Accession=PF00826.8; Description=Ribosomal L10
  Pfam annotation: Domain name=Ribosomal_L16; Domain location=885-1038; Score=-37.4; E_value=0.0082; Accession=PF00252.8; Description =Ribosomal protein L16
  Pfam module annotation: Pfam domain module=Pkinase::Pkinase _Tyr::Ribosomal_L10e::Ribosomal_L16; Domain location=317-682::317 -682::873-1048::885-1038
  Subcellular localization annotation: CTP_CleavageSite=35; ConfidenceScore=5.20e-01
DLSSNRLTGNIPSYFADLPRLQKLSLANNSLDGTVSSSIWQNKTSNGTKTFLLELENNNLTTISGSIDLPPNVTVGLNGNPLCSNVTLTQFCGSEGANVTDGSFTTNSSSCPPQACPPPYEYSVNCFCGLPLIVDYRLKSPGFSNFLPYLNDFEVYMASGVKISTNQLQYDFYWQVGPRLRMNLKFFPAYVDNSSSHTFNRSELLRLTSMFTGWLIPDSDLFGPYELMGFNLLGPYQDEIGRSSKSGISTGALVGIVIGAIAFAVTLSAIVTILILRIRLRDYHAVSRRRHASKISIKIDGVRAFSYGELSSATNNFSTSAQVGQGGYGKVYKGVLSDGTIVAIKRAQEGSLQGEKEFLTEISLLSRLHHRNLVSLIGYCDEEGEQMLVYEFMSNGTLRDHLSDAVYIFHFSKLNDADNLFYSNCVPKCLSMLSLLRVCLMFTVTAKDPLTFAMRLKMALGAAKGLLYLHSEADPPIFHRDVKASNILLDSKFSAKVADFGLSRLAPVPDMEGVVPGHVSTVVKGTPEKNRCSDPRSNLSSFKLKLERLGLVSQIQMVSDSEIGVVAPSPTLDELENNGWATLGYLDPEYFLTRKLTDKSDVYSLGVVFLELLTGMHPISHGKNIVREVNVAYQSGVIFSIIDGRMGSYPSEHVEKFLTLAMKCCEDEPEARPRMAEVVRELENIWSTMPESDTKRAEFMSSDSGKADSHSTPSSSSASASIMKTPFVSGDVSGSDLGTTLSLLVSLFFLYENISDDGGGARTKARSCGGMMVLDTMVRTQGAGGAGEESRARGSECDETNVAWRGGGSRSSCDGDGLGGEKKEKGKRKGGWVGGGIISLLGLEVAGYKSTTTFSLLHLQAFYYFVNSNNTTMGRRPARCYRQIKNKPYPKSRFCRGVPEPKIRIYDVGMKKKGVDEFPFCVHLVSWEKENVSSEALEAARIACNKYMAKFAGKDAFHLRVRVHPFHVLRINKMLSCAGADRLQTGMRGAFGKPQGTCARVNIGQVLLSVRCKDANSHHAQEALRRAKFKFPGRQKIILSRKWGFTKFSRSEYLKLKSENRIVPDGVNAKVLGCHGPLANREPGRAFLPATA

SEQ ID NO: 167054 - protein, 395 aa, Glycine max
  Coding DNA Sequence Number=SeqID_50276
  Gene Ontology: Mol. function=cation transporter activity; Cellular component=membrane; Biological process=cation transport
  Homolog annotation: Hit_ID=Q84ND6; Match level="QueryCoverage=99%, HitCoverage=80%, E-value=1e-151, Identity=71%"; Hit description =Cation diffusion facilitator 8
  Pfam annotation: Domain name=Cation_efflux; Domain location=41-381; Score=91.4; E_value=2.8e-24; Accession=PF01545.11; Description =Cation efflux family
EKEYYERQFATLKSFDEVDSVESSDCIEESDEEQAQQERAMKISNYANVALLILKIYATVRSGSIAIAASTLDSLLDLMAGGILWFTHLSMKNINIYKYPIGKLRVQPVGIIIFAAIMATLDFCLDEHLYLLLMLNVNQHEGIKFDLWFNQISVWETKKVLITAVQQLIQNSPAEMMTTEQLIWLYSIMIFATVVKLMLWLYCRSSGNKIVRAYADDHHFDVVTNMVGLVAAVLGDKYYWWIDPVGAILLAIYTITNWSHTVMENAVSLVGQSAPPEVLQKLTYLVIRHPRIKRVDTVRAYTFGVLYFVEGWVLLAVIVGVLILAHGLFFQTFFLTVDIELPEDLPLKEAHAIGESLQIKLEKLPEVERAFVHLDFECDHKPEHSVLIKLPNNQP

SEQ ID NO: 167055 - protein, 438 aa, Glycine max
  Coding DNA Sequence Number=SeqID_50277
  Gene Ontology: Mol. function=monooxygenase activity; Cellular component=integral to membrane; Biological process=electron transport
  Homolog annotation: Hit_ID=Q1LNM8; Match level="QueryCoverage=99%, HitCoverage=80%, E-value=8e-76, Identity=38%"; Hit description=PepSY- associated TM helix precursor
SVGPDAVRIAVAGAALTGHCQAGEAEGHGQRDGIDPEQRPVATRGRTPQPVTIECAVQDRHQRGTDCRRPQQLACGLCRAAQRGPQRTGRPAAEAGPADAVVDRRRRQPFQHQRGEERDRDRHAQADAHADRGPCHVHSGARLLRLATLAPRLDPQQVARVEQERTAQAEQEVQPDHHPVAELAEVQRIGGAERGVVGVALAWQLGGQYLAGGDIQRHGAERAEGAGGFAGDLDGGVGVARVGQLQVGRLEAGHALCARHLQRPRLQHAQAARRRGDAGRFTHRCGVHRCWHGLQGLAVEDQGVEQGHLHEHQAEQGAGHREHQVEGQAQYADHVVRVLPQLFQVAPRTQREQVAEQLRQMDHQAAEQRHAVQQADNAHHVDAGHGQAQAVVQLVDQLGQPGLRRRRAAANLPRPGITPAAIIGLPVRKWLRVVGAGE

SEQ ID NO: 167056 - protein, 397 aa, Glycine max
  Coding DNA Sequence Number=SeqID_50278
  Gene Ontology: Mol. function=hydrolase activity, hydrolyzing O -glycosyl compounds; Cellular component=extracellular region; Biological process=carbohydrate metabolic process
  Homolog annotation: Hit_ID=Q0WY12; Match level="QueryCoverage=60%, HitCoverage=39%, E-value=3e-41, Identity=40%"; Hit description =Chitinase
  Pfam annotation: Domain name=Glyco_hydro_18; Domain location=151-395; Score=115.0; E_value=2.2e-31; Accession=PF00704.18; Description =Glycosyl hydrolases family 18
  Pfam annotation: Domain name=S1; Domain location=12-84; Score=94.3; E_ value=3.6e-25; Accession=PF00575.13; Description=S1 RNA binding domain
  Pfam module annotation: Pfam domain module=Glyco_hydro_18::S1; Domain location=151-395::12-84
AAKARIEQITSDVEPGRIYEGKVAKIMDFGAFVTILPGKDGLVHVSQISSDRVEKVGDVLKEGDVVKVKVLEVDKQGRIRLSMKAVEEGDAVAACPAAVHERRYAAIVLSPLRGSRLSIGRRATTSTVAVLAVLIAGALPIAAHAAPAQPPIFGAYYPGGSAERYPVSSIPAERLTHLFYAFSTIEDGRCTIGAEAPKNFAALAELKKAHPHLRALISIGGWGAGGFSDAALTETSRKRLVDSCMTLFFERHAGSFDGVDIDWEFPVSGGPKELAHRPQDRANLTRLAQAFRVALDARGRKAGQPMLLTAALAAGRLQTDGPYDPAASYDLPALAKVFDFINLMSYDMGTGFSTVSTFNAPLHEVAADPLAPELRRWNNVAGAVQFYRDHGVPADKL

SEQ ID NO: 167057 - protein, 179 aa, Glycine max
  Coding DNA Sequence Number=SeqID_50279
GVAKDWLYYLAPRSITSWDDLKRVFLEKFFPASRTTTIRKDISGLSNMERSMIDAASGGALGQLGNPAGLESEICTCCKDLCPSMQQPGAIEQPEAYVANIYDRPPQPQQQNQPQQNNYDLSSNRYNPGWRNHPNLKWSSPQQQQQQPAPSFQNAAGPSRPYIPPPIQQQQQPPETTNS

SEQ ID NO: 167058 - protein, 311 aa, Glycine max
  Coding DNA Sequence Number=SeqID_50280
  Homolog annotation: Hit_ID=Q8H6Q8; Match level="QueryCoverage=67%, HitCoverage=6%, E-value=4e-27, Identity=35%"; Hit description=CTV.20
  Subcellular localization annotation: CTP_CleavageSite=58; ConfidenceScore=5.01e-01
MASESDDDSETDLQKQIQKAKQTKNVCNQKPSQSLTQQESTPQPSNSYISKNKFFNVLQMEPEYWDKNPFKATAKPRHYGSNLNQPKKFPAPFDPAGYNYWDYIDAWTNVFWHQNSKFKHSWLIYFKNNTVYNFPNWFLQWWNYFGPISQIFPEEVQQGFQQFTKLFNIKETRILADLKYFSSFALSWIFSWQYRYGKTENNKQYPSLQRHAFVKWWSQFDTSKATPEQVKNWFQSNPEFLKPADPETSLFLNQKSQLAAFLASSKSKKSLAQNLKEVLQLLQQEEEEEEPPKKEAESSENNDDQEDDPFY

SEQ ID NO: 167059 - protein, 183 aa, Glycine max
  Coding DNA Sequence Number=SeqID_50281
  Subcellular localization annotation: CTP_CleavageSite=28; ConfidenceScore=5.04e-01
RARARPAELPSTSAAPIPSSTSAAPSVPAQTDSQRFEAILQSIHQGQIILLQSLQVVAPPGSIPSVEQFREMVAWPETQPSLHREDEGPTAQVPRHVEDESSEDTIPEPFVIGEEAEETQVRQVAAATPERSLEAFCTRGGHTLSPACSRHLHSSSRDARGPDYTSPGYEHFSSSYSSIASDR

SEQ ID NO: 167060 - protein, 291 aa, Glycine max
  Coding DNA Sequence Number=SeqID_50282
  Gene Ontology: Mol. function=pseudouridylate synthase activity; Cellular component=mitochondrion; Biological process=RNA processing
  Homolog annotation: Hit_ID=Q1H1P7; Match level="QueryCoverage=94%, HitCoverage=74%, E-value=5e-83, Identity=57%"; Hit description =Pseudouridine synthase, RluD
  Pfam annotation: Domain name=PseudoU_synth_2; Domain location=40-221; Score=133.2; E_value=7.3e-37; Accession=PF00849.12; Description=RNA pseudouridylate synthase
MQLGDEVRVPPIRIAEAASKPTVNSVKAKLAEQVIYEDDAMLALNKPAGMAVHGGSGISLGVIEQLRLERPQAKFLELVHRLDRETSGVLMIAKKRSALTALHDAMRHHQMDKRYLMLVQGQWQDSKKKVTLDLQKYVTESGERRVQVVDEPLLNIEPGGRKSLKASGLVAKRHAAKGRFEVETQISETWFYLQEKLGTYSFLQAKLITGRTHQLRVQLSHLGFPILGDDKYGDFALNKQLNKQGLKRMFLHSSETRIAHPLTGEPLHLVAPLPVELEQFLQQQRQLQLIK

SEQ ID NO: 167061 - protein, 110 aa, Glycine max
  Coding DNA Sequence Number=SeqID_50283
MTQELVARGGTLRLFAPRHSVTPSVIDEQRPVWSSAPFCHPEAAGPMTSRDKIWSFCTLVSSRGGGPDDTRRYLTVIRTLLSSRGGRPDDKQRQNLVILHPCIIQRRWAR

SEQ ID NO: 167062 - protein, 84 aa, Glycine max
  Coding DNA Sequence Number=SeqID_50284
MDTSEPYTGAMRGIVHEPQPYTRAMRGIAHEPQVSIGADQKFSSIHVFKQKRGDKSWDFNGLIKHQTTPLPSLPNGQNQTEHTL

SEQ ID NO: 167063 - protein, 72 aa, Glycine max
  Coding DNA Sequence Number=SeqID_50285
MMQRSSTHIAESTQVLKGKKVQRFGCKVEVALSASSTLSPQVKVQLPQRYRAQHSDVHLVELFSQPIRGLSA

SEQ ID NO: 167064 - protein, 115 aa, Glycine max
  Coding DNA Sequence Number=SeqID_50286
  Subcellular localization annotation: CTP_CleavageSite=19; ConfidenceScore=5.17e-01
TFRGPRKVRGKRFEAPSTSASEAPTPYSSTLPPSSSTEIPVIPPAPTQIPLPTPLFAASTAQEPVTEEPPAPAAEEEITPAQTPQPSPSSAPAPMEIQPSTLDLNEEQPQEKHDV

SEQ ID NO: 167065 - protein, 110 aa, Glycine max
  Coding DNA Sequence Number=SeqID_50287
MGRKLRSIQSMNLATWNVRARKKHFERYRLRLTEPEFSTRSLHTLKRELRNFPLLAFQSFLFSTFHFMAGRCPTTDSVYLKVCLQKSSFIINKGIALRGHGAGRHSNQSW

SEQ ID NO: 167066 - protein, 162 aa, Glycine max
  Coding DNA Sequence Number=SeqID_50288
MQNHEIHLGKSYSLEDYQREPELRTYYQKEAERGFNLDNLLMQFKDTIESIQRAFKSTEIQVGKLVEEVTQAVGRREEEFVEVEAQEESPVNKHDLKEEDEEKVQQREQCSQVHTQQENNLQVKTFPHQLIVKEERPEDHEVPIILGQPCLSTASCVLDMGK

SEQ ID NO: 167067 - protein, 349 aa, Glycine max
  Coding DNA Sequence Number=SeqID_50289
  Gene Ontology: Mol. function=RNA-directed DNA polymerase activity; Cellular component=intracellular; Biological process=RNA-dependent DNA replication
GTSFQGLTVEGKKPEKNEVSFATWKSAQKVVQEGTGVGWGKVVQLIESKNREGLGFASSAGSATNSVGSSSITSTFCSAGFINNSPEANAVLEDVPEERVLAFVTPGKLVRNWDAVDVPSVVHASKLGIYEPVEHNNPALSPNFESPVYEAEEEEDDEIPEELARLLEYEKKTIRPHEEVVEVINLGTEEDKKEVKIGASLEVTVKRRVIELLKEYVDVFAWSYQDMPGLDPRIVEHRLPLKPECPPVKQKLRRTRPDMALKIKEEVQKQIDAGFLVTSEYPQWLANIVPVPKRDGKVRMCVDYRDLNKASPKDDFPLPHIDVLVDSAAKSKVFSFMDGFSGYNQIKMA

SEQ ID NO: 167068 - protein, 61 aa, Glycine max
  Coding DNA Sequence Number=SeqID_50290
MGFFLVGNLALSVFGLFLFCFCLARGAQATDAQGKDCGELGLWLKACRTDGHDICQGVGLV

SEQ ID NO: 167069 - protein, 116 aa, Glycine max
  Coding DNA Sequence Number=SeqID_50291
DKESIDDTVCEKYDISKEKWAQFCQTRRDPSWKAQAIQKQNTAPHVLSRGGYEYLENKLMEEKKKKKAEEAAQIESTDTVIDPPSPIRQHDSLEEQTLQGSFVAHGRQDVLTTAIG

SEQ ID NO: 167070 - protein, 187 aa, Glycine max
  Coding DNA Sequence Number=SeqID_50292
MTQELVARGDTLRLSAPFCHPEAAGPMTSRDQIWSFCTLVSSRGGGPDDTRRYLTVIRTLLSSRGGGPDDKQRPKAAGPMIRGDTLRLSAPFCHPEAAGPMTSRDQIWSFCTLVSCRGGGPDDTRRYLTVIRTLESSRGGGTDDKQRPSFGHSAPLYHPEAAGPMICGNTRVVIRINILLLSVRQNA

SEQ ID NO: 167071 - protein, 65 aa, Glycine max
  Coding DNA Sequence Number=SeqID_50293
CRARVLLLFPCPTPDQFRAEVAWLGDWPEARAGEAPAEAPDEADEAREDEEMTDLLDFLGGSGAT

SEQ ID NO: 167072 - protein, 302 aa, Glycine max
  Coding DNA Sequence Number=SeqID_50294
  Gene Ontology: Mol. function=hydrolase activity
  Homolog annotation: Hit_ID=Q5XM22; Match level="QueryCoverage=31%, HitCoverage=68%, E-value=5e-30, Identity=59%"; Hit description =Resistance-like protein HAAS-2
  Pfam annotation: Domain name=DUF1723; Domain location=112-161; Score =57.5; E_value=4.5e-14; Accession=PF08330.1; Description=Protein of unknown function (DUF1723)
MAEDVAGMTDDVPEQPTEAPDLRADAQGADSGEGSDGDDAAEGFPGGPRDPSVLTSFVEHVAHAVWSGQERPDLKLVSHGRKVTLIGRPVSEIEGLVAATGLSPLIDCSVITGNPRLISAFVERWHNETSTFHLHVGELTITLDDVSSILHLSTTGALHSFHALSTEEARFLLTELLEVSAEEARAETALTRGAYLALICCTLFANKSATYMHVVHLDAFRDLAHSGGYAWGVAALVHMYDQLDEACRTTTRQLAGYLTLLQCWIYEHFPSVHQCVTDDTYQETFPRTSRWLTSKAHMKGIT

SEQ ID NO: 167073 - protein, 75 aa, Glycine max
  Coding DNA Sequence Number=SeqID_50295
MGLCQFYRVPVTSSKGIRPPTNRAFIKKYCVPRQAQGETPQQPGDGQQRATDAPPSPLEFTSKRLERCLRPMSDQ

SEQ ID NO: 167074 - protein, 258 aa, Glycine max
  Coding DNA Sequence Number=SeqID_50296
  Gene Ontology: Mol. function=chlorophyll binding; Cellular component =integral to membrane; Biological process=photosynthetic electron transport
  Homolog annotation: Hit_ID=P56777; Match level="QueryCoverage=99%, HitCoverage=68%, E-value=7e-69, Identity=84%"; Hit description =Photosystem II P680 chlorophyll A apoprotein
  Pfam annotation: Domain name=PSII; Domain location=1-252; Score =233.6; E_value=4.2e-67; Accession=PF00421.9; Description=Photosystem II protein
LYGPGIWVSDPYGLTGRIQSVNPAWGVEGLFHLSVRPPQRLYKGLRMGNIETVLSSSIAAVFFAAFVVAGTMWYGSATTPIELFGPTRYQWDQGYFQQEIYRRVGAGLAENQSSMDNGDGISVDGDGIVRADVPFRRAESKYSVEQVGVIVEFYGGELNGVSYSDPATVKKYARRAQLGEIFELDRATLKSDGVFRSSPRGWFTFGHASFALLFFFGHIWHGARTLFRDVFAGIDPDLDAQVEFGAFQKLGDPTTKKQ

SEQ ID NO: 167075 - protein, 60 aa, Glycine max
  Coding DNA Sequence Number=SeqID_50297
MEDRVMTDRSSSLPGAGQAENVAARQPIMGHAHIVPVLLLLMLTRAPNKCTVKCLNGISA

SEQ ID NO: 167076 - protein, 103 aa, Glycine max
  Coding DNA Sequence Number=SeqID_50298
MANFFFRALKFGSLLLHRYWHPPLTSFVCFFRHPDEGSSARRTFFCACGRGSWILKRKKEFFRGNLWKKAEKVLPRVPAEEGSEGSSAGSSGRWFRRFFRGLQ

SEQ ID NO: 167077 - protein, 582 aa, Glycine max
  Coding DNA Sequence Number=SeqID_50299
MSLSNGDDSTVTSKQQKPQLPNPFDLTDSEILEKVYLTHLHDDDRCDVEVLSDIVSTVVLKTRLAEGKAYQTVFQPEYRTMKLISCQIITTPRGERYVHQTTMCILQHLRSYSWEAKALVTLAAFALEYGNLLHLSDVATPEKQLTNSLKQLNQVEARKKPATTLVELVMEVLHGIQEWTRLSGLDYDIVEVPSLTEAQQEVPVVVYWIIASLVAATANLVGLSEYKLSAFLERLSSAAYKFKEHLKSSLVQKGYADEYYKRRNAISKPKDIVEFLKLLIHHNGSKDIEVFSQKYVLLFISSLDKIEDEISLLNSIHDRLHENPNEVVKNYKKGDFKILWIPIVDAWDVQAKTQVQYLEGYHQMKFNYLGKPIIPVLTPLGDIMNEDAMNLIFQWGIEAFPFRKIDGIELTLKWKWFWDATKKANLGIQQLGKEDPTDVRRFWIEIERKRLKKHKDAVDCEIRKIVKTLLCLKQDQQGWAILTKGSNVRVLGHGEPMRQTLAEFDTWKEKVFQKEGFDVAFDEYYKTKLDELYARQECDFVKNNADVLVTIACPNPTCGRVMEVTSVNYKCCHRDATNNVNI

SEQ ID NO: 167078 - protein, 523 aa, Glycine max
  Coding DNA Sequence Number=SeqID_50300
  Homolog annotation: Hit_ID=Q10GG7; Match level="QueryCoverage=89%, HitCoverage=86%, E-value=1e-157, Identity=60%"; Hit description =H1flk, putative, expressed
  Subcellular localization annotation: CTP_CleavageSite=26; ConfidenceScore=5.28e-01
MDQDSSIGKVFKFTHVLAASFAGLVAAAAASSYRRAPSTVVGEQKKVIPELRRTESGRLGEIEKFSHYVARQMGFEDADEVPELCILAQEYLKKSKGCDESIFEYISSGNVENTDSLYAKLVEELERCILSYLAFHWNQATSVISQVLGVESQQKKKLKGILLAATREQRFDRVTKNLKVTRVISTLVEEMKAINGDSQCTEVMVPMAHSERSPVLLFMGGGMGAGKSTVLKDILKESFWSGAASNAVVVEADAFKESDVIYRALSSRGHHDDMLQTAELVHQSSTDAASSLLVTALNEGRDVIMDGTLSWEPFVEQTIAMARNVHKHRYRMGVGYKVAEDGTITENYWEQVNDAEEHQSEEISNGEAHTQKPYRIELVGVVCDGYLAVVRGIRRAIMTGRAVRVNSQLKSHKRFANAFPRYCKLVDNARLYCTNAVGGPPKLIGRKDGDHNLLVDREEIKCLETLGSLNAGADSIYELHKEPSPIMEPGSVWNDIVMSPSRPSDQKELKESIQKIEKSIRKM

SEQ ID NO: 167079 - protein, 473 aa, Glycine max
  Coding DNA Sequence Number=SeqID_50301
MDYDIEAVHSLQAAMQEIPLVVYWTIASTVASIGNLVGISEHKLSAYKERLEFIFKKLQFHLENCRVEIGRIQDYCFRNTIRYPKLKDVVELLDILIIPGSDNGTSIPKIFEGGVLIKNGIEVFKQKYVMLFFSSLDNIGDEISLLNSINNGLQENPGEEIKGFKKGDFKILWIPIVDDWKTTREQFNNLKEKIKFYLVEYFEKLPGYDIIVDKFKYEGLPIVSVVNPQGQIMNDNAMQIIFEWGIDAFPFRRSDVYDLNKKWKWFWNLLEKTDDNAKRLGKDNTSYVFIYGGNDSSWVQNFKIAIGKIEKHVINNVDINIEPYQLGESNPDNVPSFWIGLDGKKKNKGCKDKVDCEIQEVVRTLLCLKQDPSGWVVLGRGRNLKILGHAEPMYQTVLDFDKWKSKVLEKETFDVAFKEYYDVVKEKYASLPYDHTSSVLATITCPNPLCGRVMEVTSINYRCCHGSANSCNL

SEQ ID NO: 167080 - protein, 856 aa, Glycine max
  Coding DNA Sequence Number=SeqID_50302
  Gene Ontology: Mol. function=RNA binding; Cellular component =ribonucleoprotein complex; Biological process=regulation of translation
  Homolog annotation: Hit_ID=Q2R1U8; Match level="QueryCoverage=90%, HitCoverage=82%, E-value=0.0, Identity=49%"; Hit description =CRS1/YhbY domain containing protein, expressed
  Pfam annotation: Domain name=CRS1_YhbY; Domain location=211-287; Score=47.3; E_value=5.1e-11; Accession=PF01985.11; Description=CRS1 YhbY domain
  Pfam annotation: Domain name=CRS1_YhbY; Domain location=438-522; Score=37.1; E_value=6e-08; Accession=PF01985.11; Description=CRS1 YhbY domain
  Pfam annotation: Domain name=CRS1_YhbY; Domain location=671-758; Score=133.0; E_value=8.3e-37; Accession=PF01985.11; Description=CRS1 YhbY domain
  Pfam module annotation: Pfam domain module=CRS1_YhbY::CRS1_YhbY::CRS1_ YhbY; Domain location=211-287::438-522::671-758
  Subcellular localization annotation: CTP_CleavageSite=100; ConfidenceScore=5.76e-01
MALVPTRPFFDSFHSSPNFHSLRFCNSLFRHSLTPSPNSTFLRRKPLFIFRCNPAKSFSTDKHWLKRWNDPTNNHARPKPPCAVLDYSENGHASKSGLASSDEEGGDGNTGGSTMDRIVEKLKKFGYVEDGIQNKERVIEKGSVEDIFYVEEGMLPNSRGGFSSESPLGFGSFGSDDREVRFPWEKPVVEELEERKSMRSRSKTSLAELTLPESELKRLLKLTFEKKHKTRIGRSGVTQAVVDKIHERWKTSEIVRLKFEGEAALNMKRMHEILEVWCLSLVDSMFRKSCFCCKTCGVHDGNEKQMSGNSVSLYRGVSYEVPSVQQNKKIYRKSENSSKLLPTPSYNSVGNPSDIASNSGTSAPLAKLESTNDEKERDYLPKVNYEHEVDKLLDGLGPRYTDWPGCDPLPVDADMLPVTVPGYQPPFRVLPFGVRATLGLREATALRRIARTLPPHFALGRNRQLQGLAVAMIKLWEISSIAKVALKRGVQLTTSERMAEEIKKLTGGILLSRNKDFLVFFRGKNFLSADVTQALLERERMAKVMQDEEEQARLRASSLLIPTNNTSELSAEAGTLGETLDADAKWGKTLDERHKQKIMRESLIVLPMAFAFNYLIIQHDCNALSSKGFLDETLKLFIELAERKLRRAEKALMKVESFLKPSEYKADPESITDEERFMFRKLGLRMKAFLLLGRRGVFDGTIENMHLHWKYRELVKIIVKAKTFEQVKKIALALEAESGGVLVSVDKVSKGYSVIVYRGKDYQRPSTLRPKNLLTKRKALARSIELQRHEEQMEKVKDKGDEALYDKLDSAYPSDDENSEVEDGEQGDEAYLKTYNSENDSEIESEVESDNMYPPI

SEQ ID NO: 167081 - protein, 364 aa, Glycine max
  Coding DNA Sequence Number=SeqID_50303
  Homolog annotation: Hit_ID=Q5ZC04; Match level="QueryCoverage=96%, HitCoverage=68%, E-value=1e-103, Identity=56%"; Hit description =Putative histone H1flk
MMVHVYREQRFERVTKNLKVARVFSTLVEEMKAIKVDSQKTNDIVHTVHTERSPVLLLMGGGMGAGKSTVLKDILKESFWSGASSNAVVVEADAFKESDVIYRALSSRGHHDDMIQTAELVHQSSTDAASSLLVTALNEGRDVIMDGTLSWEPFVEQTIAMARNVHKHRYRMGVGYKVSEDGTTITEDYWEQVNEEEEEHQSEENCNGEPRTRKPYRIELVGVVCDGYLAVVRGIRRAIMTGRAVRVNSQLKSHKRFANAFPRFCKLVDDARLYCTNDVGGPPQLKWRKDDDQNLPYPKDIKCLERIGSVNVEADSIYELYKEPSPIMEPGSVWKDIVLSPSRSNDQKELKESIQKIEKFIRKR

SEQ ID NO: 167082 - protein, 140 aa, Glycine max
  Coding DNA Sequence Number=SeqID_50304
MALVLSKTASNGTTPQQKDQLPNPFELQDSQIRHKVYLTHVNDEKEFDRDVLFTLVSNTLNSASAQLSAAASSVTSFKPDFPTLKWLSCQMITTRGTPECAHQTALRILQQLSGFSWDAKALVAVAAFSLEYGEFLRLDR

SEQ ID NO: 167083 - protein, 247 aa, Glycine max
  Coding DNA Sequence Number=SeqID_50305
IVVEWSQGSREQFKALKSGIKFYAVEYFFELPGLKIIKDTERLNYEIQPIAPLFSSKGTLLNENALEVIFEWGIEAFPFRKVDGDELTLKWKWLWDLILKATPVLQVNQVKENRYIFIYGGANNTWVQNFTHELSKIKMNENIQRADIIIENYELGKGKGELNNSVPSFWIGVSHQEAVDCEIQKIVKCLFCLKRDPQGWAILSKGHNIKHLCHGQAVYQIVAEFQNWKERVFDREGFDIAFKEYYI

SEQ ID NO: 167084 - protein, 178 aa, Glycine max
  Coding DNA Sequence Number=SeqID_50306
MTLKTKSIPDFHSQCQTRIPYTEADFLPDVVLRIAYSKQQCGSFNTWDAKALIAIYSCFVFGVREFRSPYSVSNKRRARKLAEAAESSPEKECLCCWRTCHKPSKPSLLLYNGQLLPPLLPPATSLVYANVRDYITIQNVFERPKDIVDLLKALIYPQQKGAENPKIFEGTNLVTRVS

SEQ ID NO: 167085 - protein, 68 aa, Glycine max
  Coding DNA Sequence Number=SeqID_50307
  Homolog annotation: Hit_ID=Q9FNG5; Match level="QueryCoverage=68%, HitCoverage=24%, E-value=5e-15, Identity=82%"; Hit description =Arabidopsis thaliana genomic DNA, chromosome 5, P1 clone:MHF15
MGSILRYFYAKPEMMVLLLNYDVSYVPGFVLLDNNGKALAKTGVPNSRLHVIAGLSHLLKMKRPQQNY

SEQ ID NO: 167086 - protein, 84 aa, Glycine max
  Coding DNA Sequence Number=SeqID_50308
MNWPQEVQIDIDMDDFHGLSSVQIAIGMGDFHGLSRQTKWQLSPKPKKSTKSAALHPARPAKLPAPLLLAYRKSLVRLAISPQP

SEQ ID NO: 167087 - protein, 71 aa, Glycine max
  Coding DNA Sequence Number=SeqID_50309
METWTRQSLREDPDSAVEEACTIINSWGSESKWGPETCTRQSLWRMHERKSIHGAPNKSGEWRIALGNHFA

SEQ ID NO: 167088 - protein, 146 aa, Glycine max
  Coding DNA Sequence Number=SeqID_50310
MLQGCVDERRIAALRLLLFHAGVCQALCFGPDFPADVRHHVVMSGQNGQVFAKAVELCRFVSVFKPGPVSGPVLETEVEESENLAVKGGVAGQFDFGGVLLAILKSGQALYVGIKRRGENPPCRFDQLDLHGWPQSSSAPVPKPHQ

SEQ ID NO: 167089 - protein, 80 aa, Glycine max
  Coding DNA Sequence Number=SeqID_50311
MTAQTNGDELEREKFEAWYCINYRTPFTHMQRHDKSDDYVDRQIRAAWRAWLARSKKEEKKVKSGAARRGLHEQRNPPKT

SEQ ID NO: 167090 - protein, 133 aa, Glycine max
  Coding DNA Sequence Number=SeqID_50312
SRNTAYLHVKALEKKGVLQRKHKRSRSIVLADAPAVELPDLNDSEYWYEGVFKHSLYQRDVVDAIKSASMKARNITESIINLAKVDGLTTEKFQSHLRAIDLLAREAHDLIVDAEFERDSRSEKGGKNKKGGF

SEQ ID NO: 167091 - protein, 49 aa, Glycine max
  Coding DNA Sequence Number=SeqID_50313
MTLFCTWLPIESKIKRGVGYRQSRTTLNGNLKGRDTKNGFSFAGNPLPC

SEQ ID NO: 167092 - protein, 270 aa, Glycine max
  Coding DNA Sequence Number=SeqID_50314
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=100%, E-value=2e-34, Identity=25%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VLAFRGLDVLVIGGLHALTFSGLKVLIFRGLQVLAIRGRHALTLKGVHILGIRGLRALSIRGLHILAFRRLLVFRGLHALTFRGLHALPFRGLDVLDCRGIDVLTLRGLEVLAIRVLHALAFKGLHILLFRGLHVLVFRGLHALTFRGLHILAIRGLHALTIRGLLVLAFRGLHVLVFRGLHALTCRGLHALPFRGLDFLACRGIDVLTLRGLEVLAIRVLHALAFRGLHGLVFRGLHVLVFRGLHALTFRGLHVLAIRGLHAITFRGLH

SEQ ID NO: 167093 - protein, 128 aa, Glycine max
  Coding DNA Sequence Number=SeqID_50315
MAMVTCELMWIKQFLQELRFCEELQMKLYCDNQARLHAHFGYIWHHFLLLDEPQIPLIIVEAHTTYHVPFEHTPQCNINHVISYNAYFGFKRSSNPLRFWQQFFGHDANGWATRSTFCQILLLMFARK

SEQ ID NO: 167094 - protein, 48 aa, Glycine max
  Coding DNA Sequence Number=SeqID_50316
MEFNGLRGGGHNPLFEDLPSESGSGAATVRYGLISNDTHETRCKCKAV

SEQ ID NO: 167095 - protein, 60 aa, Glycine max
  Coding DNA Sequence Number=SeqID_50317
MVNETRIVVLLRPFWVPAGKEKATAAGKRKSFGEEKRENENEGKKRHRPSKNRPNIAIYT

SEQ ID NO: 167096 - protein, 252 aa, Glycine max
  Coding DNA Sequence Number=SeqID_50318
  Gene Ontology: Mol. function=DNA binding; Biological process=DNA recombination
  Homolog annotation: Hit_ID=Q1L9R3; Match level="QueryCoverage=67%, HitCoverage=28%, E-value=5e-08, Identity=28%"; Hit description=Phage integrase
VGHHDEAAFTDTVHQRAYPLGAGHGSGLPWLGLTGQRGEAEARDGIYDPEARLGLAHAIGQRGVVGRLCPMPQRNDVTGRRADQAQCCRHQRHGDLVRGIGQPPTIMLGQALQQHGNRLVDRHIGKAAALQVQQVQDAAVGAQGRRRQRLAFLHAGTPGHVGEELQRRVAVQVGEAAQAPRGHPAHQRTQHAEGGHERAVVHMPAPRRRIHLEAPQETLGRTRPGMPFRSAEAAVVVQPEAPVQREVAGIGT

SEQ ID NO: 167097 - protein, 69 aa, Glycine max
  Coding DNA Sequence Number=SeqID_50319
RFNTFQLNFNVFKSTSTFSCENKTEGKGFYREEGRARGPTTSGRAWQATTSGRAWGPTTTGRAWGPTTT

SEQ ID NO: 167098 - protein, 90 aa, Glycine max
  Coding DNA Sequence Number=SeqID_50320
MTLFTVISNNTLTALRQQMDHMQTTNDNFRLLANQMSGIRNLMAILQVQPQNGIPSHNAMTLGGIANKKKTKFMGYINHMSEEMVEGQNY

SEQ ID NO: 167099 - protein, 42 aa, Glycine max
  Coding DNA Sequence Number=SeqID_50321
MTSIYVRGRGCHSLRMGKFLGSTRVLPLLLRILKCDEGFRPK

SEQ ID NO: 167100 - protein, 130 aa, Glycine max
  Coding DNA Sequence Number=SeqID_50322
  Gene Ontology: Mol. function=DNA binding; Biological process=DNA integration
  Homolog annotation: Hit_ID=Q1S7C5; Match level="QueryCoverage=56%, HitCoverage=5%, E-value=3e-11, Identity=44%"; Hit description =Integrase, catalytic region
MAAVVEAVATMVIVVATVMGGADSNYHPHESLVLYDPQTLQLVQINHSQSNNRTSNTWVNPNLKNSSQDINVTSATPSVMLANVSSTGAAHSAWIPDSGASFHVTGEPQNIHQLGHFEGPDQIFIGNSQD

SEQ ID NO: 167101 - protein, 58 aa, Glycine max
  Coding DNA Sequence Number=SeqID_50323
MPEMQMLKLGEGQAWVVFAADRRKIAVSRSDGRPQANAVVIGNSGEEGRVKFGGKGVQ

SEQ ID NO: 167102 - protein, 179 aa, Glycine max
  Coding DNA Sequence Number=SeqID_50324
  Gene Ontology: Mol. function=endonuclease activity; Biological process=DNA packaging
  Homolog annotation: Hit_ID=Q0EHF5; Match level="QueryCoverage=99%, HitCoverage=29%, E-value=2e-28, Identity=37%"; Hit description=Phage Terminase
GAKWIALADWRACEDKSLKLDDFAGKRCWIGLDLAERRDIAAVCYVFRENGKYYVFWRFYQNEYQASLLENKHYQTWANAGFLHITPGNATDFDVIGDQIAGRRAEHSIEVIEKPGDLQQFAVEELDYDPKFAPYFVKKLMEKGVPAVEIGQNPSTFTAPIIEVENLVLTGKLVHEESP

SEQ ID NO: 167103 - protein, 77 aa, Glycine max
  Coding DNA Sequence Number=SeqID_50325
MQTTLETPPPPPTTTGGNHEPPLLATKPPHREERFNRSGILRIHLKDLVEKNPSTLSFVASLRYCNRVPFTVLLKNP

SEQ ID NO: 167104 - protein, 87 aa, Glycine max
  Coding DNA Sequence Number=SeqID_50326
  Homolog annotation: Hit_ID=Q2HSN5; Match level="QueryCoverage=87%, HitCoverage=27%, E-value=9e-12, Identity=44%"; Hit description =Transposase
MAFSVAFVYLEGERLNNVVWALQRFQGLLLRRDALPGVIVTGRDIALINVVKIVVPEAMNLLCRFHIDKNVKAKCKTFVGLSLLIGP

SEQ ID NO: 167105 - protein, 213 aa, Glycine max
  Coding DNA Sequence Number=SeqID_50327
  Pfam annotation: Domain name=zf-CCHC; Domain location=68-85; Score =21.4; E_value=0.0003; Accession=PF00098.13; Description=Zinc knuckle
ACLDWEIRVEQQLKRKSTSKSNGSRSYPKKNQGLGILGAAPSKPKYDKGKTIEKQPLKASMQEKTGSIKCFKCLGRGHITSQCPIKKTMIMRGQDISPSSSESEEAKGEEPSEEIYPQEERQPLMVKEECKEVSVSSKRLAMKESHFTIKTNIKETSPLRKPLHFLLGKKTLVSIAIALRLEVLPQVKELLDEGFIRKSLNAFALLVSKIGTH

SEQ ID NO: 167106 - protein, 66 aa, Glycine max
  Coding DNA Sequence Number=SeqID_50328
MARRDKLWSFCAFPSRLDRVRWHAETNYGHSAPYVNQGKRIRKYQDDVGSAGGEIDRPNGVSLEQN

SEQ ID NO: 167107 - protein, 80 aa, Glycine max
  Coding DNA Sequence Number=SeqID_50329
  Homolog annotation: Hit_ID=Q1STT2; Match level="QueryCoverage=80%, HitCoverage=14%, E-value=5e-08, Identity=38%"; Hit description =Lipocalin
MASEYLESTMAKITRFGIMNQILNQGDTQVIQNMSLLIIADDDTHVWQFTSNGNYSVRSSYHHIMESMLSNDIYKVEGDW

SEQ ID NO: 167108 - protein, 62 aa, Glycine max
  Coding DNA Sequence Number=SeqID_50330
SLGAPLVTIKLTFLARVFNIHEAEQYVEAHVILEKYKCLIRSPLIPNNDDQHPIKVDSEGVD

SEQ ID NO: 167109 - protein, 210 aa, Glycine max
  Coding DNA Sequence Number=SeqID_50331
  Gene Ontology: Mol. function=structural constituent of ribosome; Cellular component=intracellular; Biological process=translation
  Homolog annotation: Hit_ID=Q0LD73; Match level="QueryCoverage=96%, HitCoverage=97%, E-value=2e-55, Identity=49%"; Hit description =Negative transcriptional regulator
  Pfam annotation: Domain name=FMN_bind_2; Domain location=1-165; Score= 238.6; E_value=1.4e-68; Accession=PF04299.3; Description=Putative FMN- binding domain
MYIPTHFAAPGKDALHDLIRAYPFATLVMTTATGVEVNHLPLCLDGNGVLTGHLARANRLWQAVQGDTDVLAVFHGPHTYVSPSYYPSKVRTGMVVPTWNYVVVHARGKLRVIEDVHWLRAHLEAFTAQHEAGFAEPWQLEDAPAGFIDKLMQAVVGIEMTIIELTGKWKVSQNQPLENQMGVVRGLSTSDDEYAQKMAAVVKAVNHLTG

SEQ ID NO: 167110 - protein, 75 aa, Glycine max
  Coding DNA Sequence Number=SeqID_50332
MEMTKGCRVLPVYGTTSGLKLANSSTKVGHDQQRLTRCGMFPALGVESGVGIGQAKALKGLRLAYDESLRPEPGL

SEQ ID NO: 167111 - protein, 83 aa, Glycine max
  Coding DNA Sequence Number=SeqID_50333
MGCYNSSPLKRSFFSETSSKDRDGKDYTYGSQYQAMCPVKVFFSDFDHKTPLNLATKPGDSHFLNDSTSTLVTSKVSYSSSNY

SEQ ID NO: 167112 - protein, 165 aa, Glycine max
  Coding DNA Sequence Number=SeqID_50334
SRPKDADISGKGAANETLSKSEPEDANISGKGVGHESPPKDPDISEEGASDDSRLEDADISGKGADVNISGKGADISGKGAGDNVSHCMLSGFESYGYQMRLFHSLGRKTLTSFGKVLIVNETFSQSRPENTDIFGKGAENADIFGKGAGDDFSHCMLSGFECYG

SEQ ID NO: 167113 - protein, 81 aa, Glycine max
  Coding DNA Sequence Number=SeqID_50335
GVQIETRSTWAFQEVLQMAVPSGGSNLAHLGELGGKLLPRFPINKGRREEQKCSTLLVSENHLKLVRKIVSVKKIQVEALP

SEQ ID NO: 167114 - protein, 76 aa, Glycine max
  Coding DNA Sequence Number=SeqID_50336
MFLRDNLALTRHMDKTGRNGVRVYLILSAGTELKKKFLSIRNGNRYGDDFEEAETINHVPVPDSRRYNIYIICFVP

SEQ ID NO: 167115 - protein, 362 aa, Glycine max
  Coding DNA Sequence Number=SeqID_50337
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=78%, HitCoverage=20%, E-value=1e-160, Identity=99%"; Hit description=DNA -directed RNA polymerase beta'' chain
  Pfam annotation: Domain name=RNA_pol_Rpb1_2; Domain location=1-43; Score=-75.8; E_value=0.063; Accession=PF00623.11; Description=RNA polymerase Rpb1, domain 2
  Pfam annotation: Domain name=RNA_pol_Rpb1_3; Domain location=46-164; Score=-24.5; E_value=0.0016; Accession=PF04983.8; Description=RNA polymerase Rpb1, domain 3
  Pfam annotation: Domain name=RNA_pol_Rpb1_4; Domain location=140-219; Score=83.6; E_value=6.1e-22; Accession=PF05000.7; Description=RNA polymerase Rpb1, domain 4
  Pfam annotation: Domain name=RNA_pol_Rpb1_5; Domain location=221-357; Score=-147.3; E_value=0.044; Accession=PF04998.8; Description=RNA polymerase Rpb1, domain 5
  Pfam module annotation: Pfam domain module=RNA_pol_Rpb1_2::RNA_pol _Rpb1_3::RNA_pol_Rpb1_4::RNA_pol_Rpb1_5; Domain location=1-43::46 -164::140-219::221-357
GRAIGLHPLVAKGFNADFDGDQMAVHGPLSLEAQAEARLLRFSHTNLLSPAIGDPISVPTQDMLIGLYILTSGNRRDHFGMAYTSHILDQVKTLGFRQATDTSISLGIDDLVTIPSKGWLVQDAEQQSFILEQHHHYGNVHAVEKLRQSIEIWYATSEYFRQEMNPNFRMTDPFNPVHIMSFSGARGNASQVHQLVGMRGLMSDPQGQMIDLPIQSNLREGLSLTEYIISCYGARKGVVDTAVRTSDAGYLTRRLVEVVQHIVVRRTDCGTIQGISVNTQNGMMPERIWIQTLIGRVLADDIYRGSRCIAVRNQDIGIGLINRFKPFKPNQYLSELPLPVGIHLGSVDCVMAKVLLMVTWWN

SEQ ID NO: 167116 - protein, 84 aa, Glycine max
  Coding DNA Sequence Number=SeqID_50338
MASGNRLPKRNKPLVIDYQPCVIDYTVQFAGFHVLKLCNSSLASGNRLPMRCNRLPKMKSLEIPFNLHVVVMGRIVLLPQLDLS

SEQ ID NO: 167117 - protein, 113 aa, Glycine max
  Coding DNA Sequence Number=SeqID_50339
MEHETFLATWLAEIDSSPNGLDGGSSQYCIIIVILQRILLCERAVYAMMLVFPPEFSPLKTILFGNPSQDTIEPLMEALEEDYKDGNKINESRQFIEGVLDLEKRINRLDTLT

SEQ ID NO: 167118 - protein, 74 aa, Glycine max
  Coding DNA Sequence Number=SeqID_50340
MEMIRKDELVLWVLQMVRGGDGQQQQWWRTFPFASSMIFPFDEIREEEARQGECGYAALLVYAAVIDYRLSVLV

SEQ ID NO: 167119 - protein, 96 aa, Glycine max
  Coding DNA Sequence Number=SeqID_50341
MVPHESFYARAIGARKNPYPHDVSKKRERDVYYLSKKFTTCEMNYYLLEMTCYALVWVAHRLRQYMLNYITWLVSKIDPVKYIFVKPTLTERIARW

SEQ ID NO: 167120 - protein, 291 aa, Glycine max
  Coding DNA Sequence Number=SeqID_50342
  Gene Ontology: Mol. function=RNA-directed DNA polymerase activity; Cellular component=chromatin; Biological process=chromatin assembly or disassembly
ATTAKTYIYRLTEDMDTNCPRDILREIEWFPAKCHLVGSCTRSRVPRGVVLPFYPWKELAPPIGSPVNKGSQLLLHNPIEDFCLTITLRMVSRTHPQVSTASPKKLLPKTVNEKGVTMNPLQKAIHHDENDGVSMVRGQANDKIEGEILPWPMSVVFHEQNGSDWQSSRQPNTAIGHHQILGDRESGKIGRIVDNILSALSIVRMCIQLTAKFLQEVIAQEACQVHVLLRRLDDLSENFLETSMVSQDGQALTKKGLMKKAMGWLFYERTAPMPTPEASISTVKGSLKFGK

SEQ ID NO: 167121 - protein, 148 aa, Glycine max
  Coding DNA Sequence Number=SeqID_50343
MLNPTQFQAKEEKVKAADDSLSEVDPLSEMHPLSKASSLLSGWETLEEDKLEICMPSTQPARPASLQKLKSPRAFKNTEVGGVKKGEPVESNKESLVSLSLFVSEFCRQRIKLKVLMMPKDYMNHMLLKDLLKTKQLELIKMDDQDSL

SEQ ID NO: 167122 - protein, 81 aa, Glycine max
  Coding DNA Sequence Number=SeqID_50344
MEKQICESRSVCGYQLDPELEQQDVEVHVDLGRGGWSTGSPMGFRSLAAPCNGLGRGNGDAYASIGDWDMVVVIVLGKEKG

SEQ ID NO: 167123 - protein, 81 aa, Glycine max
  Coding DNA Sequence Number=SeqID_50345
MSQPTLRREGEARFKDASSKKGECAGITTNVYSRKTLEKTKRACPGKLLLQPEVTLLAQVFSIFFTEMLNNLSSCVATGVE

SEQ ID NO: 167124 - protein, 249 aa, Glycine max
  Coding DNA Sequence Number=SeqID_50346
  Homolog annotation: Hit_ID=Q1S020; Match level="QueryCoverage=17%, HitCoverage=14%, E-value=4e-12, Identity=75%"; Hit description=2OG -Fe(II) oxygenase
MRKVKQLINTYYEEDLKESFYQSEIAKRLEKQQNTSDIDWEIIFYLYRQLTQQYYQEAKCSALTIHKAYSKAGREKRKSIEKLNPSREATHGLRILLKRRVLEARRGAAESTRGNIDCTHLSSCKILQQTNDNNHKSIILRLGNLANKDWQIGEKEEAGLENEEARMLDLMADFIDEIDVRCAILLHAKAIDDEIKLEEEPKQGKEVDREEKEAARVNRLTQCRNEEAQPVRYPRERKREYQGKRVTAV

SEQ ID NO: 167125 - protein, 43 aa, Glycine max
  Coding DNA Sequence Number=SeqID_50347
  Pfam annotation: Domain name=COX5C; Domain location=2-43; Score=20.4; E_value=8.1e-05; Accession=PF05799.2; Description=Cytochrome c oxidase subunit Vc (COX5C)
MAGPRIVHAILKGPSVVKDIIIGITLGLAAGEKPTKISLATEV

SEQ ID NO: 167126 - protein, 101 aa, Glycine max
  Coding DNA Sequence Number=SeqID_50348
MLGAPSNTHVLNMKKGTRDPIFYTRANIRFKEWGFHKGLGNTTLVLEKVVYILDQVRALEEEILHKIELQGLVLFCLLRFVSLYYLYHANSHHIFLLVSHL

SEQ ID NO: 167127 - protein, 98 aa, Glycine max
  Coding DNA Sequence Number=SeqID_50349
  Gene Ontology: Mol. function=protein binding; Cellular component =nucleus; Biological process=mRNA processing
  Homolog annotation: Hit_ID=Q3I4X9; Match level="QueryCoverage=68%, HitCoverage=11%, E-value=4e-21, Identity=80%"; Hit description=GAMYB- binding protein
  Pfam annotation: Domain name=SKIP_SNW; Domain location=1-97; Score= -22.0; E_value=6.7e-05; Accession=PF02731.6; Description=SKIPSNW domain
MTFCGNEMQNQIKEMMQETKPTLERASKVQAQACYEGVGVYAMPMMHLPMQPVTVKDQKDWKIPPCISNWKNLKGYNIPHNKRLAADGRGLREESNGY

SEQ ID NO: 167128 - protein, 85 aa, Glycine max
  Coding DNA Sequence Number=SeqID_50350
MAPAPGPKGDDILILAANKTNRPGILAANKTKSHDGHWPLQYNNQQEMSPKVDSMDRRSVNVVQTAFGLKSDVKAEKGKEVCPDS

SEQ ID NO: 167129 - protein, 491 aa, Glycine max
  Coding DNA Sequence Number=SeqID_50351
  Gene Ontology: Mol. function=DNA binding; Cellular component=beta -galactosidase complex; Biological process=DNA integration
  Homolog annotation: Hit_ID=Q1SS72; Match level="QueryCoverage=87%, HitCoverage=33%, E-value=1e-98, Identity=40%"; Hit description =Integrase, catalytic region
MTAEIKALESNNTWTLVPLPIGKQCISYRWVYKVKFKPDGTMDRHKARLVAKGYTQQVGIDFFYTFSPVAKLTSVRVLLAVATAKNWPILQLDMDNAFLNGGLFEEVYMELPKGYTSVDKNLVCRLNKSIYGLRQASRQWFCKLSTTLIANGFSQSKNDYSLFTIDKGASLVVLLVYVDDILLAGPSATCVHSIQAKLQALFILKILGSLQYFLGLEVAKSRKGVVLTQHLLGRLMYLTISRPDITFVVNKLSQYIQHPRTPHLDVVHHLLQYIKGTPGQGLHFPASNSFNLSAYADADWGGCLDTRRSKSGSSEAEYRALSSVSSEVIWLRRLLLHFEITIPYAMLFCDSKFAIDLASNPANHEQSKHIDIDYHFIRELVQSNILKLVHHSLTVYSGYDQVTVVLQREYEREIVYLDSRRTLCAIGAGQGPITTNTTNATRKLKLPSFCTGIEEGVKKIDTLIDREVFGIPLVAEVKENASNKEKEGNGV

SEQ ID NO: 167130 - protein, 42 aa, Glycine max
  Coding DNA Sequence Number=SeqID_50352
MTLDEGTTTPQSNSRSLRGNTSSPQSHSHSLSRLLSDSINSK

SEQ ID NO: 167131 - protein, 446 aa, Glycine max
  Coding DNA Sequence Number=SeqID_50353
  Gene Ontology: Mol. function=DNA binding; Cellular component =membrane; Biological process=DNA integration
  Homolog annotation: Hit_ID=Q1S7S0; Match level="QueryCoverage=97%, HitCoverage=35%, E-value=2e-58, Identity=30%"; Hit description =Integrase, catalytic region; Peptidase aspartic, catalytic
  Pfam annotation: Domain name=zf-CCHC; Domain location=224-241; Score =7.0; E_value=0.07; Accession=PF00098.13; Description=Zinc knuckle
MDDSNPFLIQTSDNPGLSLVTHPLSGENYNSWKKAIKMALLGKNKFGFVDGSILKPPLEHSSNALWQQNESIIASWLLNSLTKEIQLKHELANLQYGSMFVSSYYSKLRSIWESISELKPAHLCTCNGIRPWHDYAQMEYAIHFFMGLNESYSSIRGQILSMDPFPSINQNFSLVVQEEKQREIGTSVSALHSTNDASRSHAFAVKDSRYQFDHKVSATSRNRPLCAHCVRLGHTQDKCFKLHGFPPNYKKNKPSSSNTKSKTVNQVSTSTFVPDFHLTAQQYSQLMSLLQAHTSNVVTPDIGSSNTSMVLSASLTKFPQNSWIVDSGASTHIVCAIDLFDSYHYVSNQIVKLPNNAVVPVIAVGTVHLSPSLTLHNVSFIPNFTFNVLSVSALLTNSSYSVCFSSNQFVIQEMPHCKKIGRGDLLHGLYVLNLKDTHSTCNVFLS

SEQ ID NO: 167132 - protein, 54 aa, Glycine max
  Coding DNA Sequence Number=SeqID_50354
MVDSEVVPSSIAVLVPILRAANEIEEENPRVAYLSPCKLKVEVDQRVTRMEVDY

SEQ ID NO: 167133 - protein, 112 aa, Glycine max
  Coding DNA Sequence Number=SeqID_50355
MVMDQTASMHTIFIMFNGFSNTFQKERQRSHRQNEQPRYHRLEQHTLNNQDPFDKINGQDFTNWSCRNLPFDGRATHDSQVRHPRKEYARSRHQRLFEENVGKTGKDVVYKL

SEQ ID NO: 167134 - protein, 209 aa, Glycine max
  Coding DNA Sequence Number=SeqID_50356
  Homolog annotation: Hit_ID=Q0KIN0; Match level="QueryCoverage=36%, HitCoverage=4%, E-value=3e-10, Identity=40%"; Hit description =Integrase core domain containing protein
MPFMASETPSTENSLDPTSAMTFTNVPFIPCEKLTGSANYTTWAAIVKLWFHGQGHADHLTAKVTDIPNKDLALWRQIDTSLCNVLWYSIALNLQISYQAFDTETFYRQRNQYFMLLTLPSLPHDIDSVHNQILLAPTVPTHDIVSEQLLCLSTPHVFGHSFAFSSFVDSSTVVSHLYHGGGCAGKNHRSNYCKNYGHIESKCHTKVQN

SEQ ID NO: 167135 - protein, 217 aa, Glycine max
  Coding DNA Sequence Number=SeqID_50357
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=UPI000034F02F; Match level="QueryCoverage =93%, HitCoverage=10%, E-value=3e-53, Identity=53%"; Hit description =ATGSL11 (GLUCAN SYNTHASE-LIKE 11); 1,3-beta-glucan synthase/ transferase, transferring glycosyl groups
MNISKREMKQQNGTEAFLQHVKGRFHAFKKAHSMDPTSSGPGVRQFKCYLLHKLEKEEELTARHALRTDARELQTYYQHFYEKKIRDGEFNQRPEEMAKNVQIATVLYEVLKTMVSPQNIEEKTRRYAEDVEHKRGRYEHYNILPLYAVGVKPAIMELPEIKAAIAALCNVDNLPMPIIHARPDDSTVPMERLKEVNDILDWIAFVFGFQVRIRCHT

SEQ ID NO: 167136 - protein, 245 aa, Glycine max
  Coding DNA Sequence Number=SeqID_50358
  Homolog annotation: Hit_ID=UPI000034F02F; Match level="QueryCoverage =37%, HitCoverage=4%, E-value=3e-20, Identity=53%"; Hit description =ATGSL11 (GLUCAN SYNTHASE-LIKE 11); 1,3-beta-glucan synthase/ transferase, transferring glycosyl groups
MQIPCSWNHHNMVKAVHLPTTACEIHGTNMVCSIIQIHRGLSSNSVDTFNNVIEAVMTKMEAQLDPLLDRFHAPPTFIIYMFLFWAVAIRKQRGIPMSALWMWMTNTSEKDLRNFSSTAQAAIVSNGHRQTSTGVGKRKPKTNFVEVRTFLHLYRSFDRMWIFFILALQAMIIIAWSSLRPVRVFFDADVFRNVMTIFITYAFLNFLQAKLESISIDSKGLQLAEHMQDYQTRLVNSTHRLVRVS

SEQ ID NO: 167137 - protein, 81 aa, Glycine max
  Coding DNA Sequence Number=SeqID_50359
MGKSGVRDIVGGSFGKGDDAGGSLARTTSGCEGMQLIMEHAVREKGRSGFNQHFIVNLVIPPRYLVEDDRVADHVNPEYEA

SEQ ID NO: 167138 - protein, 60 aa, Glycine max
  Coding DNA Sequence Number=SeqID_50360
MHKSLPRIRCSMNEARLSIQSRSVHVMSEKSKRALLGFDGEVEHVGNVVIEVEDLKALEA

SEQ ID NO: 167139 - protein, 66 aa, Glycine max
  Coding DNA Sequence Number=SeqID_50361
MGRTMRRTTRGLSPSMEQVKKGVVSKKQARVAKEETHDKLGRKFVFVESEMMDKISETKDMEKDNV

SEQ ID NO: 167140 - protein, 138 aa, Glycine max
  Coding DNA Sequence Number=SeqID_50362
MEKERIRKLGILFLSLQGRRAIQYKWVYTTNMSLVESRTHLKACLIANGYDQTYEIDYVDAFLPTAKLSSTHSYFSCFYTSLAVVLIGCYVLEEGDLPITMEEWSGIGNLISWKSKKYNVVARSSVETKYKDITQTTC

SEQ ID NO: 167141 - protein, 294 aa, Glycine max
  Coding DNA Sequence Number=SeqID_50363
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=UPI000034F02F; Match level="QueryCoverage =93%, HitCoverage=18%, E-value=5e-66, Identity=42%"; Hit description =ATGSL11 (GLUCAN SYNTHASE-LIKE 11); 1,3-beta-glucan synthase/ transferase, transferring glycosyl groups
MAKDYTKKTDDDLYKKIRSDGYMFSAVIECYETLKDIILKLLLDEDDRLAVSSICAKVERSIREETFVKEFKMSGLPSLIDKFGEFVTELVSANTSRISCRQKAEVIRLHLLLTVKDSAINVPQNLEARRRITFFANSLFMNMPKAPKVRNMLSVSILTPYYKQDVLYSDADLNSENEDGISLLFYLTKMYPDEWANFHERLKSEGLEKDTDELICQWASYRGQTLYRTALTEGYSDKNKNLYEDAQAMADLKFTYVISSQLYGSLKSSKYARDRNCYHNILSLMLKWVNISIF

SEQ ID NO: 167142 - protein, 198 aa, Glycine max
  Coding DNA Sequence Number=SeqID_50364
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=77%, HitCoverage=9%, E-value=1e-38, Identity=52%"; Hit description=Chromo
MDEPKVQSVLAWPVPGSINQLREFLGLTGTGIGVVLTQGHHLIAYFSKQLLPRMQKQSANSRELYAITEALAKFCHYLLGHRFIIRIDQQSLKSQCDQTIQTPEQQVWLHKFLRYDFTIECNPGKENVVADALSRPFFMALSEPQASLLFQIVQAMHIDPSLFVIHTKCVQGNALGPHFHVANNFLYWKQKIAVPNQL

SEQ ID NO: 167143 - protein, 149 aa, Glycine max
  Coding DNA Sequence Number=SeqID_50365
MEKKHLGSVKKVPIFVFSNCILLRGVSTQEVDSEEKRERLPYSWSSAQESSIQVPRDGDYETSKTITNMCNQSSGVRGLMTLIKMEEILISSKCGPRLISSWVGSFRDHLAKLVGQGDLPCSLQPTINCMSESMAIFTLKVVLQVGYFT

SEQ ID NO: 167144 - protein, 149 aa, Glycine max
  Coding DNA Sequence Number=SeqID_50366
  Gene Ontology: Mol. function=diacylglycerol kinase activity; Biological process=protein kinase C activation
  Homolog annotation: Hit_ID=Q9FIF7; Match level="QueryCoverage=58%, HitCoverage=18%, E-value=3e-19, Identity=46%"; Hit description =Arabidopsis thaliana genomic DNA, chromosome 5, P1 clone:MNC17
  Pfam annotation: Domain name=PPR; Domain location=46-80; Score=43.1; E_value=9.3e-10; Accession=PF01535.11; Description=PPR repeat
MVWKHVLADNYAVTAVLKECMLQLALGSDIDEAQALFDGVRVKDVSTYNSMIGGLALHRKSIEAVELFSEMLKERVRPNGLVDLGGEIFESMEMIHGIEPEVEHYGCIVDILSRVGTSTEPELPEFEEPPRNFGGLDDIVKWAKQHKNN

SEQ ID NO: 167145 - protein, 133 aa, Glycine max
  Coding DNA Sequence Number=SeqID_50367
MKIDPQEFDARLYIPGRGFVLNTEGHPRKLLRKDLSTLAKTWSVLFYSNLTLTSHTSDLNMDRARLVYGLVTGMDMNIGALISALITALCGARGVTFDSLTYESLSPAINLAFIKKNCWNMDDLTVNFRGAKK

SEQ ID NO: 167146 - protein, 67 aa, Glycine max
  Coding DNA Sequence Number=SeqID_50368
MLSVSDTLENEETVSASEPDCPDMEIEPSDNDDVLIPNTGAMSDAVLLGLTNVERDGVSTYNYSFSF

SEQ ID NO: 167147 - protein, 224 aa, Glycine max
  Coding DNA Sequence Number=SeqID_50369
MTDKRKVLGKNNEETRIYFTWNLEMERVLAGVLRDQRNLGNKGDGGWKRPALNTAAAVLSTSFNVNVTSDNVKNHIKLWRSWYGISHKSAKPFRFKVLQNWDDIVDLCAKDRATGHGAETAMDADEAMSRETNEVEFTGLGATATIDLEEPSSNTKGKRQGLTSSVTHSHKRKMGEKEGITTSLDKMANSFNRMVEKMDGKVDDEDIQEVLREAALIPDLNRQQ

SEQ ID NO: 167148 - protein, 172 aa, Glycine max
  Coding DNA Sequence Number=SeqID_50370
  Homolog annotation: Hit_ID=Q5XM22; Match level="QueryCoverage=75%, HitCoverage=88%, E-value=3e-29, Identity=43%"; Hit description =Resistance-like protein HAAS-2
MWHPYCIYPLQVSSNLRFIDVDEAMDLLVKLLEFSTQEAKDETEQCRGAYVCLAWLRDIYRSKYNARQWTLVAQAYLLHLVGCTLFTNKSVTHISVVFLDAFHDLSQSGGYSWEAVALVHMYDNLNVTSKHTTKHLAGYITLLHRWIYDHFPIIASIIVDEDYHERKPCVCR

SEQ ID NO: 167149 - protein, 139 aa, Glycine max
  Coding DNA Sequence Number=SeqID_50371
  Gene Ontology: Mol. function=unspecific monooxygenase activity
  Homolog annotation: Hit_ID=O04892; Match level="QueryCoverage=61%, HitCoverage=21%, E-value=1e-15, Identity=51%"; Hit description =Cytochrome P450 like_TBP
LPTLETAQPEVGSSGWKSTARRVVSGAPPAALENPEDRVPPTPGRTHNRIRSPRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 167150 - protein, 422 aa, Glycine max
  Coding DNA Sequence Number=SeqID_50372
  Gene Ontology: Mol. function=carbohydrate binding; Cellular component= membrane; Biological process=homophilic cell adhesion
  Homolog annotation: Hit_ID=Q8XD19; Match level="QueryCoverage=100%, HitCoverage=87%, E-value=1e-164, Identity=44%"; Hit description=, complete genome
  Pfam annotation: Domain name=HYR; Domain location=232-306; Score= -7.0; E_value=0.081; Accession=PF02494.7; Description=HYR domain
ASRVVTVDTLPPAITLDNLTADNIINAAEAQQDLALSGTSSAEAGQTVTVTLNGKTYQTTVQTDGTWQLIVPAADVGALNDGIVTVTATVSDVAGNSSSADRVGLVDATVPQVTINDFVTDTNTVNQLAHSQAQILSGSVTGAAAGDLVTITINSVDYTTVVDAAGNWSLGLPASVVQGLTDGTWTIDVSVTDRSGNTGSTSLDVVVNTVTPVIGINTLAVDDVINATEKGQDLQVSGTSNQPDGTTITVTLNGISYTATTDASGNWSVTVPAANVSALGEASYTVTASVTDAAGNSASTGHSVLVDSALPQVTINPVATDDVINAAEVAAGQTLSGKVSGAASGDTVTISIGGNIYTATVQDDLSWSVNVPSSVLTAIGNGDLTVSASVTNGHGNTGTGERDISIDANLPGLRVDTVAGDD

SEQ ID NO: 167151 - protein, 249 aa, Glycine max
  Coding DNA Sequence Number=SeqID_50373
  Homolog annotation: Hit_ID=Q7BP84; Match level="QueryCoverage=24%, HitCoverage=53%, E-value=4e-23, Identity=88%"; Hit description=P-II regulatory protein
EGEPQRREQQHRTELDAFGEGTDDQRSGDAREGRLEGDEQVIRQALDRRVADRLRSEALEEGEFGERAEEWVAGAEYRAVAVRHPQQQHQREHHQDLAEYRQHATSPWSNAGAVASAAAGAAATGACNGSTATVSLGSGDTCAWAWALPGHAPAANALSSINSHTTWNRACHPVRRRIFMGESPEGGLQRVGTDFAGADADDLFDGGDEDLAVTDLAGACRRLDRFDHRVGTLVGDHGFDLDLGQEIDD

SEQ ID NO: 167152 - protein, 236 aa, Glycine max
  Coding DNA Sequence Number=SeqID_50374
MDMNIGALISGVTSDSLTYESLSPTINLAYIKKNYWNVEDLTVNFRGARKARARLADVPSSSAPPAPSTSTTPTPAPPGLSAQDSQCFEAMLQSLHQGQILLMQSLQVVSPPGSTLLLEQFMEKDASSEATIPGAFDFLGGGLEMRPDKAASPEPILVPADPPSPVVDPSSLAPEAALPSTPLIISEDPTVPVLGLATTPPTTPVLHFSDEEEGQITTPSRTPVLHLDNEEQDWDE

SEQ ID NO: 167153 - protein, 246 aa, Glycine max
  Coding DNA Sequence Number=SeqID_50375
  Subcellular localization annotation: CTP_CleavageSite=14; ConfidenceScore=5.28e-01
MNVGALISGQITSMAQSNSSRLGFPALITALCKSRGVASNSLVFEHLSPVINLAYIRKNCWNPDDLIVTIRGAKRVRIRPVEASSTSTTPPPTRTLAAPSAPDPADFQHLEAMLQSINQGQIILLQSLQMVTPPDSIPLVEQFNEWVAWPETQSSLHKEDKGPQPRSHSLEPLVRRKKANQTQEAAATSEKSLEATSEPSKPVADTASLLQATDPSTPEDQTTPVLSPNTSPTATPELHLTDEEDV

SEQ ID NO: 167154 - protein, 125 aa, Glycine max
  Coding DNA Sequence Number=SeqID_50376
  Subcellular localization annotation: CTP_CleavageSite=72; ConfidenceScore=5.13e-01
MSFQYLATKRMRCGYEKLTSSSQKMMRDGRSCWVKSLNGRLRGLRLSRSRKLSLGVVVLSSRIVRLYNEVVNQMMNMENKYPAIALTTQWGLPVLSYSSHVCRRRVFPLDRKVTLCQQLGLCFGS

SEQ ID NO: 167155 - protein, 257 aa, Glycine max
  Coding DNA Sequence Number=SeqID_50377
  Gene Ontology: Mol. function=DNA binding; Biological process=DNA integration
  Homolog annotation: Hit_ID=Q1SS72; Match level="QueryCoverage=99%, HitCoverage=17%, E-value=2e-98, Identity=65%"; Hit description =Integrase, catalytic region
MALQNFVDFSTNSANPYYLHPNENPALVLVSPSLTAKNYHTWSRSMHIALISKNKDKFIDGSLPKPPVSDPLYAPWIRCNTMVLAWIHRSISDSIAKSVLWIDTAAGVWKNLRIRFSQSDIFRISDLQEDLYRFRQGTLDVSDYFTQLKIYWDELENYRPIPHCKCSIPYSCGGIDSVRVYREQDYVIRLLKGLNDRFSHSKSQIMMMNPLPDIDHVFSLVIQQEREMLGSNSDSVSEATSDSAMAMQVNSNQSNFH

SEQ ID NO: 167156 - protein, 1061 aa, Glycine max
  Coding DNA Sequence Number=SeqID_50378
  Gene Ontology: Mol. function=G-protein coupled photoreceptor activity; Cellular component=membrane; Biological process=regulation of transcription, DNA-dependent
  Homolog annotation: Hit_ID=P93673; Match level="QueryCoverage=97%, HitCoverage=91%, E-value=0.0, Identity=76%"; Hit description =Phytochrome type A
  Pfam annotation: Domain name=GAF; Domain location=224-407; Score =113.3; E_value=6.9e-31; Accession=PF01590.16; Description=GAF domain
  Pfam annotation: Domain name=HisKA; Domain location=901-964; Score =31.0; E_value=4.3e-06; Accession=PF00512.15; Description=His Kinase A (phosphoacceptor) domain
  Pfam annotation: Domain name=PAS; Domain location=625-740; Score =90.9; E_value=3.8e-24; Accession=PF00989.14; Description=PAS domain
  Pfam annotation: Domain name=PAS; Domain location=755-880; Score =106.3; E_value=9e-29; Accession=PF00989.14; Description=PAS domain
  Pfam annotation: Domain name=PAS_2; Domain location=75-191; Score =207.2; E_value=3.9e-59; Accession=PF08446.1; Description=PAS fold
  Pfam annotation: Domain name=PAS_4; Domain location=631-745; Score =24.5; E_value=0.00038; Accession=PF08448.1; Description=PAS fold
  Pfam annotation: Domain name=Phytochrome; Domain location=418-597; Score=401.5; E_value=1.2e-117; Accession=PF00360.10; Description =Phytochrome region
  Pfam module annotation: Pfam domain module=GAF::HisKA::PAS::PAS::PAS _2::PAS_4::Phytochrome; Domain location=224-407::901-964::625 -740::755-880::75-191::631-745::418-597
  Subcellular localization annotation: CTP_CleavageSite=54; ConfidenceScore=5.52e-01
MSSSRPSQSSSNNSGRSRTSRLSARRMAQTTLDAKLHATFEESGSSFDYSSSVRMSPAGTVSGDHQPRSDRATSSYLHQTQKIKLIQPFGCLLALDEKTCKVIAYSENAPEMLTMVSHAVPSVGDHPALGIGTDIRTIFTAPSSAAIQKALRFGDVSLHNPILVHCKTSGKPFYAIIHRVTGSVIIDFEPVKPHEVPMTASGALQSYKLAAKAITRLESLTTGNMETLCNTMVREVFELTGYDRVMAYKFHEDDHGEVIAEVKRPGLEPYLGLHYPATDIPQATRFLFMKNKVRMIVDCCAKHVNVLQDKKIPFDLTLCGSTLRAAHSCHLQYMENMNSSASLVMAVVVNDNDEDGDSSDAVQPQKSKRLWGLVVCHHTTPRFVPFPLRYACQFLAQVFAVHVSKELEIEYQIIEKNILQTQTLLCDMLVQGEPLGIVSQSPNIMDLVKCDGAALLYKNKVWRLGVTPSESQIKEIALWLFECHEDSTGFCTDSLSDAGFPGAAALGDIACGMAAARIASKDILFWFRSHTASEIRWGGAKHEPGERDDGRRVHPRSSFKAFLEVVKTRSLPWKTYETDAIHSLQLILRDAFKETQSMEISTYAIDTRLGDLKIEGMQELDAVTSEVVRLIETATVPILAVDVNGMINGWNTKIAELTGLPVDEAIGKHLLTLVEDFSVDRVKKMLDMALQGEEERNVQFEIQTHHMKIDSGPISLVVNACASRDLQDNVVGVCFLAQDITAQKTMMDKFTRIEGDYKAIVQNPNPLIPPIFGTDEFGWCCEWNSAMAKLTGWKREEVMDKMLLGEVFGTQIACCRLRNHEAVVNFSIVLNTAMAGLETEKVPFGFFARDGKHVECILSMTKKLDAEGVVTGVFCFLQLASAELQQALHIQRISEQTSLKRLKDLTYLKRQIQNPLYGIMFSRKLLEGTELGAEQKQFLQTGIRCQRQISKILDDSDLDSIIDGYMDLEMVEFTLHEVLVASLSQVMTKSNAKGIRVVNDVEEKITTETLYGDSIRLQQVLADFLLISINFTPTGGQVVVAATLTQQQLGKLVHLANLEFR

SEQ ID NO: 167157 - protein, 516 aa, Glycine max
  Coding DNA Sequence Number=SeqID_50379
  Gene Ontology: Mol. function=transporter activity; Cellular component= membrane; Biological process=oligopeptide transport
  Homolog annotation: Hit_ID=Q2HRU3; Match level="QueryCoverage=99%, HitCoverage=87%, E-value=0.0, Identity=82%"; Hit description=TGF -beta receptor, type I/II extracellular region
  Pfam annotation: Domain name=MFS_1; Domain location=29-491; Score =19.9; E_value=3.9e-05; Accession=PF07690.6; Description=Major Facilitator Superfamily
  Pfam annotation: Domain name=PTR2; Domain location=91-479; Score =322.8; E_value=6.1e-94; Accession=PF00854.12; Description=POT family
  Pfam module annotation: Pfam domain module=MFS_1::PTR2; Domain location=29-491::91-479
MANHDAKEEQRPLNQWRRSKGGFMASMFIFVLSALDNMGFVANMVSIVLYFYGVMHFDLASSANTLTNFMASTYLLSLVGGFISDTYLNRFTTCLLFGSLEVLALAMLTVQAASKHLHPEACGKSSCVKGGIAVMFYTSLCLLALGMGGVRGSMTAFGADQFDEKDPTEAKALASFFNWLLLSSTVGAITGVTGVVWVSTQKAWHWGFFIITIASSVGFVTLALGKPFYRIKTPGDSPTLRIAQVIVVAFKNRKLSLPESHGELYEISDKEATEEKIAHTNQMRFLDKAAIIQENSKPKAWKVCTVTQVEEVKILTRVLPIVASTIILNTCMAQLQTFSVQQGNVMDLKLGSLTVPAPSIPVIPLVFISVLVPLYELFFVPFARKITHHPSGITQLQRVGVGLVLSAISMAVAGIVEVKRRDQGRKDPSKPISLFWLSFQYGIFGIADMFTLVGLLEFFYRESPASMKSLSTSLTWLSTSLGYFLSTVFVNVINAVSKRITPSKQGWLHGFDFEPK

SEQ ID NO: 167158 - protein, 110 aa, Glycine max
  Coding DNA Sequence Number=SeqID_50380
  Homolog annotation: Hit_ID=Q15B61; Match level="QueryCoverage=39%, HitCoverage=19%, E-value=1e-15, Identity=86%"; Hit description =Pectin acetylesterase
MEMERVLWVGIAIGLVFSNWVVGYEQYHFNETELSLLEAHEASLSYAGTERNNLLLVGLTLIQNAAAKGAVCLDGTLPGYHWHRGYGSGANSWLINLEICVANNICLAKG

SEQ ID NO: 167159 - protein, 267 aa, Glycine max
  Coding DNA Sequence Number=SeqID_50381
  Gene Ontology: Cellular component=cellulose and pectin-containing cell wall
  Homolog annotation: Hit_ID=Q153F8; Match level="QueryCoverage=99%, HitCoverage=68%, E-value=1e-115, Identity=73%"; Hit description =Pectin acetylesterase
  Pfam annotation: Domain name=PAE; Domain location=1-251; Score=358.2; E_value=1.3e-104; Accession=PF03283.4; Description=Pectinacetylesteras e
MEDLMSKGMRFANQALLSGCSAGGLATIIHCDEFRGLFPRTTKVKCLSDAGLFLDVIDVSGGHTLRNLYSGVVGLQGAQKNLPQICTNHLDPISCFFPQNLIASVKTPLFILNAAYDSWQIQSSLAPPSADPHGYWQQCRLNHAKCTGPQIQFLQGFRNHMLNAIKYFSRSKQNGLFINSCFSHCQTERQDTWFADNSPVIRNKCLLRSLSKHDLNPIALTIEHRFTCRNIMAIALAVGDWYFDRAGVKAIDCPYPCDNTCHHLIFR

SEQ ID NO: 167160 - protein, 633 aa, Glycine max
  Coding DNA Sequence Number=SeqID_50382
  Gene Ontology: Mol. function=transcription regulator activity; Cellular component=nucleus; Biological process=regulation of transcription
  Homolog annotation: Hit_ID=Q2HRT7; Match level="QueryCoverage=96%, HitCoverage=98%, E-value=1e-130, Identity=46%"; Hit description =Basic helix-loop-helix dimerisation region bHLH
  Pfam annotation: Domain name=HLH; Domain location=401-450; Score =60.4; E_value=5.9e-15; Accession=PF00010.16; Description=Helix-loop -helix DNA-binding domain
MPLHELYRVAKGKLDPIEMNNNTCAVDQSSVPNNDLLELVWEKGQISVQGQFSRARVSPNCKTLPSHCLPSHTPIGYANNAISTNTRMGKCGNLGVELNEIRRLVPSGEVDLSEEEEDMVMPWFNYGMEDSLQHGYSTDFFHEPSSYGVTMNELSASNNFSLLDRRNNCTKIFRDTHKHSSYAPVRSSVADIAENNANNVPSGSSGFSSLKMERQGPVMCSSSSTMMNFSHFAKPAAIVKANIENIGLASRSGNEGIQIKSAAATVTNPAESTKVELSGECPKKPATHNQDQDVTVSTKCDPSCKDVSKVDQNQTSNLVVGESVNKGHEAVEKGVELAVVSSSVCSGNGPERGSEDPNQNLKRKSKDTEDFESQSEDVEEESVGVNKEVPARRNGAKKSRSAEVHNLSERRRRDRINEKMRALQELIPNCNKADKASMLDEAIEYLKTLQLQLQIMSMGTSLCMPAMMLHPGMQHMHAPHMGPFSPIGVGMQMRLGVGCGMGMPDANDIESSRFIQVPQMQGTHHPSQGHPIPMPHAPIFSFPGEPFINPSTLGLVETVDKASSAFGLIKDQIPQLAQNTNNGCNSTNQMSTVQCEATIGGFEHSILVLNSGHATSVNDRGAINPSTEDNPYH

SEQ ID NO: 167161 - protein, 154 aa, Glycine max
  Coding DNA Sequence Number=SeqID_50383
  Subcellular localization annotation: CTP_CleavageSite=80; ConfidenceScore=5.44e-01
MLTAKCEPPLTAQTRKPAASPTALRKRNGIDSGFFFLTMVNQVIAFAVVKLVWGPLSFVQSHTNPTVTFNKGEGATPLLSLERVKHTHVLSVQDHDEMSSVASLFCVLGRKEYHHHILFRSLNLLSMQDLIRHHHIDTCWDKVTPFVVYGYELG

SEQ ID NO: 167162 - protein, 102 aa, Glycine max
  Coding DNA Sequence Number=SeqID_50384
MDRFRTNWRTHFSSPSLICEEKVQKSIASIINSNYTLHKKACPGQSNKKAKGGRSDHGGGREIVRDWPSDYDKGTWGVASPNIDKKARIFIDKQKNRVHHQL

SEQ ID NO: 167163 - protein, 107 aa, Glycine max
  Coding DNA Sequence Number=SeqID_50385
MWSFLKGEMNILTSHDQRWEQELSLYNQYEKERTPNLENKLLMHFMETTKSTQQALQSVEIQVGELAEAVTQFMVRQEKSFVEIEAQKKSPVTEHEPREKDDEKDEE

SEQ ID NO: 167164 - protein, 89 aa, Glycine max
  Coding DNA Sequence Number=SeqID_50386
MDFGKATSEITKRHLKKLGIREPTTRNFNQLEEDAEAEAPQEPVHQWSPFKSPMIQKMEAMLHLHQEHSVEVHSSLENITTRLENIKLG

SEQ ID NO: 167165 - protein, 41 aa, Glycine max
  Coding DNA Sequence Number=SeqID_50387
MPWKNQIMLLLSVLLMMKPPKLLIPANGDDGYIGPSQCAHS

SEQ ID NO: 167166 - protein, 99 aa, Glycine max
  Coding DNA Sequence Number=SeqID_50388
MERKKEKEKMKIKKRTKERKGRIPDQRSKGSEKGKEAILDQRKKEDRKSPKPDCHSESFVIGNIPPQMNKEEKTETPSFLSKNVDLEKILLVRDRTFDL

SEQ ID NO: 167167 - protein, 165 aa, Glycine max
  Coding DNA Sequence Number=SeqID_50389
MEGNEHKCKSDSKIWLKECWVGYLRDLSMYEKIDEVNFFGSLGEAKLRHMGGGMEFHFMRDASIFAKVVERCRTLVDIDKSTENMNKINFARILVQTSAGMHMYFAQGEDGRRNWCHNIMCRCNEWKFRKPNTRISSIANDMGMHVQSIFSEFNREVDVAMAEVV

SEQ ID NO: 167168 - protein, 78 aa, Glycine max
  Coding DNA Sequence Number=SeqID_50390
MKIKFENSSGRGSCFKGFSPLGTSLSFEFAWKNCFREENLSEALPKRFRNVFREESRKGFNRSSTFFIRSSSFFDLQR

SEQ ID NO: 167169 - protein, 66 aa, Glycine max
  Coding DNA Sequence Number=SeqID_50391
MENWQTALRNNFAGLRTRRWSTHEQRKAINSWGSEKSGEWRIGEQRYTMTSWGSELEGGGHMNSAR

SEQ ID NO: 167170 - protein, 93 aa, Glycine max
  Coding DNA Sequence Number=SeqID_50392
MSSARHHGRSFLPLLKLHLRKNASSVESRGIRLLGDSTEETVFRGCYFNNMDEDQWAYYSAMSEEVDMDFQDEEDYGVNEAHVDCSDAFNTSQ

SEQ ID NO: 167171 - protein, 162 aa, Glycine max
  Coding DNA Sequence Number=SeqID_50393
  Homolog annotation: Hit_ID=Q2QYN0; Match level="QueryCoverage=72%, HitCoverage=14%, E-value=1e-52, Identity=79%"; Hit description =Expressed protein
MLPWLVIPFIGLWALSQLLPPAFRFEITSPRLACVFVLLITLFWYEILMPWLSAWRVRRNARIRERKRFEAIEMQKLRKTATRRCRNCLNPYRDQNPGGGRFMCSYCGHVSKRPVLDLPVLPGFGISNSGIVKDLVGKNGKIVNSKSGMVGEWQLGWWVYSR

SEQ ID NO: 167172 - protein, 137 aa, Glycine max
  Coding DNA Sequence Number=SeqID_50394
MVVPVGLEEPLTMLAKGGDRDFAISSSLTSLLAHSDSSNPNSARILKEGTSNSDVSVLVGLLWRLDLRASIGSFNGDFPPWRCSGRQRKRIERRRHPLRNKPWKKELHHQDEPWIRSLERMLQWRKRKRERKREGGA

SEQ ID NO: 167173 - protein, 87 aa, Glycine max
  Coding DNA Sequence Number=SeqID_50395
MGKGWGPSAARAGYIGRSCHSTIPGPYEWPPTGMPNAACRAPSSACELRWTLEMVAAVEVAVVRLWPAAAAGPARAVVPALACSTSQ

SEQ ID NO: 167174 - protein, 52 aa, Glycine max
  Coding DNA Sequence Number=SeqID_50396
MDGSRPILDSVAMAPKKLLTKRARKATAGEGSSVALQAEIEFDKHRFRSEEH

SEQ ID NO: 167175 - protein, 105 aa, Glycine max
  Coding DNA Sequence Number=SeqID_50397
MGVALTRHPVDSEESNRALGFPALVMGLCQSYKAPVPPASSCHHDIGITPARHSIDPEKSNRVLELPALITGLYRFYGVHVAPSKVIRPSTNRVFIKKYCAPRQA

SEQ ID NO: 167176 - protein, 111 aa, Glycine max
  Coding DNA Sequence Number=SeqID_50398
MELSNGKGPSRVNLGFVEPWTKDVFALGFVTSMELCRGLPRTGLGFCKPLWISKREGTGDTVVSISGDSPKEDLGFRKPFGGLTRAFSDLGFEHRTLAYIAYISLAMGGMH

SEQ ID NO: 167177 - protein, 243 aa, Glycine max
  Coding DNA Sequence Number=SeqID_50399
  Gene Ontology: Mol. function=transition metal ion binding; Cellular component=nucleus; Biological process=proteolysis
  Pfam annotation: Domain name=Transposase_21; Domain location=176-243; Score=-107.5; E_value=2e-05; Accession=PF02992.5; Description =Transposase family tnp2
MGDRLEDMIRDLGQESFQQAHALVYEGLQSDSKKPSYTGCKNSLTLLSAVLSLVNVKARYGWSDKSFTSLLEVVHNLLPKDNTLPKSYYKAENILCPMGMEYQKIHACPNDCILYRHEFQEMSKCPTCGTSRYKVKDEKENSSDENSNKGPPAKVLWYLSIIPRFKRLFSNEDDAKDLTWHANGRISDGIVRHPADCSQWKKIDGLYLDFGKEPRNLRLGLAIDGMNPYGTLSTQHNSWLVLL

SEQ ID NO: 167178 - protein, 134 aa, Glycine max
  Coding DNA Sequence Number=SeqID_50400
MEQKYGDTMNHKKLVATQVGKLHGEVSRLKGEVKKYKEELKLATEDLGKYFSEKLRLEGKEVGLREEVEKWKAECATNDAATFNDHADGFNRALAQVVSFYPTVDLSNIELYKDVVDGKVIDSSSPPGTPTPKV

SEQ ID NO: 167179 - protein, 209 aa, Glycine max
  Coding DNA Sequence Number=SeqID_50401
MTGNLIIRVMMLVAMVCNDQAEMTGRLLAGILLPRSSNLAQASEEDLILMWAFLTGRQIDWAHLVRYRMHKALRANAPLPYPHLITLFLRHFQIPLDDEPFIQVKRSFAIGAGAVTSFGYRKDRNGQWLKKDALPPQDEHTPSPPPPREDFALMNEVLSELRGLRSYVGDRFESLDTRFAGMDIRLTQLEEDVGYIRQSFDLPPPPPSS

SEQ ID NO: 167180 - protein, 97 aa, Glycine max
  Coding DNA Sequence Number=SeqID_50402
MAKFDPEIVLEFYANAWPTEEGVRDMRSWVRGQWIPFDADVLIQFLGDPLVLEEGQQCEFSQRRNRVDGFDEETIAQLLCIPGQDFARTTTRLVWRP

SEQ ID NO: 167181 - protein, 34 aa, Glycine max
  Coding DNA Sequence Number=SeqID_50403
MALSAPSRTESPFLSLTCGEWERGTLALENVLFP

SEQ ID NO: 167182 - protein, 43 aa, Glycine max
  Coding DNA Sequence Number=SeqID_50404
MIFVGIGFLGDMMGSSTRKLIEMKGRVNLGLKSENGSDMSGKV

SEQ ID NO: 167183 - protein, 115 aa, Glycine max
  Coding DNA Sequence Number=SeqID_50405
AADAPPPPHQADPVGSFDTERYLRHLVRQQAANHRAHVQTHDCLYQLSLSLQSQGFTSFPCPTPDQFRAEVAWPGDWPEAQAGEAPAEAPDDGEEARMDEEMTNLLDFLEGSGAT

SEQ ID NO: 167184 - protein, 149 aa, Glycine max
  Coding DNA Sequence Number=SeqID_50406
FVKDFTKIVEISSGLLEYWTPQGPTEKWKLFSNSNGHNFSLGGPIQAHNISRRSKLNNGSSREVQMVITFHSEKLSRNANGHKFSLGGPIQAYDISRHSKLNNGKLSRNSNGNNFSLGGPIQAHNISRRSKFNNGRSGAIQMVITFHSE

SEQ ID NO: 167185 - protein, 444 aa, Glycine max
  Coding DNA Sequence Number=SeqID_50407
  Gene Ontology: Mol. function=succinyl-diaminopimelate desuccinylase activity; Cellular component=cytoplasm; Biological process=lysine biosynthetic process
  Homolog annotation: Hit_ID=O34984; Match level="QueryCoverage=88%, HitCoverage=88%, E-value=4e-44, Identity=30%"; Hit description =Acetylornitine deacetylase
  Pfam annotation: Domain name=M20_dimer; Domain location=214-335; Score=1.0; E_value=0.093; Accession=PF07687.4; Description=Peptidase dimerisation domain
  Pfam annotation: Domain name=Peptidase_M20; Domain location=107-434; Score=159.0; E_value=1.2e-44; Accession=PF01546.18; Description =Peptidase family M20M25M40
  Pfam module annotation: Pfam domain module=M20_dimer::Peptidase_M20; Domain location=214-335::107-434
MSLTEKISAHVDASAQRIAQTLCDLLAFPSVVKVDPREAGPGERDCQRYLQQRLMALGMDTDLWDPDGPALYQKYQGRPGANKGRTFEGRPNLGGTLSGSGGGRSLMLTGHIDVVPPGPAEHWHSDPFVPEIRNEAVYGRGAVDMKGGVACMLMAVELLQDLNVQLAGDVVFTTVVDEEIGGMGSLAMVDRGFKADAGIMTEPTANRIAPICHGILWARIILDGIGGHAELTPNSWDSSGPVDAVMLCRQMLDGLDVLNRRWQTQPDKNHPLMDLPNQIIVTQLKVGEHPASIAGRAEIVIDVQYLPAEKDEMGLGGKVKQEIEAHVAKVCALDPYLAKHPARVEWILDADCAEIPADHPFVSAFQQGVSDAALSPQLAGFGAHSDIGLPSTLGQTPTVNFGPGDPALSHQPNEHVPIADLVACTKAIALTLVHWCGLAKEAGR

SEQ ID NO: 167186 - protein, 332 aa, Glycine max
  Coding DNA Sequence Number=SeqID_50408
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=3e-47, Identity=31%"; Hit description= UPI00006A17C9 related cluster
HVPTFRGQHALAFRGLHVLTFRGLHALTFRGLHVLAIRGLHALAFIGPHVLPFRGLHVLAIRGLRTLAFRELHVLAFKGLQVLAFRGLHVLAFRGLHILTYRGLHILAFRGLHALAFRGLHALIFRGLLASPSEGYMPSPLEGCTPSPLEDYIGQHALAFRGLHVLVFRGLHVLTLRGLHALSFRELQVHTYKGLHALAFIGLHVLAGRGLHVLAFRGMHTLAFIGLHVLPFREQHVLAFRGLHVPTFRGQHALAFRGLHVPVLRGLHVLTLRGLHALSFRGLHVLTFRGLHVLAFKGLHVLTYKGLHAHVFRGQHALAFRGLHVLTFRGLH

SEQ ID NO: 167187 - protein, 186 aa, Glycine max
  Coding DNA Sequence Number=SeqID_50409
  Gene Ontology: Mol. function=DNA binding
  Homolog annotation: Hit_ID=Q1SDS1; Match level="QueryCoverage=60%, HitCoverage=20%, E-value=1e-13, Identity=38%"; Hit description=IMP dehydrogenase/GMP reductase
  Subcellular localization annotation: CTP_CleavageSite=33; ConfidenceScore=5.13e-01
MGSSQTPSLKKRFYQVKVKSLGITSLKELGQLMVSSNGKLFAKITQLTLFLPIIATRKARYDRRCEKSSTRIVCCTPALYVWLVSHLFRQEVRHACPQEGHRSCTEKGGTNWDQLLANKERASINWFPRWKEGRTGVLISCGGYPNVPLMGTKGCISYNPVLAIRQLGYPMRGAPLEEEIAPVLST

SEQ ID NO: 167188 - protein, 282 aa, Glycine max
  Coding DNA Sequence Number=SeqID_50410
  Gene Ontology: Mol. function=argininosuccinate synthase activity; Cellular component=mitochondrial outer membrane translocase complex; Biological process=queuosine biosynthetic process
  Homolog annotation: Hit_ID=P77756; Match level="QueryCoverage=74%, HitCoverage=90%, E-value=1e-102, Identity=85%"; Hit description =Queuosine biosynthesis protein queC
PDGAAQRQERRAEPKGDAGSGGDAACAAARGGTACASGGACAAGKLTAIGAQVAGGALAAAVTLDAVVAGQRILAHAIQLVVIVRQRPGLGLVQPHQRRFEADIAGDAQRHRLVQRFNELVAAIGVAGEIGFTHAGDHRFRFHLVGVDRRQRQEQDVAARHEGARQRIFLIGVVGGNRDIVACQAADGQLVEQRYVQHLVRLGAEGHRQLLSHFNLGAMALAVIERDAVNFVILLQCLDQAGRGVLSTAENDNRALHKITFLGFGLSRYTFGRQDKIALRRQ

SEQ ID NO: 167189 - protein, 470 aa, Glycine max
  Coding DNA Sequence Number=SeqID_50411
  Gene Ontology: Mol. function=nucleoside-triphosphatase activity; Cellular component=membrane; Biological process=proteolysis
  Homolog annotation: Hit_ID=Q5VMB3; Match level="QueryCoverage=96%, HitCoverage=65%, E-value=1e-147, Identity=63%"; Hit description =ATPase-like
  Pfam annotation: Domain name=AAA; Domain location=74-278; Score= -19.6; E_value=0.0064; Accession=PF00004.19; Description=ATPase family associated with various cellular activities (AAA)
MDVESERDECLNWTSTISVGDFAIDNRAGISRTLHRISAIRNRKGTIIGLTCRVGRAISGSAKLLQDLIQDGASLLLIGPPGVGKTTIIREIARMLANDYKKRVMIVDTSNEIGGDGDIPHAGIGNARRMQVPNSDMQHKVRVLGYNYDTSICAYSNLNIEVLIEAVENHMPQVIVIDEIGTKLEAMAASTIAQRGIQLVATAHGITIENLIMNPSLEMLVGGIQSVTLGDEEASRRGVQKTVLERKGPSTFSCGVEIISKTELRIHRSLEATVDAILSGRFPNVEIRKMKSQEQEEILQDGLVSDSSLQKNGEIMFEKATKGSDDQTNQNESLLKLPIDLVEDSWQLKLPLSLFCYGLSTNALEFKILEATVIQGVKQLKMNDAAIQLTDNISEANALLALQSKLKKNPGIQAAAKSHDIPIYVTKTSSLEHVAKAIRALVSDHEDGIKDSELTDKIKSSEMIDALEVI

SEQ ID NO: 167190 - protein, 91 aa, Glycine max
  Coding DNA Sequence Number=SeqID_50412
MAWGNYLTQNNEEGGLGIGENGSGDAFVGVDPGVRMQGEEKLVLSDVVVEKENHLFGKTFVSNGRFKKRELTRVEIFRSTLPGISISDSDV

SEQ ID NO: 167191 - protein, 91 aa, Glycine max
  Coding DNA Sequence Number=SeqID_50413
MIYFERKIEWNGWEIVLGCDGARGSLQFEGYEAMLAAVRCGCNAIELQLLRVNRNHSNFDVVHSQEKKMKRIKEVNQIKFLTYIKINLRKS

SEQ ID NO: 167192 - protein, 138 aa, Glycine max
  Coding DNA Sequence Number=SeqID_50414
  Gene Ontology: Mol. function=nucleoside-triphosphatase activity; Cellular component=membrane; Biological process=proteolysis
  Homolog annotation: Hit_ID=Q5VMB3; Match level="QueryCoverage=71%, HitCoverage=14%, E-value=6e-21, Identity=54%"; Hit description =ATPase-like
MKFVDYPSNYLGSGVLDILNRDRILRYHEIPGRKPCERFPSQIHDNLYQLRQLGVVAHAPPHLLRQQRQQPPQLHVQLILGKNRTGPGWKTRAQAGAGSEPGKGGNEGRVEGFGRNRVGKWRLLREVAAAKLERESEP

SEQ ID NO: 167193 - protein, 322 aa, Glycine max
  Coding DNA Sequence Number=SeqID_50415
  Gene Ontology: Mol. function=transferase activity, transferring hexosyl groups; Cellular component=integral to membrane; Biological process=carbohydrate biosynthetic process
  Homolog annotation: Hit_ID=Q8LF94; Match level="QueryCoverage=99%, HitCoverage=91%, E-value=1e-128, Identity=69%"; Hit description =Avr9/Cf-9 rapidly elicited protein 231
  Pfam annotation: Domain name=Glyco_transf_8; Domain location=27-297; Score=288.9; E_value=9.4e-84; Accession=PF01501.10; Description =Glycosyl transferase family 8
APQFYNSPNCPSIEHHDILSSSEEAVHVAMTLDTTYIRGSMAAILSVLQHSSCPQNTFFHFVCSSNANANANTNTNASLLRATISNAFPYLNFQLYPFDDAVVSNLISTSIRAALDCPLNYARSYLPNLLPPRVKRVVYLDSDLVLVDDIAKLATTSLGQNSVLAAPEYCNANFTSYFTPTFWSNPSMSLTFAERKRKACYFNTGVMVIDLERWREGDYTRKIEEWMELQKRMRIYELGSLPPFLLVFAGNIVSVDHRWNQHGLGGDNFRGLCRDLHPGPVSLLHWSGKGKPWMRLDANRPCPLDALWAPYDLLKTSFSLDS

SEQ ID NO: 167194 - protein, 78 aa, Glycine max
  Coding DNA Sequence Number=SeqID_50416
MKSETTDVLMPLQCSGTRRNYTPLPACGNMSDNVAMQEGPELYIDESSILLQSISNMMNVDCQEFEEMTPLYGTKYEG

SEQ ID NO: 167195 - protein, 178 aa, Glycine max
  Coding DNA Sequence Number=SeqID_50417
  Gene Ontology: Mol. function=binding
  Homolog annotation: Hit_ID=Q8L5R3; Match level="QueryCoverage=80%, HitCoverage=12%, E-value=3e-36, Identity=52%"; Hit description =Tubulin folding cofactor D
MENGVFLPILTHALYGYFNLIVIAEMCYQGLVISIGGLKNSLKRVSLSALLEYLEEVESKDPNTRTSRKSDRIIVPTLKTIEVLFRKKIFIDMEAYTPAFCGAVLDSLSFELKRSKDFSKLYAGIAILGYVASVQEPINMRAFSQLPVVVPASSAIVSSACADLGIQWPASTLKAGLP

SEQ ID NO: 167196 - protein, 986 aa, Glycine max
  Coding DNA Sequence Number=SeqID_50418
  Gene Ontology: Mol. function=RNA-directed DNA polymerase activity; Cellular component=chromatin; Biological process=chromatin assembly or disassembly
HDLRSQFGIRGPIIGALVVLMGDPNKVSGSLDRLEATPPPLPHSHPVPASTHKMKLDVPRFEGTEPLGWIFKINQFLEYHGTPEHDRLTIASFYMEALQTRYAPSQYEDPTSTLFKLTQRGTVGQYLSEFEDLSNCIIGLPPPFLLSCFISGLTPNIHREVQAHQALTLPSRTHASQPTPPGPLHATLLPPLLPSPPRPPPPTLKRLTPDEITSHHECGVLLLIVEEEDPLWSNIDPIDLPPDPPDSPDPYPIQISLNSLTGHLASEGHDHRPPHDPSGQQWEYPQLHSTTARHPAGLTLSGNYTFTGDVIIDIQTTKFTVDLYVLPISGANVVLGEITMPPRTPYPTATSPFMSQTGQCSILSHCGALPPTRDTDHHIHLILHSTSVNVHHYCYPYYQKHEIKLQKGLIQPSTSPFSLPVLLVKKHDGSWRFCVDYHTLNALKVRDRFPIPTIDEFLDELGGARCFSNTLCHLVSQKGVELVALKVAAIHQWSVPRSTKALRSFLGLTGFYRRFIRSYATIAAPLVKVTTIEPFQWMTQAQTTFEQLKQALSSALVLALPDFQLPFTIETDASRVGMGAVLSQQGHPIAFFSKPFSPKLLCASTYVRELFAITTTVKKWRQYLLGHRFTIITDHRSLKELLTQVIQTLEQHMYLARLMRYDYQIQYRSGIHNQDANALSRLPEQDPSLSMILSVSSLTFLEELHRQLDNHQEYICHCQDVLDNLAKHPQFSISDDLVLNKGRVGKAIAHILENFYWPGLRDDVKQFMAKFPYRPWKDLSLDIIVGLPSYHGNTIILAVIDHFSKEVLNHIVEQYLCAFVHHRSGTWGKLLPWVEWSHNTSWNVGIGTTPYEITFGHKPFNFPEYIVWSSNIDVVEDILIDTEETFQAIRKKLMKAQDAMKKHADSKRREVSYQAGDKSHITGTQHPHPVVVVLAPALTAPPFSDLQHSEFGFNGRLESLPLALLLELVVGSCDALVFKYWFWNFN

SEQ ID NO: 167197 - protein, 244 aa, Glycine max
  Coding DNA Sequence Number=SeqID_50419
  Gene Ontology: Mol. function=1-acylglycerol-3-phosphate O -acyltransferase activity; Cellular component=integral to membrane; Biological process=phospholipid biosynthetic process
  Homolog annotation: Hit_ID=Q8L4Y2; Match level="QueryCoverage=92%, HitCoverage=60%, E-value=6e-94, Identity=70%"; Hit description =Probable 1-acyl-sn-glycerol-3-phosphate acyltransferase 4
  Pfam annotation: Domain name=Acyltransferase; Domain location=2-149; Score=31.5; E_value=3e-06; Accession=PF01553.11; Description =Acyltransferase
MKERVLLIANHRTEVDWMYLWDLALRKGRLGCIKYILKSSLMKLPIFGWGFHILEFIAVERKWEIDEQILQQKLSTFKDPQDPLWLALFPEGTDYTDQKSKTSKKFAAEAGLPVLTNVLLPKTKGFHACLEALRGSLDAVYDVTIAYKNQCPSFLDNVFGVDPSEVHLHVRRIPVEEIPASETKAASWLIDTFQIKDQLLSDFKIQGHFPNQLNENEISRFKSLLSFMVYLVHILLLQPASIFN

SEQ ID NO: 167198 - protein, 251 aa, Glycine max
  Coding DNA Sequence Number=SeqID_50420
  Gene Ontology: Mol. function=protein binding; Cellular component =apoplast; Biological process=response to biotic stimulus
  Homolog annotation: Hit_ID=Q9SNY0; Match level="QueryCoverage=89%, HitCoverage=91%, E-value=6e-94, Identity=70%"; Hit description=SCUTL2
  Pfam annotation: Domain name=Thaumatin; Domain location=33-247; Score= 349.5; E_value=5.5e-102; Accession=PF00314.8; Description=Thaumatin family
MALIPNSKTPPLFHLLLFLLGNVANATVFTLENHCSYTVWPGTLSGNSAAILGGGGFALAPGSAVRLIAPAGWSGRFWARTGCRFDGSGAGKCTTGDCAGGLRCTGSGVPPVTLAEFTIGSASNGNKDFYDVSLVDGYNVGMGVRAAGGTGDCQYAGCVADVNGVCPAELQVRDGAGSVVACKSACAAFNTAEFCCTGDHSTPQTCSPTHHSEIFKKACPTAYSYAYDDASSTCTCSGSDYRITFCPTGSS

SEQ ID NO: 167199 - protein, 1383 aa, Glycine max
  Coding DNA Sequence Number=SeqID_50421
  Gene Ontology: Mol. function=RNA-directed DNA polymerase activity; Cellular component=nucleus; Biological process=RNA-dependent DNA replication
  Pfam annotation: Domain name=AT_hook; Domain location=2-14; Score =14.1; E_value=0.085; Accession=PF02178.9; Description=AT hook motif
  Pfam module annotation: Pfam domain module=AT_hook::RVT_1; Domain location=2-14::879-1147
MSRGRGRPKKTAPSSPASQTNIVEQAIVNNQDEDSTKHQVVEEIEVVDDDSSVSMPETLIPKLTCDAQGDLKEERKLWIDVLNDNRNPAKGMAIEYVQPTLVDGEIEIAIDEEDIVSEKKFWENALVMYVLGGELSMNGVKHFITKAWNFVQLPAIYYHDDGYFLLKFNTHKDMDDVMLRGPYTVRNMPMLLREWKPGFNLKQDMLRTLPIWIQLPQLPLHLWGARSLGKIGSALGKPITTDECTAKKYRVSYARILVEVDVTQKLPNDITIRDSEGKKLKQPVHYEWKPMFCDKCQKFGHHCEEVKAKKVWQMKSKQGSTSHAQPKENSTGLYNIETVDNGLESKKSVENGLKSTQAAGKNAGSSGVKGTNSADFQANTSTTVLNLVASGDIGNVAEYTHEWSSRRKNGKDNGKKIVVDCTPNLIRCTNGFEALEDLNDPLVYQDGKLKEIGSRLLELRPTITILIETRVKQVKARNIRNKLRLQGEFLDNYSSHSNDRIWLNWDTNKVTIKYIRETSQLLHCGVYDLTAKDRVGGNLVTESEYEDLAKMMRNTGTFEKDSMGDYYTWSNKQTDGMIYSRIDRVLGNVEWFQDNMDTMLQILPPSVSDHTLLCLADPGNTTGRQFHFKFSNCLTDLKEYHSTVSNSWNEPLNGRPMYVLWEKLKRLKPALNKINRPLHHIQSRIMEARQNLQHAQQSLVEDRWNSSKIDTVKRYTEEVINWNSLEEKTLQQKSKIDWLRLGDGNNSYFHATIKAKKSSKRLNLLHKDDGTVITSHDEIQDEVLNFYEGLMGTKDGNVRHINIMAMRGGPQLSMEQREQLVAPITDQEIRKALNGIGDTKSPGIDGFGAKFFKTSWNIIGKDVVAAVRDFFENDRIYKAFNCTLVTLIPKNEEAKTIKEYRPIAGCTTVYKIISKIITARMGRVMDSIVGKNQAAFVPGQQIHNHILLAYELIKGYSRKGGTPRCMMQIDLQKAYDMVNWDALECILKEIGVPQQFIRWIMIAVTTISYRFNVNGCHSNLLQAKRGLRQGDPMSPLLFVIVMEYLNRILYDMQKNPNFNHHAKCEKLSITNLAFADDLLLFSRGDPISVDLMVKAFKNFSESTGLIANPSKCKIYFGGVGDDSKRNILNLTGFTEGPLPFRYLGVPLTSKKLSIHHYMPLVDKIVGRINHWSTNLLTYAGRVQLIRSVTFAIANYWMQCFPIPKYVVHKIEAICRSFLWTGGQEIKRKSPVAWDSVCKPKDYGGLNIIDLSVWNKVTMLKLLWNLSGKSDSLWVKWVNAYYLNKDTLMNVSVKIHNSWIMKSILKHRSSILDIQSIWDSMLEKNRFGMKEVYKSLCTNTSKVRWRNLFRGNTARPRALMTLWLACHGRLATKNHLKKFGMIED

SEQ ID NO: 167200 - protein, 246 aa, Glycine max
  Coding DNA Sequence Number=SeqID_50422
  Gene Ontology: Mol. function=protein binding; Cellular component =apoplast; Biological process=response to biotic stimulus
  Homolog annotation: Hit_ID=Q9SNY0; Match level="QueryCoverage=94%, HitCoverage=95%, E-value=4e-93, Identity=67%"; Hit description=SCUTL2
  Pfam annotation: Domain name=Thaumatin; Domain location=33-244; Score= 329.2; E_value=7.1e-96; Accession=PF00314.8; Description=Thaumatin family
MALIPNSKTSALFHLLLFILGNVAYATVFTLENHCSYTVWPGTLSGNGAATIGDGGFPMAPGSSVQLTAPSGWSGRLWPRTGCNFDASGNGKCLTGYCAGGMRCTGGGVPPATLAEFTIGSGGKDFYDVSLVDGYNVGVGVRATGGTGDCKYAGCSEDLNPACPAELQVKDGGGAVVACKSACAAFNTAEFCCTGDHSSPQTCSPTRYSKIFKNACPAAYSYAYDDPSSICTCSGSDYVITFCPSH

SEQ ID NO: 167201 - protein, 95 aa, Glycine max
  Coding DNA Sequence Number=SeqID_50423
  Pfam annotation: Domain name=G-patch; Domain location=46-90; Score =25.2; E_value=0.00017; Accession=PF01585.13; Description=G-patch domain
  Subcellular localization annotation: CTP_CleavageSite=52; ConfidenceScore=5.07e-01
MDSLGGSPPLNAPPKTKIQGEGALSHCFGGGGCSKSLPMWPCMSGATMMVARVMLRHGYEPGMGLGKNNDSMANLVDIKENRGKFRLGYKPTRTD

SEQ ID NO: 167202 - protein, 78 aa, Glycine max
  Coding DNA Sequence Number=SeqID_50424
MFLHVGLSQQVVIAKHKGYVSGSLSDEGKVELGGDSGKSESSLEKGLVDRSDASDVDAKVDNMARCFRTNQRILVRKG

SEQ ID NO: 167203 - protein, 60 aa, Glycine max
  Coding DNA Sequence Number=SeqID_50425
MIEFQMIDEKSISDQIHEFENIIYDMKLKGIVLPDIMLVAFMISKLPPSWTNFARSLKHK

SEQ ID NO: 167204 - protein, 194 aa, Glycine max
  Coding DNA Sequence Number=SeqID_50426
  Homolog annotation: Hit_ID=Q3SC79; Match level="QueryCoverage=93%, HitCoverage=90%, E-value=5e-20, Identity=33%"; Hit description=ACI19
  Subcellular localization annotation: CTP_CleavageSite=78; ConfidenceScore=5.43e-01
MALRKLLSKRFFDGVKMTTPFERSVVLSSPLQQKAIAPPSTTRASSDDGGFLRRFFLLRRAVYHSGPARLPEFLSLPVGEKLRQKLKDINDIASAPIAGDAVFGNGMSVRDARKIMRASQMEKLKAKLRNFPESSVQYSEFLRICVEACENPEQGAEFAKILDDSGDVIVLGNAVFLRPEQLQRRRMDPYPSVA

SEQ ID NO: 167205 - protein, 69 aa, Glycine max
  Coding DNA Sequence Number=SeqID_50427
MARRSWGWTKSEHLPSPVEDWKKLCVVQVTSRTSPCISLGAILAIVDPVVIAVSKFKLVLRSLLESQLC

SEQ ID NO: 167206 - protein, 243 aa, Glycine max
  Coding DNA Sequence Number=SeqID_50428
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-34, Identity=33%"; Hit description= UPI00006A17C9 related cluster
RPTHPRLLRAPCPRLKTATRPRLQRTPHPHLQRTHVLPFRGLHALAFRGLHALTFRGLHVLTFRGLHVLPFRELQTLTFRGLHVLPFRELHALVFRGLYDLTFRGLHVLALRGLHVLPFNGLHLPTFGGLHLLTFRGLHVLSFRGLHVLAFRGLHVLTFRGLHALTFRGLHVLAFRGLHVLAFRGLHVLTFRGLHALAFRGLHALAFRGLHALAFRGLHALTFRGLHILAFRGLHALTFKGPH

SEQ ID NO: 167207 - protein, 317 aa, Glycine max
  Coding DNA Sequence Number=SeqID_50429
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=43%, E-value=1e-136, Identity=98%"; Hit description=DNA -directed RNA polymerase beta chain
  Pfam annotation: Domain name=RNA_pol_Rpb2_3; Domain location=123-192; Score=135.4; E_value=1.5e-37; Accession=PF04565.7; Description=RNA polymerase Rpb2, domain 3
MNSLGTSIANGIYRIVINQILQSPGIYYRSELDPSGISVYTGTIISDWGGRLELEIDRKARIWARIYYKINLDWPLVRLENMVRGTICGAIRHKLIPTPQNLVTSTPLTTTYESFFGLHPLSQVLDQTNPLTQIVHGRKLSYLGPGGLTGRTASFRIRDIHPSHYGRICPIDTSEGINVGLIGSLAIHARIGSWGSIESPFYEISERSKRIRMLYLSPSRDEYYMVATGNSLALNRDIQEEQTVPARYRQEFLTIAWEQVHLRSIFPFQYFSIGASLIPFIEHNDANRALMSSNMQRQAVPLSQSEKCIVGTGLERQ

SEQ ID NO: 167208 - protein, 126 aa, Glycine max
  Coding DNA Sequence Number=SeqID_50430
  Gene Ontology: Mol. function=transporter activity; Cellular component= 1-2nm peptidoglycan-based cell wall; Biological process=transport
  Homolog annotation: Hit_ID=Q0XCC1; Match level="QueryCoverage=73%, HitCoverage=35%, E-value=1e-38, Identity=89%"; Hit description=Amino acid ABC transporter, permease protein, 3-TM region, His/Glu/Gln/Arg/o pine precursor
STLEDPTHCAGAERGRLQRRSRARRPAGRAARPGRGRTRPGPAAHLRLHGRGVPAGLQDLAAAAGEQLRGPAQGFVAGVRHRRGGADQCGQPHPVGHLPARGDPGHRGRDLPGADHAGDPGHGCRG

SEQ ID NO: 167209 - protein, 132 aa, Glycine max
  Coding DNA Sequence Number=SeqID_50431
  Subcellular localization annotation: CTP_CleavageSite=36; ConfidenceScore=5.12e-01
MYFHQPSYKGKAGNNKHHTYLGQQGSLGHGGARMTQCKTANRDTGNNGWAGYGMVVRRGRQRHNGCQLRGPSRRLAIDTRSRITSSKYQNAITTWLQRRVSKTVVVTLPLITKMPLTYILYRFLGTALECAS

SEQ ID NO: 167210 - protein, 60 aa, Glycine max
  Coding DNA Sequence Number=SeqID_50432
MSISRLNHLEDTMDLDYVFNQFKGDQIIATKVSLVDPQGNMSCVLLPKDEHCIAYFAQGI

SEQ ID NO: 167211 - protein, 136 aa, Glycine max
  Coding DNA Sequence Number=SeqID_50433
MDLKKLSAKRARKATTREGSSATPEEHQCRFEVIKDWFFLKERRVQLEEGEYAEFQAEVSRRCWTQLTQPMVKYDLKVVMEFYVNAWPTKEGVMDKCSWKRDNDVNMLKEEANSQVLMKRSWVNYFAPRYMILHGA

SEQ ID NO: 167212 - protein, 148 aa, Glycine max
  Coding DNA Sequence Number=SeqID_50434
MALITGLCQFYEISVAPTKLIRPPITKSFIEKYCMPRQAQQPGQDHQQQPAADTPPPPPYQAPSLESISAHIIARTSTIISGLLPSSSEPLSHGLGIGPIFRSRHVLRVLKEPPKRTKVELRRMETWQICLISSLEETELPNHDLLNL

SEQ ID NO: 167213 - protein, 597 aa, Glycine max
  Coding DNA Sequence Number=SeqID_50435
  Gene Ontology: Mol. function=protein kinase activity; Cellular component=extracellular region; Biological process=protein amino acid phosphorylation
  Homolog annotation: Hit_ID=Q69TY6; Match level="QueryCoverage=94%, HitCoverage=90%, E-value=9e-84, Identity=34%"; Hit description =Putative receptor protein kinase PERK1
  Pfam annotation: Domain name=LysM; Domain location=151-195; Score =24.5; E_value=0.00038; Accession=PF01476.10; Description=LysM domain
  Pfam annotation: Domain name=LysM; Domain location=85-130; Score=3.2; E_value=0.27; Accession=PF01476.10; Description=LysM domain
  Pfam annotation: Domain name=Pkinase; Domain location=307-573; Score =45.3; E_value=2.9e-11; Accession=PF00069.15; Description=Protein kinase domain
  Pfam annotation: Domain name=Pkinase_Tyr; Domain location=312-573; Score=38.8; E_value=7.5e-15; Accession=PF07714.7; Description =Protein tyrosine kinase
  Pfam module annotation: Pfam domain module=LysM::LysM::Pkinase::Pkinas e_Tyr; Domain location=151-195::85-130::307-573::312-573
  Subcellular localization annotation: CTP_CleavageSite=40; ConfidenceScore=5.55e-01
MGPSPSFLYTCNGFNKTCMSFLIFKSKPPFNSITTISNLTSSNPEELARINDVTVLKVFPTGKEVIVPLNCSCLTREYYQAETKYVLGQSPTYFTVANDTFEGLTTCDTLMRANSYGELDLLPGMELHVPLRCACPTWHQITNGTKYLLTYSVNWGDSIKNIAARFNVAAGNVVDANGFSTQTQTIFPFTTVLIPLPSEPVSSMAIIVNGPPAVSPLPVCSSEKCNSRRKLYIVIATTGGSMLVLCVVLFGGFLCRKRSARFIKRGEQSEKAKKLSSEDIRGKIAIIEHHSKVYKFEEIEEATENFGSKNRIKGSVFRGVFGKEKNILAVKKMRGDASMEVNLLERINHFNLIKLQGYCENDGFPYLVYEFMENGSLREWLSRNRSKEHQSLAWRILIALDVANGLQYLHNFTEPCYVHRNINSGNILLNRDLRAKIANFALVEESESKITSGCAASHVVKSRGYTAPEYLEAGMVTTKMDVFAFGVVLLELITGKDSVTLHDGREVMLHAIIVNLIGKENLEEKVSLFIDPCLTVTGNSEIVCAPQLVKLGLACLIQEPAERPTMVEVVSSLLKIYTSYMEQIIPPSISNSPSMER

SEQ ID NO: 167214 - protein, 160 aa, Glycine max
  Coding DNA Sequence Number=SeqID_50436
  Gene Ontology: Mol. function=RNA-directed DNA polymerase activity; Biological process=RNA-dependent DNA replication
MDREEKEYVGRVEGDKKSEQYCTLVYCWCDLNCMRKACERVGVGGEDDGSGERLEFNNFIHELGVDDLPLVGRRFTWYRPNGRARSRLQRALTSSDWCHVWPRCTQFVLDRNILNHCPFSSRIRLWIEDLSHSRSLIVGLKIKLLSKFVEDARRKLNFEG

SEQ ID NO: 167215 - protein, 108 aa, Glycine max
  Coding DNA Sequence Number=SeqID_50437
DGICGTHLQIMVRTKELGHALGHVAGRGVGIGDRDDSNDAPQCQRPTASARRQRVPVTVAHDEPMLPAMEADGASVETKVFPDDPMAPADVEDIGADIPVDIGAQATE

SEQ ID NO: 167216 - protein, 68 aa, Glycine max
  Coding DNA Sequence Number=SeqID_50438
MAGQGMPLLAFAGQGEREKWPQCIPPFLLAGHAYVGSPAIGAGGIGSGCGIGAGGIGLAHVKAAVFRR

SEQ ID NO: 167217 - protein, 356 aa, Glycine max
  Coding DNA Sequence Number=SeqID_50439
  Pfam annotation: Domain name=IncA; Domain location=109-344; Score= -19.2; E_value=0.1; Accession=PF04156.5; Description=IncA protein
MNVKCNHLHTQLHQLTLDGCTIFEFLSTSQDLVDSLNAIVDPILVREHIAVIGEGLPETNGLAILQQQLRRGPLSLRAMRQVIGLTPSSRRPSSFQDPPSAPLAVHAYTSAVVVVPAPPPPLVALVQEVAPAVEVSAQTTLTGPVVAPLSIIGTPLLSAGVATTSAPKMSSLSSSAPPVPPSAVFASALPSTSSHPKENGQRHQEMLSKVASLDAVVAKWRVTARTVWRVEHPNMANAIATFAEAVREKNELADKVEIIAVEKDELAKVVVDLEVQLKESESRLEEFEMRACKEREANKELKEELLVFKKEVVEQHEKGFHKAVWQDVKDDVLLDKEDITVEEEYANEEQGVRASV

SEQ ID NO: 167218 - protein, 152 aa, Glycine max
  Coding DNA Sequence Number=SeqID_50440
MSHTSSAASTETIILIPSFYHKQWAPDYPQHVDLKYDGTIYKIRARQHKTRCYLGDGLENFKRELEIYESTIINFFACNHLYKFDIHFTPPLHRQTCGRPRHLCRKHIWSVKITRAMAAAPHPLKLPPSTEIPLNACGHHIKTIWPSIAMAY

SEQ ID NO: 167219 - protein, 76 aa, Glycine max
  Coding DNA Sequence Number=SeqID_50441
MATPVTSGGGDPHTPHGDVTLPVHLAPVNTDLNHIIIEKLDLKNYLFWRLQIPQRFSTVEDVNASKVTETFRLWDQ

SEQ ID NO: 167220 - protein, 87 aa, Glycine max
  Coding DNA Sequence Number=SeqID_50442
MNPKRKGSQSHHKKLGKVERNEGRGVMFGVGGGDVGIEGLQGSKEDVVVDKELTYGKDEDKGGVKVEVINVDKMEVIGKDEIMEFSS

SEQ ID NO: 167221 - protein, 106 aa, Glycine max
  Coding DNA Sequence Number=SeqID_50443
MEFSSYLRGTEAAPFFGSWTASSKGQFGGEDRKEAGIGKSQSAGAMPLGLCLPPPLSATTTCTLRRPDGIGGNDMGNDGDSGSGVVTTSLMAVVEVVLVVVVRGGN

SEQ ID NO: 167222 - protein, 138 aa, Glycine max
  Coding DNA Sequence Number=SeqID_50444
MLEAVDDWELMVIMVSGLIHGEEVKCENEFLGGEKDIGSRSGGPHHSREDRLMAISFYLAFTCMRGGWILKPGALCLIAHSFRFHQIVHHILMTHHLPIDEKTSLPDMRSKTSTIVSMSSFMKKELRVSAANNGKQSL

SEQ ID NO: 167223 - protein, 234 aa, Glycine max
  Coding DNA Sequence Number=SeqID_50445
  Homolog annotation: Hit_ID=Q1T493; Match level="QueryCoverage=83%, HitCoverage=38%, E-value=1e-10, Identity=25%"; Hit description =Nucleic acid-binding, OB-fold, subgroup
MPEIEEFKQRLTELDIEVHSVMTPHSQPTSQVSAFIHCYKKTDVDTTPFTCACSKYNQQVVLRYRLEVMVTHKEKCTKFLLWDRECTELIGQSAEEVNRLKITDGDVDLNASPEALDKLLGYSLAFKVKVQPKFKNSVVLKYSSDLDLIRTIVDLLPDAEASCKTHIPLPDSDDPPHYETQSLSEIVDHDPLLKVPLTPTKRQTFQGCDDEALSSQISPAQLSSNKLGKHAKIE

SEQ ID NO: 167224 - protein, 322 aa, Glycine max
  Coding DNA Sequence Number=SeqID_50446
  Gene Ontology: Mol. function=metal ion binding; Cellular component =nucleus; Biological process=regulation of transcription, DNA -dependent
  Homolog annotation: Hit_ID=Q9SMX9; Match level="QueryCoverage=99%, HitCoverage=33%, E-value=4e-52, Identity=41%"; Hit description =Squamosa promoter-binding-like protein 1
MRNQDVLSHLLRNLASLTGTINGRNIVSLLEGSQDLVKAGTSGAAQNVPNTNSNGPEPSRPLYSSIKMDDGLIHRDPPESLVQCETTPANDMAKECIASGNDEVGSLKSPSVPLSTNDYVENTRNCRPPLPSGNGSLDHPLLVQCDSLKSSPPQTSRNSDSTSTQSPSSSSGEAQSRTDRIVFKLFGKAPNDFPHALRSQILNWLSHSPTEIESYIRPGCIMLTIYLRLENSAWEELCYNLGPSLRKLAASNDCFWRTGWIYTRVQHSVAFLYNGQVVLDAPLRLKSPQSCQILCVKPLAVSASSCAQFVLKGFNFLLSNSR

SEQ ID NO: 167225 - protein, 127 aa, Glycine max
  Coding DNA Sequence Number=SeqID_50447
MAATTTLEAIVTMKEKNVVMATTTGNGDNNNDGDNMMIMMMKMAMVVVVMAMIMSLMVMMKKLVEVTVVMVMDMVVVATKTIVMEVWHWQWCGRDDNGKSVSDNYQGDGVRDNGDEYFCLLSILYVG

SEQ ID NO: 167226 - protein, 524 aa, Glycine max
  Coding DNA Sequence Number=SeqID_50448
  Gene Ontology: Mol. function=DNA binding; Cellular component=nucleus; Biological process=regulation of transcription, DNA-dependent
  Homolog annotation: Hit_ID=Q1SEQ4; Match level="QueryCoverage=80%, HitCoverage=39%, E-value=3e-86, Identity=44%"; Hit description=SBP
HLEVGDCVKEACGGCTIHVVFSEGEQGGGSRMVDKAVGDVGGVRGIPVRLVRVVYELGTTYSAKIWNTQQDLVTRKYLVQDNCYDLIDSVDAANGHHELQHLRFSCHVPNVTGRGFIEVVSTHAEAQKKLENAFETSLIYLNDWIYTAVDAWYLVTLRNSEGPVEDNGLSSCSFPFIVAEQEICSEICKLENVIEAAETADDIQIKTKLMEEKTQALYFIQEMGWLLHRSRVKVRLGPVAPVQDNFHFNRFMWLVGFSMDHDWCAVMKKLLNIVFEGTVDTGDHASVELALLEMGLLHKAVKRNFRPMVELLLKFVPVKASDGGDSNEKQINKSPDRFLFRPDTVGPARLTPLHVAASMHGSENVLDALTDDPGMVGSEAWKSAQDATGLTPYDYASLRGYYSYIQLVQRKTSNTCKNQQHVLDIPGNLVDSNTKQKQSDGHRSSKVLSLQTEKIETTAMRHCGLCQQKLVYGGMRRALVFRPAMLPSAGNHWSMGQSNVVYQGRFTFTSDVRHKMLTVLSSKY

SEQ ID NO: 167227 - protein, 325 aa, Glycine max
  Coding DNA Sequence Number=SeqID_50449
MDAPFRSPEDYKKSFFSDHPLAFQLHTFDPPPLFIMSYSKEGLVCSGRVGGTTLPFIGATTTAEEGPHPNPMVHSLPREDEVESPFLVPPHNVIDLDSEATIVQVLVCHPFIPLSPPPPPPSKASKIRKKLPLITLPNYSWVHEEVRSYESDAMFNYQSIKKAQTKKAKKATIQKVQANKAKGKQQDHTEDDWVPPPPPISPSDTKRANTIPQDEGPSKWSRVDSILIVVPSSIGSHPAFLSMKKGTTSLWGKDFNPRRLAPYVSLDFVACFTTKTWGIIEFWAEEFEKVDAESEKAQAECAKAEKALAEATMTNETLLQSTKDS

SEQ ID NO: 167228 - protein, 123 aa, Glycine max
  Coding DNA Sequence Number=SeqID_50450
MWTAQSQRAQGGDDIPQGLYSTASCEFDRIRFGEKVNPGLPLFFSSFIFFFLICVFSMLSKNNVWRNSLTFGDFGAGAGFRVEDAEIEVFDAENETRVVRFMLGLAWGMGEGRMEDESERDIE

SEQ ID NO: 167229 - protein, 112 aa, Glycine max
  Coding DNA Sequence Number=SeqID_50451
MVIPKFKVSDFDKYKGTTCPKNHLKMYCRKMGAYAKDEEQLIHFFQESITGVVVTWYTNLGPSRVHSWKDLMVPSLGSISRILIWLWIGCNYRTCAKRGMNHSKNTPKGGET

SEQ ID NO: 167230 - protein, 81 aa, Glycine max
  Coding DNA Sequence Number=SeqID_50452
  Subcellular localization annotation: CTP_CleavageSite=46; ConfidenceScore=5.17e-01
MCSPLTVRACSPLEARVCNPLKARTCSPLKVRTCSPLKARTCSPLKARACSPLKAIGDNSCNLILSFANLFRGLPQSVCPI

SEQ ID NO: 167231 - protein, 235 aa, Glycine max
  Coding DNA Sequence Number=SeqID_50453
  Gene Ontology: Mol. function=DNA binding
  Homolog annotation: Hit_ID=Q1SP03; Match level="QueryCoverage=77%, HitCoverage=34%, E-value=6e-22, Identity=34%"; Hit description=IMP dehydrogenase/GMP reductase
MGTNQTGKRFYQVKVKSPNTTSIKELGRLMEPLQMQAFRRTYGKILELTIAEVSIEAIASLTQYYDQPLRCFTFGDFQLVPTIEEFEEILGCPLGGRKPYLPPARGLDRVKQTRNGIAGLPQKYLEDKARGMANQGDWVPFMDVLALLIFGVVLFPNVDGLVDLAAIDAFLAYHHSKESPVVAVLADLFDTFDRRMDWDQLLAGIGSRTISWFPRWKEGKEGVLFSCGRYPNIPL

SEQ ID NO: 167232 - protein, 189 aa, Glycine max
  Coding DNA Sequence Number=SeqID_50454
  Gene Ontology: Mol. function=RNA-directed DNA polymerase activity; Biological process=RNA-dependent DNA replication
IPESQTKPFLEQLIGFARETSDTIGYVHLLTTFGDETWSQSIMIKYRTFDALTAYIILIGHPLLNELGTIISNPHLAMKFPSEDGKIIIFKVNQMTAREYYVANLMISKGKNVAEPKTSHLPEARPVAQRKRKLGPEKGKVEDEEAKKLLSLGFTKEDKEKTAFMPDMTNYCYSVIHSIYRMLEQPAKG

SEQ ID NO: 167233 - protein, 111 aa, Glycine max
  Coding DNA Sequence Number=SeqID_50455
  Gene Ontology: Mol. function=chitin binding; Cellular component =extracellular region; Biological process=chitin metabolic process
  Homolog annotation: Hit_ID=UPI0000612705; Match level="QueryCoverage =98%, HitCoverage=47%, E-value=9e-09, Identity=29%"; Hit description =UPI0000612705 related cluster
  Subcellular localization annotation: CTP_CleavageSite=73; ConfidenceScore=5.83e-01
MASISSPQKARACSPLKMRKCSPLKVRTSSALMVRVSSPLKVRKCSPLMVRTCRPLKVRTCSPLKARTCSPLKAKASSHLKLRMCSPLKARTGSPLKARACSPLKVRTCSP

SEQ ID NO: 167234 - protein, 408 aa, Glycine max
  Coding DNA Sequence Number=SeqID_50456
  Gene Ontology: Mol. function=RNA-directed DNA polymerase activity; Cellular component=chromatin; Biological process=RNA-dependent DNA replication
MEKLIQKGHLKKFIKDPSRDKDCEKERDRSLECSTTREAIETQCQDENPLPKTQLRGVVNTIAGGLTEGGSSNSTSKHYVCNLKSINSFATEKKVTRSLPSTIFTDEDFEGINQCHKDPMVGKIEVATFLVNTSTSYNILIGRLSLNELGVIISTPHLTMKFSSKNGKIITVRANQMTTRECYVASLKISKGKKEEKPKVQMVAYTSLNRNLGEAKINPREAEPKYNPLKKLAICPEARPAPKRKRKLDPKRGKTMDEQAKKLLSIGFIKELQYTTLLANMVMVKKSNRKWRMCIDNTDLSRVFPKDLFPFSSIDHLVDEAFGFPTLSFLDAYLGYNQISMFKQDEEKTRLMDKILVNQLGKNLEVYVDVMVAKNISTTSPIRPRGKFFGFMLTHIRIEANSKKCVTM

SEQ ID NO: 167235 - protein, 73 aa, Glycine max
  Coding DNA Sequence Number=SeqID_50457
MLMMLKMHCDDVMLCMYMGGAVTLLDIPGGGNRVEKYLYMRACHSVWNSLETQADHLGGELPVHDRVTSTLTA

SEQ ID NO: 167236 - protein, 156 aa, Glycine max
  Coding DNA Sequence Number=SeqID_50458
  Gene Ontology: Mol. function=RNA-directed DNA polymerase activity; Biological process=RNA-dependent DNA replication
MARDNRCRKTLLTDVESITRKMEVEFKWGGRLSLEIGVDIKIWKLERFREKSSLKDKYPRPFLLFEQHDAMLKDMGLWEEGVWQWSLSERRHFFIWEEWDIRDSLEGDINAIAPIEGKCDGWRWEVENLGLYMANSSYCVIHKFIVDSIANEFEIA

SEQ ID NO: 167237 - protein, 139 aa, Glycine max
  Coding DNA Sequence Number=SeqID_50459
  Homolog annotation: Hit_ID=Q2R029; Match level="QueryCoverage=32%, HitCoverage=6%, E-value=5e-10, Identity=69%"; Hit description=AAA -type ATPase family protein, putative, expressed
MEDTRTHRQVGQSLFVRVDKLQLVKYAKHPYGSLGKKGMVAVLTAAIFLFLLLAITFVYWFIKARRQFAAIDNFSDANKLGQGVFGSVYKAIATEVGANFINISMSSITSKWFGEGEKYVKTDLVRNVELSKTVIEQPS

SEQ ID NO: 167238 - protein, 222 aa, Glycine max
  Coding DNA Sequence Number=SeqID_50460
  Gene Ontology: Mol. function=protein tyrosine/serine/threonine phosphatase activity; Biological process=protein amino acid dephosphorylation
  Homolog annotation: Hit_ID=Q5JNL3; Match level="QueryCoverage=59%, HitCoverage=42%, E-value=1e-41, Identity=58%"; Hit description =Putative PTEN-like phosphatase
MKIEELDDGECSRDEEEKCQRQIVSIDAKRALVGAGAWILFYPTLLYNVLRNQIEVEFRWWDHIDEFLLLGTVPFPKDVPHLNKVGVGGVITLNEPYETLVQLYQAHGIDHLVIPTRDYLYAPSFVDINRAVHTYCLAFQKDIVATCHQQKLIRWKLHSCLLKRFLTLPLSNYLNYARWHKSRLKLCCMKLLGWHQNCMSRITPLDLSILHSRIMKELWLFT

SEQ ID NO: 167239 - protein, 71 aa, Glycine max
  Coding DNA Sequence Number=SeqID_50461
MITGLQDSLPKSIGPLPFDGGVTVPRNFRLLEELERGEKGIRDGTISYIHPYRCVSNDSYQLHVRGCPQKC

SEQ ID NO: 167240 - protein, 172 aa, Glycine max
  Coding DNA Sequence Number=SeqID_50462
MLTVWVEIALMVATWIGQIQKIRLMVVEINHRGGGAERLRERGRAKAPEKEWERHIPLAVATTRTMMPNMSMTMELAIIYPDNVVGGLLEQDHDIMVECAEVDGREMDRVVVDDGDDMKEVVVPLWSFWWSSIWIIKALFALRVWRVTSMVLGFWGREDEVGDCGKFVGEGI

SEQ ID NO: 167241 - protein, 74 aa, Glycine max
  Coding DNA Sequence Number=SeqID_50463
  Subcellular localization annotation: CTP_CleavageSite=28; ConfidenceScore=5.22e-01
MVWHHQVWVLGMALGSGSRGVSTSSPSTAAAGSSEVGSWAAEAPPPPKGEGWARGQATCASNSSMLMMDGKPKP

SEQ ID NO: 167242 - protein, 159 aa, Glycine max
  Coding DNA Sequence Number=SeqID_50464
MATGGSTPYSLTSKGLCGANEFISSCYIAIFCHKQGLGISTKTKAYDVGKRRCQGEVDMASRPLPPLSYIHVAYLQYLGNLDACHEYALGVVALCTSRTISPMQASRAIGNVEVFAHFPTIGYSKRQENYVVEDPIATRWKPLRGSGLLLSIRDIWDNL

SEQ ID NO: 167243 - protein, 58 aa, Glycine max
  Coding DNA Sequence Number=SeqID_50465
MRCYNHCRRAQQLGATQAHKDPGRGLTRMVAELVDIIIIRLLGHSNNIHSDDDIMSPS

SEQ ID NO: 167244 - protein, 183 aa, Glycine max
  Coding DNA Sequence Number=SeqID_50466
ETTLVSACYQAFRLTDSKKVYTDDHSGISARQRDSKVSMTDLVSAEDDAFRLTDSKKVYTDDHSGISARQRDSKVSMTDLVSAEDDIAKRMYTDNHSGISARQRDSKVSMTDFVSAEDDAFRLTDSKKVYTDDHSGISARQRDSKVSMTDLVSAEDDAFRLTDSKKVYTDDHSGISARQRDSK

SEQ ID NO: 167245 - protein, 214 aa, Glycine max
  Coding DNA Sequence Number=SeqID_50467
ENAATARALEQETKRARKEEHGRDKFRGALWGSNNELKLRREERDQSWVHGMILKEELATFARSKRSLAQHLEATKQSMLAIIGQYKEELNQPVTHEQNLVEDFAQVYTEKEARGRVIDALHQEATMWMDRFALTLNGSQDVPRLLAKAKAIAEADLSALKDQMASITEAMLKLQKTIEDNATATASNTAREAEPVLRPAINLGRDRNTTVFGR

SEQ ID NO: 167246 - protein, 177 aa, Glycine max
  Coding DNA Sequence Number=SeqID_50468
MTTITQIWMTLLLSNILPSDHNNDLPLRKDHAHKTPSGPRGAQQGPGVSSSGYGPLSVLQGARPPQQGIAPARHPVDPEKSNRVLGFPALITGLCQFYGVPVAPNKVIRPPTNRAFIKKYCAPRQAQGETLQQPGDVRQRVIDTPPPPPKPLSSSTKAGALPTTRGRPAGDQVQSKR

SEQ ID NO: 167247 - protein, 126 aa, Glycine max
  Coding DNA Sequence Number=SeqID_50469
DLIWARLDERKADFAKSALMQSFCCEIVQQNFAQVQKNACVWLAVESLVQNEFWMFASRSQRSKCRLIHYRLPLERIDGDPVLRETRIWATWEYVSSVGGGQQGMVGLCAHCGCEKLVVHHRPTAT

SEQ ID NO: 167248 - protein, 89 aa, Glycine max
  Coding DNA Sequence Number=SeqID_50470
FSEELTKRTDRAKRVHPVRMNTHPLAELPRASLAKLPTLSGIYEELVPLSVAFKELSAYPCGRPSGPCLAKRPVTFVEAKLHGESKVIQ

SEQ ID NO: 167249 - protein, 119 aa, Glycine max
  Coding DNA Sequence Number=SeqID_50471
MTSELQMLITFAMIICLRPTIYQNAQNSEENDRIEPVSRAEALIPDDVNLSRSGLFDTGYGGLDDATSGERKISQGRRHKDYLDKSEIGSTRNSERNSHQILSNVKSFFYSNQKPILIV

SEQ ID NO: 167250 - protein, 132 aa, Glycine max
  Coding DNA Sequence Number=SeqID_50472
MYPPLFSLNLVDVLSTRTDPQEMYPLLFSVKPKEWEESKEFSDYVVLNSLTREKGDTKEFRQLVLCSFGKERRETQKEFRRLVLGEFFLAKGEENEKMNSRSFQGLENQKTSESFWYKEEEEVQRDSRLVKD

SEQ ID NO: 167251 - protein, 245 aa, Glycine max
  Coding DNA Sequence Number=SeqID_50473
  Homolog annotation: Hit_ID=Q1S175; Match level="QueryCoverage=52%, HitCoverage=38%, E-value=9e-34, Identity=47%"; Hit description=MtN19- related
  Pfam annotation: Domain name=SURNod19; Domain location=26-245; Score =9.2; E_value=3.3e-13; Accession=PF07712.3; Description=Stress up -regulated Nod 19
MEFISNAMILSFSILLLLPSTSYSLYQKPENHIKTAIFVTGSFEMGPGSIATKTFENIKFPKGHVGIKSFDAKLVDQEGNSIPSYETYLHHWFAIKYHQNITMSPNPKLRRPEDAFFQRNEGTCNGGILPHYWGFGVESRGTTSKIPDPFAIEQVKVYILDSTDKVRSNGSKILHDCLAEYTIPAGGGGDSPHVQKANIPMENGGYLIYGTAHMHSGVVNATLYGQDGRTLCTSTPKYGTGKRLE

SEQ ID NO: 167252 - protein, 114 aa, Glycine max
  Coding DNA Sequence Number=SeqID_50474
  Subcellular localization annotation: CTP_CleavageSite=57; ConfidenceScore=5.67e-01
MAKPSSPANLASAIIGFFASKKFPHRLKASPGRFARQNPSPHPSVMVHVHGFFKVLLADSRFTRPDMGFHPTKLNFVPSDADEAPLDVSICLHAFGIVGCGSFSGVKSCEREGA

SEQ ID NO: 167253 - protein, 95 aa, Glycine max
  Coding DNA Sequence Number=SeqID_50475
  Subcellular localization annotation: CTP_CleavageSite=44; ConfidenceScore=5.49e-01
MGKNKGRQSHLATKQIMVKGTTSGSRKSQTSATSGLAGCLDVVQANQNAYTASQDNLVGKVLVKKAGTSSAKTDDVAHQVFDNLSECNAESESSP

SEQ ID NO: 167254 - protein, 116 aa, Glycine max
  Coding DNA Sequence Number=SeqID_50476
MAVPLACPAAATGGTHYPAIGTSGSSFPLVSMAAPTIHDLIITKDSDPNNLMDIVLPPLRLPSHTLGPVVIIIMHLQQTQKLTMDGEKKISEKEKIEGRKIEKEGEGEKHQKLTMD

SEQ ID NO: 167255 - protein, 108 aa, Glycine max
  Coding DNA Sequence Number=SeqID_50477
MLCTSPCCAFSHLHHIVTHALYVSLVFCHGKPEGPYHLLNCTHGALCPRMLNIDDQNCHSLDYRVEPSSCFYEKVRQVKLKHGSNHLAKIGVKDGSSYIAASSTAKHI

SEQ ID NO: 167256 - protein, 484 aa, Glycine max
  Coding DNA Sequence Number=SeqID_50478
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q5NA51; Match level="QueryCoverage=92%, HitCoverage=97%, E-value=1e-122, Identity=48%"; Hit description=Leaf senescence related protein-like
  Pfam annotation: Domain name=DUF231; Domain location=314-461; Score =100.6; E_value=4.6e-27; Accession=PF03005.6; Description=Arabidopsis proteins of unknown function
  Subcellular localization annotation: CTP_CleavageSite=80; ConfidenceScore=5.60e-01
MSALNRTIISFNKTSSFNRRTLGIGSPRAIHNNRFGCVSLRFQVLIITVSVVSFFVAVGGYMYVLPSLSRAFFNGQVPLLSEHNSNGSVRECDVFDGSWVQVKDHTLYNATECPFVERGFDCLGNGRGDRDYLGWRWKPRSCDIPRFDVRGVLEMLRSKRVVFVGDSMSRTQWESLICMLMAGVEDKRGVYEVNQNQITKRIRFLGVRFSAFNFTIEFFRSVFLVQQGRVPRHAPKRVQSTLLLDKLDDISDQWLNSDILIFNTGHWWVPSKLFDIEWEPRVISGWTETFNVVAPESSYAICYIYNYIQEYFPLNVPNCQDKLSVGSSLKLGMTIPSAFRIALETWSSWVDREINKNRTRIFFRTFEPSHWSDLTRRICNVTQYPTFGTNGRDQSLFSDTILDVVKNVTIPINALHVTSMSAFRSDAHVGSWSDNPSIQDCSHWCLPGVPDMWNEIILSQLFAESEIPSQQIESFSKFSYLLID

SEQ ID NO: 167257 - protein, 615 aa, Glycine max
  Coding DNA Sequence Number=SeqID_50479
  Gene Ontology: Mol. function=signal transducer activity; Cellular component=chromatin assembly complex; Biological process=signal transduction
  Homolog annotation: Hit_ID=Q9FUF3; Match level="QueryCoverage=99%, HitCoverage=100%, E-value=0.0, Identity=85%"; Hit description=FAS2
  Pfam annotation: Domain name=WD40; Domain location=102-140; Score =34.6; E_value=3.4e-07; Accession=PF00400.22; Description=WD domain, G-beta repeat
  Pfam annotation: Domain name=WD40; Domain location=151-189; Score =32.4; E_value=1.6e-06; Accession=PF00400.22; Description=WD domain, G-beta repeat
  Pfam annotation: Domain name=WD40; Domain location=3-41; Score=22.8; E_value=0.0012; Accession=PF00400.22; Description=WD domain, G-beta repeat
  Pfam annotation: Domain name=WD40; Domain location=359-398; Score =13.6; E_value=0.74; Accession=PF00400.22; Description=WD domain, G -beta repeat
  Pfam annotation: Domain name=WD40; Domain location=54-92; Score=25.6; E_value=0.00018; Accession=PF00400.22; Description=WD domain, G-beta repeat
  Pfam module annotation: Pfam domain module=WD40::WD40::WD40::WD40::WD4 0; Domain location=102-140::151-189::3-41::359-398::54-92
MKGGTVQISWHESKPVLTLDFHPLSATLATAGADFDIKFWQIKPAGSPKKLPVVSYLSNLYYHSSAVNVIRFSSSGELLASGADGGDLIIWKLHSTDAGQTWKVLKMLRSHHKDILDLQWSTDATYIISGSVDNCCIIWDVNKVLDPCVSGTNLQTLDAHAHYVQGVAWDPLGKYVTSLSSDRTCRIYMNKPHKSKGIEKINYVCQQVISKADQPLLKNSKETKFHLFHDETLPSFFRRLAWSPDGSFLLVPAGSYKISTASESVNAAYIFSRKDLSRPAIQLPCASKAVVAVRFCPIFFKLRGTHSDCTVTIELPEWPGVQLKSKLSLPITGLFKLPYRIIFAVATLNSLYIYDTESTSPIAVLAGLHYAAITDITWSSDAHYLALSSQDGFCSLVEFENDELGSPYSLSGKVSNEDGKSTVQTTNDTVTVPTEDVSAVLAESKKMESEEKADDMVIEASGNIDAVVTESGETITQEKDEMIKSTGNLADFRKNEAAEKAIDMAIEATGNVEGVIADSRKKEAEEKTDGMVIETTGSIGAAELDRRKAEQEDKTEKQPANLDSDGKQKEAKEKTEILQSSLDGIKSGPQLFSPKSTPISNKPAKKRITPIAIDP

SEQ ID NO: 167258 - protein, 54 aa, Glycine max
  Coding DNA Sequence Number=SeqID_50480
MATARWALQHPVYGIVILRLGIYTDRPNVSKTTFLNEKLYTVPEFQQTLLTTTK

SEQ ID NO: 167259 - protein, 164 aa, Glycine max
  Coding DNA Sequence Number=SeqID_50481
RKNQDSIFMRRMSKCSLDGTRGCINYNPVLAIRQLGYPMRGVPSDESITPFIARGFSDHNARDRELRGSSNGIIGGYHKWLRVRTQGLDWLPNLKTVRDDEVKASEESDEVQALKAELERARVVEEKFKSIAIKAAIVSSSFEEVKGIIMGQRHDLEGRAKGLP

SEQ ID NO: 167260 - protein, 264 aa, Glycine max
  Coding DNA Sequence Number=SeqID_50482
  Gene Ontology: Mol. function=RNA binding
  Homolog annotation: Hit_ID=UPI00006748F9; Match level="QueryCoverage =86%, HitCoverage=100%, E-value=4e-77, Identity=62%"; Hit description= COG3820: Uncharacterized protein conserved in bacteria
  Pfam annotation: Domain name=DUF1013; Domain location=48-208; Score =413.3; E_value=3.5e-121; Accession=PF06242.2; Description=Protein of unknown function (DUF1013)
  Subcellular localization annotation: CTP_CleavageSite=41; ConfidenceScore=5.33e-01
MMQSGYRAPISRKSVVDTTPATPARTDRRTVSMAQQLLMPKATAVWLVDNTALSFDQIATFCKLHPLEVKAIADGEAAQGIKGLDPIATGQLSRDEIARAEANPNHKLKLSEPKVRVPESKRRGPRYTPVSKRQDRPNAILWLVRNHPELKDAQISRLVGTTKSTIEQIRDRTHWNSANLTPMDPVTLGLCSQIDLALVVERASRGRSLPTAEELDNTLQPATATEGLDYNFQREEDEQIDADAVFKKLSSLKSTQKDEDEDDQ

SEQ ID NO: 167261 - protein, 69 aa, Glycine max
  Coding DNA Sequence Number=SeqID_50483
  Gene Ontology: Mol. function=RNA-directed DNA polymerase activity; Biological process=DNA integration
MAFVHNTRCLWLDAMKEELNSIKHNGVWDLVELLKGCTRVGRKWVFKTKRDSHGNLEHYKARLVVKGFT

SEQ ID NO: 167262 - protein, 120 aa, Glycine max
  Coding DNA Sequence Number=SeqID_50484
  Gene Ontology: Mol. function=enzyme inhibitor activity
  Homolog annotation: Hit_ID=O49603; Match level="QueryCoverage=97%, HitCoverage=65%, E-value=3e-21, Identity=43%"; Hit description =Invertase inhibitor homologue precursor
MAVVMVGIGMANGTSTSLYLSSQLLGTANKDSTFKRVLKECVEKYKYASDALQASAHDLANEACDYASMHITAASDYPNVCHNLFKLYPGLVYPTELAPREDGLKCLCDVALRIVENLNW

SEQ ID NO: 167263 - protein, 141 aa, Glycine max
  Coding DNA Sequence Number=SeqID_50485
  Gene Ontology: Mol. function=pyridoxal phosphate binding; Biological process=metabolic process
  Homolog annotation: Hit_ID=Q1RT21; Match level="QueryCoverage=66%, HitCoverage=14%, E-value=3e-30, Identity=71%"; Hit description =Aminotransferase, class V family protein
MWVGCWPEGMQMERIQAAPLISYCIRKQRHIIKPRSKYAVADEGKNKTNDIEEERSHDDFCIHSESFKKLVEMGVPCNECVEEKLRWLRSQIIGNHLDFYSPLGRRILVYADHTASARSLNYNENFISNHLLPFYACDIYT

SEQ ID NO: 167264 - protein, 155 aa, Glycine max
  Coding DNA Sequence Number=SeqID_50486
  Gene Ontology: Mol. function=pyridoxal phosphate binding; Biological process=metabolic process
  Homolog annotation: Hit_ID=Q1RT21; Match level="QueryCoverage=96%, HitCoverage=23%, E-value=2e-70, Identity=84%"; Hit description =Aminotransferase, class V family protein
MVHEAREYIKKCLGGGEDDALILCGSGTTAAIKRLQEVMGIAVPSVLRERVLKSLGTEERWVVFVGPHEHHSNLLSWRQSLAEVVEIGLDQKGLLDIDALKLQLEAYRDTNRPMLGSFSACSNVTGIYSDTRAIAQLLHKYKAFACFDFAARFYV

SEQ ID NO: 167265 - protein, 117 aa, Glycine max
  Coding DNA Sequence Number=SeqID_50487
  Homolog annotation: Hit_ID=Q7Y252; Match level="QueryCoverage=33%, HitCoverage=13%, E-value=3e-11, Identity=77%"; Hit description =Xyloglucan endotransglycosylase
MLLIVTRALVKSELDCPALIKLLDVGVRPRDMKVLQKSGWSTQSRHTKEKNTKEKEDTRISNLSGIELKYCVKPKRALAFHTANGLPSLGPTQQFVFLFAAFNPLLPKSLSQRVHPL

SEQ ID NO: 167266 - protein, 609 aa, Glycine max
  Coding DNA Sequence Number=SeqID_50488
  Gene Ontology: Mol. function=pyridoxal phosphate binding; Biological process=metabolic process
  Homolog annotation: Hit_ID=Q1RT21; Match level="QueryCoverage=97%, HitCoverage=95%, E-value=0.0, Identity=77%"; Hit description =Aminotransferase, class V family protein
  Pfam annotation: Domain name=Aminotran_5; Domain location=76-528; Score=-7.2; E_value=1.8e-12; Accession=PF00266.9; Description =Aminotransferase class-V
MDQSVDKTNYEVGVLSKTSISETSHDFCNHSESFKKLVEMGLPCNESVEEKLHWLRSQIIGNDAEFDSPFGKRKVVYADHTASGRSLHYNENFIIKHLLPFYGNTHTCDSYVGSRTTKMVHEAREYIKKCLGGGEDDALILCGSGTTAAIKRLQEVMGIAVPSVLRERVLKSLGTEERWVVFVGPHEHHSNLLSWRQSLAEVVEIGLDQKGLLDIDALKLQLEAYRDTNRPMLGSFSACSNVTGIYSDTRAIAQLLHKYKAFACFDFAASGPYVEIDVRSGESDGYDAVFLSPHKFLGGPDSPGVLLMNKALYLLGSSPPSTCGGGTVTYVNGFNEQDTLYLENIEERETGGTPPIIQTVTAALAFWVKEYISYEEIEKREQLYINKAFERFGSNPNIEVLGNLKAKRQAILSFLIYSTTTNSSSAGEWSDGNKENEGELDLWAETGNQRGKPLHGPFVAALLNDLFGIQARGGCACAGPYGHELLHINKSQSLAIRSAVQEGYIGVKPGWTRVSFPYYMSEEDFEYILRAIEFLAVYGQRFIPLYSFNLINGSWRLKTEKFEALTKEDMRRDESYFEVAKCVASGLPKFPSQGILQEDVDPNIFCFRV

SEQ ID NO: 167267 - protein, 35 aa, Glycine max
  Coding DNA Sequence Number=SeqID_50489
SVDSLEKLIDHEQVLLAVYLQLGPAHCSKLEHTIE

SEQ ID NO: 167268 - protein, 166 aa, Glycine max
  Coding DNA Sequence Number=SeqID_50490
  Homolog annotation: Hit_ID=Q2QWP2; Match level="QueryCoverage=56%, HitCoverage=87%, E-value=2e-10, Identity=39%"; Hit description =Expressed protein
MDIATANTNRGKYHHIGGENAGRKKEAETLRGIRKVHDMRTRLDRRGPSPWRCPSTVSEHEKMEAPIMLPLERTSSIEREPRTLNINQIQSARELAIYILNTKTIEEASRIFTEGLQPVVSAACCMRSGTTMDMDLGEELEVLNSKDATTQVAPAAAFRDIASAPF

SEQ ID NO: 167269 - protein, 352 aa, Glycine max
  Coding DNA Sequence Number=SeqID_50491
  Gene Ontology: Mol. function=nucleotidyltransferase activity
  Homolog annotation: Hit_ID=Q9SKH2; Match level="QueryCoverage=97%, HitCoverage=62%, E-value=1e-124, Identity=60%"; Hit description =Expressed protein
MEVENLGVFRDTIELMFEDDDRITKTLINVGVSRSIDILEVSAGIVFAKGVRCCLKYLEAVPWTEEEEEKLRSLFTRFEFDDATTRDILGRLYLNDSVDSRPNVAQQLVWSISTCEDANARNEMKSLVKGLLCKSSVYEKNHLDLSKEDLYAVCDSCLSSLISLFEEASDTTPPERLMKKDSNKPLIERISRQVDNINWLLEIMLDGQVAEDFVDIWAHQQQLLKMHDIASPMIRYELSRVSAILFVAMGTRKLQCPLEARSGLLQAWFGPMLLDFGWLQRCRKGLDMRTLEEAMGQTLLTLPLKQQYVLFMEWFRHFSRHGTECPNMSKAFQIWWRRSFLRGSETYAVESR

SEQ ID NO: 167270 - protein, 233 aa, Glycine max
  Coding DNA Sequence Number=SeqID_50492
  Gene Ontology: Mol. function=DNA binding; Biological process =regulation of transcription
  Homolog annotation: Hit_ID=Q1RT19; Match level="QueryCoverage=95%, HitCoverage=71%, E-value=5e-29, Identity=44%"; Hit description=No apical meristem (NAM) protein
LIGLCMIIHRLEDKDLADKGIAQDSYVVCKVFQKEGLGPRKGAHCARPFNEEEWDDEEIGIPCAALTAPVPILPMTSDGSVPNDNLPASGCTVSASISCLSGSLPSPGTVNPTGPNDQAANDNDILPMLDIFNDDKWFEEVYNPGQENIVEGASPSDDFFEGLEDYLAGFSSGQNTEFNTNGMRLLQGLKDYWAALAGFSAGQNTGDIGNSDNLDFIELNDLDTPLFYPITQP

SEQ ID NO: 167271 - protein, 608 aa, Glycine max
  Coding DNA Sequence Number=SeqID_50493
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1RT14; Match level="QueryCoverage=99%, HitCoverage=55%, E-value=0.0, Identity=90%"; Hit description =Glycosyl transferase, family 48
  Pfam annotation: Domain name=Glucan_synthase; Domain location=1-608; Score=541.9; E_value=6.7e-160; Accession=PF02364.6; Description=1,3 -beta-glucan synthase component
MMYYRRAIKLQAFLDMASEQEIFDGYKAIAVPSEEEKKSHRSLYANIEAMADLKFTYVATCQNYGNQKRCGDRRATDILNLMVNNPSLRVAYIDEVEEREAGKIQKVYYSVLIKAVDNLDQEIYRIKLPGPAKLGEGKPENQNHAIIFTRGEALQTIDMNQDNYLEEALKMRNLLEEFNEDHGVRPPTILGVREHIFTGSVSSLAWFMSNQETSFVTIGQRVLARPLKVRFHYGHPDVFDRIFHFTRGGISKASCGINLSEDIFAGFNSTLRRGNVTHHEYIQVGKGRDVGLNQISLFEAKVACGNGEQTLSRDIYRLGHRFDFFRMLSFYFTTVGFYVSSMLVAITVYAFLYGRFYLSLSGLEEAIIKIARKKGDDPLKAAMASQSLVQIGLLMTLPMVMEIGLERGFRTALSDIIIMQLQLAPVFFTFSLGTKMHYFGRTLLHGGAKYRATGRGFVVRHERFADNYRMYSRSHFVKGIEIAILLICYGLYGSATSDSTSYALLSLSMWFLACSWLFSPFLFNPSGFEWQKIVEDWEDWAKWISSRGGIGVPSNKSWESWWDEEQEHLQHTGIWGRIWEVILALRFFVYQYGIVYHLHVARGDKSIS

SEQ ID NO: 167272 - protein, 402 aa, Glycine max
  Coding DNA Sequence Number=SeqID_50494
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1RT14; Match level="QueryCoverage=99%, HitCoverage=37%, E-value=0.0, Identity=83%"; Hit description =Glycosyl transferase, family 48
MDLLLVPYSSGHNLKIIQWPPFLLTSKITVALDMASQFRGRDSDLWKRICADEYMKCAVIECYESFKHVLHDLVIGETEKSIISSIIKEVESNISKNTLLTNFRMGFLPSLCKKFVELVEIMKNGDPSKQGTVVVLLQDMLEVVTDMMVNEISELAELNQSSKDAGQVFAGTEAKPAILFPPVVTAQWEEQIRRLYLLLTVKESAVEVPTNSEVRRRVSFFTNSLFMDMPRAPRVRKMLSFSVLTPYYSEETVYSKNDIEVENEDGVSIIYYLQKIFPEEWNNFLERLECKKDSDIWEKEENILQLRHWASLRGQTLCRTVRGMMYYRRAIKLQEFLDMASEKAEIFDGYKAIAVPSEEEKKSHRSLYARLEAMADLKFTYAATDSNMGIRSALETVVQQIS

SEQ ID NO: 167273 - protein, 72 aa, Glycine max
  Coding DNA Sequence Number=SeqID_50495
MDNIRFTAPFRVQKTLPAAASKFVYGSKKSITIHHGLPKSTKWPLSIHNHMPAITEPWFNLIHEKNLRPRDE

SEQ ID NO: 167274 - protein, 252 aa, Glycine max
  Coding DNA Sequence Number=SeqID_50496
  Gene Ontology: Mol. function=protein binding; Cellular component =integral to membrane; Biological process=defense response to fungus
  Homolog annotation: Hit_ID=Q1SWI7; Match level="QueryCoverage=96%, HitCoverage=80%, E-value=3e-51, Identity=30%"; Hit description =Leucine-rich repeat
  Pfam annotation: Domain name=LRR_1; Domain location=100-123; Score =7.7; E_value=10; Accession=PF00560.23; Description=Leucine Rich Repeat
  Pfam annotation: Domain name=LRR_1; Domain location=125-148; Score =3.4; E_value=65; Accession=PF00560.23; Description=Leucine Rich Repeat
  Pfam annotation: Domain name=LRR_1; Domain location=173-196; Score =6.4; E_value=18; Accession=PF00560.23; Description=Leucine Rich Repeat
  Pfam annotation: Domain name=LRR_1; Domain location=203-224; Score =12.0; E_value=1.6; Accession=PF00560.23; Description=Leucine Rich Repeat
  Pfam annotation: Domain name=LRR_1; Domain location=227-249; Score =5.0; E_value=33; Accession=PF00560.23; Description=Leucine Rich Repeat
  Pfam annotation: Domain name=LRR_1; Domain location=28-50; Score=0.5; E_value=2.3e+02; Accession=PF00560.23; Description=Leucine Rich Repeat
  Pfam annotation: Domain name=LRR_1; Domain location=52-74; Score=4.0; E_value=51; Accession=PF00560.23; Description=Leucine Rich Repeat
  Pfam annotation: Domain name=LRR_1; Domain location=76-98; Score =11.6; E_value=1.9; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=100-123::125-148::173- 196::203-224::227-249::28-50::52-74::76-98
MEIDFSYLKLNQQVNELLEILAPCISHGLTALAVQSSRLSGNLTDHIGAFKNIDTLLFSNDSIGGALPRSFGKLSSLTYLDLSINKFSGNPFESLRSLSKMSSLQIDGNNFQGVVKEDDLANLTSLMEFHASGNNFTLKVGPKWLPNFQLSYLDVTSWQLGPNFPSWIQSQNQLQHFGLSNTGILDSIPTWFWEALSQDEPMQLKFLNLASNNLSGEIPDCWMNWTFLADVNLQSNHFVGNLPQSMGSLADL

SEQ ID NO: 167275 - protein, 154 aa, Glycine max
  Coding DNA Sequence Number=SeqID_50497
ERKTFPFGVKCGQCKVCKCAMDDTSIKDSSMDNMWSWLLCPRCGAIGLVREKKSSCMNSPQRLDDHIEWYLGNDRMEGPSLGVWHQVVALSHTPTWQPQLNVRHYLVGESLPLYHGEGLNGVATLSTTTEDGLAYGRRTFRGYLMILDEYLMGY

SEQ ID NO: 167276 - protein, 270 aa, Glycine max
  Coding DNA Sequence Number=SeqID_50498
  Gene Ontology: Mol. function=oxidoreductase activity; Cellular component=chloroplast; Biological process=metabolic process
  Homolog annotation: Hit_ID=Q8G2F5; Match level="QueryCoverage=97%, HitCoverage=54%, E-value=1e-111, Identity=78%"; Hit description =Aldehyde dehydrogenase family protein
  Pfam annotation: Domain name=Aldedh; Domain location=1-264; Score =135.3; E_value=1.7e-37; Accession=PF00171.12; Description=Aldehyde dehydrogenase family
IVKTLNDAGFPAGVVKVISNAPEDAPEIVAALVAHPSIRRINFTGSTHVGKIIAKQAAEHLKPVLLELGGKAPFIVLEDADLDQAVDAAAFGAFMNQGQICMSTERFIVHEKVADAFAQKLAAKAKSLPAGDPRGNVVLGSLVDLKSAERMDALIQDAVSKGGKVLAGGKREGSIVDATIIDHVTPDMNIYTQESFGPVKPIIRVRDADEAIRVANDTEYGLSSAIFSQDVKRALALSKKLATGICHINGPTVADEAQMPFGGVNLPAMA

SEQ ID NO: 167277 - protein, 402 aa, Glycine max
  Coding DNA Sequence Number=SeqID_50499
  Gene Ontology: Mol. function=thioredoxin-disulfide reductase activity; Cellular component=cytoplasm; Biological process=removal of superoxide radicals
  Homolog annotation: Hit_ID=Q6D3U5; Match level="QueryCoverage=52%, HitCoverage=66%, E-value=1e-104, Identity=88%"; Hit description =Thioredoxin reductase
  Subcellular localization annotation: CTP_CleavageSite=65; ConfidenceScore=5.45e-01
MMLAQLPAGLPWIQAGPSCCSLSSTCWRMRWRITWPHRKPTRSRSQLNSARSANAAASQINEGISCSRGVCSMIRACSRLANSHACATISRPLNSPNSMERRSQRCANELWVLSQRICVCVAGALFGAIGDKQARPHVTSSPGRLKIIKRPNVAITDARRGVRRGETKKAAREPLFADEENVLADFCAGDAVQVTLRVQRRHTAGAGGGDRLAIDVIHHVARGEHAGDGGLGRIAVNAGLHLDVAVFQLQLAAEDAGVRAVADGDEHAGQFQFTGFVFRFGAADTHAGHALFISQHFVQRMVGVQHDVAAFHFFHQPVDQDLLRAEAVAAVDQVNLGGDVGQVQRFFNGGVAAADHCDFLVAVEEAVAGRTGGNAFALEGLFGRQAKIAGGGAGRDDQRVAA

SEQ ID NO: 167278 - protein, 219 aa, Glycine max
  Coding DNA Sequence Number=SeqID_50500
  Gene Ontology: Mol. function=ATPase activity, coupled to transmembrane movement of substances; Cellular component=integral to membrane; Biological process=transport
  Homolog annotation: Hit_ID=Q6D3U4; Match level="QueryCoverage=85%, HitCoverage=34%, E-value=3e-52, Identity=53%"; Hit description=ABC transporter ATP-binding protein
MDHIYRQAITSAGTGCMAALDAERYLDGIAGAEFVSAALAAPFHAVGAVQRPADRGASVAVGQPAARPDHRAYPARTADPFVYLAGRRVRAAGAVELAAGTGRFPVWPGDPPAHAPTGQTGGQLGQHHRRADRGYAGLLLALSAADVSGGLHPAADPDRRLPDQLGRRHHSAGDRAADPAVHGAGRHGGRIRPPPQLRGAGAIERQLPRPPARPGHPAA

SEQ ID NO: 167279 - protein, 160 aa, Glycine max
  Coding DNA Sequence Number=SeqID_50501
MDKLLMQFMETTKSTQQALQSVEIQVGELAEAVTQFMSRREKSFVEAEAQEKSPIKEHESREKDEEKDDEQTQQQWEKYSTVENQQGNILQSNNLPHQLIDKKGRQGEHEETLSAILSLITNTFLEMIWNVLPDYMKFMEFLAKRRNFKEDVFFVTFMPP

SEQ ID NO: 167280 - protein, 228 aa, Glycine max
  Coding DNA Sequence Number=SeqID_50502
  Gene Ontology: Mol. function=two-component response regulator activity; Cellular component=intracellular; Biological process=two -component signal transduction system (phosphorelay)
  Homolog annotation: Hit_ID=Q8XR79; Match level="QueryCoverage=95%, HitCoverage=99%, E-value=2e-80, Identity=72%"; Hit description =Probable nitrate/nitrite response regulator transcription regulator protein
RRAISGRIVAVQAVLDGVDRDLHAAGEVQLLQHVLHVDLDRAFADVEFARDDLVAGAARQALHDLAFTRRQAMAFGLAGRRLRGQAGLAAELFDQLGRHALGDDGFAGRGAADGRRQGLGVDVLEQIAAGAVAQRLAQLVGFFRHGEDDHRTGRQILRQQLQRLQPRQARHVQVQQHHVGLEFLGALQAFDAIAGLGHDLEIGLALQQQAHARTEQGVVIDEQDTDGH

SEQ ID NO: 167281 - protein, 69 aa, Glycine max
  Coding DNA Sequence Number=SeqID_50503
MILVKERKLLEFMCMVKREAGTDSFNAEFPPTHAKKGRGSSRKRRNGGYRRGSTSLPDVTTIFGGFDGM

SEQ ID NO: 167282 - protein, 142 aa, Glycine max
  Coding DNA Sequence Number=SeqID_50504
  Gene Ontology: Mol. function=nucleotide binding; Cellular component =membrane; Biological process=small GTPase mediated signal transduction
  Homolog annotation: Hit_ID=Q40207; Match level="QueryCoverage=83%, HitCoverage=57%, E-value=2e-60, Identity=93%"; Hit description=RAB1Y
  Pfam annotation: Domain name=Ras; Domain location=1-110; Score=22.7; E_value=5.7e-11; Accession=PF00071.12; Description=Ras family
MAAISVLDALCLMVLGNQEVALPIYDVTRRDTFTNLSEIWAKEIDLYSTNQDCIKMLVGNKVDKEGDRVVTKKEGIDFAREYGCLFIECSAKTRVNVQQCFEELVLKILDTPSLIAEGSKGVKKNIFKERPPQSDASTSSCC

SEQ ID NO: 167283 - protein, 666 aa, Glycine max
  Coding DNA Sequence Number=SeqID_50505
  Gene Ontology: Mol. function=protein serine/threonine kinase activity; Cellular component=cell; Biological process=protein amino acid phosphorylation
  Homolog annotation: Hit_ID=Q75PK5; Match level="QueryCoverage=72%, HitCoverage=74%, E-value=1e-177, Identity=66%"; Hit description =Mitogen-activated kinase kinase kinase alpha
  Pfam annotation: Domain name=Pkinase; Domain location=234-516; Score =289.9; E_value=4.8e-84; Accession=PF00069.15; Description=Protein kinase domain
  Pfam annotation: Domain name=Pkinase_Tyr; Domain location=234-516; Score=121.6; E_value=2.3e-33; Accession=PF07714.7; Description =Protein tyrosine kinase
  Pfam module annotation: Pfam domain module=Pkinase::Pkinase_Tyr; Domain location=234-516::234-516
MPAWWNRKWSKSKEEDEEDEPRAGFHLNFMKSPVSVTSSKSKSKTTTPTPMKKKKKPKSFDEKVEGVPLPRPAHSHADPLGSVSVSGGSSVSSSTSFDDHPISSPNTNPNPNRKLQTNAADVVTKRPNSLTSRMKSWLWTIFETLFFRNCILGGHDEVRVNVRSKSPGPGSRGPTSPTSPLHQRLNNLSLDSPTGSQCHPLPLPPGSPTSPSSVLSNARANAHLENATSNVSKWRKGKLLGRGTFGHVYLGFNRLCIRLNVYILDRLLKPISFPLPMFDSENGQMCAIKEVKVVSDDQTSKECLKQLNQEINLLNQLSHPNIVQYHGSELVEESLSVYLEYVSGGSIHKLLQEYGSFKEPVIQNYTRQIVSGLAYLHGRNTVHRDIKGANILVDPNGEIKLADFGMAKHINSSASMLSFKGSPYWMAPEVVMNTNGYSLPVDIWSLGCTIIEMATSKPPWNQYEGVAAIFKIGNSKDMPEIPEHLSNDAKNFIKLCLQRDPLARPTAHKLLDHPFIRDQSATKAANVSITRDAFPCMFDGSRTPPVLESHSNRTSITSLDGDFASKPALAAPRALRSPRDNTRMITSLPVSPSSSPLRRYGPTHQSCFFSPPHPAYTIMGQSSYTLNDISSYPMTSNATFALDPWHETSRYRANTPPGGSPRMRLI

SEQ ID NO: 167284 - protein, 71 aa, Glycine max
  Coding DNA Sequence Number=SeqID_50506
MAINSTFTSKWAHVLGLYGKRESYNTKGIFITSDDIVSQILMVRMFRDEFQTWCSNFLMIQRLTSLRSSFY

SEQ ID NO: 167285 - protein, 101 aa, Glycine max
  Coding DNA Sequence Number=SeqID_50507
MKRKSRTTKNKDLRLGNLEARSGAALPESQLFSSLLSRWFEEVTAFPVETMVLGFGEEGDGGGQGGIKKPQRTVTGKIVGEGCGSSINCLIVINKSNGSKL

SEQ ID NO: 167286 - protein, 1285 aa, Glycine max
  Coding DNA Sequence Number=SeqID_50508
  Gene Ontology: Mol. function=solute:hydrogen antiporter activity; Cellular component=integral to membrane; Biological process =regulation of pH
  Homolog annotation: Hit_ID=Q9SIT5; Match level="QueryCoverage=61%, HitCoverage=94%, E-value=0.0, Identity=59%"; Hit description =Putative Na/H antiporter
  Pfam annotation: Domain name=Na_H_Exchanger; Domain location=26-416; Score=211.5; E_value=2e-60; Accession=PF00999.11; Description =Sodiumhydrogen exchanger family
MITTEGIWNNDDPLKYSLPLFILQLMLIVIVTRLFVFILKPLRQPRVISEMLGGILLGPTFLGKNTVFFDAVFPSRSRMLIETMSNVGILYFMFLVGVGMDASALRNIGRKAVAIAILGMILPFSLGALFASFLIRLSEEDSRSGAYIIFLGAILSVASFPVLARILAELKFINTELGRVALSSALVNDIISWMLLIASITMVENEKPSLSILMVFGSCAAFIAFNIFAVRPLILLIIRKTPEGEAFSDFYICLILSGVMISGLITDAIGTHAIFGAYIFGLTIPNGPLGLTLVERLEDFISLLLLPLFFATTGLRTDLGLLRGFYSWAILISLIALSCIAKIVGTMVAAVYYQMSIREGAVLGLLMNTKGVIEVIVLNIGKDQKVLTDESFASMVIITLLMTGIIVPGISAIYKTSKGIIPYKRRNIQMSQTDTEFRVLVCIHSPRNVPTMINLLDASNPTKNSPICIYVLHLTELAGHASALLVVHNQYGKKSDQIGNGGYNRTQAQSDHIINAFENYVQQASHISVQPMSVVSPYSTMHEDICNVAQDKRVAFIVVPFHKQQMVDGGMQDMNTSFRTVNRNVLTKAPCSVGILVDRGFNFCNHLAPDQKAHHVAVLFFGGPDDRESLSYGWRMSEHQSINLTVMRFVHEEEVMHCHSHSGGDRDDEPSVLTVKTDKDTQKQIDEKFIHWFMTSHADDGGSVVYVEKRVNNGEQTVAAIRSMDDVHGLFIVGRSYGISSPLTAGFTDWSEYPELGAIGDLLASSDFAATASVLIVQQYVGEGIEGDHVVKGNITALGLGAGDGVSSESVVAISSASGAGGLLRIIVVGAGARESAGAGVGVSIAGVGAGVGVLLSGAGAGVSLAGVGALDGVGDTFGVGNGGASAGGNGSGGGEMGAFLGGILGDGGFGLNAGVTLGTGGFTGAIFGGKVLGTGGFTGAIFGGVVLGTGGFSGVEVGGKALGTGNLTGADDGGKGLVSGNFTGAEVGVVTLGTGNLTGADVVGDVAFGSGDFTGADVVGDVAFGSGDFTGADVVGDVAFGSGDFTGADVVGDVAFGSGDFTGADIVGDVAFGSGDFTGADVVGDVAFGTGDFTGTYDVGDVVLGTGDFTGADDVGDVAFGTVGEAAVGNLEGAAVVVGVEVGEVAAVGGFFEVEGVAATTGCCLATDGLLEEGEVAVGNVEGAVGFVVGNVEGAFGVVVGNVEGATGVVEGNVEGAFGVVVGNVDGAFGVVEGNVDGAYVVVVGNVESAFGVVVGKLEGAEGVEGCQLEGVPVGAWALIVASG

SEQ ID NO: 167287 - protein, 205 aa, Glycine max
  Coding DNA Sequence Number=SeqID_50509
  Gene Ontology: Mol. function=DNA binding; Cellular component=nucleus; Biological process=regulation of transcription
  Homolog annotation: Hit_ID=Q9FLG5; Match level="QueryCoverage=94%, HitCoverage=96%, E-value=6e-47, Identity=50%"; Hit description =Similarity to NAM
  Pfam annotation: Domain name=NAM; Domain location=8-125; Score=126.1; E_value=1e-34; Accession=PF02365.6; Description=No apical meristem (NAM) protein
MACGSVNLPPGFCFSPTDEELVLHFLCSKASLPCHPNIIPELDLSLLDPWELNGKALSSGNQHYFFTKVKENRSTENGYWKEIGVMEPIVSSSEKVGIKKYLVFNLGEAPQGTETSWVMQEYHICSSGFNTTTASNCASTRGRRKTDQCGSKWVLCKAYEKKSCQSQQGVNCYSDEDDCGTELSWLDEFYMSLDDDLEEVMSLPS

SEQ ID NO: 167288 - protein, 222 aa, Glycine max
  Coding DNA Sequence Number=SeqID_50510
  Homolog annotation: Hit_ID=Q9LVN4; Match level="QueryCoverage=65%, HitCoverage=60%, E-value=2e-29, Identity=48%"; Hit description =Arabidopsis thaliana genomic DNA, chromosome 5, P1 clone:MBM17
MAFEDFDPIFSKPKVKWDSESCSSSCPFFLHAYAPDSSHLVIHVTNIYDAWETRLSLSMLEDIRDIVGIGGSWSDFADYFLTSLKSQDLKLVLEPDSNSDGVSHVKLVAQKSKGMPLITIPLTKLMDSAAMEVKLNFCSSLFEAFEIKSTECSLEKANMNTLSIPIRKEMKPYNWNSDKSFKRLATQRMAFLLMDCKTLQVLPTSLWYYGIHGELVSKMSQG

SEQ ID NO: 167289 - protein, 52 aa, Glycine max
  Coding DNA Sequence Number=SeqID_50511
MVLDSATDSKTMCGSKGLSCKDTQLYTKHSLTSVALPIANSNCKTKDAKSAL

SEQ ID NO: 167290 - protein, 649 aa, Glycine max
  Coding DNA Sequence Number=SeqID_50512
  Gene Ontology: Mol. function=nucleoside-triphosphatase activity; Cellular component=integral to membrane; Biological process=transport
  Homolog annotation: Hit_ID=Q9SIT6; Match level="QueryCoverage=98%, HitCoverage=98%, E-value=0.0, Identity=69%"; Hit description=White -brown complex homolog protein 5
  Pfam annotation: Domain name=ABC2_membrane; Domain location=369-579; Score=191.0; E_value=2.9e-54; Accession=PF01061.14; Description=ABC -2 type transporter
  Pfam annotation: Domain name=ABC_tran; Domain location=72-258; Score =167.6; E_value=3.2e-47; Accession=PF00005.17; Description=ABC transporter
  Pfam annotation: Domain name=MobB; Domain location=72-183; Score= -39.7; E_value=0.081; Accession=PF03205.4; Description=Molybdopterin guanine dinucleotide synthesis protein B
  Pfam module annotation: Pfam domain module=ABC2_membrane::ABC _tran::MobB; Domain location=369-579::72-258::72-183
MMQGCEVDAIGINYTIHTHKSEHPFKIFSNKSAHLDTEQDGKEPEEEAEVEQSCSGVRHVLKNVSFQAKPWEILAIVGPSGAGKSSLLEILAGKHSPQSGTVFLNHKPVDKAQFRKLSGYVTQKDTLFPLLTVEETLMFSAKLRLKLSQEQLCSRVKSLIQELGLDNVAGTRIGDDRVRGISGGERRRVSIGVEVIHDPKVLILDEPTSGLDSTSALQIIDMLKVMADTRGRTIILSIHQPGFRIVKLFNSLLLLANGSVLHHGTADLLSVNLRLMGLELPLHVNVVEFAIESIDTIQQQQKCVPVQVETPRQLPGTIQQKKGGDGEAGEGRNGKLTLQQLFQQSKVIDEQTMYAGMDFTSEFANSRLRETMILSHRFSMNIFRTKELFACRTVQMLVSGLVVGSIFCNLKDDLEGAFERVGLFAFILTFLLSSSIEALPIFLQEREILMKETSCGSYRVSSYAIANGLVYLPFLLILAILFSMPLYWLVGLNRNFLAFLHFLLLIWLILYTANSVVVCFSALVPNFIVGNSVIAGVIGSFFLFSGYFISKQEIPNYWIFMHYISLFKYPFEGFLINEFSNSGKCLEYMFGACIKSGEDVLKEEGYGGESNRWKNVGVTVCFILVYRFISYVILRYRCSQRGFGRVVTN

SEQ ID NO: 167291 - protein, 77 aa, Glycine max
  Coding DNA Sequence Number=SeqID_50513
  Homolog annotation: Hit_ID=Q9LVN3; Match level="QueryCoverage=99%, HitCoverage=26%, E-value=3e-26, Identity=81%"; Hit description =Arabidopsis thaliana genomic DNA, chromosome 5, P1 clone:MBM17
MATGGEESPEVQNVGWEYGLVKPRGAIRPDGWAYRFPKTNTTILYYWSASLCDLQPFNITDKQTNDTTGTGGSLMRT

SEQ ID NO: 167292 - protein, 117 aa, Glycine max
  Coding DNA Sequence Number=SeqID_50514
MALCSVFLNLHLLLFVSLTIEALGVAKPLVASYLSQEILAEQEADRVHGLLAQPPVKFNNMVVISLSMKLQEEHCSIGVVIVIKHLIFLDVKNHKPEGLEVSAVGVNIDNHINEGGG

SEQ ID NO: 167293 - protein, 68 aa, Glycine max
  Coding DNA Sequence Number=SeqID_50515
MRHRVEVSGVSQLQIHCVVGGKDEVSPALEEEEEDGRGGDDAIVLLVLSHSLFTTPPRIQLKDAVFGR

SEQ ID NO: 167294 - protein, 206 aa, Glycine max
  Coding DNA Sequence Number=SeqID_50516
  Homolog annotation: Hit_ID=Q5ZFS7; Match level="QueryCoverage=47%, HitCoverage=34%, E-value=2e-18, Identity=51%"; Hit description =Nodulin-like protein
MWFANDTQLDIDIITTIRKKWATFFLKTTITIVPPSLPLQQLSEQMKCRQSLDGCLVEAPDFQFPQTCAVMCDKQHAPCYDICHGCYFQVIGTVVTLAGAMLMTLYKGQVISFLGSKYMHHPTNYVPKNNTDSGEKDWFKGSVLLAVTLRKYPAQLSLTALPFDDDYRSHHGCLHPCRKNISWRLISGVIRAILIVMGLHSFRLEQ

SEQ ID NO: 167295 - protein, 35 aa, Glycine max
  Coding DNA Sequence Number=SeqID_50517
MLDSVIEVGATRVMVKCGESDNGNRSSGGKIRGLD

SEQ ID NO: 167296 - protein, 63 aa, Glycine max
  Coding DNA Sequence Number=SeqID_50518
MEERLLVSDSVDERQRSPWQPVHVHSSNSLTCFMELNMVLVDESLGVERPLIGKRKKLKMSRF

SEQ ID NO: 167297 - protein, 330 aa, Glycine max
  Coding DNA Sequence Number=SeqID_50519
  Gene Ontology: Mol. function=protein kinase activity; Cellular component=integral to membrane; Biological process=protein amino acid phosphorylation
  Homolog annotation: Hit_ID=Q9FL51; Match level="QueryCoverage=89%, HitCoverage=53%, E-value=9e-89, Identity=37%"; Hit description =Receptor protein kinase-like protein
  Pfam annotation: Domain name=LRRNT_2; Domain location=27-68; Score =57.2; E_value=5.3e-14; Accession=PF08263.3; Description=Leucine rich repeat N-terminal domain
  Pfam annotation: Domain name=LRR_1; Domain location=122-144; Score =11.6; E_value=1.9; Accession=PF00560.23; Description=Leucine Rich Repeat
  Pfam annotation: Domain name=LRR_1; Domain location=146-168; Score =19.3; E_value=0.014; Accession=PF00560.23; Description=Leucine Rich Repeat
  Pfam annotation: Domain name=LRR_1; Domain location=170-192; Score =17.2; E_value=0.06; Accession=PF00560.23; Description=Leucine Rich Repeat
  Pfam annotation: Domain name=LRR_1; Domain location=194-217; Score =13.6; E_value=0.72; Accession=PF00560.23; Description=Leucine Rich Repeat
  Pfam annotation: Domain name=LRR_1; Domain location=219-241; Score =9.2; E_value=5.4; Accession=PF00560.23; Description=Leucine Rich Repeat
  Pfam annotation: Domain name=LRR_1; Domain location=243-265; Score =12.4; E_value=1.3; Accession=PF00560.23; Description=Leucine Rich Repeat
  Pfam annotation: Domain name=LRR_1; Domain location=269-292; Score =9.1; E_value=5.6; Accession=PF00560.23; Description=Leucine Rich Repeat
  Pfam annotation: Domain name=LRR_1; Domain location=294-316; Score =3.6; E_value=61; Accession=PF00560.23; Description=Leucine Rich Repeat
  Pfam annotation: Domain name=LRR_1; Domain location=74-96; Score=7.1; E_value=13; Accession=PF00560.23; Description=Leucine Rich Repeat
  Pfam annotation: Domain name=LRR_1; Domain location=98-120; Score =10.0; E_value=3.9; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1; Domain location =27-68::122-144::146-168::170-192::194-217::219-241::243-265::269 -292::294-316::74-96::98-120
MATTTFCTYLFLLLSVYLSIFINLSSSSSEGDILLSFKASIEDSKKALSSWFNTSSNHHCNWTGITCSTTPSLSVTSINLQSLNLSGDISSSICDLPNLSYLNLADNIFNQPIPLHLSQCSSLETLNLSTNLIWGTIPSQISQFGSLKVLDLSRNHIEGNIPESIGSLKNLQVLNLGSNLLSGSVPAVFGNLTKLEVLDLSQNPYLVSEIPEDIGELGNLKQLLLQSSSFQGGIPESLVGLVSLTHLDLSENNLTGGVTKALQPSSLKNLVSLDVSQNKLLGPFPSGICRGQGLIINLSLHTNAFTGSIPNSIGECKSLERFQVQNNGFS

SEQ ID NO: 167298 - protein, 493 aa, Glycine max
  Coding DNA Sequence Number=SeqID_50520
  Gene Ontology: Mol. function=protein kinase activity; Cellular component=integral to membrane; Biological process=protein amino acid phosphorylation
  Homolog annotation: Hit_ID=Q9FL51; Match level="QueryCoverage=92%, HitCoverage=52%, E-value=1e-163, Identity=64%"; Hit description =Receptor protein kinase-like protein
  Pfam annotation: Domain name=LRRNT_2; Domain location=26-67; Score =55.2; E_value=2.1e-13; Accession=PF08263.3; Description=Leucine rich repeat N-terminal domain
  Pfam annotation: Domain name=LRR_1; Domain location=121-143; Score =11.6; E_value=1.9; Accession=PF00560.23; Description=Leucine Rich Repeat
  Pfam annotation: Domain name=LRR_1; Domain location=145-167; Score =19.8; E_value=0.01; Accession=PF00560.23; Description=Leucine Rich Repeat
  Pfam annotation: Domain name=LRR_1; Domain location=169-191; Score =17.2; E_value=0.06; Accession=PF00560.23; Description=Leucine Rich Repeat
  Pfam annotation: Domain name=LRR_1; Domain location=193-216; Score =13.6; E_value=0.72; Accession=PF00560.23; Description=Leucine Rich Repeat
  Pfam annotation: Domain name=LRR_1; Domain location=218-240; Score =7.1; E_value=13; Accession=PF00560.23; Description=Leucine Rich Repeat
  Pfam annotation: Domain name=LRR_1; Domain location=242-264; Score =15.9; E_value=0.15; Accession=PF00560.23; Description=Leucine Rich Repeat
  Pfam annotation: Domain name=LRR_1; Domain location=267-290; Score =9.6; E_value=4.5; Accession=PF00560.23; Description=Leucine Rich Repeat
  Pfam annotation: Domain name=LRR_1; Domain location=291-313; Score =4.5; E_value=41; Accession=PF00560.23; Description=Leucine Rich Repeat
  Pfam annotation: Domain name=LRR_1; Domain location=315-337; Score =9.4; E_value=5; Accession=PF00560.23; Description=Leucine Rich Repeat
  Pfam annotation: Domain name=LRR_1; Domain location=339-361; Score =5.8; E_value=24; Accession=PF00560.23; Description=Leucine Rich Repeat
  Pfam annotation: Domain name=LRR_1; Domain location=363-385; Score =8.4; E_value=7.7; Accession=PF00560.23; Description=Leucine Rich Repeat
  Pfam annotation: Domain name=LRR_1; Domain location=387-409; Score =1.2; E_value=1.7e+02; Accession=PF00560.23; Description=Leucine Rich Repeat
  Pfam annotation: Domain name=LRR_1; Domain location=411-432; Score =8.2; E_value=8.5; Accession=PF00560.23; Description=Leucine Rich Repeat
  Pfam annotation: Domain name=LRR_1; Domain location=434-456; Score =16.7; E_value=0.087; Accession=PF00560.23; Description=Leucine Rich Repeat
  Pfam annotation: Domain name=LRR_1; Domain location=458-480; Score =20.9; E_value=0.0044; Accession=PF00560.23; Description=Leucine Rich Repeat
  Pfam annotation: Domain name=LRR_1; Domain location=73-95; Score=7.1; E_value=13; Accession=PF00560.23; Description=Leucine Rich Repeat
  Pfam annotation: Domain name=LRR_1; Domain location=97-119; Score =10.0; E_value=3.9; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1; Domain location=26-67::121-143::145 -167::169-191:...
  Pfam module annotation: Domain location=:193-216::218-240::242 -264::267-290::291-313::315-337::339-361::363-385::387-409::411 -432::434-456::458-480::73-95::97-119
  Subcellular localization annotation: CTP_CleavageSite=65; ConfidenceScore=5.05e-01
MATTTFCTYLFLLSVYLSIFINLSSSSSEGNILLSFKASIEDSKRALSSWSNTSSNHHCNWTGITCSTTPSLSVTSINLQSLNLSGDISSSICDLPNLSYLNLADNIFNQPIPLHLSQCSSLETLNLSTNLIWGTIPSQISQFGSLRVLDLSRNHIEGNIPESIGSLKNLQVLNLGSNLLSGSVPAVFGNLTKLEVLDLSQNPYLVSEIPEDIGELGNLKQLLLQSSSFQGGIPDSLVGIVSLTHLDLSENNLTGGVPKALPSSLKNLVSLDVSQNKLLGEFPSGICKGQGLINLGLHTNAFTGSIPTSIGECKSLERFQVQNNGFSGDFPLGLWSLPKIKLIRAENNRFSGQIPESVSGAVQLEQVQLDNNSFAGKIPQGLGLVKSLYRFSASLNRFYGELPPNFCDSPVMSIVNLSHNSLSGEIPELKKCRKLVSLSLADNSLTGDIPSSLAELPVLTYLDLSHNNLTGSIPQGLQNLKLALFNVSFNQLS

SEQ ID NO: 167299 - protein, 265 aa, Glycine max
  Coding DNA Sequence Number=SeqID_50521
  Gene Ontology: Mol. function=protein kinase activity; Cellular component=integral to membrane; Biological process=protein amino acid phosphorylation
  Homolog annotation: Hit_ID=Q9FL51; Match level="QueryCoverage=92%, HitCoverage=28%, E-value=2e-83, Identity=63%"; Hit description =Receptor protein kinase-like protein
  Pfam annotation: Domain name=Pkinase; Domain location=1-242; Score =48.0; E_value=2e-11; Accession=PF00069.15; Description=Protein kinase domain
  Pfam annotation: Domain name=Pkinase_Tyr; Domain location=1-242; Score=2.9; E_value=1.2e-12; Accession=PF07714.7; Description=Protein tyrosine kinase
  Pfam module annotation: Pfam domain module=Pkinase::Pkinase_Tyr; Domain location=1-242::1-242
VKKLVNFGNQSSKSLKAEVKTLAKIRHKNVVKILGFCHSDESVFLIYEYLHGGSLEDLISSPNFQLQWGIRLRIAIGVAQGLAYLHKDYVPHLLHRNVKSSNILLDANFEPKLTDFALDRVVGEAAFQSVLNSEAASSCYIAPENGYTKKATEQLDVYSFGVVLLELVSGRQAEQTESNDSLDIVKWVRRKVNITNGVQQVLDPKISHTCHQEMIGALDIALHCTSVVPEKRPSMVEVLRGLHSLESRTCIANLHEPNEEPSIPV

SEQ ID NO: 167300 - protein, 77 aa, Glycine max
  Coding DNA Sequence Number=SeqID_50522
MVEDAQTALDSQFMGLRTRWMHEQRLKINSWGYGLDGGGCMNDNQFMGLQIRFDDGGCTNSARQSIRGDPDSMVEDA

SEQ ID NO: 167301 - protein, 323 aa, Glycine max
  Coding DNA Sequence Number=SeqID_50523
  Gene Ontology: Mol. function=sequence-specific DNA binding; Cellular component=intracellular; Biological process=regulation of transcription, DNA-dependent
  Homolog annotation: Hit_ID=Q26LA3; Match level="QueryCoverage=95%, HitCoverage=83%, E-value=4e-51, Identity=37%"; Hit description=Helix- turn-helix, AraC type
  Pfam annotation: Domain name=DJ-1_PfpI; Domain location=37-174; Score= -1.8; E_value=0.0027; Accession=PF01965.14; Description=DJ-1PfpI family
  Pfam annotation: Domain name=HTH_AraC; Domain location=216-262; Score= 14.4; E_value=0.059; Accession=PF00165.13; Description=Bacterial regulatory helix-turn-helix proteins, araC family
  Pfam annotation: Domain name=HTH_AraC; Domain location=268-312; Score= 46.5; E_value=9e-11; Accession=PF00165.13; Description=Bacterial regulatory helix-turn-helix proteins, araC family
  Pfam module annotation: Pfam domain module=DJ-1_PfpI::HTH_AraC::HTH _AraC; Domain location=37-174::216-262::268-312
MGFLLMKQFTLASVAGLVESLRFAADESFSSRQIFCQWEWMTCDDRPVTASCGLPVSPTAKLDFSRDWDYFVVAGGLLEETRNPPEWLLQALRDLHARNIPIITLCSGAFVAGNAGLLDNHHCAIHFTTRDEFRLRFPKAIPVIDKTYIKDGGIISCPGGMAIDLAADLIRQHCGLVRSQKVLKYLLMDAPQPAGKTKQKAPLNAPDVYENERVSKVIEFMKQHLDSPIPLADVADFAGVTFRQLNLIFTKCTGHSAAVYWRSMRLEQARKLMADSSNSINEIATATGFSDASHLISWFRKQYGETPSSFRKRRREVEKLVKE

SEQ ID NO: 167302 - protein, 298 aa, Glycine max
  Coding DNA Sequence Number=SeqID_50524
  Gene Ontology: Mol. function=transcription factor activity; Biological process=regulation of transcription, DNA-dependent
  Homolog annotation: Hit_ID=UPI00005F9E6D; Match level="QueryCoverage =69%, HitCoverage=94%, E-value=2e-62, Identity=50%"; Hit description =COG0583: Transcriptional regulator
RAEPVAQPAKKRSAQAEGAVRNQYRTAGSADWQRADRRRDPHQRQWPGGENPAAGGAAGGAAGRRVLAPRGLREAEALTHRAGDGARTGTPLRPGGGSQLRQPADPVHAIEKSGERAGRAEAGGGVAQARLARHAAPWRGAAVQYLGIGNAQGGQRALPASRLPAGGAERRSTAGGADGAYRAAFPIATAGGNRRRAADALFPPLSRSTLPRRRVDAAHTAGDGLDLPTAGGDFRRPGLRAVPARPTAIATDAGVAAAPGGHRRHAASCGGGGRYGGARHAVGAKILRRRQRVAASAK

SEQ ID NO: 167303 - protein, 71 aa, Glycine max
  Coding DNA Sequence Number=SeqID_50525
MAVSFKDEDYPRFLDMEKFKGTGQPPKGMKFIKRKRFFREATRENKLAYFGITTSQPFGGHFNRERKVAKI

SEQ ID NO: 167304 - protein, 53 aa, Glycine max
  Coding DNA Sequence Number=SeqID_50526
MEVAQLLQAPVVRRVQLQREFFIPRTDDLVKGIRILKGPIFEAYIYEWEWEWN

SEQ ID NO: 167305 - protein, 49 aa, Glycine max
  Coding DNA Sequence Number=SeqID_50527
  Subcellular localization annotation: CTP_CleavageSite=21; ConfidenceScore=5.19e-01
MSSKSINIQNALCYTTRPAPRSNNSNSSSSGTQLPTIQKVFSRRFCDDE

SEQ ID NO: 167306 - protein, 77 aa, Glycine max
  Coding DNA Sequence Number=SeqID_50528
MEKSDKRNVKEKREKKAHITWKDNDMDNSSDLENEIINLGLMAKDYESEEEMHSMICIKNMPNLPNYSHILRKIFQV

SEQ ID NO: 167307 - protein, 145 aa, Glycine max
  Coding DNA Sequence Number=SeqID_50529
  Subcellular localization annotation: CTP_CleavageSite=94; ConfidenceScore=5.24e-01
MARLNRAAAPSYLFKVCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPGIL

SEQ ID NO: 167308 - protein, 135 aa, Glycine max
  Coding DNA Sequence Number=SeqID_50530
  Subcellular localization annotation: CTP_CleavageSite=90; ConfidenceScore=5.67e-01
MPLRGRIASLCPLPSTGISLSTKVRNSVASSADIPFLLNSFPSSAILPTGTSSFGVRPALSLSPTSAFAFPFGSLDCTGSSGAVKIRPLRVMSLVPDMFVTLAEDTSSLTCTTDTSFLSSGHCVTYFHGTALSLL

SEQ ID NO: 167309 - protein, 141 aa, Glycine max
  Coding DNA Sequence Number=SeqID_50531
  Gene Ontology: Mol. function=RNA-directed DNA polymerase activity; Cellular component=intracellular; Biological process=RNA-dependent DNA replication
MVGQEDREVKPHQEETEVVNLGVGDERKEVKVTTGMSSNIRDKSVVLLRDYQDIFAWSHQDMPGLSFDIVQHRLPLNPECSPIKQKMRRTKPEMSLKIKEEMKKQFELASRPLLGTRNGLPTSCQSLKRMERGKCAWTIGI

SEQ ID NO: 167310 - protein, 89 aa, Glycine max
  Coding DNA Sequence Number=SeqID_50532
MGEGDMEDIKSEKMERDKVKIPNFQMKRDIEAYFEWEMKENARVIRKLETTTWQEMKEFMRKTFFPPFYEKDVYDELQSLTQGSTSIDK

SEQ ID NO: 167311 - protein, 73 aa, Glycine max
  Coding DNA Sequence Number=SeqID_50533
MKKMKVRSCENHPLSETLSLLRELGESGGESAMHLRAQCVISLLSESFVSSCAKHTHLTQRNSTNSPSVRTWH

SEQ ID NO: 167312 - protein, 68 aa, Glycine max
  Coding DNA Sequence Number=SeqID_50534
  Homolog annotation: Hit_ID=Q6S591; Match level="QueryCoverage=37%, HitCoverage=10%, E-value=5e-09, Identity=100%"; Hit description =JAGGED
MGSLSLFTGNKVEHCPWFVTHPCGCRKKKSGGKDGKDECGKVYECRFCSLKFCKSQALGGHMNRHRQG

SEQ ID NO: 167313 - protein, 166 aa, Glycine max
  Coding DNA Sequence Number=SeqID_50535
  Gene Ontology: Mol. function=molecular_function; Cellular component =integral to membrane; Biological process=retrograde vesicle-mediated transport, Golgi to ER
  Homolog annotation: Hit_ID=O48670; Match level="QueryCoverage=88%, HitCoverage=79%, E-value=1e-61, Identity=73%"; Hit description =Protein RER1A
  Pfam annotation: Domain name=Rer1; Domain location=2-152; Score =361.2; E_value=1.6e-105; Accession=PF03248.4; Description=Rer1 family
MLDKTTPHVLRRWIGCLVVAAVYVLRVYLVQGFYIVSYALGIYILNLLIGFLSPQVDPEISDGPTLPTRGSDEFRPFVRRLPEFKFWYSITKAFCIAFVMTFFSAFDVPVFWPILLFYWVVLFTLTMRRQISHMIKYKYVPFSFGKLDYILVANSKLKFSVLLLAL

SEQ ID NO: 167314 - protein, 47 aa, Glycine max
  Coding DNA Sequence Number=SeqID_50536
MRKIPKREGKRLAWRARLLQDEVTARLGELSSPGRAIMTPDALFCYK

SEQ ID NO: 167315 - protein, 128 aa, Glycine max
  Coding DNA Sequence Number=SeqID_50537
MEELFLVPNMVIPPKFKTLDFDKYKGTTCPKNHLKMYCRKMGLSPGTLIWNLPESILGRTKWLPSLGSISTILIWLQIGCNYRACVKKRMNLSKNTPKVKGSDSSSSAPNDREGDDNNDSRHITGVLL

SEQ ID NO: 167316 - protein, 396 aa, Glycine max
  Coding DNA Sequence Number=SeqID_50538
  Gene Ontology: Mol. function=protein serine/threonine kinase activity; Cellular component=chloroplast; Biological process=protein amino acid phosphorylation
  Homolog annotation: Hit_ID=Q06548; Match level="QueryCoverage=98%, HitCoverage=95%, E-value=1e-148, Identity=67%"; Hit description =Protein kinase APK1A, chloroplast precursor
  Pfam annotation: Domain name=Pkinase; Domain location=55-337; Score =178.7; E_value=1.5e-50; Accession=PF00069.15; Description=Protein kinase domain
  Pfam annotation: Domain name=Pkinase_Tyr; Domain location=55-337; Score=123.6; E_value=5.5e-34; Accession=PF07714.7; Description =Protein tyrosine kinase
  Pfam module annotation: Pfam domain module=Pkinase::Pkinase_Tyr; Domain location=55-337::55-337
FTSRSVSRDGYDIHSNSRNSSASIPMTPRSEGEILQSSNLKSYSYNELKMATKNFCPDSVLGEGGFGSVFKGWIDEHSLAVTRAGTGMVVAVKKLNQESFQGHKEWLAEINYLGQLQHPNLVKLIGYCLEDQHRLLVYEYMPKGSVENHLFRRGSHFQQLSWTLRLKISLGAARGLAFLHSTETKVIYRDFKTSNILLDTNYNAKLSDFGLARDGPTGDKSHVSTRVMGTHGYAAPEYLATGHLTAKSDVYSFGVVLLEMLSGRRAIDKNRPSGEQCLVEWAKPYLSNKRRVFRVMDSRLEGQYSLTQAQRAATLAFQCLAVEPKYRPNMDEVVRALEQLRESNNDQVKNGDHKKRSRVSGSGLGHHNGLPASTSKGSIDAAKKFNYPRPSASLLY

SEQ ID NO: 167317 - protein, 195 aa, Glycine max
  Coding DNA Sequence Number=SeqID_50539
  Subcellular localization annotation: CTP_CleavageSite=50; ConfidenceScore=5.05e-01
MARKAMPPLTAAGQGLSHCPYRHSNWRDMLTKHLAIGTVFSLKKMGRLAVGVAVFSLKKMGRLRVCSYEKLAFLFLFLLECELVLVLAVCFLLCAPWFKFGACFLPSSVCPYPYPSFLKVRRSARWSRWCYWRDAQSALVSLVLLAGCPVSTCLAGANGGLPVTLLVLAAPSHVSPELVAASMESLMQLATSNEK

SEQ ID NO: 167318 - protein, 71 aa, Glycine max
  Coding DNA Sequence Number=SeqID_50540
MKLSLAHQGAKRASTAKRSLRVLSAIEEFDRASISMSSAKREISALIAAVVFSQAQRKTGAKLESTYSREA

SEQ ID NO: 167319 - protein, 173 aa, Glycine max
  Coding DNA Sequence Number=SeqID_50541
  Gene Ontology: Mol. function=RNA-directed DNA polymerase activity; Biological process=RNA-dependent DNA replication
MGKLDHLEERLRAIEGGEDYAFANVEEFFLVPNIITPPMFNVSDFDKYKGTTFPKNHLKMYCRKMGAYAKDKELLIHFFQESLTGIAVTWYTNLEPSRVHSWKDLMVAFVRQYQYNSDMAPDRMQLQNICKKGARIFQRIHLKVERSGSPSGTPNDGKGDDNCDGRHITSILL

SEQ ID NO: 167320 - protein, 169 aa, Glycine max
  Coding DNA Sequence Number=SeqID_50542
MGDVEEVQEQMKAKMSTLKDQMASMMEAMLGMKRLIESNVATAAAASTATEADPVLLFTANLAHQLAPDMVGQGGNMLGNTNSLHLGYNQSAYPYGLPPNFTPPTMHGNIDHAAPPTFEGQPPQPIGGAREDPQERAQGDVDSYPLFTTEGLMPNALPQPNIAGVSQPR

SEQ ID NO: 167321 - protein, 38 aa, Glycine max
  Coding DNA Sequence Number=SeqID_50543
MGSFLEKQGSISSSILLESLARGSGNWSIPREDYIKIP

SEQ ID NO: 167322 - protein, 207 aa, Glycine max
  Coding DNA Sequence Number=SeqID_50544
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=8e-26, Identity=32%"; Hit description= UPI00006A17C9 related cluster
MRATRPRLQRLHFLTFRGLHVVTVNGLHALTFKGLYALAFRGLHAFTFRGLHVLPFRGLYALAFRGLHALTFIGLHALTFRGLHVPSFRGLHTFALRGLHALIIGGLHVLAITGLHILALRGLHILTFRGLHILTLRGLHALTFRGLHVLTFRGLHVLAFIGLHALTYRGLHVLSFRGLHTLALEGSTPSPLEGYTSSLLVGSTSAP

SEQ ID NO: 167323 - protein, 204 aa, Glycine max
  Coding DNA Sequence Number=SeqID_50545
  Homolog annotation: Hit_ID=Q2HSX6; Match level="QueryCoverage=93%, HitCoverage=72%, E-value=3e-50, Identity=47%"; Hit description =Cyclin-like F-box
MEKNMKNGLVSLLDLPEPTLDLILKCFSPNELCTVSEEWEWHITIAKEGSFLNQNTNNQTGSMGTFTGVWPNLYLGSYLEDCKVLNGQRPNNFLMSLYFSLESGRFWFPAQVYKGLMLHNALVSYDSESNTFQARYQTGGWRCLGRNIEWDMVRVPSVDSPPYVMHVSDCLDNLKPEDHIEIQWRGNTHCPYGIFLSPQGPVNL

SEQ ID NO: 167324 - protein, 97 aa, Glycine max
  Coding DNA Sequence Number=SeqID_50546
MRLILCLCENETEGRWFYREQGRARGPTTSGSACQATTSGRAWQVGTTGRAWQVGTTGRAWQVGTTGSAWQAGTTTPVTSPCPDKPRVAFWWNALLR

SEQ ID NO: 167325 - protein, 207 aa, Glycine max
  Coding DNA Sequence Number=SeqID_50547
  Homolog annotation: Hit_ID=UPI00006B5F9C; Match level="QueryCoverage =88%, HitCoverage=39%, E-value=8e-32, Identity=42%"; Hit description =putative outer membrane protein, probably involved in nutrient binding
  Pfam annotation: Domain name=SusD_RagB; Domain location=22-206; Score= -32.1; E_value=0.00039; Accession=PF07980.2; Description=RagB, SusD and hypothetical proteins
MGKYSQAAQNANAARQGYALGTEADWRNGFYDLTKTTDAMWGAVITGDNTSFVASFFAHFDNTNNSGYAGGLGIYKLIDKRLYDNISATDYRKKAFVAPGGNPSYPALPAYANLKFIDPTVTDGDYIYLRASEMYYIEAEALARSGNEPQAKAVLAQITQARDASYTTSTNTGAALITEITTQKRIEMWGEGCAWFDMKRLGVGLNR

SEQ ID NO: 167326 - protein, 93 aa, Glycine max
  Coding DNA Sequence Number=SeqID_50548
MVGYTPSSFTDLVFASKKIEVDPKRGKFDHPTRTTEKTGANEEAITLAKVHQPPFIREYDSNATCACHGEAPGRSIEHGRALKRKVQGLIDAG

SEQ ID NO: 167327 - protein, 74 aa, Glycine max
  Coding DNA Sequence Number=SeqID_50549
MTPLMKKIQGLQAPHGAYITILGAPLDLKQPKPHQILSETLEKNQKVGTLLLTLVRNFMMPLSTTPHMIRSCMP

SEQ ID NO: 167328 - protein, 128 aa, Glycine max
  Coding DNA Sequence Number=SeqID_50550
  Homolog annotation: Hit_ID=Q9PBL0; Match level="QueryCoverage=29%, HitCoverage=4%, E-value=2e-09, Identity=65%"; Hit description=Ferric enterobactin receptor
MKASPRPTATMLIRSVSWCIGTRRQSGDAPIFTDEARYGKPAVHVPWRAGLPTHFSSTPAFGAPLQQEGALLQMRPGVAGQRPALPEPRLPGVLDPPVHIRAVEAERRVVAVRQHAEGGVLQVFGAVR

SEQ ID NO: 167329 - protein, 228 aa, Glycine max
  Coding DNA Sequence Number=SeqID_50551
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=2e-21, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSFSKGYTPSPPEDYTSSPSEGYAPSASEDYTSNIQRSTCPHLLITTHRHLQRTKRPRLQRAGHPRHEMTTHPRHQRATRPHLQGTTSPRLQRSTCPHLLITTHPHLQRTKRPRLQRAGHPRHERTTRPRHQRATRPHLQGTTSPRLQRTTCPNIWRTTHPPFQRATHPHLQRTSHPSLQRDTRPPLQRATRPPLQRTTRPRLQRATRPHHQRTTRPHLKRTTRPCL

SEQ ID NO: 167330 - protein, 97 aa, Glycine max
  Coding DNA Sequence Number=SeqID_50552
GFNFSPPSQILSLPNFAYIVDGRLDGLGREADGDKVIECGVGLRDVVHTRLQGPRHRVAGQVKATVPAPRVAKAEGKATGSDVQPNTGGLGRFHHTL

SEQ ID NO: 167331 - protein, 73 aa, Glycine max
  Coding DNA Sequence Number=SeqID_50553
MYKDKLTQPWPMGSKIYAEVHENPRAFFSSSSLILLEPLAHGSGNWSLPREDCITSSVLAIGSGGQYVVMLGP

SEQ ID NO: 167332 - protein, 48 aa, Glycine max
  Coding DNA Sequence Number=SeqID_50554
MAILCVILKLEWAMAPKKFSAKRARKATTGEGSSAASQAKIEFDRHCF

SEQ ID NO: 167333 - protein, 58 aa, Glycine max
  Coding DNA Sequence Number=SeqID_50555
MKGLFVTKLESNKVLLSPIALKVVGPFLLDSNSSRDGTNPPSNSLFGNPQTRKQRDKQ

SEQ ID NO: 167334 - protein, 139 aa, Glycine max
  Coding DNA Sequence Number=SeqID_50556
MVILRLLSSRGGEPDDMRRQIMAASPMTCGDRLWSFRTPFRHPETIVSDGTQIQIMVILHLLSSKGGKPDDMRRQIMVIPHTFSPSGDNRVRWHADTNYGHSAPFRHPETIVSDGTQRQIMVILRLMSTERNEFGSIRM

SEQ ID NO: 167335 - protein, 72 aa, Glycine max
  Coding DNA Sequence Number=SeqID_50557
  Gene Ontology: Mol. function=RNA-directed DNA polymerase activity; Biological process=DNA integration
MAPIVKGDRFNLNQCPKNELERKQMRNIPYASVVGSLMYAQVCTRLDITFVVGMLARYQNNSGIEHWTTAKK

SEQ ID NO: 167336 - protein, 127 aa, Glycine max
  Coding DNA Sequence Number=SeqID_50558
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q6H7M3; Match level="QueryCoverage=97%, HitCoverage=12%, E-value=4e-52, Identity=79%"; Hit description =Putative copper-transporting P-type ATPase
MTVAMVGDGINDSPALVAADVGMAIGAGTDIAIEAADIVLVKSSLEDVITAIDLSRKTMSRIRLNYIWALGYNILGMPIAAGVLYPFAGIRLPPWLAGACMAASSLSVVSSSLLLQFYKKPLHIESS

SEQ ID NO: 167337 - protein, 104 aa, Glycine max
  Coding DNA Sequence Number=SeqID_50559
  Subcellular localization annotation: CTP_CleavageSite=53; ConfidenceScore=5.09e-01
EEKLLDSPAQAHNHSSLSAPLPPVRPLLSPQPPLLIAPPKPSLSVALPLKCLSQKELASRWERGLCFNCDEKFHRGHHPGIGSWLNSGLTGRPRPQGYTVVTPN

SEQ ID NO: 167338 - protein, 114 aa, Glycine max
  Coding DNA Sequence Number=SeqID_50560
MADKAKEMASSAHHTKSFRYAVPFGPVYCMHLLLAISLLLAIVPIRLQNNLVLKVSLIEAAPSLPRTCLQDTILPIGPKPARWSSTQIDKYLKWLKKVVEVEGHHRGPMERFEQ

SEQ ID NO: 167339 - protein, 166 aa, Glycine max
  Coding DNA Sequence Number=SeqID_50561
  Gene Ontology: Mol. function=sequence-specific DNA binding; Cellular component=nucleus; Biological process=regulation of transcription
  Homolog annotation: Hit_ID=Q1SXB7; Match level="QueryCoverage=100%, HitCoverage=93%, E-value=1e-54, Identity=67%"; Hit description=DNA -binding WRKY
  Pfam annotation: Domain name=WRKY; Domain location=129-166; Score =39.7; E_value=9.9e-09; Accession=PF03106.6; Description=WRKY DNA -binding domain
MEPTCVDTSLNLNVIPSPTHRPPRELRRLSSENKRLTETLNHLCESYVALQKHLSEFSQLRNANFDKEGTCAVPSLKRKPESENCVNLFGTECNTITEEETFKRPKHSTEPKVSKVLTRTDASDTGLYVRDGYQWRKYGQKVTRDNPSPRAYFKCSYAPSCPVKKK

SEQ ID NO: 167340 - protein, 78 aa, Glycine max
  Coding DNA Sequence Number=SeqID_50562
MVGYTPSSFADLVFAGEMIKVGLKRGKSDHHALINAKKLGQMKKPCFPPTQQCHYSANDKPSPYPPPSYPQRSSLNQP

SEQ ID NO: 167341 - protein, 165 aa, Glycine max
  Coding DNA Sequence Number=SeqID_50563
MGANRVHLVEELLKLMQPEELGLQDLKGNTVIWFATAGLAELVFRGRKTGVRSLTAGFYTGSYYTYLNSHAYQLPPENQTGLHVLAPTVGCGCQDLQEFKEWDGVGLAWNNFLENKTTFTIKRLWQRSDAILPRKGLVTRAMSKRLQEDWARAAEEDPRILMNLR

SEQ ID NO: 167342 - protein, 150 aa, Glycine max
  Coding DNA Sequence Number=SeqID_50564
  Gene Ontology: Mol. function=glutamate-5-semialdehyde dehydrogenase activity; Cellular component=cytoplasm; Biological process=amino acid biosynthetic process
  Homolog annotation: Hit_ID=Q6RUF7; Match level="QueryCoverage=54%, HitCoverage=11%, E-value=1e-19, Identity=66%"; Hit description=Delta- pyrroline-5-carboxylate synthetase
MKVGLLLSNHQQTQTTLLSPTRHRSVPLSSSIRLIQNLNLHICSYLTEQSIIDSHEIVLSNGDTGHAIKYELGFLMFDKVVVDQFAVLESLAVDVDGARGDKNNFVSDGVELLICSQRIPNFPFVNLMNLVQARGYAIECGGGDENNHEQ

SEQ ID NO: 167343 - protein, 320 aa, Glycine max
  Coding DNA Sequence Number=SeqID_50565
  Gene Ontology: Mol. function=protein transporter activity; Cellular component=nuclear pore; Biological process=protein import into nucleus, docking
  Homolog annotation: Hit_ID=Q2R300; Match level="QueryCoverage=88%, HitCoverage=27%, E-value=2e-45, Identity=41%"; Hit description =Importin, putative, expressed
  Pfam annotation: Domain name=IBN_N; Domain location=26-94; Score=5.1; E_value=0.024; Accession=PF03810.9; Description=Importin-beta N -terminal domain
  Pfam annotation: Domain name=Xpo1; Domain location=120-277; Score =85.0; E_value=2.3e-22; Accession=PF08389.2; Description=Exportin 1 -like protein
  Pfam module annotation: Pfam domain module=IBN_N::Xpo1; Domain location=26-94::120-277
MELAMKVAEAVHVLNHDTQSCNRVAANQWLVQFQQTHAAWDVATAILTADRRLPLPANFEVEFFAAQILKRKIQNEGYLLQLGAKDALLNALLLAVKRFSTGPPQVHGFSFFVILLILFSRELLTQICLALSALVLQVAAHGNPIEQLFYSLRNLQSQDDGNFAVLEMLTVLPEEVVDNQRIDSKISSLHKSHYTQELLSHTPMVLEFLLQQSETNFDGSVQQHERNRKILRCLLSWVKAGCFSEISPGTLPAHPLLNFLFNSLQVPLSFDLAIEVLVELVTKHEASYARGGLASYKLIIKGQFYGFLGAVNYIMEVGVE

SEQ ID NO: 167344 - protein, 68 aa, Glycine max
  Coding DNA Sequence Number=SeqID_50566
MDDGRGSDAWKGLIQLTSSKGVIFEGRAKLMGIGDAFKVANVVEEGESGSTDFVVRELDARHNPFMAG

SEQ ID NO: 167345 - protein, 447 aa, Glycine max
  Coding DNA Sequence Number=SeqID_50567
  Gene Ontology: Mol. function=transferase activity; Biological process= flavonoid biosynthetic process
  Homolog annotation: Hit_ID=Q94CD1; Match level="QueryCoverage=94%, HitCoverage=91%, E-value=2e-50, Identity=31%"; Hit description =Putative N-hydroxycinnamoyl/benzoyltransferase
  Pfam annotation: Domain name=Transferase; Domain location=15-445; Score=454.2; E_value=1.7e-133; Accession=PF02458.6; Description =Transferase family
MGTTCLESPPILQDPRVTILETSMVFPSKETEKRSLFLSNIDKVLNFEVETVHFFGANEDFPPAKVAKMFKNALEEALVVYDFLGGRLNLNPETKRLEIDCNGKGAGFVVASSEYKLSEIGDLVYPNPAFAQFVQKSKDFVQQNDQPLCVAQLTSFKCGGFAIGFTTSHTTFDGLSFKTFLDNLAALAANKPLAVIPCHDRHLLAARSPPRVSFPHPELIKLDKLPTGSTESGVFEATNEELNFKVFQLTSHNILSLKEKAKGSTNARATGFNVITAHLWRCKALSAPYDPSRSSIILYAMDIRPRLKPPLPKSFAGNAVLTAYAIAKCEELEKEEFSRLVEMVTEGAKRMSDEYARSMIDWGEVHSGFPHGEVLVSSWWRLGFEEVEYPWGKPKYCCPVVYHRKDIILVFPPFGGSSGDDDGINIIVALPPKEMDKFENLFYMFLN

SEQ ID NO: 167346 - protein, 225 aa, Glycine max
  Coding DNA Sequence Number=SeqID_50568
  Gene Ontology: Mol. function=aspartic-type endopeptidase activity; Biological process=transposition, DNA-mediated
MTEGLQGYVFTLTGGLVCWKSIIQSLVAMSTTEMEYMVVAKASKEVVWLVRLVKEPNIEQGEVQLHCDSESVIDLAKNQVYHAKLKHIDVRKLMTSGQILLKEVLDVTRPPTQETKVDLFIYLPRDQIFAKVEIVMHDSYFMDLTNVGAERKGYLLLGYEVVGKFDRTGNFRLWQRQAKDLLAQQGLLKALCKSKPNNMEALDLEELQEKVAVTIRLCLANKVDE

SEQ ID NO: 167347 - protein, 117 aa, Glycine max
  Coding DNA Sequence Number=SeqID_50569
  Pfam annotation: Domain name=zf-CCHC; Domain location=1-18; Score =23.2; E_value=0.00015; Accession=PF00098.13; Description=Zinc knuckle
MECYKCNQKGHFKRDFLESKKSSEGTSRSANVAETDDSNYYIEGDVYYRSGSPYTNQVILAMSIWVQIAMDNGGANGFSYRIDEDRDNFRGEGYHVDKTYFRERLLEYNNEVKAHIE

SEQ ID NO: 167348 - protein, 275 aa, Glycine max
  Coding DNA Sequence Number=SeqID_50570
  Gene Ontology: Mol. function=exonuclease activity; Cellular component= intracellular; Biological process=DNA integration
MNMACYLLNRSSQVSLDAKVTEEVWTSYSKGVMWFKFWDPFSKKMVISRDVVFDEQSMLPEIVDTTMPMSDGASPRSLEVQVDLEQLLVILGRTEPCIPRPEYNLVKDSDCHTIKPVVQYGFEVLAKLATFALFTSAGDPSTFQEVMNSQEEVKRIGAMVEKIESSQKNQTWELVEFLVEESHRMQMSVQEETSSIRKRKVVRHTSIKAMLALVASHDMHLKQMDVKTSFLHGDQEGQIYMEQLEGFNKYGLGRLVCKLKRSMYGLKQSPRIWYK

SEQ ID NO: 167349 - protein, 73 aa, Glycine max
  Coding DNA Sequence Number=SeqID_50571
MSMNAMFLIEFMELNRICVIREMSKGSNKMNYVKGTIKPNLLRKLIFEHGSGANALSVSNLKGKIKLKGYNGR

SEQ ID NO: 167350 - protein, 96 aa, Glycine max
  Coding DNA Sequence Number=SeqID_50572
MNLVHMVWSKLLRIITGSSDKVTRFFGGKVGCNPKGHGGIVGGGCNVWWFTRAQGFMKGWAKRGFCRPITISITTNNKRIATNWSTSSEFTLQVLT

SEQ ID NO: 167351 - protein, 88 aa, Glycine max
  Coding DNA Sequence Number=SeqID_50573
  Gene Ontology: Mol. function=pectinesterase activity; Cellular component=cell wall; Biological process=cell wall modification
  Homolog annotation: Hit_ID=Q9FKF3; Match level="QueryCoverage=83%, HitCoverage=25%, E-value=1e-09, Identity=54%"; Hit description =Pectin methylesterase-like protein
MASKTICTTIQIKEKRTVDPALVAAEEGVKVVKVMQDGSGKFKTITDAINNIRSGNTKRDKAFNQLVWGTRENAKLDIWGNCAAIWHC

SEQ ID NO: 167352 - protein, 167 aa, Glycine max
  Coding DNA Sequence Number=SeqID_50574
  Homolog annotation: Hit_ID=Q75PK5; Match level="QueryCoverage=54%, HitCoverage=17%, E-value=1e-07, Identity=33%"; Hit description =Mitogen-activated kinase kinase kinase alpha
MFKVINEKPGGINLRVTGRVIIVGAADAGVGNRARSENKALLDAEALRGGDRGARQGEALVDGDGGTEIAAASRGVSDDVVEALGGPVGAGLVRLDEIEVKDTGGAASSSAMRGVVVVFLRLLVLVLAGLFTPPSGHVLSYWTKHKDRVVQFKEEGESCLILNDKYV

SEQ ID NO: 167353 - protein, 264 aa, Glycine max
  Coding DNA Sequence Number=SeqID_50575
  Gene Ontology: Mol. function=transporter activity; Cellular component= membrane; Biological process=transport
  Homolog annotation: Hit_ID=Q107W9; Match level="QueryCoverage=73%, HitCoverage=80%, E-value=3e-39, Identity=45%"; Hit description=Small basic intrinsic protein 1
  Pfam annotation: Domain name=MIP; Domain location=2-212; Score= -118.6; E_value=0.048; Accession=PF00230.10; Description=Major intrinsic protein
MVGAIKAAIGDAVLTFMWVFCSSVLGIASGYITNALNLQHITYNGFPYPSFLVTTTLVFVLVFLFTIIGNVLGGASFNPTGTASFYAVGLGSDTLFSMALRFPAQAAGAAGGALAIMEVIPAKYRHMIGGPSLKVDLHTGAVAEGVLTFVITFVVLLIFLKGPRSDLLKTWLLATATVVLVMVGSAYTGPAMNPANSSVARYSTTIAASRQWAALRKLIALSIVAHCYGLRGKNCSCYISYHCSRIKNPFFGSLSEVVLCSGAV

SEQ ID NO: 167354 - protein, 110 aa, Glycine max
  Coding DNA Sequence Number=SeqID_50576
MDEKVTLVINYNGGGNAIGIKVLTLSPEKYCNHVTHGNNIPFAMHGLTERCRRKQKDLHMVFIALKMAYDKIWIGRNAAESSVPDGLHRREKRPMRVVHDLVCKGVRVGK

SEQ ID NO: 167355 - protein, 612 aa, Glycine max
  Coding DNA Sequence Number=SeqID_50577
  Gene Ontology: Mol. function=RNA-directed DNA polymerase activity; Cellular component=intracellular; Biological process=RNA-dependent DNA replication
  Homolog annotation: Hit_ID=Q5N752; Match level="QueryCoverage=70%, HitCoverage=80%, E-value=1e-125, Identity=51%"; Hit description =Pentatricopeptide (PPR) repeat-containing protein-like
  Pfam annotation: Domain name=PPR; Domain location=193-227; Score =11.1; E_value=0.36; Accession=PF01535.11; Description=PPR repeat
  Pfam annotation: Domain name=PPR; Domain location=231-265; Score=1.4; E_value=5.1; Accession=PF01535.11; Description=PPR repeat
  Pfam annotation: Domain name=PPR; Domain location=336-370; Score =41.4; E_value=3.1e-09; Accession=PF01535.11; Description=PPR repeat
  Pfam annotation: Domain name=PPR; Domain location=371-405; Score =28.7; E_value=2.1e-05; Accession=PF01535.11; Description=PPR repeat
  Pfam annotation: Domain name=PPR; Domain location=406-440; Score =40.4; E_value=6e-09; Accession=PF01535.11; Description=PPR repeat
  Pfam annotation: Domain name=PPR; Domain location=473-507; Score =18.7; E_value=0.022; Accession=PF01535.11; Description=PPR repeat
  Pfam annotation: Domain name=PPR; Domain location=508-542; Score =33.2; E_value=9.1e-07; Accession=PF01535.11; Description=PPR repeat
  Pfam module annotation: Pfam domain module=PPR::PPR::PPR::PPR::PPR::PP R::PPR; Domain location=193-227::231-265::336-370::371-405::406 -440::473-507::508-542
  Subcellular localization annotation: CTP_CleavageSite=74; ConfidenceScore=5.03e-01
MIRIRSNLPLFSVVLSRISHNSIAVNHCHIVKKPLMGATFNFFDPFKSETFLAPQKFGFSVKPFSTSSSTRSLGASTDAPAHGALGDDDDDGDGDGDEDDDDHDNNKDKNDTHCSQLHLRDDGLAKDVKTILAIMHEVGSGPSQIKQKLEHCSIVLSPELVVEVLSRTRNDWEAAFTFFLWAGKQPGYAHSVREYHSMISILGKMRKFDTAWNLIEEMRGGRNGLSLVTPQTLLIMIRKYCAVHDVARAINTFYAYKRFNFRVGLEEFHSLLSALCRYKNVQDAEYLLFCNKDVFPLDTKSFNIILNGWCNLIVSTSHAERIWHEMIKRRIQHDVVSYGSIISCYSKSSKLYKVLRMFDEMKKRKITPDRKVYNAVIYALAKGRLVKEAVNLIGTMEGNDVTPDVVTYNSLIKPLCKAHKVDEAKQLFDEMLKRHLSPTIQTFHAFFRILRTKEEVFELLDKMKELRCYPTIETYIMLIRKFCRWCQLDDVFKIWDAMREDEISHDRSSYIVLIHGLFLNGKLEEAQRYYAEMQEKGFLPEPKTEEMLQAWVSGKQATEGQEKDLEPSQLENDTLKKKVKGIPSKFDRKKAFLREPETRRVTRERGFSFWEQ

SEQ ID NO: 167356 - protein, 148 aa, Glycine max
  Coding DNA Sequence Number=SeqID_50578
  Gene Ontology: Mol. function=hydrolase activity; Cellular component =nucleus; Biological process=mRNA transport
  Homolog annotation: Hit_ID=Q9FVC3; Match level="QueryCoverage=68%, HitCoverage=22%, E-value=8e-53, Identity=100%"; Hit description =Apyrase GS50
  Subcellular localization annotation: CTP_CleavageSite=17; ConfidenceScore=5.06e-01
MSKDYLIILSLLLSTVLATASSSSSSSSLYLGKGFSHRKLSPSYHIHKTIDESYAVIFDAGSTGSRVHVYRFNQQLDLLRIGQDLELFVKTMPGLSAYAENPQDAAESLIPLLEEAEAAVPQEFHPRTPVKLGVRIPQLNIMKIILFN

SEQ ID NO: 167357 - protein, 111 aa, Glycine max
  Coding DNA Sequence Number=SeqID_50579
  Gene Ontology: Mol. function=hydrolase activity; Cellular component =nucleus; Biological process=mRNA transport
  Homolog annotation: Hit_ID=Q9FVC3; Match level="QueryCoverage=88%, HitCoverage=21%, E-value=6e-50, Identity=98%"; Hit description =Apyrase GS50
MQVTINYLLGNLGKHYSETVAVVDLGGGSVQMAYAVSETDAAKAPRAPDGVESYITEMFLRGKKYYLYVHSYLRYGMLAARAEALKVRDSENPCILAGFDGKHNFSISLYT

SEQ ID NO: 167358 - protein, 133 aa, Glycine max
  Coding DNA Sequence Number=SeqID_50580
  Gene Ontology: Mol. function=hydrolase activity; Cellular component =nucleus; Biological process=mRNA transport
  Homolog annotation: Hit_ID=Q9FVC3; Match level="QueryCoverage=99%, HitCoverage=23%, E-value=3e-52, Identity=81%"; Hit description =Apyrase GS50
AGFVDPNAPNAKVRPVDFENAAKVACNTELKDLKSIFPRVKDGDVPYICLDLVYEYTLLVDGFGMVCVPIGIAIPIYVKVDDEFHQRIDPQQEITLVRQVEYQDSLVEAAWPLGSAIEAISSLPKFEKLMYFI

SEQ ID NO: 167359 - protein, 210 aa, Glycine max
  Coding DNA Sequence Number=SeqID_50581
  Gene Ontology: Mol. function=hydrolase activity; Cellular component =nucleus; Biological process=mRNA transport
  Homolog annotation: Hit_ID=Q9FVC2; Match level="QueryCoverage=82%, HitCoverage=37%, E-value=8e-67, Identity=70%"; Hit description =Apyrase GS52
  Pfam annotation: Domain name=GDA1_CD39; Domain location=1-209; Score=- 130.6; E_value=3.9e-05; Accession=PF01150.8; Description=GDA1CD39 (nucleoside phosphatase) family
MAKLSWVCGVKAREMTKVALNYLLGNLGKVISKTVGVADLGGGSVQMAYAVSKNTAKNAPQPPEGEESYIKTLVLNGKTYDLYVHSYLHFGKEASRAEMLKVTGDSANPCILAGYNGTYTYSGVKYKALASTSGSNFDKCREVALKALKVNEPCPHQNCTFGGIWNGGGGSGQKVLYVTTSFYYLVIQLQIHFLKVDFAYVKSISANFDH

SEQ ID NO: 167360 - protein, 62 aa, Glycine max
  Coding DNA Sequence Number=SeqID_50582
MWLSECCLAKPNVACAKRRLYGLSAIRCGMHKAKPVLLAKPLYEIKVVYTKRVPISLSQLCR

SEQ ID NO: 167361 - protein, 468 aa, Glycine max
  Coding DNA Sequence Number=SeqID_50583
  Gene Ontology: Mol. function=hydrolase activity; Cellular component =nucleus; Biological process=mRNA transport
  Homolog annotation: Hit_ID=Q9FVC2; Match level="QueryCoverage=99%, HitCoverage=100%, E-value=0.0, Identity=96%"; Hit description =Apyrase GS52
  Pfam annotation: Domain name=GDA1_CD39; Domain location=49-467; Score= 567.3; E_value=1.5e-167; Accession=PF01150.8; Description=GDA1CD39 (nucleoside phosphatase) family
MVLVLWSRGTKNMDFLTLFTLLLLLFIHTALSSTQYHDGNILLTHRKIFPKQEAITSYAVIFDAGSTGSRVHVFHFDQNLDLLRIGNELEFYDKVTPGLSAYADNPQQAAESLIPLLEEAESVVPEDLYPTTPVKLGATAGLRLLEGDASERILQAVRDLLKNRSTLNTQPDAVAIIDGTQEGSYLWVTINYLLGKLGKRFSKTVGVVDLGGGSVQMAYAISRNTAKNAPKPPDGEEPYIKKLVLKGKEYDLYVHSYLHYGREASRAEILKVTDGSANPCILAGFDGTYTYSGADYKAFAPISGSSYDECREVVLQALKLNESCPHQNCTFGGIWDGGRGSGQKILFGTSSFYYLPTEIGIIDLNKPNSKIHPVDLEIEAKRACETKLEDAKSTYPNLAEDRLPYVCLDIAYQYALYTDGFGLDPWQEITVANEIEYQDALVEAAWPLGTAIEAISSLPKFDRLMYFI

SEQ ID NO: 167362 - protein, 242 aa, Glycine max
  Coding DNA Sequence Number=SeqID_50584
  Gene Ontology: Mol. function=hydrolase activity; Cellular component =nucleus; Biological process=mRNA transport
  Homolog annotation: Hit_ID=Q9FVC2; Match level="QueryCoverage=66%, HitCoverage=58%, E-value=5e-47, Identity=41%"; Hit description =Apyrase GS52
  Pfam annotation: Domain name=GDA1_CD39; Domain location=1-193; Score=- 127.7; E_value=2.9e-05; Accession=PF01150.8; Description=GDA1CD39 (nucleoside phosphatase) family
TGSRVYVFHLDQNLDLLRIGKDLDFKEKVAFNYLLGKLGEEFTKTVGVVDLGGASVQMTYAVSGTYAYSGTEYVVYPYPPISGYSYDACREIVLKAIKVNEPCPHSNCTFGGIWDDAKSAYPILTEERIPYVCMDSTYMYALLVDGFGLDPWQQITVANKILYQDALVAAAWPLGTAIEAISAMPKFERNDAARAEIFKVADGSSSPCLLAGYDGLDPFQEITVAEGIEYRDAIVETAWPGL

SEQ ID NO: 167363 - protein, 122 aa, Glycine max
  Coding DNA Sequence Number=SeqID_50585
MATTMEVMMSMKKIMGANAVTVAATNTIAKCKNKHAFPPYDLPPYYTPPNVAYTPNGNVNNSTPILVESQQPQSDHAHVSRPMGETHEMPHHNLANFEPCLGYVAEGQAVGDIPLQNTLEGP

SEQ ID NO: 167364 - protein, 133 aa, Glycine max
  Coding DNA Sequence Number=SeqID_50586
MGKLDHLEERLRAIEGGEDYVYASLEELFLVPNIITPPMFKVPDFDKYKGTTCPKNHLMIYCQKMGEYAKDEKLLIHFSKKVLLGQLSPGSMGTILIWLRIGCNYRTCAKRGMNLLKNMPKGGETWQPKWFPQ

SEQ ID NO: 167365 - protein, 308 aa, Glycine max
  Coding DNA Sequence Number=SeqID_50587
  Gene Ontology: Mol. function=4 iron, 4 sulfur cluster binding; Cellular component=integral to membrane; Biological process=electron transport
  Homolog annotation: Hit_ID=Q8UF69; Match level="QueryCoverage=100%, HitCoverage=58%, E-value=1e-156, Identity=89%"; Hit description =Nitrogen fixation protein FixG
  Pfam annotation: Domain name=Fer4; Domain location=67-90; Score=9.3; E_value=0.013; Accession=PF00037.17; Description=4Fe-4S binding domain
MIAYSTVAILTATTYVFAGLMREQVCTYMCPWPRIQAAMLDENSLVVTYNDWRGEPRSRHAKKAAAAGESVGDCVDCNACVAVCPMGIDIRDGQQLECITCALCIDACDGVMDKIGKPRGLIAYATLAEYQSNMALATGNGQHAIRPANVREEDGKFSKRVRHFNWRIIFRPRTLLYTAIWAAVGIGMLSALVTRERLALNVLHDRNPQYVLESNGSIRNGYTVRILNMVPQPRTMSLTINGLPDAVMKINGMPDAAARAFEVTVEPDEATTLKVFVTRPGGRVARAAENFEFIVSDTGGHETARYDA

SEQ ID NO: 167366 - protein, 127 aa, Glycine max
  Coding DNA Sequence Number=SeqID_50588
  Gene Ontology: Mol. function=drug transporter activity; Cellular component=membrane; Biological process=multidrug transport
  Homolog annotation: Hit_ID=Q6ZJI2; Match level="QueryCoverage=54%, HitCoverage=14%, E-value=1e-14, Identity=48%"; Hit description =Putative ripening regulated protein DDTFR18
YKADRGDFGSGGGGGGVRGVDDPAAVRVRGELPGAEQDHGDGVDRGGGTGAAHFVQLVAHSGVLVGSRQRRRGAERVVVVHRHWTAAHFFFNLIEDDTSSPSELEDERAKSVSSLSRAHYDGNEESG

SEQ ID NO: 167367 - protein, 118 aa, Glycine max
  Coding DNA Sequence Number=SeqID_50589
MDADEAMSRETNEVEFIGLGATAIDLEEPSSNTKGKRQCSTSSSTHPHKKKMGEKEGIAASLDKMANSFNRMVEKMDGKVDDEDIQEVLRETALIPDLSRQQWAKAIKWLADDPKQLL

SEQ ID NO: 167368 - protein, 167 aa, Glycine max
  Coding DNA Sequence Number=SeqID_50590
  Gene Ontology: Mol. function=helicase activity
  Homolog annotation: Hit_ID=Q9LTU4; Match level="QueryCoverage=99%, HitCoverage=11%, E-value=2e-49, Identity=52%"; Hit description =Helicase-like protein
MREWFAYRLQCRPNEGQTLLHSRKLFQQFVAKGYTMIESERLSYVRNNQKKLRVDKFCNLQQSSNAGNTEGLSKGKRIIIPSTFVGSPHYMDQLYFDGIAICSHVGFPNLFITFTCNPNWPEIHMLLTPLNLTAIDRPKIISRIFKLKYEQMLSDLTKNHLLGKVVA

SEQ ID NO: 167369 - protein, 71 aa, Glycine max
  Coding DNA Sequence Number=SeqID_50591
  Subcellular localization annotation: CTP_CleavageSite=25; ConfidenceScore=5.04e-01
MPLNKKLGIYKGKNSSKLNLHVAPCCNLPFGGRATRDSRVCLPWEENERSRHQRLFEENVSKNGKGMVCKL

SEQ ID NO: 167370 - protein, 162 aa, Glycine max
  Coding DNA Sequence Number=SeqID_50592
  Gene Ontology: Mol. function=RNA-directed DNA polymerase activity; Biological process=RNA-dependent DNA replication
MKKGKSEANREKKKETTPIEGKEVPYPLVPSQKDKERHLARFLDIFKKLEITLPFGEALQQMSLYAKFLKDMLTKKNRYIHSDKIGLEELEIMPTRITLQLADRSITRPYGVIEDVLVKVKHLIFPADFVVIDIEEDADIPLILGRPFMSIASCVVDMGKKM

SEQ ID NO: 167371 - protein, 198 aa, Glycine max
  Coding DNA Sequence Number=SeqID_50593
MVTYEAEKDVSSPLKTVEEEKAAEVIDPLGELVKNLFDIYQRPVEVSWDGAKFGINNVKDGFFITHADVSKIILGDKCLNISILQLWLMFIHDWSASIGYGSLYGFLEPQCIHNASSRRQECENYIGRWLKEAGKQIYIAPYLNQAHWQLVVLCPGDNVVVWFCSLKKKPDAAIKGAVNSAMKSVTKTAEGKPPQHGP

SEQ ID NO: 167372 - protein, 126 aa, Glycine max
  Coding DNA Sequence Number=SeqID_50594
MSMVDENFRLTAISEDDVSSHQSDNGVYIDDVGGMNNQRQIFGLSSEAVKFRPSSCTDGISRSEFEQLRALEQLKTLQEESRLVRERWRQFMESFSLSPPFGPVRHSDQDDEQDDNESDDDFNGDV

SEQ ID NO: 167373 - protein, 592 aa, Glycine max
  Coding DNA Sequence Number=SeqID_50595
  Gene Ontology: Mol. function=protein serine/threonine kinase activity; Cellular component=membrane; Biological process=protein amino acid phosphorylation
  Homolog annotation: Hit_ID=Q9ZR08; Match level="QueryCoverage=62%, HitCoverage=46%, E-value=7e-62, Identity=37%"; Hit description =Putative receptor kinase
  Pfam annotation: Domain name=B_lectin; Domain location=79-185; Score =131.5; E_value=2.3e-36; Accession=PF01453.15; Description=D-mannose binding lectin
  Pfam annotation: Domain name=PAN_2; Domain location=318-391; Score =2.5; E_value=0.00073; Accession=PF08276.2; Description=PAN-like domain
  Pfam annotation: Domain name=S_locus_glycop; Domain location=201-305; Score=8.5; E_value=8.7e-06; Accession=PF00954.11; Description=S-locus glycoprotein family
  Pfam module annotation: Pfam domain module=B_lectin::PAN_2::S_locus _glycop; Domain location=79-185::318-391::201-305
MRSSDEVLFSFFLLLALVLCFQLCSTGDTLKAGQKITLNSMENLVSSSRTFELGFFSLNDSSRVVKSYYYLGIWYQFNPQTVVWVANRDKPVLDSSGVFRIAEDGNLVVEGASKRHWSSVIEAPSSTNRTLKLLESGNLVLMDDNSGTSNYLWQSFENPTDTFLPDMKMDASLALTSWRNPTDPAPGNFTFRLLQIDERPNYAVLINHSQLYWTADGLDAEMIPKEIQLNAISFGWPQQSRLVMNYSGEIQFLEFNGTEWVKKWWKPDHKCDIRDYCGSFAICNKNNRIHCKCLPGFIPGHEGEFPLQGCKRKSTLSCVDTNVMFLNLTSIKVGNPPEQEISIEKEEECKSFCLNTNKCPESQCQAYSYTAPSYDRGSYTCKIWKQDLSTLVEEYDRGRNLSILLKTSDIAPSIAAAKFCEPCGTYIIPYPLSTGPNCGDPMYNKLYCNKSTGHVTFLMPGGISYPVTRIDEDTRTFFIETDASHSCSSRRDQNNTPNIPFNVADCIQDVVIKINWLPAPEPPCIKPIDCKKWSHSTCRTSKGGTRCLCNPNYKWNDSTMKCTQDFLPYAYECLTVPTGAEISSGPEFSKLR

SEQ ID NO: 167374 - protein, 366 aa, Glycine max
  Coding DNA Sequence Number=SeqID_50596
  Gene Ontology: Mol. function=protein serine/threonine kinase activity; Cellular component=membrane; Biological process=protein amino acid phosphorylation
  Homolog annotation: Hit_ID=Q9ZR08; Match level="QueryCoverage=90%, HitCoverage=39%, E-value=1e-128, Identity=66%"; Hit description =Putative receptor kinase
  Pfam annotation: Domain name=Pkinase; Domain location=51-322; Score =143.6; E_value=5.3e-40; Accession=PF00069.15; Description=Protein kinase domain
  Pfam annotation: Domain name=Pkinase_Tyr; Domain location=51-322; Score=115.6; E_value=1.5e-31; Accession=PF07714.7; Description =Protein tyrosine kinase
  Pfam module annotation: Pfam domain module=Pkinase::Pkinase_Tyr; Domain location=51-322::51-322
RASTQIQESLYESERHVKGLIGLGSLEEKDIEGIEVPCYTYASILAATDNFSDSNKLGRGGYGPVYKGTFPGGQDIAVKRLSSVSTQGLEEFKNEVILIAKLQHRNLVRLRGYCIKGDEKILLYEYMPNKSLDSFIFDRTRTLLLDWPIRFEIIVGIARGMLYLHQDSRLRVIHRDLKTSNILLDEEMNPKISDFGLAKIFGGKETEACTGRIVGTYGYMAPEYALDGFFSTKSDVFSFGVVLLEILSGKKNTGFYQSKQISSLLGHAWKLWTENKLLDLMDPSLCETCNENEFIKCAVIGLLCVQDEPSDRPTMSNVLFMLDIEAASMPIPTQPTFFVKKHLSSSASSSSKPDIGQFESSYQEGR

SEQ ID NO: 167375 - protein, 257 aa, Glycine max
  Coding DNA Sequence Number=SeqID_50597
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=100%, E-value=3e-29, Identity=32%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHILTIRRTTRPRLQEGYMPSLQRLHTLAMRGLHVFTFRGLHILAFRGLRALAFTGLHVLTFSGLHLLAFRGLHVLTFIGDYTSSHSEDYRSSPSEDYMSSPYEDYTSSPSEDNTCSPSEDYTSSPSEDYTSSPSEDYTPSPSEGYTAACPRLQRLHVLAMRGLHVLTFRGLHVLAFRGFHALAFTGLHVLIFRGLHVLAFRGLHTLAFKGLHTLAFKGLHALDMRGLDVLAYSGLHVLTFRGLNVLAFGGLHVLAF

SEQ ID NO: 167376 - protein, 987 aa, Glycine max
  Coding DNA Sequence Number=SeqID_50598
  Gene Ontology: Mol. function=protein serine/threonine kinase activity; Cellular component=membrane; Biological process=protein amino acid phosphorylation
  Homolog annotation: Hit_ID=Q9ZR08; Match level="QueryCoverage=93%, HitCoverage=91%, E-value=1e-129, Identity=51%"; Hit description =Putative receptor kinase
  Pfam annotation: Domain name=B_lectin; Domain location=76-183; Score =124.3; E_value=3.5e-34; Accession=PF01453.15; Description=D-mannose binding lectin
  Pfam annotation: Domain name=PAN_2; Domain location=339-408; Score= -1.2; E_value=0.0018; Accession=PF08276.2; Description=PAN-like domain
  Pfam annotation: Domain name=Pkinase; Domain location=671-942; Score =149.0; E_value=1.2e-41; Accession=PF00069.15; Description=Protein kinase domain
  Pfam annotation: Domain name=Pkinase_Tyr; Domain location=671-942; Score=119.8; E_value=7.6e-33; Accession=PF07714.7; Description =Protein tyrosine kinase
  Pfam annotation: Domain name=S_locus_glycop; Domain location=185-324; Score=30.7; E_value=2e-07; Accession=PF00954.11; Description=S-locus glycoprotein family
  Pfam module annotation: Pfam domain module=B_lectin::PAN _2::Pkinase::Pkinase_Tyr::S_locus_glycop; Domain location=76-183::339- 408::671-942::671-942::185-324
MRTDEVLFSFSLFSLVLCFQLCSTGDTLKAGQKITLNSLENLVSSNRTFELGFFPLSGSSSVVKSYLGIWYHGLEPQTVVWVANRDKPVLDSSGVFRIAEDGNLVIEGASSESYWSSKIEASSSTNRTVKLLESGNLVLMDDNLGRSNYTWQSFQHPTDTFLPGMKMDASVALISWRNSTDPAPGNFTFTMAPEDERGSFAVQKLSQIYWDLDELDRDVNSQVVSNLLGNTTTRGTGSHNFSDKTIFTSKPYNYKKSRLLMNSSGELQFLKWDEDEGQWEKHWWGPADECDIHDYCGSFGICNRNNHIGCKCLPGFAPIPEQSEGELQGHGCVRKSTSCINTDVTFLNLTNIKVGNADHEIFTETEAECQSFCISKCPLCQAYSYNRSTYSDRSPFTCNIWTQNLSYLVEEYDRGRDLSILVKRSDIAPTAKTCEPCGTYEIPYPLSTGPNCGDSMYNKFNCTKSTGQVNFMMPEGISYQVTRIEEDTRTFFIQADASYSCSSRRDQNNTPNFPFNVVDCIQDFGIVKFSWQPAPEPPCNRPMDCMNWPHSTCRETRCHCDLKYRWNNSIMSCTQEEPSREHLTHRLTLILTVTLGSMAILACITAFVLVRRKKKAHKLDRASTQIQESLYESEKRVKGLIGLGSLEEKDIEGIEVPCYTFASILAATDNFTDSNKLGRGGYGPVYKGTFPGGQDIAVKRLSSVSTQGLEEFKNEVILIAKLQHRNLVRLRGYCIKGDEKILLYEYMPNKSLDSFIFDRTRTLLLDWPIRFEIIVGIARGMLYLHQDSRLRVIHRDLKTSNILLDEEMNPKISDFGLAKIFGGKETEASTERVVGTYGYMAPEYALDGLFSFKSDVFSFGVVLLEILSGKRNTGFYQSKQISSLLGHAWKLWTENKLLDLMDPSLGETCNENQFIKCALIGLLCIQDEPGDRPTMSNVLSMLDIEAVTMPIPTPPTFFVNKRHSSSASSSSKPETSLQFDSSYQEGR

SEQ ID NO: 167377 - protein, 939 aa, Glycine max
  Coding DNA Sequence Number=SeqID_50599
  Gene Ontology: Mol. function=protein serine/threonine kinase activity; Cellular component=membrane; Biological process=protein amino acid phosphorylation
  Homolog annotation: Hit_ID=Q9ZR08; Match level="QueryCoverage=93%, HitCoverage=91%, E-value=5e-91, Identity=46%"; Hit description =Putative receptor kinase
  Pfam annotation: Domain name=B_lectin; Domain location=76-183; Score =118.1; E_value=2.6e-32; Accession=PF01453.15; Description=D-mannose binding lectin
  Pfam annotation: Domain name=PAN_2; Domain location=336-405; Score =10.7; E_value=0.0001; Accession=PF08276.2; Description=PAN-like domain
  Pfam annotation: Domain name=Pkinase; Domain location=628-868; Score =64.4; E_value=3.8e-16; Accession=PF00069.15; Description=Protein kinase domain
  Pfam annotation: Domain name=Pkinase_Tyr; Domain location=628-895; Score=0.1; E_value=1.8e-12; Accession=PF07714.7; Description=Protein tyrosine kinase
  Pfam annotation: Domain name=S_locus_glycop; Domain location=185-324; Score=22.3; E_value=8.5e-07; Accession=PF00954.11; Description=S -locus glycoprotein family
  Pfam module annotation: Pfam domain module=B_lectin::PAN _2::Pkinase::Pkinase_Tyr::S_locus_glycop; Domain location=76-183::336- 405::628-868::628-895::185-324
  Subcellular localization annotation: CTP_CleavageSite=44; ConfidenceScore=5.03e-01
MRTDEVLFSFSLFSLVLCFQLCSTGDTLKAGQKITLNSFENLVSSNRTFELGFFPLSGSSSVVKRYLGIWYHGLEPQTVVWVANRDKPVLDSNGVFRIAEDGNLVIEGASSESYWSSKIEAYSSTNRTVKLLESGNLVLMDDNLGRSNYTWQSFQHPTDTFLPGMKMDASVALISWRNSTDPAPGNFTFTMVPEDERGSFAVQKLSQIYWDLDELDRDVNSQVVSNLLGNTTTRGTRSHNFSNKTVYTSKPYNYKKSRLLMNSSGELQFLKWDEDEGQWEKRWWGPADECDIHDSCGSFGICNRNNHIGCKCLPGFAPIPEGELQGHGCVRKSTSCINTDVTFLNLTNIKVGNPDHEIFTETEAECQSFCISKCPLCQAYSYHTSTYGDRSPFTCNIWTQNLSSLVEEYDRGRDLSILVKRSDIAPTAKTCEPCGTYEIPYPLSTGPNCGDPMYNKFNCTKSTGQVNFMTPKGISYQVTRIEEDTRTFFIHTNASYSCSSRRDQSNTPNFPFNVAECIPDVGVLFRWQPAPEPPCNRPMDCMNWPYSTCRETSEGGTRCHCDLKYRWNNSIMSCTQDRASTQIQESLYESERQVKGLIGLGSLEEKDIEGIEVPCYTYASILAATDNFSDSNKLGRGGYGPVYKGTFPGGQDIAVKRLSISHIPSYNFPEVLFNHYNHNFTNLVLNLKCEMYILKDPTRTSLLDWPIRFEIIVGIARGMLYLHQDSRLRVIHRDLKTSNILLDEEMNPKISDFGLAKIFGGKETEACTGRVMGTFGYMAPEYALDGFFSTKSDVFSFGVVLLEILSGKKNTGFYQSKQISSLLGHRYADLPIISMDILYQAWKLWTENKLLDLMDPSLCETCNENEFIKCAVIGLLCVQDEPSDRPTMSNVLFMLDIEAASMPIPTQPTFFVKKHLSSSASSSSKPDIGQYESSYQEGR

SEQ ID NO: 167378 - protein, 107 aa, Glycine max
  Coding DNA Sequence Number=SeqID_50600
MKFTARECLVSSTVVVEIGEGCGRDLCRLESERECNSKGYFWKIKSKGECHSKNGNTNNNSLKLRGCLKIIVESDSMEAISTIAWGGAVAKEDSHIVSSIHLLAKQA

SEQ ID NO: 167379 - protein, 92 aa, Glycine max
  Coding DNA Sequence Number=SeqID_50601
MSHMSVGDCTITLQEVSTLLDLPIDGKPVTSAGVQDRAEYGVFQHHNKRLLDVLDKNHIEACIFNVKRYDIGRTKFDVEELFNHATHRGQKT

SEQ ID NO: 167380 - protein, 488 aa, Glycine max
  Coding DNA Sequence Number=SeqID_50602
  Gene Ontology: Mol. function=indole-3-acetic acid amido synthetase; Cellular component=cytoplasm; Biological process=response to auxin stimulus
  Homolog annotation: Hit_ID=O81829; Match level="QueryCoverage=93%, HitCoverage=75%, E-value=0.0, Identity=77%"; Hit description=Indole -3-acetic acid-amido synthetase GH3.5
  Pfam annotation: Domain name=GH3; Domain location=31-488; Score =826.8; E_value=1.1e-245; Accession=PF03321.4; Description=GH3 auxin -responsive promoter
MPKATKHLCHDPKDNLDDDDDGSNTSNNNKSALEYIEEVTSNADVIQEKVLAQILSRSAHAEYLQRHGLDGRTDRNTFKKIMPVVTYEDLKPYIDRIANGDTSPILCSKPISEFLTSSGTSGGERKLMPTIEEELERRSMLYSLLMPVMDQFVPALDKGKGMYFLFTKSEAKTPGGLLARPVLTSYYKSSHFKHRKHDPYTNYTSPNETILCPDSYQSMYSQLLCGLCQNEEVLRVGAVFASGFIRALKFLEKHFVSLCNDIRKGTLDAKINDPLVREAVMKVLKPNPTLADFVEAECMKGSWKGIVTRIWPNTKYVDVIVTGTMSQYIPILDYYSNGLPLVCTMYASSECYFGLNLNPLCDPSEVAYTLIPTMAYFEFLPLDEINGHTNSVSHLVQEQLLDLADVKLGQEYELVVTTYAGLYRYQVGDILRVAGFKNKAPQFNFVCRKNVVLSIDSDKTDEVELQNAVMSGADHLAQFGASLTEYTS

SEQ ID NO: 167381 - protein, 259 aa, Glycine max
  Coding DNA Sequence Number=SeqID_50603
  Gene Ontology: Mol. function=magnesium ion binding; Cellular component=chloroplast; Biological process=metabolic process
  Homolog annotation: Hit_ID=Q6USK1; Match level="QueryCoverage=93%, HitCoverage=42%, E-value=6e-69, Identity=51%"; Hit description =Geraniol synthase
  Pfam annotation: Domain name=Terpene_synth_C; Domain location=1-193; Score=120.6; E_value=4.4e-33; Accession=PF03936.6; Description =Terpene synthase family, metal binding domain
MFDTYGTLDELILFTKAIKRWDLDVMEQLPEYMKICYMALYNTTHEIAYKIQKDHGQTVVACLKRTWIDLIEAYLKEAKWFNNKYVPTFQQYLDNGVISSGSYLALVHASFLIGDDFSKETISMMNPPYPRLFSCSGEILRLWDDLGTSRDEQERGDNACSIQCLMTENNISDENVARRHIRKLIKNLWPELNGLSMTTTTTTLPLSVMRASLNMARTSQVIYQHGDYQSMLTVDDHVQALLFTPSINYQDESDINHVI

SEQ ID NO: 167382 - protein, 231 aa, Glycine max
  Coding DNA Sequence Number=SeqID_50604
  Gene Ontology: Mol. function=hydrolase activity
  Homolog annotation: Hit_ID=UPI00005FA563; Match level="QueryCoverage =85%, HitCoverage=76%, E-value=2e-53, Identity=52%"; Hit description =COG1073: Hydrolases of the alpha/beta superfamily
  Pfam annotation: Domain name=Peptidase_S9; Domain location=2-206; Score=-31.5; E_value=2.5e-05; Accession=PF00326.11; Description =Prolyl oligopeptidase family
VYSYFAVALAQTGFRVVMPDAEMHGARYNGDIDARMTHFWEILRQNIDEVPLLEAALRDNDWVPDERFAIAGASMGGMTALGAMARYPHLHSVACLMGSGYFMQLSQTLFPPLVAHTPEQKAALQARLAPLAAYDPCQQLAQLANRPLLLWHGEADEVVPFAETVRLEKALREAQLDSRLTFLAEKQIGHKITPPALTALRLVSGAGKSGGRQEETHTTPDRRAERLVQGF

SEQ ID NO: 167383 - protein, 58 aa, Glycine max
  Coding DNA Sequence Number=SeqID_50605
MVKEECMEVNVSSKMLAKKEIHFAIKINIKETSPLRQPPYFLFCQKTLVSTVTPLGLK

SEQ ID NO: 167384 - protein, 124 aa, Glycine max
  Coding DNA Sequence Number=SeqID_50606
  Pfam annotation: Domain name=zf-CCHC; Domain location=83-100; Score =26.5; E_value=4.2e-05; Accession=PF00098.13; Description=Zinc knuckle
MELMRIHQHEENDKKNKGITLKASSSSIHEENNKEDLNENNLEEDDDFRLFVKKFNKFMRNKGNQKRSNFNPKKKGEDSSLAPKCYECDQPGHLRFDCPVFKRRMKKSNKKSFKDKKEKKPCNT

SEQ ID NO: 167385 - protein, 114 aa, Glycine max
  Coding DNA Sequence Number=SeqID_50607
  Gene Ontology: Mol. function=magnesium ion binding; Cellular component=chloroplast; Biological process=metabolic process
  Homolog annotation: Hit_ID=Q5SBP3; Match level="QueryCoverage=99%, HitCoverage=19%, E-value=2e-23, Identity=50%"; Hit description=R -linalool synthase
GNFKESVTRDIWGMLSLYEASYLGAKGEEVLQQAMDYSRAHLCQSLSDLSPKVGSIVVEALKLPRHLRMGRLEAKNFMVEYSQASNQIPALLELARLDYDMIQSMHQKELAEIS

SEQ ID NO: 167386 - protein, 56 aa, Glycine max
  Coding DNA Sequence Number=SeqID_50608
  Subcellular localization annotation: CTP_CleavageSite=47; ConfidenceScore=5.18e-01
MAITELRVSSFTISLASHNSRPSMYQPWNLSLQTSKPGMVPNKLSIKSVAFSEKMT

SEQ ID NO: 167387 - protein, 75 aa, Glycine max
  Coding DNA Sequence Number=SeqID_50609
MKQFIKKEKEYNLTTPPKNALTQWLRPPQSLRQLLLWQKLDCDLKDNLKSSKVPEFKNSKGKYKNIDFEGLCTYC

SEQ ID NO: 167388 - protein, 84 aa, Glycine max
  Coding DNA Sequence Number=SeqID_50610
MEDCLEGPHLGKHETQLQTRKWRTHERKRNSWSSEKRGEWRIALRVRTKAIVKHSSKLESGGHMNENAIHGAPKKGGEMEDCLE

SEQ ID NO: 167389 - protein, 49 aa, Glycine max
  Coding DNA Sequence Number=SeqID_50611
  Gene Ontology: Mol. function=RNA polymerase II transcription factor activity; Cellular component=transcription factor TFIIF complex; Biological process=transcription initiation from RNA polymerase II promoter
  Homolog annotation: Hit_ID=Q5N8X8; Match level="QueryCoverage=100%, HitCoverage=17%, E-value=4e-13, Identity=67%"; Hit description =Putative transcription initiation factor IIF beta subunit
EKKKAPTKATNMKRTRRDHGKIEEIVFKIFERQPNWSLRNLIQETNQPE

SEQ ID NO: 167390 - protein, 75 aa, Glycine max
  Coding DNA Sequence Number=SeqID_50612
MASRDQVWSFCTQDTRRYLTVICTPLLGRHSCVRWQAETKFGHSAPKIRGDTLRLSAPLLLGRHSCVRWQAETKI

SEQ ID NO: 167391 - protein, 267 aa, Glycine max
  Coding DNA Sequence Number=SeqID_50613
  Homolog annotation: Hit_ID=Q1SP02; Match level="QueryCoverage=69%, HitCoverage=39%, E-value=2e-20, Identity=32%"; Hit description=IMP dehydrogenase/GMP reductase
MAGYISLLRCWIYEHFPSVHRSVVDDGYAEASPCACRWLTGKAQMTEIKGALYRARIDALTVTDVCWMSYAEHRGVRSYDLISSYTGQVRWGPIIVYLRPERVVRQIGYIQTVPPPSVRDSLTGTDIDDRWVHFSDHVAPTGELCVVPGQVAPDYMEWFFQISHPFVTPTEDTVELRPTPPPPTNDDFVEPPVAEVPIASDSPTHSVVDCTTCVRMGRIAEHLERVINLRMVTAGTNLYDIMDLCLRIARDDDPNDNLRPRQRPCIN

SEQ ID NO: 167392 - protein, 79 aa, Glycine max
  Coding DNA Sequence Number=SeqID_50614
MPLRHFTEHLVGTRLGINSKRTGTMWHAPLLQNSTKRRSKYTNEKLESLGMEYLLVGDEQKRGTESKNAKSDDPKTANS

SEQ ID NO: 167393 - protein, 86 aa, Glycine max
  Coding DNA Sequence Number=SeqID_50615
MERDEKRFEYRFCCSSEEKYVEEDKEGGIGAMDALISISEIKRKLKKKKIASYESRFDEEMSKIGRFGNGGTSQGGRGCTGVSEKR

SEQ ID NO: 167394 - protein, 97 aa, Glycine max
  Coding DNA Sequence Number=SeqID_50616
MTCCSRRNKRCRRLCQPLHAIKRSVLQIAKEWVRITIRMTKLGLCLSSGPPPLDDKRVRITVRMTKLGLCLSSGPPPLDDKKGADNRKVSPRIMGAE

SEQ ID NO: 167395 - protein, 155 aa, Glycine max
  Coding DNA Sequence Number=SeqID_50617
MIMRGQVIYSSQDKATTSPSFSESEEAKAEESSEEIYPQEEGQPIMVKEECKEISVSSKRLAKKERHFEIKTNIKEISPIRQPPHFLLCKKTLVSIVTPLRLKFIPQVKELLEEGLIHKSLNPCALLVPKIGIIWHQIPKIGGIQYKLRYSYGTP

SEQ ID NO: 167396 - protein, 305 aa, Glycine max
  Coding DNA Sequence Number=SeqID_50618
  Gene Ontology: Mol. function=chitin binding; Cellular component =extracellular region; Biological process=chitin metabolic process
  Homolog annotation: Hit_ID=UPI00006A17C9; Match level="QueryCoverage =56%, HitCoverage=98%, E-value=6e-13, Identity=30%"; Hit description =UPI00006A17C9 related cluster
  Subcellular localization annotation: CTP_CleavageSite=80; ConfidenceScore=5.01e-01
LIEARNQSWKPQGPVGLFRVHWVSLVGAIPANNRWGRLALRSLGRMLLSSNVIYICVRVVMLVRMIRTRLFAAARVKSCLSMHSSSAIASLSSCARTVGPPPISGGGPGTVWIWSPLKVRTRSPLKARACSPLKFRTCRLSKARECSPMMARTCNPLKVRTCSALMVRTCSPLKARTCSPLNGEGNEYPSPLMVRTGSPLKARTCSPLKARTACSPLMVRTCSPHKARTCSPLNGEGEDVQSSGGEGVQPSGGEDVRTCGPLNVRACSPLLARMCSPLKARTCSPLNGEGEDVQSSGGEGVQPSD

SEQ ID NO: 167397 - protein, 39 aa, Glycine max
  Coding DNA Sequence Number=SeqID_50619
MANYLGYDIYDLELIEFNNVSMLWTVVGGEVGDTSLVAR

SEQ ID NO: 167398 - protein, 117 aa, Glycine max
  Coding DNA Sequence Number=SeqID_50620
MGETHEAPRDHNLADFKTHLGYATEGQEFGGIPLPNTLGGPQYHPQPQPLHFAVGRVPPTMMEREKFDHIKESLRTIEGGGDYVFPDMAKLCLVPNVVIPPKFKVPDFDKYKGTTCP

SEQ ID NO: 167399 - protein, 94 aa, Glycine max
  Coding DNA Sequence Number=SeqID_50621
MELMRLNQHEENDKKKKGMTLKVLSSVQEERHLRVDYPSFKKRMERSKRKTFNDKKANKAYITWEDNNMDSSEDSENEVMNLSLMAKNYESEEE

SEQ ID NO: 167400 - protein, 161 aa, Glycine max
  Coding DNA Sequence Number=SeqID_50622
MTTLTWIWMTLLFSNILPNDHNANLPLQMDRTHKTPSGLEEVQQGLGVSSSGYGPLSVLQGAHSPSKESHPQRHPVDPEKSNRALGFPALVTGLYSPIGCPFPPARSRHHGIGKFAGIAPARHPVDPKKSNRVLEMPSSNYGPLSILRSACRPQQGHQAPY

SEQ ID NO: 167401 - protein, 76 aa, Glycine max
  Coding DNA Sequence Number=SeqID_50623
MARTKKTGQMTSEADSLEEQASQGSFIPHGRQDVLTVAIWATRAPWSCPCCWSRCHHQEIFWIGSTNVPQFFLPAS

SEQ ID NO: 167402 - protein, 105 aa, Glycine max
  Coding DNA Sequence Number=SeqID_50624
MLPFDFRHVAELHVLPNDEWYDSWDDLKRVFLEKFFPASRTTAIKKDISGIRQLSGESLDLAIWERSMIYAASGGALGDMTPPEARNLIEKMASNSQQFNARMML

SEQ ID NO: 167403 - protein, 84 aa, Glycine max
  Coding DNA Sequence Number=SeqID_50625
KKKEEGVQMRVVITERAGQTKSVSYLYFPLISDERFFLQKAFASGGSNLARRGELGGKLLPYFSINRGRSEEGRVQPSWHFVFS

SEQ ID NO: 167404 - protein, 118 aa, Glycine max
  Coding DNA Sequence Number=SeqID_50626
MVEALSIYKKCKGYSLDYVGSRKLINLTTLADQPNYSSAKVEEMEMTLASTVDGGKALHRNLLNAPHCNSTSLQMAMPRKKNTKSAQENEKLGEEEEEYEKRERETEALGEEEEEYEK

SEQ ID NO: 167405 - protein, 1471 aa, Glycine max
  Coding DNA Sequence Number=SeqID_50627
  Homolog annotation: Hit_ID=Q9LST1; Match level="QueryCoverage=29%, HitCoverage=40%, E-value=2e-15, Identity=24%"; Hit description =Arabidopsis thaliana genomic DNA, chromosome 5, BAC clone:F15L12
  Subcellular localization annotation: CTP_CleavageSite=71; ConfidenceScore=5.57e-01
MNFANTATNLQKQAVVKGLSKNPKTVPSNPKVGLADKCSVTRTLAKQARKHLDNSVSKTHLPSRMHQSGTEANKESEACLPQGVSDISEKKQQTQIQTTKLSGLRMPSPSLGFFSLEKTPSSHSQLQKSSKPCKPDSSNIPKLQNLETNSVNEARLPHAPGIRSQIVKGAAKNCTNVLTLLDVKSEPRMQVDNKQLAGVEVEHSSMGSEKISKQEKVENNLEHVNIKSKDQGQLHRSDNASSMENVIFPRHEKKLLSVSQTQEQSEKEADHPDVLSNEYQSVFQESQSMDSHGMQRNLLMKASISNTVHNAMGQDEDEQLKLLACDVLTSNESFVLQENHDTSFKDSRLSEEFKEYNSVETALLNYSLVDLSETVLGGSIQEIPLKNTEQVNGDATDFVTSGGDAQVHLLNGNLSVECNESTESSLEAVNQQLQGEQLKTTSAGIVGEISSSKDESHVNSCQLVHMTTLSSKGSPQKSIPEINCPAESEPKAEIEDCQFPVDDQSGFILTRPVLEGCEKVIDPIAMHESSQAFELDTLSEDCVAVSAPACNTVVSNVSQESKPFQENLHFTSQLCPMVKADFDSSKNEMSANNCCTISELQLKDEDSSKDASIHNDVSFDIPGNFEQQISKTIYSKSSKILCEGESLELNHGHLLDQGEFCEVSADFISNTKDSIIIEAGKSSGCLQHTLLAQLVQEVDHSNREIEESHVEDAQVHLFNENPVAYNCNCKHCLLVTNDKFPLSDNNNINVNSHLSDFHRPGAVVGVGSENVNNIQHLDGDRLPTSIASSEEIKKTNLSEGVLEGCDIHTSDHNASNHHIQVMPENKDENIDVDEREELLRMDDLKEGSSDILPLVEVQLNDNVISSESNSSIEVSKDSFTDMVAWKSEEHCSLSERSNFPASDNLTFNTGILQKLNQNAPHGDWPETVSATACDTKLRDDGSSRDASMHYDGQCDVTGNFEQQTSMITYSIANEMLCEDESSVQNHDHLVDQIDSSEVSADFISNTKGSIGNGAETPPGHLQHTLLAQLVQEFDHTNREIEESHLEVAQVQSFAENPVTYNCSSNHHLAVTDDKFPLADNNNINEDFHLSEFQRPGAVVGVDSQNVDNILIASSQEIKKTNLSEGALEGCDIHTSEQNASNHHIQAMPENKEGNLDVDEREELSQMDGAKKGSSDILPLVKVQLKGSQKVDNILNLDVDWLPTNIASSEEFKKKKLSEGALEGSDIHSSEHNASDHHIQAMPENKDETLDVEERAELLQMDDAKKGSSDILPLVEVLLNDNVVSSKCNFSIEVSKVSVTDVVTWKSEEHCSLSESSNLPALDDLTFNTRTPQVCEVSSLNSTIFSDEAETNNIFEKYEFPNTDMQHQSSGNIYSAEDSSKIICLEDSATKSKQEVPTVKPPPNAAPFSDEWLAAIEAAGEEILTMKSGAVQNSPPDKPQQEPGPWSPVRRKNQSIGPFDCTKHNIQHSSSE

SEQ ID NO: 167406 - protein, 271 aa, Glycine max
  Coding DNA Sequence Number=SeqID_50628
MSHHSSSVNGEGTNHKDPLSRILDELSSLKLWKEKLERKEKGKERSLSEELHDYYEGRHRSHLRPHSHRREKERKPQEANINLPYFHGKDNVEAYLNWEIRVEQQLKRKSTLKSYGSHFYPKKDQGLGILGAAPSKPKDDKGKTIEKQVPKASMQKKTSFIKQKGEKLKSVAASVSLSEALELSESHPLSETSAHLASKRNLEANLPCKHVLSTSSARPMSHLPLLALSASGSLRQRSLTCAKRENGAKHAFKDRKSFLKPEVKEKRELGR

SEQ ID NO: 167407 - protein, 119 aa, Glycine max
  Coding DNA Sequence Number=SeqID_50629
  Gene Ontology: Mol. function=dihydroneopterin triphosphate pyrophosphohydrolase activity; Cellular component=cytosol
  Homolog annotation: Hit_ID=Q9CA40; Match level="QueryCoverage=78%, HitCoverage=48%, E-value=1e-10, Identity=31%"; Hit description=Nudix hydrolase 1
LRAQLVARTTVLLAEFYVISDNTIIVTQRIIKKLPIEANFRLTNCKSTLAKPPPYTLANLVVDVEASIGGRDSVEEQVPQNLEPTKCDGWDWYEWDHLPHPLVGPLEKMVKGAFDPFPI

SEQ ID NO: 167408 - protein, 217 aa, Glycine max
  Coding DNA Sequence Number=SeqID_50630
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=28%, E-value=1e-107, Identity=84%"; Hit description =Photosystem I P700 chlorophyll a apoprotein A1
  Pfam annotation: Domain name=PsaA_PsaB; Domain location=1-217; Score=- 200.1; E_value=0.0024; Accession=PF00223.9; Description=Photosystem I psaApsaB protein
MLNHHLTGLLGLGSLSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFM

SEQ ID NO: 167409 - protein, 40 aa, Glycine max
  Coding DNA Sequence Number=SeqID_50631
MMIWEQRAKLVMATARWDDVPKGKLYKVPEFQQALPTITE

SEQ ID NO: 167410 - protein, 48 aa, Glycine max
  Coding DNA Sequence Number=SeqID_50632
VWLESGVGVLAGEEEGKGSHGRQPWAAGRTKLLGTKAKLHYANYTNRY

SEQ ID NO: 167411 - protein, 984 aa, Glycine max
  Coding DNA Sequence Number=SeqID_50633
  Gene Ontology: Mol. function=nucleic acid binding
  Homolog annotation: Hit_ID=Q1SDP2; Match level="QueryCoverage=98%, HitCoverage=86%, E-value=0.0, Identity=66%"; Hit description=RNA -binding region RNP-1 (RNA recognition motif); Aldehyde dehydrogenase
MSDEGERTCPLCAEEMDLTDQQLKPCKCGYEICVWCWHHIMDMAEKDDTEGRCPACRSPYDKEKIVGTAANCERLVNGINMEKKMKTQKAKSKSSDGRKQLSSVRVIQRNLVYIVGLPLNLADEDLLQRREYFAQYGKVLKVSMSRTAAGVIQQFPNDTCSVKYLYDQPCSNPDCLYLHEIGSQEDSFTKDEIISAYTRSRVQQITGATNNMQRRSGNVLPPPLDDNMNSSSVKPIVKNSSCNSVNIVRGSPPNGIYGKNMALPASAAWGTQASNCQPPAGGLSYPNGPSKPKPDTGCSTLAFSAAVTGSIQASDVTKRPPSSDGCHSMTPTVKSELLKPVKQYNNSVGSLVSAGEKTSASDVSPVLVNLNSQLSSLPLSRDSDGNCTTANTIYSTNMTGQSCNSGPEEAMTATNEEIQNLSNELSSINIDRNAEHCGITKPNSPPTDHALVKSPQIQGSKYNVDRFRDVITTNVTGKATLNNVACNSREQCDWKLDSQSLVSDTAEIDDDVTSFDNQRLKDPEVVCRSYLPKSTSFLHASNHSSPCLLQHGELCTAINAGSVSADDRVQNESMLHASNILCNGHPEKLVSSSSYGLLHDERNGHIIQRLVGDDVNFGHDVARDKGESSIISNILSMNFDTWDDSLTSPHNLAKLLGDNTDNRSGPLNKSSSWKGNGNNQSRFSFARQEESKIQMFDAHASYGVSHQRPNHTVFQNFAERDLYMDKLGIANGFSTGNFEEADNLVSGHPIASSNKFSAISRAQVSAPPGFSIPSRLPPPGFSSHERVEQAFDSISGNSLLDHSSLLRNSYQTPSAGNLGSAGDIEFMDPAILAVGKGRLQGALNSPALDIRSNFMPQLNYFENDARLQLLMQRSLAPQQNLRFSEIGNTFSQLGDSYAVSSRLDQSQVSNLGPFQQLSLQQSTNAVLSNGQWDGWNEVQSGNGLGVAELLRNERLGFNKFYSGYDDSKFRMPNSGDLYNRTFGM

SEQ ID NO: 167412 - protein, 56 aa, Glycine max
  Coding DNA Sequence Number=SeqID_50634
MKATPNLDNGDIEREMAAWVMLRGEEVGKHDGGKTWLAMVTQWWWFPLENGKKKRR

SEQ ID NO: 167413 - protein, 102 aa, Glycine max
  Coding DNA Sequence Number=SeqID_50635
MALLIEVTVGAVFNELLRTEIEQQNNELQLPKEELQSFIRKMEEGTQLVFECSKIRWLHFVTRAYKDMLQGQTGSVFRRARETICHRHASSDGKRSEETLLK

SEQ ID NO: 167414 - protein, 134 aa, Glycine max
  Coding DNA Sequence Number=SeqID_50636
MTLSGQNSKTSTSLPSGTLERWQRHSKRHDFGYMAVVGAAGPLQLQVLHGGKQNVRVVAGWSSRRDEVVQAIAGALGFWRDGVPTSTVFYDFHQNYNDGVIDKCHCTTNVPHKNLYNYVNATVLTTTTGSSTLT

SEQ ID NO: 167415 - protein, 422 aa, Glycine max
  Coding DNA Sequence Number=SeqID_50637
  Gene Ontology: Mol. function=transcription factor activity; Cellular component=nucleus; Biological process=regulation of transcription, DNA-dependent
  Homolog annotation: Hit_ID=Q1SDP0; Match level="QueryCoverage=95%, HitCoverage=79%, E-value=1e-124, Identity=62%"; Hit description =Pathogenesis-related transcriptional factor and ERF
  Pfam annotation: Domain name=AP2; Domain location=155-218; Score =102.9; E_value=9.8e-28; Accession=PF00847.10; Description=AP2 domain
  Pfam annotation: Domain name=AP2; Domain location=252-316; Score =80.9; E_value=4.1e-21; Accession=PF00847.10; Description=AP2 domain
  Pfam module annotation: Pfam domain module=AP2::AP2; Domain location =155-218::252-316
  Subcellular localization annotation: CTP_CleavageSite=46; ConfidenceScore=5.15e-01
MLDLNLNAEWTDSFSNGDSPLPSQKFPEGSRNQMAESGTSNSSVVNADGSSNGGGDEDSCSTRADDVYTTFNFDILKVEGANDVVTKELFPVMSEGAKGHATSSFSARNGFVDLSFDREGGDSEMKMLQPQNQPQTQTQTQQPAKKSRRGPRSRSSQYRGVTFYRRTGRWESHIWDCGKQVYLGGFDTAHAAARAYDRAAIKFRGVDADINFNLSDYEDDLKQFLTGQMKNLSKEEFVHILRRQSTGFSRGSSKYRGVTLHKCGRWEARMGQFLGKKYIYLGLFDSEVEAARAYDKAAIKCNGREAVTNFEPSTYEGEMKSAAINEGGGQNLDLNLGIATPGPGPKENWGQLHFPSIPYNTHGGRSSKMETNVNSGIGNPSLKRMVVTEDRPSLWNGMSPNFFPNGVIHLALIAYFFIEYFI

SEQ ID NO: 167416 - protein, 52 aa, Glycine max
  Coding DNA Sequence Number=SeqID_50638
MDPIGNNRMKEAILVGSVTGHRYCKKGTDIFRCWFSLYVEGHRLVEGNYRLR

SEQ ID NO: 167417 - protein, 115 aa, Glycine max
  Coding DNA Sequence Number=SeqID_50639
  Gene Ontology: Mol. function=structural constituent of ribosome; Cellular component=ribonucleoprotein complex; Biological process =translation
  Homolog annotation: Hit_ID=Q9SF35; Match level="QueryCoverage=80%, HitCoverage=98%, E-value=5e-31, Identity=57%"; Hit description=40S ribosomal protein S23-1
  Pfam annotation: Domain name=Ribosomal_S12; Domain location=28-114; Score=60.0; E_value=7.9e-15; Accession=PF00164.15; Description =Ribosomal protein S12
MEPVSFRNAISFNEIVFSDFEWKTHGMGAARKLNSHRRRQRKADKSYKKSHLGNEWKKPFAGSSHAKGIDEMLIAGFGRKGHAVGDIPGVRFKVVKVSGVSLLALFKEKKEKPRS

SEQ ID NO: 167418 - protein, 90 aa, Glycine max
  Coding DNA Sequence Number=SeqID_50640
MESIEEEQEEVAINASNETILNVVNEETYVFRESDDVSGEEDNGVEDENEDVFEDDGTLFSNNLLARLCEESVGGEPIIINGLVDIGKLI

SEQ ID NO: 167419 - protein, 47 aa, Glycine max
  Coding DNA Sequence Number=SeqID_50641
  Homolog annotation: Hit_ID=Q6L3K0; Match level="QueryCoverage=68%, HitCoverage=7%, E-value=1e-10, Identity=87%"; Hit description =Prephenate dehydratase family protein
MADGPKFRQLNTAFFRGFMVLIVNQQHRRPTQIVKLCLVNNLKPHLM

SEQ ID NO: 167420 - protein, 354 aa, Glycine max
  Coding DNA Sequence Number=SeqID_50642
  Gene Ontology: Mol. function=zinc ion binding; Cellular component =nucleus; Biological process=regulation of transcription
  Homolog annotation: Hit_ID=Q76KV2; Match level="QueryCoverage=85%, HitCoverage=99%, E-value=3e-93, Identity=61%"; Hit description=DNA binding with one finger 2 protein
  Pfam annotation: Domain name=zf-Dof; Domain location=83-145; Score =144.9; E_value=2.2e-40; Accession=PF02701.6; Description=Dof domain, zinc finger
MERCEWTRFCIWGLTKDRRRRSGLWRGSGGCVGTVGEVGSTNSCIHARGDPREKEQNWQMSSQSLENMLACSKAQQERKPRPQPEQALKCPRCDSTNTKFCYYNNYSLSQPRYFCKSCRRYWTKGGTLRNVPVGGGCRKNKRSSSSSSSTSKRVQDQAFTPNPNSLIGLPSLSYDSSDLTLALARLQKQSCGQLGYDEHDLSMLGNHHPSTPCDNILGMHHHSSSSTNPGFLDALRSGFLGTQSSNMQQNLYYGYGNGDMGEVDNGNASCGGEMMMMPYNDQEMSVASTQAVTVTTMKQEICNGREPSSESRVLWGFPWQFNNADTNMGELDSGRASWNGINSSWHGLLNSPLM

SEQ ID NO: 167421 - protein, 271 aa, Glycine max
  Coding DNA Sequence Number=SeqID_50643
  Gene Ontology: Mol. function=prephenate dehydratase activity; Cellular component=cytoplasm; Biological process=L-phenylalanine biosynthetic process
  Homolog annotation: Hit_ID=Q1SRL6; Match level="QueryCoverage=99%, HitCoverage=65%, E-value=1e-112, Identity=78%"; Hit description =Prephenate dehydratase with ACT region
  Pfam annotation: Domain name=PDT; Domain location=1-143; Score=154.7; E_value=2.4e-43; Accession=PF00800.9; Description=Prephenate dehydratase
AVERWLVDRAVLPIENSLGGSIHRNYDLLLRHSLHIVGEVNFAVCHCLMANHGVKREDLKRVLSHPQALAQCENTLTKFGLVREAVDDTAGAAKHVAYHKLQDAGAVASSAAAKIYGLNILDQDIQDDSDNVTRFLMLAREPIIPGTDRRFKTSIVFSLEEGPGILFKALAVFALRQINLTKEVTLQACFLGILCYIIYLFLQPIESRPLRNQPLRASDDSNNSKYFDYLFYVDFETSMADQSAQNALRHLKEFATFLRVLGSYPVDTSSM

SEQ ID NO: 167422 - protein, 250 aa, Glycine max
  Coding DNA Sequence Number=SeqID_50644
  Gene Ontology: Mol. function=cysteine-type peptidase activity; Cellular component=nucleus; Biological process=proteolysis
  Homolog annotation: Hit_ID=Q1SRL5; Match level="QueryCoverage=90%, HitCoverage=97%, E-value=1e-102, Identity=79%"; Hit description =Peptidase C48, SUMO/Sentrin/Ubl1
  Pfam annotation: Domain name=Peptidase_C48; Domain location=38-235; Score=22.8; E_value=1.1e-05; Accession=PF02902.9; Description=Ulp1 protease family, C-terminal catalytic domain
CIGDDLAKLVLICFHQASLYTGMRKSKADEKILSYNDVVLRRSDLHILSGPYFLNDRIIEFYFSYLSSCHPSQDILLVPPSIAFWIIQCPVAEALGDFIEPLHLPDKTLVIFPVNDNDDVDRAEGGSHWSLLAYYRNANLFVHHDSCRSMNAAPAKQLYKGIAGYMGSSGSASEASFLECTNSPMQDNGYDCGLYATAIARVICNWHVNHKNADTNDLWFSAVKEQVSPSAVASMRGEILALIRDLMARH

SEQ ID NO: 167423 - protein, 69 aa, Glycine max
  Coding DNA Sequence Number=SeqID_50645
MAATMVRWWWNRDGDSSSGRMTIPNGGDDDSSNGGMWNDGGNNDNVVGTLVVDDSNSGMVLVVTTTMMG

SEQ ID NO: 167424 - protein, 84 aa, Glycine max
  Coding DNA Sequence Number=SeqID_50646
NANDTTKGRRGLPRRSTVEQRNARLAGREEPPKHHEHADNNAEEEWNKKINRARTEEEEGAQEEGALADAKEGALTVGEEEEAG

SEQ ID NO: 167425 - protein, 81 aa, Glycine max
  Coding DNA Sequence Number=SeqID_50647
MTPRKLASKRSRKDKGWSFLRERRVQLRDDEYTDFQEEIVRRWWASLVTPMAKFDPDIVLEFYVNAWPTEEGVRDMRSWVR

SEQ ID NO: 167426 - protein, 147 aa, Glycine max
  Coding DNA Sequence Number=SeqID_50648
  Gene Ontology: Mol. function=DNA binding; Biological process=DNA integration
MSPYWVVFGKACHLLVEIEHKAYWAVKTCNFSMNQAGEERKLQLSELDEIRLEVYENAKFYKEKTKKFHDSMIIKKDFMVGQKVLLYNSKLGLMSVEIKSDSRTRASRSMDTDLSHSSNPSLVDVVVEETSLLHPTLPPPYPPSTMT

SEQ ID NO: 167427 - protein, 132 aa, Glycine max
  Coding DNA Sequence Number=SeqID_50649
  Subcellular localization annotation: CTP_CleavageSite=57; ConfidenceScore=5.65e-01
MPITRCKSISWFVSSRHGNRTHKTPSGPGKVPQGPGVSSSGYGPLSVLQGARTPPARSRHHRDRTCKTPSGPKKSNRVLELSALITGLCQFYRVPVTSCKGIRPPTDRAFIKKYCVPRQAQGETPQQHWDGW

SEQ ID NO: 167428 - protein, 301 aa, Glycine max
  Coding DNA Sequence Number=SeqID_50650
  Homolog annotation: Hit_ID=Q653U4; Match level="QueryCoverage=19%, HitCoverage=9%, E-value=4e-09, Identity=55%"; Hit description=Zinc finger (C3HC4-type RING finger) protein-like
MGKNQIVLLCYCEKLSDSGIWIDMAISVAAESKREEEKAKGVNPDNGGENPDIVPFEDNEEEEEEESDEEEESFSHGVGPAGQGRGRGRGMMWPPHMPLGRGARPMPGMQGFNPVMMGDGLSYGPVDLFGVGPRGFAPYGPRFSGDFGGPPAAMMFRGRPSQPGMFPSGGFGMMMNPGRGPFMGGMGVGGANPPRGGRPVNMPPMFPPPPPLPQNANRAAKRDQRTADRNDRFGSGSEQGKSQDMLSQSGGPDDDAQYQQGYKGNQDDHPAVNNFRNDDSESEDEAPRRSRHGEGKKKHKL

SEQ ID NO: 167429 - protein, 35 aa, Glycine max
  Coding DNA Sequence Number=SeqID_50651
MTNIGSYLYKTTVKVEPDETGRHAGIRQGSIREHL

SEQ ID NO: 167430 - protein, 100 aa, Glycine max
  Coding DNA Sequence Number=SeqID_50652
  Gene Ontology: Mol. function=peroxidase activity; Cellular component =vacuole; Biological process=response to oxidative stress
  Homolog annotation: Hit_ID=Q9XFL3; Match level="QueryCoverage=64%, HitCoverage=19%, E-value=1e-20, Identity=76%"; Hit description =Peroxidase 1
  Pfam annotation: Domain name=peroxidase; Domain location=19-100; Score=-96.9; E_value=0.062; Accession=PF00141.13; Description =Peroxidase
MSLVPSINFMRKRKRSLKCQAFLMGTDKSRGCDASILLNQTDEIDSEQTAFPNDNSIRGLDVVNKIKTRLENACPGIVSCADTLALAAEVSSELDMDHMK

SEQ ID NO: 167431 - protein, 167 aa, Glycine max
  Coding DNA Sequence Number=SeqID_50653
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=99%, HitCoverage=24%, E-value=2e-78, Identity=89%"; Hit description=DNA -directed RNA polymerase beta' chain
  Pfam annotation: Domain name=RNA_pol_Rpb1_1; Domain location=5-158; Score=-133.4; E_value=0.00053; Accession=PF04997.3; Description=RNA polymerase Rpb1, domain 1
MDSSLIEWKELGEEGSPDNENEWEDRKVGRRKNFLVRRIELAKHFLRTNIEPEWMVLCLLPVLPPELRPIIQIDGGKLMSSDINELYRRVIYRNNTLIDLLTTSRSTPGELVMCQEKLVQEAVDTLLDNGIRGQPMRDGHNKVYKSFSDIIEGKEGKISRDSTWETG

SEQ ID NO: 167432 - protein, 321 aa, Glycine max
  Coding DNA Sequence Number=SeqID_50654
  Gene Ontology: Mol. function=peroxidase activity; Cellular component =vacuole; Biological process=response to oxidative stress
  Homolog annotation: Hit_ID=O23961; Match level="QueryCoverage=87%, HitCoverage=80%, E-value=1e-130, Identity=82%"; Hit description =Peroxidase precursor
  Pfam annotation: Domain name=peroxidase; Domain location=24-262; Score=402.8; E_value=4.9e-118; Accession=PF00141.13; Description =Peroxidase
MSKISSGNYTNVQEKKLILTSSCVFVENEQEMNYVVYACGMQGCDASILLNNTATIVSEQQALPNNNSIRGLDVVNQIKTELEKACPGVVSCADILTLAAEVSSVLAHGPYLKFPLGRRDSLTANRTLANQNLPAPFFNLTQLKAAFAVQGLDTTDLVALSGAHSFGRVRCLFILDRLYNFSGTGRPDPTLDTTYLKQLRQICPQGGPPNNLVNFDPTTPDTLDKNYYSNLQVKKGLLQSDQELFSTPGADTISIVNKFSSDQIAFFKSFSASMIKMGNIGVLTGKKGEIRKQCNFVNKKSAELDIGSVASESEEGLVSSI

SEQ ID NO: 167433 - protein, 425 aa, Glycine max
  Coding DNA Sequence Number=SeqID_50655
  Gene Ontology: Mol. function=oxidoreductase activity; Cellular component=vacuole; Biological process=response to oxidative stress
  Homolog annotation: Hit_ID=O24081; Match level="QueryCoverage=99%, HitCoverage=79%, E-value=1e-103, Identity=69%"; Hit description =Peroxidase1A precursor
  Pfam annotation: Domain name=peroxidase; Domain location=135-366; Score=365.2; E_value=1e-106; Accession=PF00141.13; Description =Peroxidase
ICSNGGPESDLTNLDLTTPGTLDSSYYSNLQLQKGLLQSDQELLSANGTDIVAIVNSLTSNQTFFFENFAASMIKMANIGVLTGSDGEIRTQCNFVNGNSSALTTKESSQDGMVRWAKVMLENAGIKGGKRGWKCQGFLIIWALIKGCDASILLNDTDTIVSEQSAAPNNNSIRGLDVVNQIKTAVENACPGTVSCADILALAAQISSDLASGPVWEVPLGRRDSLTANQTLANQNLPAPTFTIDQLINSFGNQSLNITDLVALSGAHTIGRAQCRFFVDRLYNFSNTGNPDPTLNTTLLQSLQGICPNGGPGTNLTNLDLTTPDTFDSNYYSNLQLQNGLLQSDQELLSANNTDIVAIVNNFIMNQTLFFENFKASMRKMGNIGVLTGSQGEIRSQCNSVNGNSSGLTTTATKESSQDSVVSSM

SEQ ID NO: 167434 - protein, 66 aa, Glycine max
  Coding DNA Sequence Number=SeqID_50656
  Gene Ontology: Mol. function=oxidoreductase activity; Biological process=response to oxidative stress
  Homolog annotation: Hit_ID=Q18PQ8; Match level="QueryCoverage=70%, HitCoverage=13%, E-value=6e-11, Identity=68%"; Hit description =Peroxidase
MKLDFSLFLFVIHAKACGPVWEVPLRRRDGFSANQTLANENLPAPSLCIDQLISAFANQGLNITLI

SEQ ID NO: 167435 - protein, 535 aa, Glycine max
  Coding DNA Sequence Number=SeqID_50657
  Gene Ontology: Mol. function=pyruvate kinase activity; Biological process=glycolysis
  Homolog annotation: Hit_ID=Q1RYJ8; Match level="QueryCoverage=40%, HitCoverage=37%, E-value=5e-80, Identity=72%"; Hit description =Pyruvate kinase
  Pfam annotation: Domain name=PK; Domain location=131-374; Score= -13.7; E_value=4.3e-16; Accession=PF00224.11; Description=Pyruvate kinase, barrel domain
MAHLKTSRHSPMDFTMATPSPLQPLKTTIHHQPPLHLYYPPQDLFPSLPCPHPSPQPILKSSSLSQKLTHLCPSTQKLKSHYTRMEPFRKNHIDIQLLCNDETPHSYVCALWFLKQLDVYFLLFDGWVVDACQLFDDIGWVADATSARPFIKWFCSGAIRSKYLAHAQPNPHEMLPQHPTFHDSAYPKRMLDKRVAILFCATWTCVLFGKGGMMSMVVKSKTKDSVKYEVVDGGKLKSSCGADIHVIVKIESAESIPNFHSIITASNGAMVARGDLGTELPIEEVPLLQGEIINLCHTMGKAVIVATNMLDSMIVHPTPTRTEVSNIAIVVREGSDGIMLSGETAHGKFPLKVVQVMHTVALWTEATIPSGKMPPNIGQVLKNHMSEMFAYHATMMSNTLGTSIIVSTGTGFMAQVVFLDHILIVTDRVTATENGLPPHKATPLFDKLAFEKTQQALGGHVPILLLGAASSPRLVEEICFSYTGINNLVLHFICCSSGAYCSLYIYIYIVRGLNLVLIWQLDHNYHLEDNKILQA

SEQ ID NO: 167436 - protein, 270 aa, Glycine max
  Coding DNA Sequence Number=SeqID_50658
  Subcellular localization annotation: CTP_CleavageSite=54; ConfidenceScore=5.18e-01
MAGEDDSLLFDVSAASSTDVFSCSPLLPLRSNPPQSEGREGGGADSRNLSSSVSDSASKENADWNTPQKLSLEPQQMKKRKKKGGGVLNPVELSMISGTATPKAGLNLEVIHEEECVGNSIELQDIEENLFMHSSDAVPVKDRKIGLSPKPAALAKASPAPVSKVGLYMLFAQMMIAKRKVLTVNDSVGNRSKRNACPPRMPVASSSYPSHCLFRIDIKWIKAPSKELKVTRIPGPKSDISASATTARSGMLITGSSKRNQHARPGVFCN

SEQ ID NO: 167437 - protein, 223 aa, Glycine max
  Coding DNA Sequence Number=SeqID_50659
  Gene Ontology: Mol. function=chitin binding; Cellular component =extracellular region; Biological process=chitin metabolic process
  Homolog annotation: Hit_ID=UPI00006A17C9; Match level="QueryCoverage =90%, HitCoverage=100%, E-value=2e-17, Identity=27%"; Hit description= UPI00006A17C9 related cluster
  Subcellular localization annotation: CTP_CleavageSite=50; ConfidenceScore=5.35e-01
MSMRMIRTRLFAAARVKSCPGMHSGCTIASSSGCARTINLPPRSGGLRTLSSLKEQIWSPLKVRTRSPLKVRVCNPLKARVCSPLKARACSPLKGKICSPFKARTCSTLMARTCRPPKGVQPSDGEDVKPMKGRTCSPLKVRTCSPLKARACSPLKVRACIPLMARTCSPLKARACSPLKVRTCSPLMARACSPLKDVQSSEGEDMQSSEGEGVQPSDGEDIL

SEQ ID NO: 167438 - protein, 230 aa, Glycine max
  Coding DNA Sequence Number=SeqID_50660
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=2e-18, Identity=24%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPSEDYTSSPLEDCTSSPSEGCIPSPLEDVLAIRGLHALTFRELHTLAFRGLHVLTIRKLHALTFRGLHVLTFRGLHVLTFRGLHVLNIQGLHRAARPHLQRTARPPLHRLHVLTIRGLNALTFRGLHVLAFRGLHLLTFRGLHLLTCRGLHALTFGGRHVLAIRVLHVLALKGLHIFPFRGLHALAFRGLHTLAFRGLHTLTFRGLRVLTFSGLHICSFRELKVLNP

SEQ ID NO: 167439 - protein, 128 aa, Glycine max
  Coding DNA Sequence Number=SeqID_50661
  Gene Ontology: Mol. function=helicase activity
  Homolog annotation: Hit_ID=Q9ZQ61; Match level="QueryCoverage=87%, HitCoverage=12%, E-value=3e-12, Identity=36%"; Hit description =Putative helicase
MVHDDNETVPHVNTPNDEIKEYLDCRKPSVERLQFHLPGQHSVLYQDHDDIDDLLSNPSISKSKFIARMNTNQAFVEEDQSHLKISEQLMVLNIPYIEKHVLLWIFYRMIENSLQQSRKQKTGAQHLI

SEQ ID NO: 167440 - protein, 74 aa, Glycine max
  Coding DNA Sequence Number=SeqID_50662
MMLLLKVFPIKESSNNDPSQRHDDSNAASDHVYNILTSDVALIDGVAPPDTVFATSIGGCDIAEGGTHPNFDQH

SEQ ID NO: 167441 - protein, 220 aa, Glycine max
  Coding DNA Sequence Number=SeqID_50663
  Homolog annotation: Hit_ID=UPI00006DA4DE; Match level="QueryCoverage =31%, HitCoverage=85%, E-value=9e-11, Identity=51%"; Hit description =COG4104: Uncharacterized conserved protein
  Pfam annotation: Domain name=PAAR_motif; Domain location=17-48; Score= 24.4; E_value=0.00041; Accession=PF05488.3; Description=PAAR motif
  Pfam annotation: Domain name=PAAR_motif; Domain location=50-79; Score= 17.8; E_value=0.038; Accession=PF05488.3; Description=PAAR motif
  Pfam module annotation: Pfam domain module=PAAR_motif::PAAR_motif; Domain location=17-48::50-79
MKGIIRIGDKTTGGGQVMDGSKKMKFAGIGVARKGDPVSCPILGHSPSFIAEGHPTMKDNGVPVAFHEYKCRAKRRAAPSFKRWGMFLIVLIATGGIAAYFISTSTADHTAAFWFCFPGILLAIGGGLFALRWLVYLTGEWLADGWDSAREWDLAQDIRRGQRSLSLLGYVVHLPHVISAESISLQLLMPESIMLPLQVDESGERLIRHASFSDAGSPAL

SEQ ID NO: 167442 - protein, 38 aa, Glycine max
  Coding DNA Sequence Number=SeqID_50664
MDVQDYPKHRPDKGHLYQPGTVTQYSLARRALCLSPSP

SEQ ID NO: 167443 - protein, 345 aa, Glycine max
  Coding DNA Sequence Number=SeqID_50665
  Gene Ontology: Mol. function=RNA-directed DNA polymerase activity; Cellular component=chromatin; Biological process=chromatin assembly or disassembly
DHGTINVRPYRYPHHQKEEIEKQVRELLKVGVIRPSMSAYSSPVILVKKKDKSWRMCVDYRALNKATIPDKYPIPVIDELLDELFGATIFSKIDLKSGYHQIRMHKDDIHKTAFRTHNGHYEYLVMPFGLMNAPATFQATMNDIFRPFLRKFVLVFFDDILVYSRDTTEHQDHLTQVLSVLSANCFVANPSKCKFGCKQIDYLGHVISGDGVAVDPEKVKCILEWPEPKNVKGVCGFLGLTGYYRKFIKDYGKVAKPLIDLTKKDNFVWGADAMKAFNLMKQIMTSPPVLVLPNFELPFEVECDAAGRGIGAVLMQQRQPIAFFSKALSDGNLAKSVYETDFMAL

SEQ ID NO: 167444 - protein, 244 aa, Glycine max
  Coding DNA Sequence Number=SeqID_50666
  Gene Ontology: Mol. function=peroxidase activity; Cellular component =vacuole; Biological process=response to oxidative stress
  Homolog annotation: Hit_ID=Q40366; Match level="QueryCoverage=87%, HitCoverage=60%, E-value=6e-73, Identity=66%"; Hit description =Peroxidase precursor
  Pfam annotation: Domain name=peroxidase; Domain location=2-185; Score= 173.6; E_value=5e-49; Accession=PF00141.13; Description=Peroxidase
MVENPTKHVPCDGDKILTYPDNIILIWAEAHGPDWKVPLGRRDSLNSSFSLALQNLPGFNFTLDQLKSTFDRQGLNTTDLVALSGAHTIGRSQCRFFAHRIYNFSGNGNSDPTLNTTLSQALRAICPNGGPGTNLTNLDLTTPDRFDSNYYSNLQLQNGLLRSDQVLFSTSGAETIAIVNSFGSNQTLFYEHFKVSMIKMSIIEVLTGSQGEIRKHCNFVNGDSSNLATLATKKSSEDGMVSSI

SEQ ID NO: 167445 - protein, 171 aa, Glycine max
  Coding DNA Sequence Number=SeqID_50667
  Homolog annotation: Hit_ID=Q2HTR6; Match level="QueryCoverage=41%, HitCoverage=16%, E-value=4e-10, Identity=45%"; Hit description=RNA -directed DNA polymerase
MDQGRILGVLVDECWIKESCRVKEEIRQFFKRRFEEIEWERPRLDGNPGLDGINFKFIKKFWDVIKTNLLRFLDEFYINGVFPKGSNVSFLALVPKEKDLFEGFTVGRNVEISILQYADDMIFFGTTMMTNVRAIKAEAVVLVGRTFGSEEDCMGELGNNLSAKGERCLGH

SEQ ID NO: 167446 - protein, 67 aa, Glycine max
  Coding DNA Sequence Number=SeqID_50668
MAQAPIRKCGSQQASEITMHDKQGASLPFGKPFCGYKNSVQSAFGCGLYQVNFLPTQGTSRMKSCSN

SEQ ID NO: 167447 - protein, 72 aa, Glycine max
  Coding DNA Sequence Number=SeqID_50669
MGAILDVGWEIDMAGKFMEDIEGYSDGRLGGSPWHGVFGIIEKGLFSQMTASKVTQIDGGCFVLPLNMAYIQ

SEQ ID NO: 167448 - protein, 425 aa, Glycine max
  Coding DNA Sequence Number=SeqID_50670
  Homolog annotation: Hit_ID=Q8PK51; Match level="QueryCoverage=46%, HitCoverage=95%, E-value=5e-46, Identity=64%"; Hit description=ABC transporter heme permease
  Subcellular localization annotation: CTP_CleavageSite=42; ConfidenceScore=5.43e-01
HRTGPVADRGRPAQARPAPALAPPRRCAAAAAVRGAGGGAVRAGAGSRAATAGRHRRRSAVACGAASRAAVAGFTVPLRCRRRLAGTMAAGAGAAGLAGAGARAAALGDHRAAADRAADVAGIVAAGNAVAEPDRWRGRRADRRHPTLWYSRGVAVAAAVRAGAGVRRRQSGGSRTRTGSGRCAADAGRRPAGRAGAGAPIHPCWIAATHESDCPLVPPTRFAPHVRPIRCPLVAGVLPRGGAGAAGRHVAGAAGGAAGSQAAGQLPHPLHPRAQCLDEPVRVRADGAVCRHRPDLADQGLRDPGHGLCADGRRLHPDHPADRQHLGQGYLGYLVGLGPAHDQRTGAAVPVPGRDRPRQSINVFGESAISSAMIAPLWWMVIGTKFWFAGSVLAKARADNLDREAGKAWVGGRVDAARAAGEAQP

SEQ ID NO: 167449 - protein, 243 aa, Glycine max
  Coding DNA Sequence Number=SeqID_50671
MGNGDVWEGGVKKDNSGSHAKKGGDESGWVFEGKRWKGAGYMVLANLVLSSIPTYAMHMQWGGMGVRIARFHDVVLLGKLIWDLCHNPNKLWVHLISTKYPWVQFEDLFLYKGLYTMTSLPYVFEHQVVPSRNFLCIRHIINNDRCPQCGVMSDDVGHILWQCGNVHNGLLDMDSGFYGNIGVMDIVKAKLVTMLKGLEMYASIILSIRNFLEEQWSLEFGHSLHEGNFCSNLLAKKCSNVGV

SEQ ID NO: 167450 - protein, 54 aa, Glycine max
  Coding DNA Sequence Number=SeqID_50672
MNRELGILGKTQVPHCLSGRAQVEQLIRYIIEEAPEDAEKKRSFKLVAQIGDFD

SEQ ID NO: 167451 - protein, 549 aa, Glycine max
  Coding DNA Sequence Number=SeqID_50673
  Gene Ontology: Mol. function=RNA-directed DNA polymerase activity; Cellular component=mitochondrion; Biological process=RNA-dependent DNA replication
  Homolog annotation: Hit_ID=Q9FJR9; Match level="QueryCoverage=86%, HitCoverage=64%, E-value=0.0, Identity=76%"; Hit description =Similarity to maturase-related protein
  Pfam annotation: Domain name=Intron_maturas2; Domain location=233 -381; Score=10.5; E_value=2e-06; Accession=PF01348.12; Description =Type II intron maturase
MKVGLVINSVMRDVRDKLVVDLIKDALVTPVVVTTVEKKEKKKKRKYQKKRVLAEDEPKPDPYWLDTFFGFAPEEAERVPNWGHCGVLSPLLANVCLDELDRWMEGKIKEFYVPSKSDVIWNSPEEEQGNTSWPEFVPTSGPDKTRKMDFLRYGGHVLIGVRGPRADAAALRKQLIEFCDLRFMLKLDNESLPIEHITKGIMFLDHVLCRRVVYPTLRYTATGGKIISEKGVGTLLSVTASLKQCIKQFRKLSFLKGDRDPDPQPCFRMFHATQAHTNAQMNKFLSTMVEWYRYADNRKKIVNFCSYIIRGSLAKLYAAKYKLRSRAKVYKIGARNLSRPLKEKKGQSPEYQNLLRMGLAESIDGLQYTRMSLVPETDYSPFPSNWRPDHEKLLLEYIKLEDPKTLEEQRDCIREQGLVSPQDYISRLVWNYKRNSLPMDQLSLVRSNESVVGNQHLLVGSNQDDQDHTNKEEENDGRMNAAAQMIFASVSSFGAVVSSLQDIDSDKIFNTATLLVNTDWAIRKEYAASCGKLIKRVPCGCIASIGQGK

SEQ ID NO: 167452 - protein, 219 aa, Glycine max
  Coding DNA Sequence Number=SeqID_50674
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q4F885; Match level="QueryCoverage=72%, HitCoverage=25%, E-value=2e-74, Identity=81%"; Hit description=Endo -alpha-1,4-glucanase
  Pfam annotation: Domain name=Glyco_hydro_3; Domain location=1-198; Score=97.3; E_value=4.7e-26; Accession=PF00933.12; Description =Glycosyl hydrolase family 3 N terminal domain
DPNLAQRIGAATALEVRATGIPYVFAPCIAVCRDPRWGRCYESYSEDPKIVQEMTEIIPGLQGSIPANSRKGFPYVGGKTKVAACAKHFVGDGGTTKGINENNTVIDWHGLLSIHMPAYSDSIIKGVSTVMVSYSSWNGVRMHANRDLVTGFLKNTLKFKLPNAFYGNALFDYPIISSRKKNRPRHGRNTAQHDLNMATQEPDSGLIHMMWHRPRYKII

SEQ ID NO: 167453 - protein, 49 aa, Glycine max
  Coding DNA Sequence Number=SeqID_50675
MEKGVNDRNNANDTVKKQKAGEWTVFSLRSVEVAQENVVMTNHVGKKNN

SEQ ID NO: 167454 - protein, 228 aa, Glycine max
  Coding DNA Sequence Number=SeqID_50676
  Gene Ontology: Mol. function=transition metal ion binding; Cellular component=cytoplasm; Biological process=proteolysis
MDQSWMKTPHTSDEYENGVEDFLQFAQQNAPVMGSTTFTRLSTVLAFVNLKARFAWSDKSFTKLFVLMKKMLPEDNMLPKNNYEAKKILCPMGMKYWKIHACPNDCIYYINQFSEILKCPTCGVSHYKVKDEECSDEATSCNNHPTKVCWYLPIIPRFQRMFANGRDAKNLTWHAVGRKSDRLLLHSDDSPQWKTIDHLYLDFGDDPRNLRLGLASNEMNPDDNLSTN

SEQ ID NO: 167455 - protein, 303 aa, Glycine max
  Coding DNA Sequence Number=SeqID_50677
  Subcellular localization annotation: CTP_CleavageSite=71; ConfidenceScore=5.10e-01
MSSRFGRHGYMIAVAFNITRVMATPLRSPMYSDDPSEATSRESRQSAQLRSLTVRTLDQPRPTVNLFGRVVAQEKSPIVHSIWKVVPESLKDLIWDDILGKFDILEALNAKKKFMSTVATRWRQFKSSFTSKYIYGDNKGEDKQHPSVKYDLEPDTWEEFAKIRLTPNWLEIQKFNDCPHLLSHVDYDLLEKNLMEEKRKLREQQAMNTEDLAMILGPSSPIRDISAKVDVSLSELNTLSECHPLSEASTRLTDRRNVEGNLSRRHALNASSACSASRLPPSRLSASLALSDHSLTRAKRDVQ

SEQ ID NO: 167456 - protein, 42 aa, Glycine max
  Coding DNA Sequence Number=SeqID_50678
MANLVGGMGLQLEMGSMEYLKEILSVAGDGAHPVDSNKEKRL

SEQ ID NO: 167457 - protein, 767 aa, Glycine max
  Coding DNA Sequence Number=SeqID_50679
  Gene Ontology: Mol. function=protein serine/threonine kinase activity; Cellular component=integral to membrane; Biological process=protein amino acid phosphorylation
  Homolog annotation: Hit_ID=Q948R7; Match level="QueryCoverage=95%, HitCoverage=84%, E-value=1e-114, Identity=34%"; Hit description=CR4
  Pfam annotation: Domain name=Pkinase; Domain location=511-766; Score =73.3; E_value=7.5e-19; Accession=PF00069.15; Description=Protein kinase domain
  Pfam annotation: Domain name=Pkinase_Tyr; Domain location=511-757; Score=81.1; E_value=3.5e-21; Accession=PF07714.7; Description =Protein tyrosine kinase
  Pfam annotation: Domain name=TNFR_c6; Domain location=366-399; Score =15.7; E_value=0.018; Accession=PF00020.9; Description=TNFRNGFR cysteine-rich region
  Pfam module annotation: Pfam domain module=Pkinase::Pkinase_Tyr::TNFR_ c6; Domain location=511-766::511-757::366-399
MQILTALSFSSFFLLLLFLFLFGNAHGFGSMGPISASFGRDEVFCSIDASGKQDVICWGNNATSPSLSAVANAIPAMSALSGGEGFLCGILANTSQAFCWSAVTKPSADLILVPPAYRNTAYSHIAAGQNHVCAVKGSYFADRDSGTVDCWEITKTANKTLTAKQSDKFNDQLMSNLEVKRVVSGEGFTCGEVNDGGLICWGPTSENLGNINISNVTDSFAVLVAGRSAVCGVFNVSGELKCWGDPVSYSDPPLDSVRLVSLSAGANHFCGVRMDNHEVECWGDLNSSVVPKGNGFMAIASSDFTTCGIREDDLLLDCWLVNASKPDFDPPLELSSPGLCRASECGVDEFAFNVSVLNELALTSLCVREDLRICSPCGSNCSKGYFLSSECTRNADRVCTACSLCQNSSCFNVCGLHSSSGLHLHWHWHDLRKWVVIVGCPVLGFLVILLCGCLLMVRKRSKKQSKSCMGKPDQEDDHVNVALNSTPSVNSCPGVPQVFRLSELKDATNGFKEFNELGRGSYGFVYKAALADGRVVAVKRANAATIIHTNNRDFETELEILCKIRHCNVVNLLGYCAEMGERLLVYEYMPHGTLYDHLHGGLSPLTWSLRLKIAMQAAKGLEYLHKEPVPPIVHNDLKSSNILLDSEWGARISDFGLLASSDKDLNGDLESDVYNFGIVLLEVLSGRKAYDRDYTPSNMVEWAVPLIKQGKGAAIIDRYVALPRNVEPLLKLADIAELAVRERPSERPPMSDIASWLEQIVKDGLIL

SEQ ID NO: 167458 - protein, 80 aa, Glycine max
  Coding DNA Sequence Number=SeqID_50680
  Homolog annotation: Hit_ID=Q9SAF5; Match level="QueryCoverage=58%, HitCoverage=3%, E-value=2e-11, Identity=74%"; Hit description =Putative phospholipid-transporting ATPase 11
MSASLTYFDIILLASNYDDAICYVETMNLDEETEFTSARKWMYVIVKDVEGKLLLLRKRADNVMFERIAKNGRDFEEKTK

SEQ ID NO: 167459 - protein, 76 aa, Glycine max
  Coding DNA Sequence Number=SeqID_50681
MTPHTPFDKAITIVMGSTNGIQGARHTIDLKVIQARLRGGTDAAYKKKERIKLSPFQNLKFLFHKKDKEGVPLLVP

SEQ ID NO: 167460 - protein, 118 aa, Glycine max
  Coding DNA Sequence Number=SeqID_50682
MSTITTYHHNYCHHHQPLLSSALTTTTSVVMTFIVIAVITIIIDPTTTIIVIAIITINYHYYRHYNHCCRHCHHDGGGDSINGDNGHDDKGGDNNDDYADGGGDRHGDGDRLTTIEIL

SEQ ID NO: 167461 - protein, 49 aa, Glycine max
  Coding DNA Sequence Number=SeqID_50683
MWIWIMWESDSNSNHFVNSFNEDMAKVYPFLDIDLVTASFDGFESSNQF

SEQ ID NO: 167462 - protein, 212 aa, Glycine max
  Coding DNA Sequence Number=SeqID_50684
  Gene Ontology: Mol. function=peroxidase activity; Cellular component =vacuole; Biological process=response to oxidative stress
  Homolog annotation: Hit_ID=O23961; Match level="QueryCoverage=97%, HitCoverage=60%, E-value=2e-83, Identity=78%"; Hit description =Peroxidase precursor
  Pfam annotation: Domain name=peroxidase; Domain location=1-212; Score= 211.5; E_value=1.9e-60; Accession=PF00141.13; Description=Peroxidase
MSSSGCDASVLLNNTATIESEQQALPNNNSLRGLDVVNDIKTAVEKACPGVVSCADILTLASEISSVLGGGPDWKVPLGRRDSLTANRNLANQNLPAPFFNLSRLKSAFAVQGLDTTDLVALSELTAISFLTDCTISVELANLIQLLTQLTYNNCAKYAPMVDLNNLVNFDPVTPDKIDRVYFSNLQVKKGLLQSDQELFSTPGADTIPIVN

SEQ ID NO: 167463 - protein, 82 aa, Glycine max
  Coding DNA Sequence Number=SeqID_50685
  Subcellular localization annotation: CTP_CleavageSite=53; ConfidenceScore=5.00e-01
MNLSPISRGSLHSFGIDLVSNSRKFVSISFQLFGAVIQTEKPVENGLQGNACTCTGDKCQCKEPRQMRILTCESICAYVLYR

SEQ ID NO: 167464 - protein, 149 aa, Glycine max
  Coding DNA Sequence Number=SeqID_50686
MTTLTQIWMTLLLSNIPSSDHNADLLLQKYQLGSRPQGTQWTRRSPTGPWGFQLWLRASVSPKCPSPQQGHAIVTYVRIMPARNPVDPEKSNSVMGFPALIMGLCQFYRVPVAPNKVIRPPINRAFIKKYCTSRQARHHNSLGMADNGQ

SEQ ID NO: 167465 - protein, 98 aa, Glycine max
  Coding DNA Sequence Number=SeqID_50687
MRGYHMVTRTFGQQGANEPVGARRLTSSSAPFVVLTREVRLHAGLPYGYPYLSSTRADMRGYVMVTRTFCQPRANELDDARRVTSSSVPFVVLTHEVR

SEQ ID NO: 167466 - protein, 121 aa, Glycine max
  Coding DNA Sequence Number=SeqID_50688
  Subcellular localization annotation: CTP_CleavageSite=60; ConfidenceScore=5.62e-01
MRGSGEFVPFLDTTSRGSKMPQRTFLRRRHGPSVGSRQNPYAMPMQKTQCGNSPVESPTVATYPSVGGRRETRGMRVPRKEYARSRHQRLFEENVGKTGKDAIYELLSERFGSCIYARGRY

SEQ ID NO: 167467 - protein, 80 aa, Glycine max
  Coding DNA Sequence Number=SeqID_50689
MANEPVDPQRFTSSSAQTISVILTLESCDRRRYPSDTQVVIRLKLSFAICHNLPFGGRARRDSRDACSTKGIRAESPPTF

SEQ ID NO: 167468 - protein, 345 aa, Glycine max
  Coding DNA Sequence Number=SeqID_50690
  Gene Ontology: Mol. function=DNA-directed DNA polymerase activity; Biological process=DNA replication
  Homolog annotation: Hit_ID=Q1GXK0; Match level="QueryCoverage=99%, HitCoverage=94%, E-value=1e-124, Identity=67%"; Hit description=DNA polymerase III, beta subunit
  Pfam annotation: Domain name=DNA_pol3_beta; Domain location=1-119; Score=153.6; E_value=5.3e-43; Accession=PF00712.10; Description=DNA polymerase III beta subunit, N-terminal domain
  Pfam annotation: Domain name=DNA_pol3_beta_2; Domain location=129 -244; Score=147.4; E_value=3.7e-41; Accession=PF02767.7; Description =DNA polymerase III beta subunit, central domain
  Pfam annotation: Domain name=DNA_pol3_beta_3; Domain location=246 -345; Score=88.7; E_value=1.8e-23; Accession=PF02768.6; Description =DNA polymerase III beta subunit, C-terminal domain
  Pfam module annotation: Pfam domain module=DNA_pol3_beta::DNA_pol3 _beta_2::DNA_pol3_beta_3; Domain location=1-119::129-244::246-345
MQIKINREVLLKPLNSVTGIVERRHTLPILSNLLVNIKQQEMHLTATDLEMQISLKVQGGIEGELSTTISAKKLLDICRSLPDSTTIEMNNQDNRITLKAGKSRFNLQTLPAADYPLMSKASGQNISFSLAQSELKRLLKQVEFAMAQQDIRYYLNGLLLEVNGNQLHVVGTDGHRLSYTNTTLDQDFEKNEVILPRKTVLELTKLLDEQSDAPVVIDLLNGQVSFEFGDIQLISKVIDGKFPDYNRVIPTGHQNNFTVNRVAILSALQRASILSNEKYRSIRMVITNGLLKLISTNTEQEEAEEELEIDYSKVALDIGFNVTYLIDVLNNLSDEQIEFAFADAN

SEQ ID NO: 167469 - protein, 90 aa, Glycine max
  Coding DNA Sequence Number=SeqID_50691
  Homolog annotation: Hit_ID=Q653V5; Match level="QueryCoverage=64%, HitCoverage=15%, E-value=2e-07, Identity=42%"; Hit description =Receptor protein kinase PERK-like
EEALKFLKVGLLCVQETAKLRPRMSEVVEKLTKDIDMRDVHISKPGFVADLRNIRIKQQNLNSSEESSSAGATFTSSISSSANLARYLLD

SEQ ID NO: 167470 - protein, 264 aa, Glycine max
  Coding DNA Sequence Number=SeqID_50692
  Gene Ontology: Mol. function=protein serine/threonine kinase activity; Cellular component=membrane; Biological process=protein amino acid phosphorylation
  Homolog annotation: Hit_ID=Q6H6V1; Match level="QueryCoverage=92%, HitCoverage=62%, E-value=9e-75, Identity=57%"; Hit description =Putative receptor protein kinase PERK
  Pfam annotation: Domain name=Pkinase; Domain location=47-257; Score =120.3; E_value=5.5e-33; Accession=PF00069.15; Description=Protein kinase domain
  Pfam annotation: Domain name=Pkinase_Tyr; Domain location=47-260; Score=66.8; E_value=7e-17; Accession=PF07714.7; Description=Protein tyrosine kinase
  Pfam module annotation: Pfam domain module=Pkinase::Pkinase_Tyr; Domain location=47-257::47-260
MKIPCFSCFSPSTTEKNNNNDYPDEEINDGSFRLFTHKQLKLATRNFHSSEKVGEGGFGSVFKGKLVDGSFVAVKVLSVEVESMRGEREFVAELATLANIKHQNLVSLKGCCVEGAYRYLVYDYMENNSLYNTFLGSEERRMRFNWEIRKDVSIGVARGLDFLHEELKPHIVHRDIKAKNILLDRNFIPKVSDFGLAKLLRDETSYISTRVAGTLGYLAPEYANSGQVSRKSDVYSFGVLLLQIVSGLAVVDAYQDIERFIVEK

SEQ ID NO: 167471 - protein, 110 aa, Glycine max
  Coding DNA Sequence Number=SeqID_50693
  Gene Ontology: Mol. function=RNA-directed DNA polymerase activity; Biological process=RNA-dependent DNA replication
  Homolog annotation: Hit_ID=Q1SQN7; Match level="QueryCoverage=89%, HitCoverage=17%, E-value=3e-17, Identity=38%"; Hit description=RNA -directed DNA polymerase
MGVLTCASLLNCITMNLPFTYFGMSVGVDARKMTTWQPIFEKMKRKIQSEFLWGAKRDAKKSIWIKWDVVCSPIERGDLGIKNLEVFNRALVGKWMWRLGVVKGGFKGNI

SEQ ID NO: 167472 - protein, 243 aa, Glycine max
  Coding DNA Sequence Number=SeqID_50694
  Pfam annotation: Domain name=zf-CCHC; Domain location=107-124; Score =17.1; E_value=0.0015; Accession=PF00098.13; Description=Zinc knuckle
MTLEELVGILKVDKQELAQDERTKKGKSLALTTQRPKCNSASKESSSKALAINDALEEEYDDDDSDEEDEKLSLITRKIRKMWKNKNSSRFNSFSKRSFHKKEKSAIICYECKKPGHFKNKFFKSKKKSLMSTWEDLDEDNEEEANLCLMADASTSKDPQPYDTINSDGEEVGHETHKCKDFSKRATHQRVRSMLTNTHELTRKKDPKRFSKKEILVMIPRQQLLMTHDRQKVYVPIPKPYAW

SEQ ID NO: 167473 - protein, 170 aa, Glycine max
  Coding DNA Sequence Number=SeqID_50695
MLTVLDKPNFFFDFPLLFNFPGIDHETHGLNCEPVFCSVVFGIVSCNVLRSVKPPRQWKNLGQCDWVVDSLIKKTSYPIAQRLFAMRSMLEYQFCIHSSYRRLELLTSIDNCFEWFCVYSLMLDLVVSTPWILIYQILPFVSTFGKISNGYDRHGRLWKSCVAEDFCVKP

SEQ ID NO: 167474 - protein, 104 aa, Glycine max
  Coding DNA Sequence Number=SeqID_50696
MRGLFTKKSLFHRFKNFLSSALSRDQPRGPRGHYRTPNGMCEYVEAKLHGESKVIQRCFDDNNDDDKGDDKKLKDQSKNNSSESRTIQEFMIRIKKNSRLKKKV

SEQ ID NO: 167475 - protein, 50 aa, Glycine max
  Coding DNA Sequence Number=SeqID_50697
MTLLFPEEQKVQKTVSAPACYQAFCLTDSKRMSANNHKGADNRKGADNRK

SEQ ID NO: 167476 - protein, 174 aa, Glycine max
  Coding DNA Sequence Number=SeqID_50698
  Pfam annotation: Domain name=zf-CCHC; Domain location=145-162; Score =19.0; E_value=0.00071; Accession=PF00098.13; Description=Zinc knuckle
MESVNRGIWSAVVNGYTIPAHVVDNKTIEKPYESWVSVCTTVKEMWDLIQVTHEGTLEVRKAQKNSLIQEYETIRMKQGETIRDTSIPSTNKSKDDNAEGSDAKNLNLLVRRFNKFLKKNKNYGNRTFYPKKNLKKGEPSSSNGYTCFECEKAGHIKVDCPIYQKKQQGDKKNK

SEQ ID NO: 167477 - protein, 470 aa, Glycine max
  Coding DNA Sequence Number=SeqID_50699
MAWDSKQISKIVAVVGDMVDVDDDVELVRRMDRARVLLKTPWKPYIHHIVNVHIQGEVYNVHIVEAILKGAIAGAGARTGFTASLGNNEAKAISDAAAFGNSGVQAIFEAASPAGVFEATSPAGVTISATTKVKDGRMSATSPKDGALECEATTPPSGTLLPENAALPAGQRANIQRLLPIHRSEEVVHRGALRRLQRAIGDDLAESEDNFHKIGERQCIGKIIQSVREDRGCEIGNKQKEKADDVTRTEILNPRESRDFEGTMENGLGFAAHTPLDSIKQQLSNPQASKLQVFSRKRYHKQKLQLGCTDDSNTIINKDTKSINPSPTNQQHEFHDKCESAQGQIIDIRQAQQDQEETENANNQKQEAEALWTVAKALGVTDGSSQQNFVNKLMEMEERDKKEARRLGSKKVSWEAQPASNSAGGLLCIWSERTFKLEAKVVGPGFIMLNDWESAKEGWGKATTMSSTDG

SEQ ID NO: 167478 - protein, 124 aa, Glycine max
  Coding DNA Sequence Number=SeqID_50700
SRPKDPDIFGEGASDDTSLGEVLVTTLVTACFRALSLTDSKCDFSQSRSEHTNIYGKGAVFRIANETLSKSRPEDANISGNGSRPEDLDITGEGASDDSRPENAEIFGKGAEDADIYGEGADDD

SEQ ID NO: 167479 - protein, 128 aa, Glycine max
  Coding DNA Sequence Number=SeqID_50701
MDEAVSFLNEVESKLIQPQRRDEWVWVADPSDHFIIKSAYYVMRKGISEGTADAAFDELWKIKEYSFYLKDLGLKTRIPDTRGYEDGVTNFNLLGIGNRYGCWGVGDWGCNTRPHPVVMSNLSHVGNF

SEQ ID NO: 167480 - protein, 208 aa, Glycine max
  Coding DNA Sequence Number=SeqID_50702
  Gene Ontology: Mol. function=nucleic acid binding; Biological process= RNA-dependent DNA replication
MDYLTPSFGETNTIQLSNLHEEVIFDFKHGFLQMLENNLFSVVAHEDPMHHLRKFIKLTNTMKQNCLCSLPENDITTWNQCKNAFLKRYFSPVKIDQYIRDIGNFVEREQESLPKVWESLQEIIIRFSHHDITKQRLVYIFYGGVSSHNRRSLDATCGGNLMLKTPVDAIKITKDMCSKPCNNSGDMRIMKRGINLVDTAESQTKLEK

SEQ ID NO: 167481 - protein, 1294 aa, Glycine max
  Coding DNA Sequence Number=SeqID_50703
  Gene Ontology: Mol. function=RNA-directed DNA polymerase activity; Cellular component=chromatin; Biological process=chromatin assembly or disassembly
  Pfam annotation: Domain name=rve; Domain location=933-1090; Score =82.3; E_value=1.5e-21; Accession=PF00665.16; Description=Integrase core domain
  Pfam module annotation: Pfam domain module=RVT_1::Retrotrans _gag::rve; Domain location=520-687::121-207::933-1090
GYGPRNQSSLPLTFGALVAMPDPPPNPLEVALLKLTNLHASLGETVQSMAQKFDALLLRSPSSPSSSSPNPSTPYFPFVPASQHKMKLDISKFDGTDPYGWVFKINQYFQYHATPEHDRLTIVSFYMDGRALAWFQWMANNGQFTSCPAFVQALQTRFAPSHYDDPTGSLFKLQQTGTVAQYLSNFEDLANRIKLLDARPSLRTRAPSVVPLSLRPTATPALLPLPTSRPPPPRLPATLKRLSSEEISSRRERGLCFNCDEKYHRGHRCTSRVFFLVAEEDEVVDSHIGEIDPSPDPPEIHDPGPTQISFNSLAGQLALETLRLIGTVAGTTVVVLVDGGSTHYFIQESLVTQLGLQTQPTTPLRVMIGNDQHLACDRLCPDLSLTMQQFHCVVDLFVLPIAGGNESTLTMLTPHQFRRLSRNSDTSSFFHIAVLAETPLPDSSSPLHPAIQDLVDHFAILFQPPTALPPKRITDHHIHLIPQATPVKVRPYRYPHFQKREIELQVESMLQKGLIRPSTSPFSFPVLLTKKQSWWFCVDYRALNVVTVRDRFPIPTIDELLDELGKACCFSKLDLLQGYHQIRMHSSNIAKTAFRTHHGHYEFKVMPFGLCNAPSSFQATMNMIFRPFLRRFLIVFFDDILIYSATLKEHVTHVQQAFQVLLDNHFVLKLSKCSFAQQQVEYLGHMVSERGVEPVAAKVEAVRQWPVPHSIKALRSFLGLAGFCRRFIKGYASIAAPLVAATTVEPFQWTAAAQLAFELLKKALSALVLALPDFQLPFMVETDASGVGMGVILSQQGHPIAYFSKPVPPKLQHSSTYVRELFAVTATVKKWRQYLLGNRFIILIDHRSLGTPYTSYSDPRATYVPCSVDGELRAQLAQNQLYQDRLQAIRSFPTKYPELTITNGLILKRDRIWLPLIPTLLREYHATLTGGHLGIAKTIARVMDNFNWEGLREDGNTVTLVVVDRFSKGIHLGMLPTSHTAHAVACLFMNIVEKIHGLPRSLVSDRDPLFISRFWQELFRLSGTQLRLSSVYHPQSDGQTEVLNRVIEQYLRSFVHRRSGSWGKLLLWVEWSHNTTWNAATGSTPYEVTFGRKPFNFPEYLTGTSKVDAVDEMLTNREETFLLIRKKLLKAQELMKKYVDHKRREVVYQPGEWVMIKLRPRRQISAKPQLGSSGKLSKRYYGPFQVVNRVGPVAYRLKLPEGTNIHPIFHCSILKPFKGSPEVANSAPLPDQTQLAEEYHLEDKVHLHGPWNDRRTGVQQVIDEEPSKHTNNKVQLGNGAKRAIARPAYLRDYV

SEQ ID NO: 167482 - protein, 176 aa, Glycine max
  Coding DNA Sequence Number=SeqID_50704
  Homolog annotation: Hit_ID=Q1SP02; Match level="QueryCoverage=59%, HitCoverage=21%, E-value=6e-17, Identity=44%"; Hit description=IMP dehydrogenase/GMP reductase
IYEHFPSVAESTTDQEYDEDSPRACRWIATKKTVKSIRTPAYRERLDRLQIPDVCWIPYGEHQPVQDFHVVSCYSGLLRWGPVAIYYRPERVVRQFGYTQTIPAPPIDSWVSYDDIHDRWMHYSGHIVPASEVPRIRSFARWSCPATPSRPSGPIDGYPPRAGARSTVDIYEARCR

SEQ ID NO: 167483 - protein, 107 aa, Glycine max
  Coding DNA Sequence Number=SeqID_50705
MRSDCLVQVSILTLFRNPMNCGFFHVSSTIEFGAMRIDCLAQFSILTLFGSPINCVFVHVSSTLEFGAMRSDCLVQFSILNLFGAPRIALSFMCPPPSSLELFVVIA

SEQ ID NO: 167484 - protein, 1043 aa, Glycine max
  Coding DNA Sequence Number=SeqID_50706
  Gene Ontology: Mol. function=nucleoside-triphosphatase activity; Cellular component=membrane; Biological process=defense response
  Homolog annotation: Hit_ID=Q1STU9; Match level="QueryCoverage=99%, HitCoverage=86%, E-value=1e-124, Identity=31%"; Hit description=H+ -transporting two-sector ATPase, alpha/beta subunit, central region; Disease resistance protein
  Pfam annotation: Domain name=AAA; Domain location=175-377; Score= -26.6; E_value=0.022; Accession=PF00004.19; Description=ATPase family associated with various cellular activities (AAA)
  Pfam annotation: Domain name=Dynamin_N; Domain location=176-401; Score=-43.2; E_value=0.054; Accession=PF00350.13; Description =Dynamin family
  Pfam annotation: Domain name=LRR_1; Domain location=559-580; Score =7.4; E_value=12; Accession=PF00560.23; Description=Leucine Rich Repeat
  Pfam annotation: Domain name=LRR_1; Domain location=582-603; Score =0.8; E_value=2e+02; Accession=PF00560.23; Description=Leucine Rich Repeat
  Pfam annotation: Domain name=LRR_1; Domain location=605-626; Score =13.9; E_value=0.59; Accession=PF00560.23; Description=Leucine Rich Repeat
  Pfam annotation: Domain name=LRR_1; Domain location=628-651; Score =12.4; E_value=1.3; Accession=PF00560.23; Description=Leucine Rich Repeat
  Pfam annotation: Domain name=LRR_1; Domain location=653-686; Score =1.3; E_value=1.7e+02; Accession=PF00560.23; Description=Leucine Rich Repeat
  Pfam annotation: Domain name=LRR_1; Domain location=790-811; Score =5.2; E_value=31; Accession=PF00560.23; Description=Leucine Rich Repeat
  Pfam annotation: Domain name=LRR_1; Domain location=882-903; Score =4.7; E_value=38; Accession=PF00560.23; Description=Leucine Rich Repeat
  Pfam annotation: Domain name=LRR_1; Domain location=906-926; Score =3.6; E_value=62; Accession=PF00560.23; Description=Leucine Rich Repeat
  Pfam annotation: Domain name=LRR_1; Domain location=992-1013; Score =3.4; E_value=65; Accession=PF00560.23; Description=Leucine Rich Repeat
  Pfam annotation: Domain name=MMR_HSR1; Domain location=174-276; Score= -17.4; E_value=0.039; Accession=PF01926.13; Description=GTPase of unknown function
  Pfam annotation: Domain name=NACHT; Domain location=174-345; Score= -14.2; E_value=0.00073; Accession=PF05729.3; Description=NACHT domain
  Pfam annotation: Domain name=NB-ARC; Domain location=134-445; Score =79.7; E_value=9.2e-21; Accession=PF00931.13; Description=NB-ARC domain
  Pfam module annotation: Pfam domain module=AAA::Dynamin_N::LRR_1::LRR_ 1::LRR_1::LRR_1::LRR_1::LRR_1::LRR_1::LRR_1::LRR_1::MMR _HSR1::NACHT::NB-ARC; Domain location=175-377::176-401::559-580::582 -603::605-626::628-651::...
  Pfam module annotation: Domain location=653-686::790-811::882 -903::906-926::992-1013::174-276::174-345::134-445
MDAVSSALLEPVTNSLLDLLKKQLDYIHYSRNFDELRECVKQLKLVKEKVDHQCEEAFKNGHEIEGKAREWLGKVGKFETEVEKYWNDDGHKKTRFSNYLFPYFRHRLGRLAKKMAVEGKKITDDCPKSDEIAHRVYVTSNDAIFSNNDLMDFGSRKSIMEQIMATLVEDPTVKMIGVYGRSGVGKSTLIKAIAKIARDKKLFNVVAFSEITDNPNLKQVQEDIAYPLGLKLEGEGENVRADHLRRRLKKEKENTLIILDDLWDRLDLNRLGIPLDGDVEDKQGPKGPTKEKSLGDYKGCKILLTSRKQNVLTDKMEVKLTFCVEELDEKDALKLFRKEAGIHGEMSKSKQEIVKKYCSGLPMAIITVGRALRDKSDSEWEKLKNQDLVGDQNPMEISVKMSYDHLENEELKSIFFLCAQMGHQPLIMDLVKYCFGLGILEGVYSLGEARGKISTSIQKLKNSGLVLDGSSSIHFNMHDLVRDAALSIAQKEHNAFTLRNGKLDDWPELERCTSIFICNSVIIDELPEEINCPQLKFFQIDSDDSSLKIPNSFFKGMKKLKVLMLTGIQLSSLPSSIESLSDLRLLCLERCTLDDNLSIIGKLKKLRILSFSGSRIENLPAELKNLDKLQLLDISNCSVVKRIPPQLMSRLTSLEELYVRNCFMEVSEEGERNQCQISFISELKHLHQLQVVDLSIPCAEVFPKELFFDNLSDYKIEIGNFEMLSAGDFRMPNKYENFKSLALELKDDTDNIHSQKGIKLLFKTVENLLLGELNGVQDVINELNLDGFPQLKHLSIVNNPSIKYIINSKDLFYPQDVFPKLESLCLHELNKIEMIYFSSGTEMICFSPFTDCSFTKLKTIKVEKCDQLKNLFSFCMVKLLASLETIGVSNCGSLEEIIKIPDNSDKIEFLKLKSLSLESLSSFTSFYTIEGSSTDRDEIQITVAENEHSEMAPPLFGELVEIPNLENLNLISMNKIQKIWSDQPPSNFCFQNLIKLVVKDCHNLRYLCSLSVASSLRKLKGLFVSNCKMMEKIFSTEGNSADK

SEQ ID NO: 167485 - protein, 125 aa, Glycine max
  Coding DNA Sequence Number=SeqID_50707
  Homolog annotation: Hit_ID=Q6T4Q2; Match level="QueryCoverage=19%, HitCoverage=26%, E-value=2e-07, Identity=100%"; Hit description =Putative senescence-associated protein
EGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGRADIEGSKSNVAMNAWLPQASYPC

SEQ ID NO: 167486 - protein, 151 aa, Glycine max
  Coding DNA Sequence Number=SeqID_50708
MVMGDFISRLSFPACLHFSEENTETFSSLTSYPELRRSEFLIGGYVGARASLLSTIPPFVAMTQELVVRGDTLRLFAPFCHPEAAGPMTSRDQVWSFCTLVSSRGGGPDDTRRYLTVIRTLLSSRGGGPDDKQRPSLVILHPCIIQRRRAR

SEQ ID NO: 167487 - protein, 84 aa, Glycine max
  Coding DNA Sequence Number=SeqID_50709
MTTDPTQTLMDYLTPTLGKANTIQLPNLPEGVTFDFKHGVLIHQQMTRSCLKNWSSTMCEKPSWQSAISYMGTKRTFGGLAHGF

SEQ ID NO: 167488 - protein, 207 aa, Glycine max
  Coding DNA Sequence Number=SeqID_50710
  Gene Ontology: Mol. function=DNA binding; Biological process=DNA integration
  Homolog annotation: Hit_ID=Q1SS72; Match level="QueryCoverage=50%, HitCoverage=7%, E-value=8e-16, Identity=38%"; Hit description =Integrase, catalytic region
MEEWNANINTSLINVVFHEFFFPFHINQNLFTSEAQPNSPIDPISYTLPTPPHFTPSTPITTNIDPTIPQPNGSSSPFPNPSTPPEIDTPNPNIIDQHIQEPPNSPPSNHALPSRPSRDTYPSSYLSDYQFQIPSLKFAQSSSTCAYPIQSFLSYTHVSPSHHHFLMTLSSEHQPTSFHEAVKHQCWRDAMKYEIKALQLNQTWDIV

SEQ ID NO: 167489 - protein, 121 aa, Glycine max
  Coding DNA Sequence Number=SeqID_50711
  Gene Ontology: Mol. function=DNA binding; Cellular component=oxygen evolving complex; Biological process=DNA integration
  Homolog annotation: Hit_ID=Q1S1G2; Match level="QueryCoverage=99%, HitCoverage=8%, E-value=6e-35, Identity=59%"; Hit description =Integrase, catalytic region; Zinc finger, CCHC-type; Peptidase aspartic, catalytic
MEIPPGLLGYTSSQSCKLKKSLYGLKQSNRKWYEKLSNLLLTWGYSHAHADHNLFIKAHNYEFIALVVYVDDIMLTGNSLAEIERIKCILHTNFHIKDLGKLKYFLGIDVAHSDKGISLCQ

SEQ ID NO: 167490 - protein, 267 aa, Glycine max
  Coding DNA Sequence Number=SeqID_50712
  Gene Ontology: Mol. function=transferase activity; Biological process= DNA integration
  Homolog annotation: Hit_ID=Q1SB62; Match level="QueryCoverage=34%, HitCoverage=7%, E-value=4e-15, Identity=45%"; Hit description =Integrase, catalytic region; Zinc finger, CCHC-type; Peptidase aspartic, catalytic
SKGKWKSNKWQNTGVGQRSAIDKNNNQSKNNKNGEANKSKIKKMGPDLLMVTTKFEGDYSNHWYLDTSCSNHISGRNEWFIVLNEKVKSKVKFGDNIVVTTEAVDKVMVKRKNGVKAFITNVLYVPKLKNNLLSFRQLAEKGIFYESTLKLNEVLEKECFDATLNEVHWGHITETELSKIVQAKRPQRNRQQPQRLNDFKMLLDILVTQEGDLGCLKWVYKVKGMPNGTIAKYKTRLLVKGFLQKERVDFQEVFAPVDFQEVFAPVD

SEQ ID NO: 167491 - protein, 91 aa, Glycine max
  Coding DNA Sequence Number=SeqID_50713
MLNTIRELKAFVSDLSQCLQSCRRCHTDYEEYSDHDDQYHRTQSLETYPPIIAHCIIDNFMVVDKIYGWNFYRQTRSPLEEKEHRVVEDYG

SEQ ID NO: 167492 - protein, 428 aa, Glycine max
  Coding DNA Sequence Number=SeqID_50714
MPHGGGSLLVALELMWASDHLVSLLNCLAFQNTWIGLYIRFGMILEIVDFLGSSFRAIRVVNTGPSQYRGRGGRGGRPFRGAGRGRGHGRGHGVGGVRHIPFHSSGPVVSNVPARVQPPVPPRKVCCEICKVECNSPEILEQHKVGKKHQKNMRVHEELQRRNAINEQQSGEIPTSQLNLTDQPKEVQESEKNGHPTENMGSGVIINNHEEEIQLQNNVGNMSEVPAEVPEGKTVDNSAARGRGLKRKKKGGKGGKYMRTNDGSKPVEPAQTMSFRCELCDVKCESQVVYQSHMTGKKHLSKLRRASSGVGQQQALSGALSGLQAVYPPDINALSNAINAQVQQGDNDPQVLLAQLLMTVLSQAQVPATAPVTGAIASQIPAPTSMAGPSYEPQLLQTNSSGETKTELPGSSVSTQIEGGGSETKQQV

SEQ ID NO: 167493 - protein, 184 aa, Glycine max
  Coding DNA Sequence Number=SeqID_50715
MDYSGYNFQQQPQQHSYGYDPSQIPIQPYDQSYAAYQQYYAYNPQYAYFPNAHQTQFQFQPEPAPLHPPGVNPSAAEPAPVNFSFYLFQFLNDQGFVVAVAVMSGFLILKEIADNCGRYGHNCGHGHPKSLEVVIGIVTVDCFYYRDRDRKPQLLRPQMQSKLRLHCSLGLPQNLDVDCFLKHW

SEQ ID NO: 167494 - protein, 97 aa, Glycine max
  Coding DNA Sequence Number=SeqID_50716
MDYSGYSYQQQHSYGYDPSQIQIQPNDQSYVYQQYYAYNSQYMYYPNAYQTQFQFQPKLTPLHPPNIYPITPEPALANAADVTTTAVALWSLPPEKP

SEQ ID NO: 167495 - protein, 137 aa, Glycine max
  Coding DNA Sequence Number=SeqID_50717
  Gene Ontology: Mol. function=zinc ion binding
  Homolog annotation: Hit_ID=Q1SZC1; Match level="QueryCoverage=56%, HitCoverage=25%, E-value=1e-18, Identity=58%"; Hit description=Zinc finger, RING-type
MPAPLPAPYDHHHRPAVDPMWVRYPPAAPPAPAPYVEHQKAVTIKNDVNIKKETLRIEPDDENPGCFLVSFTFDATVSGREVKKLLILFCMGFCYLLEIESEVDQCTLMANEVVTVIDWLRMEGGHIRGESDNFVVV

SEQ ID NO: 167496 - protein, 194 aa, Glycine max
  Coding DNA Sequence Number=SeqID_50718
  Gene Ontology: Mol. function=methyltransferase activity; Biological process=metabolic process
VSYLPKFVDVSNKKRLVYIDIGVKELVNANVNVNVTDWFPPSYPIDQKAFSVYFVHYNASVLLSYVKRPRVTFIYHPGLAGNIAHKSGVDGGMEPFLGEEEFDFLVWFMETVQHADFVVLKMNAGEAEIKFLSDIFENGAICSVDELFLSCSESGNGESETMSSRERCMDIYKGLRSNGVYVHQWWNAKLHQGA

SEQ ID NO: 167497 - protein, 189 aa, Glycine max
  Coding DNA Sequence Number=SeqID_50719
  Homolog annotation: Hit_ID=Q00M75; Match level="QueryCoverage=21%, HitCoverage=6%, E-value=3e-09, Identity=75%"; Hit description=PPR -repeat containing protein
MGLSINNQSPDQAAASPGLTKCGNFVAANKLNILKTNKLPSLTHSLGNDDGLGVPVAHQRQSHVADDRVPVAPRQSSYNQHRATTAHLGAPPQIPHNFEKTCAKKNCVVNVRHVLISAVLKDSRFIKKLRTPLFRDSSLCEGMREGCCTQPYPCIYKEAVSGFEPMTNKSPRHNFTAAPGLALRFPTHY

SEQ ID NO: 167498 - protein, 70 aa, Glycine max
  Coding DNA Sequence Number=SeqID_50720
MKLKVARPLKMRIDNKFTIDLAKHLVSHGRKCNINLIAFFLFFLYSSWAKDAREGPKVLMSLRIDFRPIG

SEQ ID NO: 167499 - protein, 252 aa, Glycine max
  Coding DNA Sequence Number=SeqID_50721
  Pfam annotation: Domain name=Methyltransf_11; Domain location=120 -202; Score=16.4; E_value=0.0013; Accession=PF08241.2; Description =Methyltransferase domain
MDSKSSKLHGLSGSIAQRVFFRALFLASAVSLIALIRFLPAVDLESLTPKTYVDCVIDDSDSLSENTTLTAGSYLFQSRILNTFWGSFDSMNCKNDTSLASTIITILKGKRLLNFGAKSLCVGEGSNVIVSAMQRLGFSSVIGLHKHPFFSLNKKKIACRFEYDDSTFDFVFSKDVVDKVSVPALLVLEVERILKPGGIGALLVGSSSSSSSSKRSIFYNHVLPEDCASVQFTKPLVKLMEPLVEERVRNDV

SEQ ID NO: 167500 - protein, 57 aa, Glycine max
  Coding DNA Sequence Number=SeqID_50722
MGKRSTIVQRQGSCFHECIGDWIFFFNQLVMYVSHYKECQHKMQNPVVAPIYHLANY

SEQ ID NO: 167501 - protein, 59 aa, Glycine max
  Coding DNA Sequence Number=SeqID_50723
MSIKKEYDGMGFRHLHGFNLAMLRKGSGQDIINQIFNQHDAQAIQATPLLNNLYDDALI

SEQ ID NO: 167502 - protein, 365 aa, Glycine max
  Coding DNA Sequence Number=SeqID_50724
  Gene Ontology: Mol. function=nucleic acid binding; Cellular component= intracellular; Biological process=regulation of transcription
  Homolog annotation: Hit_ID=O22090; Match level="QueryCoverage=99%, HitCoverage=98%, E-value=6e-50, Identity=39%"; Hit description=C2H2 zinc-finger protein ZPT3-3
  Pfam annotation: Domain name=zf-C2H2; Domain location=221-243; Score =21.1; E_value=0.0039; Accession=PF00096.16; Description=Zinc finger, C2H2 type
  Pfam annotation: Domain name=zf-C2H2; Domain location=274-296; Score =19.6; E_value=0.011; Accession=PF00096.16; Description=Zinc finger, C2H2 type
  Pfam annotation: Domain name=zf-C2H2; Domain location=4-26; Score =19.5; E_value=0.012; Accession=PF00096.16; Description=Zinc finger, C2H2 type
  Pfam module annotation: Pfam domain module=zf-C2H2::zf-C2H2::zf-C2H2; Domain location=221-243::274-296::4-26
MEKHKCKLCLRSFANGRALGGHMRSHMLNLPVPPKQSEFVPIQLSFEADSSPSQSSSSFYGLRENPKKSFRFADPEFAFAAADTGSVILQDRESETESSRNPTRTRSKRAWQLGGDGGGGGGGSGESEKKIMKVCKISKTNESASSVSDTTREEDVAFCLMMLSRDKWKEENINNLLYDHDQDDDEDEEDDEEDENNEDDDGYESEEKSLKKSNNKVRGRYKCETCEKVFRSYQALGGHRASHKKIKLNNNNNNNNNNEGELEVQHVVVEKKIHECPVCFRVFASGQALGGHKRTHVIGSSTAATTVSVRSSVATVSVRTASTTRVGDSLIDLNLPAPVDDDEEEEEDVSQFDDSAVSDAEFVKL

SEQ ID NO: 167503 - protein, 204 aa, Glycine max
  Coding DNA Sequence Number=SeqID_50725
MTDAHNVGEVEELEDQDVQSHSTSSPSKTTSILEPIIEENAIEVDSTLDDLLNIETEQNPPVTKEQVGVEVVTDTSTPMPLVETNIVEESTMEVGEGLQRETNPLDASLFFLLTSGLLIRCHRKPLNLATKCHSLISMRQGSKQFDPDPKRLPKGLRENYANSRADQKNQKAEAKLMKKEEELMVLLRPIQEELYSTCLKLQEL

SEQ ID NO: 167504 - protein, 119 aa, Glycine max
  Coding DNA Sequence Number=SeqID_50726
MAGCERRNGGGVIVFVLNGGDWGENVNHASFDDVEKKSHVCHHQKGGECHRVQQTCGGGGGEKKLGALMGGGDGKVDMVLDMGRRCKVGIGMSRVSKERFLERRLGMSHGNDKVGICEP

SEQ ID NO: 167505 - protein, 144 aa, Glycine max
  Coding DNA Sequence Number=SeqID_50727
  Gene Ontology: Mol. function=RNA-directed DNA polymerase activity; Biological process=RNA-dependent DNA replication
  Subcellular localization annotation: CTP_CleavageSite=34; ConfidenceScore=5.64e-01
MLKILKTSCSNFLSHFCNSSKSSSPCFFGAYGIATATRFGTTLTHNHKNSEGRATPQSQTTNLFWKKPQAQFFKFNVDATLFKDQNRFGVGICLRGDEENFIKAKTFFNNGIPNPRTTKTWELLQAMNRMTKLQIENVIFEVDC

SEQ ID NO: 167506 - protein, 86 aa, Glycine max
  Coding DNA Sequence Number=SeqID_50728
MGMMDIDAIKKEMERMDIDAIKKGKGVMDNDAIKEYEDMFGLSRELVELLGLPIWEGMKLVRQEPRRFAPNVLEAIKVEIEKATEG

SEQ ID NO: 167507 - protein, 53 aa, Glycine max
  Coding DNA Sequence Number=SeqID_50729
MGIYMGILNLPIQHATSASSGGYRGMRRPFKHIGPSVAPKIDKVKQSDEIPPF

SEQ ID NO: 167508 - protein, 65 aa, Glycine max
  Coding DNA Sequence Number=SeqID_50730
MIKRREEKKRFKSFLPKIWEKKSQDITMELGKRRKWWYLPPSRSHVYGDNEGHGGCARGCYKWVF

SEQ ID NO: 167509 - protein, 178 aa, Glycine max
  Coding DNA Sequence Number=SeqID_50731
MPFSTPLDLQQLMGFLCTFNVVLPWDHIKFGETTQTDEIQLEAPEESLNFQDWGPLDYGLELRMKLSAYREEILSREASFHIVRRLNTHMPFMLGSQFSCLATQETQFHKVIDKHVLYQKANCCKGKDLLIEDDEDAPSIRLVKARCSHVFKHELKALKQKTELTNMDWYAMKMFYRL

SEQ ID NO: 167510 - protein, 147 aa, Glycine max
  Coding DNA Sequence Number=SeqID_50732
  Homolog annotation: Hit_ID=Q1SD42; Match level="QueryCoverage=56%, HitCoverage=9%, E-value=1e-09, Identity=35%"; Hit description=RNA -directed DNA polymerase
MHFIDNLFDHCDVQAIIRVPILDVSRDDIRIWAHTSGGMYQVRSAYKLILKKFTNYDMLRVNGDWRLIWDLDIPPREKGWGVVRDHDIWCYATIVGCMDWMEAEAWVLLTTMEFAISLGLQQGDFEINCKTVVDKIIKVPLINLSLV

SEQ ID NO: 167511 - protein, 100 aa, Glycine max
  Coding DNA Sequence Number=SeqID_50733
  Gene Ontology: Mol. function=RNA-directed DNA polymerase activity; Biological process=DNA integration
MAKGYSQQKGIDYTETFVLVARLKAIHILLSFVAQHAFYGLKQAPRAWYEKFSSFLTENGFKASSSGLALREKKEYKVLGYCDADFSGDRVERKRTSGGC

SEQ ID NO: 167512 - protein, 530 aa, Glycine max
  Coding DNA Sequence Number=SeqID_50734
  Gene Ontology: Mol. function=nucleic acid binding; Cellular component= intracellular; Biological process=regulation of transcription
  Homolog annotation: Hit_ID=Q1SZA5; Match level="QueryCoverage=98%, HitCoverage=97%, E-value=6e-98, Identity=43%"; Hit description=Zinc finger, C2H2-type
  Pfam annotation: Domain name=RS4NT; Domain location=124-161; Score =15.5; E_value=0.029; Accession=PF08071.2; Description=RS4NT (NUC023) domain
  Pfam annotation: Domain name=zf-C2H2; Domain location=139-161; Score =22.0; E_value=0.0022; Accession=PF00096.16; Description=Zinc finger, C2H2 type
  Pfam annotation: Domain name=zf-C2H2; Domain location=166-187; Score =16.3; E_value=0.11; Accession=PF00096.16; Description=Zinc finger, C2H2 type
  Pfam annotation: Domain name=zf-C2H2; Domain location=63-85; Score =25.6; E_value=0.00018; Accession=PF00096.16; Description=Zinc finger, C2H2 type
  Pfam module annotation: Pfam domain module=RS4NT::zf-C2H2::zf -C2H2::zf-C2H2; Domain location=124-161::139-161::166-187::63-85
  Subcellular localization annotation: CTP_CleavageSite=30; ConfidenceScore=5.24e-01
MMPADPFSLSTSIGGFTQDQQNTNPNPKPNAPPKKKRNLPGTPDPDAEVIALSPKTLMATNRFICEICNKGFQRDQNLQLHRRGHNLPWKLRQRSNKEVRKKVYICPEQTCVHHDPARALGDLTGIKKHFSRKHGEKKWKCEKCSKKYAVQSDWKAHTKTCGTREYKCDCGTLFSRKDSFITHRAFCDALAEESARLTAVTTTTLNFKSEEGANNVMNSQQHGLGGHGLIGAQQSLQNVSGIPKFGPHSFRLDFNGMEQQQRPSLSLWLNQGNPQMNHNNNNINSSNSTSNVGPNYMSACSSSGLPEIVQMAQANAMMGSSSMVSNFGVHHAGSNNSSSANLSLGKRGEAGGSTVVDMASIYNNSEGQNKNSKPASPMSATALLQKAAQMGSTRSTNPSIFSGSFGVINSPSSQTTSLNNNNNNGDAAMMLGSNTTTTTTVAANANDHFSSLTHSSNSFDQLVMQVNGQLQSEPVKLKLHSNAVENNLTRDFLGVSGGGGGGGPQYLSQELAKFASINSPMGLIQFTSNQ

SEQ ID NO: 167513 - protein, 594 aa, Glycine max
  Coding DNA Sequence Number=SeqID_50735
  Gene Ontology: Mol. function=molecular_function; Cellular component =nucleus; Biological process=negative regulation of transcription by carbon catabolites
  Homolog annotation: Hit_ID=Q1SZB7; Match level="QueryCoverage=95%, HitCoverage=94%, E-value=0.0, Identity=71%"; Hit description=WD40 -like
  Pfam annotation: Domain name=WD40; Domain location=244-283; Score =4.6; E_value=11; Accession=PF00400.22; Description=WD domain, G-beta repeat
  Pfam annotation: Domain name=WD40; Domain location=309-347; Score =30.7; E_value=5e-06; Accession=PF00400.22; Description=WD domain, G -beta repeat
  Pfam annotation: Domain name=WD40; Domain location=351-389; Score =24.0; E_value=0.00054; Accession=PF00400.22; Description=WD domain, G-beta repeat
  Pfam annotation: Domain name=WD40; Domain location=521-557; Score =12.8; E_value=1.2; Accession=PF00400.22; Description=WD domain, G -beta repeat
  Pfam module annotation: Pfam domain module=WD40::WD40::WD40::WD40; Domain location=244-283::309-347::351-389::521-557
  Subcellular localization annotation: CTP_CleavageSite=15; ConfidenceScore=5.05e-01
MMNNSNGMISKTSSSSNTAQSQQSQSTGLKMHFKTPEGRYKLHCDKTYPSTLLHYAHGKTVSQVTLAHLKDKPVPLTPTGQSSTFSATSGVRSAAARLWGGSNGGRSLSFVGGNGTSKNLGGNSRIGSIGASSSSNSTTNSNFDGNGTYLIFNVGDAIFISDLNSQDKDPVKSIHFSNSNPTCHAFDQDSKDGHDLIIGLNTGDVSLRQQLQDVGKKLVGAQHYNKDGSVNNRQHLIPRHCMETSSDSCFFAFSSRCTCIAWVPGGDAAFVVAHADGNLYNKDSAGDSSFAVVKDQTQFSVSHARNSKSNPIARWHICQGSINSISFSTDGTYIATVGRDGYLRVFDYLKEQLICGGKSYYGALLCCAWSMDGKYILTGGEDDLVQVWSMEDRKVVAWGEGHNSWVLVSCDLVAMDSRLVVIEASSELVFIKVSGVAFDSYWSSPNSNDDEETIRYRFGSVGQDTQLLLWDLEMDEIVVPLRRPSGGSPTYSAGSQSSQWDSVVPLGTLQPAPSMLDVPKISPLVTHRVHTEPLSGLIFTQESVLTACREGHIKIWIRPAAAESQSSNSETLLSTGLKEKPLILSKIGNSSHRQ

SEQ ID NO: 167514 - protein, 219 aa, Glycine max
  Coding DNA Sequence Number=SeqID_50736
  Gene Ontology: Mol. function=zinc ion binding
  Homolog annotation: Hit_ID=Q1EPH4; Match level="QueryCoverage=69%, HitCoverage=51%, E-value=5e-44, Identity=57%"; Hit description=Zinc finger (C3HC4 type RING finger) family protein
  Pfam annotation: Domain name=zf-C3HC4; Domain location=16-63; Score =58.5; E_value=2.2e-14; Accession=PF00097.15; Description=Zinc finger, C3HC4 type (RING finger)
KNEDGGEDIPEEEAVCRICMVELGEGGNTFKLECGCKGDLSLAHRGCAVKWFTIKGNRTCDVCKQEVQNLTVTLLRVQNGLAQNGLAQNGLAHNMLGADASRYRFWPDFAILVVINMLAYFWFHVSNMGSGTIVHCLAFSCVLGSLASFTATVMVVMCGNFILTEILKWRGRSLAQSNQQQGSQEAVPPPDQSSTIPHQAQIGSEQTESNLGESHAQRS

SEQ ID NO: 167515 - protein, 134 aa, Glycine max
  Coding DNA Sequence Number=SeqID_50737
  Gene Ontology: Mol. function=protein binding; Biological process =defense response
  Homolog annotation: Hit_ID=Q2L360; Match level="QueryCoverage=65%, HitCoverage=12%, E-value=6e-14, Identity=43%"; Hit description =Putative CC-NBS-LRR resistance protein
MYPIYIYTAASINIIKNNRRPDYLLTPGPGKYFLVNNLANDRKLASPAVEEASLAWGVYDDLQQMKDTMALIEAVLLDAEQKRSQNNALKEWLRYTKHVFSDAEDIVDDFECEALQKRVVDTHGSISEKVPFLD

SEQ ID NO: 167516 - protein, 143 aa, Glycine max
  Coding DNA Sequence Number=SeqID_50738
MTKIQGPKEGKPIPIFTKKSGLILSPWAQNLPKAHENPRAFSDISSPIFLKSSIQCPCGVTTLRAIKNLDSITLEELVGILKVHELELAQDEGTKKGKSLALTIQRPKHNSASKALVVNDASKEESDEEDDELSLITRKIRKI

SEQ ID NO: 167517 - protein, 76 aa, Glycine max
  Coding DNA Sequence Number=SeqID_50739
MSTRSTITRRFSIILSIDNVENLSANRHNSNMEAITKTIKQQFLYLWPSWGAMKDHEKDAFFQCVTICKLWDWKTI

SEQ ID NO: 167518 - protein, 63 aa, Glycine max
  Coding DNA Sequence Number=SeqID_50740
MTTLCKSKGRKSKHFHKDYLKCKSWFEKKSELNARRFLTIQTISPNEMGNKVKLQCKQSRLIA

SEQ ID NO: 167519 - protein, 216 aa, Glycine max
  Coding DNA Sequence Number=SeqID_50741
  Gene Ontology: Mol. function=DNA binding
  Homolog annotation: Hit_ID=Q1S0F5; Match level="QueryCoverage=95%, HitCoverage=48%, E-value=1e-39, Identity=38%"; Hit description=IMP dehydrogenase/GMP reductase
MTLDPSDIVWYQAASDVGEIIVSCGEYPNVPLWTKPNNLALTNEFYLNHGDHSNKRERFAQAWSAIRRLNRSQLGKKSDYVHESYTQWVIDRTKSFGLPYRLPRYLSSTIPPSSLPIPFDTKEEFHEQLTKERQEKETWKRRCQELEQENETLKGKIAQQSRELFIQNQRMIEKDDLLRRKDVLLHQDARRKRKFMDLFSRAHSDSEDPSTPGVRV

SEQ ID NO: 167520 - protein, 117 aa, Glycine max
  Coding DNA Sequence Number=SeqID_50742
MPYTICRDHAHKTLSGLGGARLGPGVYSSGYGPLSVLQGARPPQQGHAIMRQVCDRQVIMRPAQDVKETLLGGNQELTAKKLPAKRSRKDTIEEDSSVAPQVDIGFDKHRFQSMEHQ

SEQ ID NO: 167521 - protein, 37 aa, Glycine max
  Coding DNA Sequence Number=SeqID_50743
MKSQQHLGDHDEQSGGGSGDHGDSHGDELMIILKSSE

SEQ ID NO: 167522 - protein, 450 aa, Glycine max
  Coding DNA Sequence Number=SeqID_50744
  Gene Ontology: Mol. function=nucleic acid binding; Cellular component= intracellular; Biological process=chromatin modification
  Homolog annotation: Hit_ID=Q4U314; Match level="QueryCoverage=97%, HitCoverage=92%, E-value=1e-106, Identity=47%"; Hit description =Cys2/His2 zinc-finger transcription factor
  Pfam annotation: Domain name=zf-C2H2; Domain location=195-217; Score =19.3; E_value=0.014; Accession=PF00096.16; Description=Zinc finger, C2H2 type
  Pfam annotation: Domain name=zf-C2H2; Domain location=277-299; Score =11.6; E_value=0.58; Accession=PF00096.16; Description=Zinc finger, C2H2 type
  Pfam module annotation: Pfam domain module=zf-C2H2::zf-C2H2; Domain location=195-217::277-299
MRAHGIGDESGHMDDDDQASDWEDRLGGNVPPSNKRMYALRTNPNRLKSCRVCENCGKEFLSWKSFLEHGKCTSEDAESLVSCPGSDADDGGIGSGRRGCGWSKRKRSLRTKVGSFNYNCPSSEEEDLANCLMMLSNAIVDPLIAEPEESCASASKEEEQRRNPMNFIAPLSYKINNNNQHLVDNKAKGVAKGLFECKACKKVFNSHQALGGHRASHKKVKGCFAAKLDNLDDNIMEDDVITHEEFFPTKSNSTLQFDHGSSNPSLASSSKRKPKVHECSICHRSFSSGQALGGHKRCHWITSNAPDTSTLTRFQPFQEHLDQIPKFDTSSEPLDLKLDLNLPAPSNDLARRNVSSEFYLRPWVASKDAKDDNKNSQCQSLHNPNNNLDIDNDEDKNNNNSMQNLDNEGDSKIKLAKLSELKDMNTGGSSLPWLQVGIGSTATDVETDNC

SEQ ID NO: 167523 - protein, 1001 aa, Glycine max
  Coding DNA Sequence Number=SeqID_50745
  Gene Ontology: Mol. function=RNA-directed DNA polymerase activity; Biological process=RNA-dependent DNA replication
  Pfam annotation: Domain name=rve; Domain location=703-841; Score= -5.1; E_value=0.016; Accession=PF00665.16; Description=Integrase core domain
  Pfam module annotation: Pfam domain module=Retrotrans_gag::rve; Domain location=11-105::703-841
MGVPNDVIQLNMFSFSLVGNAKKWLYFCKGHSLTTWDKVVDKFFRKYFSEAKFTKGKTKISSFHQFSNEYLSEAWDRFRGLHWKTPAHMFSEPFQVNMFIDGLRPKTKQLLDASTSGKIKLKTSDEAIELIENSRCTLVLVSTVRWQPLEQTHPSNTYKQDEGGASNKPPNLYEKQSKLEDTLTQFMQQNARGLSANAKVNPKENCDAIFIKSGKEWEKNKDDEKNDKKENEKEGVEASVDEQKCKNHIVRERKKVAKEESIKPLPYPLTPSKNAKESYFAKFLKIFKKLEIKIPFGDALQQIPLYAKFMKELLTKKRKNNEDPGSFTIPCTIHDLSIGKALIDEGAIIKLMPLLMLKKIGTLEMKPIRMSLHLVNQSITYPLGVMEDVLVKVGELTFPVDFVIMDIEEDREVPIILGKPIIMISKVIVDIGEIPLKYEVIDDLRKHEVVSKPKLELKTLPPHLKYVFLEDNWCKSMPFGLCNASTTFQRCMLAIFFNMVEKYIKVFMDDFFMHCVSHKISSRGIEVDKGKVDMVERLPPTINAKGIKSFLGHAIFYRRFIKYFSKITRPFSNLLNKDAPFVFNEKCGIAFNLLKEKLMTTLVIVAPNWSQDFELMCDASDYMVGAVMGQKRDKGIFYTDHPAIKYLFTKPDSKPRLICWILLLQEFDMEIKDKKVCENLLVDHLSRLVNEEVTSKEREIRDEFPDEFLLMGIDFVGLFPSSYGHEYILVTIDYVSKWVEVVATPKNDAKIMINFLKKNIFSRFRVPRVLISDEARFETIERWCLWLKKKLSLNAKEFPKLERNIKNRKCKLGESVEVKFDVTSINMMLGTTLDGPFEYGESKSKGITKMILRIWSGFCVFLDKPLTTNKYIKSECWNNDSTITLSAHSVPSKIPFPQQLKEVRRELNEIKEKNLALLRAISFDVAERKRHMVVQHPDNQFPSREDFAAHVAWPQSTVDQSFEDQWGSSSRTTVEENEEEAKGSEEDEYEIDEEEADDDME

SEQ ID NO: 167524 - protein, 186 aa, Glycine max
  Coding DNA Sequence Number=SeqID_50746
  Gene Ontology: Mol. function=RNA-directed DNA polymerase activity; Cellular component=chromatin; Biological process=chromatin assembly or disassembly
  Subcellular localization annotation: CTP_CleavageSite=18; ConfidenceScore=5.26e-01
MKLVTTFSTLTSLLMPMQATKVASPQCLSLVPFFMQGSVLAWFKWLHANHLLTTWKEYTQALELRFGLSSYQLGSVTEYWKEFETLSNREMGLYPEAFLNYFMSGLHVGIHDKLKDVHPFSHCFSHTSSTTTTPFILGPSPSVSPSMTLLIQLISSVKMSEQKAKGLCYNCEDRWSPNHHCQKKQC

SEQ ID NO: 167525 - protein, 116 aa, Glycine max
  Coding DNA Sequence Number=SeqID_50747
MAEADNATQTLMDYLTQKTCAYLYNIYGDKRIMKREVHQVENEVATSGLGQQIQALSKQIESLMKDQSQKFHGEMKNSKEEAMRELYRSLSQLLQSKSIFRIVQIKKIQSKCMKIP

SEQ ID NO: 167526 - protein, 192 aa, Glycine max
  Coding DNA Sequence Number=SeqID_50748
  Gene Ontology: Mol. function=protein transporter activity; Cellular component=integral to membrane; Biological process=intracellular protein transport
  Homolog annotation: Hit_ID=Q9SF29; Match level="QueryCoverage=94%, HitCoverage=69%, E-value=4e-63, Identity=66%"; Hit description =Syntaxin-71
MSVIDILTRVDSICKKYDKYDVDKHRDANVSGDDAFARLYASVDADIEALLQKAESASKEKGKASAVAINAEIRRTKARLLEEVPKLQRLAVKKVKGLSSQEFAARNDLVLALPDRIQAIPDGAPPVPKQTGGWAASASRPEIKFDSDGRFDDEYFQQSEQSNQFRQEYEMRRMKQASNLKQLRVVCRYLLA

SEQ ID NO: 167527 - protein, 409 aa, Glycine max
  Coding DNA Sequence Number=SeqID_50749
MITKDDDKGDDKKLKGQSKNEFKIFKIQSRTLQDSRGKLISRDQDFKNQDSRDQDSRLKIQESREGLIKIRYILCGTSKRYIYLGLTENKRGYISCGSVLVEGTSTRFKENKGGYIPCGSLLLVVYTKSDHFHLSPAYFKGTHSPRTLRVAGRIKELDVTILVDSGSSHNIIQPRIAKFLGVPVVAISPFSVMVGSGNTIQCLGLVITYMFELAEQEFSISIFVLPIHADLVLGVQWLQTLGTFRLDFSISLIQFTYNKKPISLIGTTQATPMYYSGRRGLKPYFVRGVNEFVDKAQQNIYYKDDGGIRCICLKCNYCAILKDEMVKVHLYKVGFKLDYWIWIEHSEERPHVYLHVQDICIGISSNGADVAQVEQFMSMQKMVFDALRQHELVKAPKSNNMEEPPNEET

SEQ ID NO: 167528 - protein, 356 aa, Glycine max
  Coding DNA Sequence Number=SeqID_50750
  Gene Ontology: Mol. function=transferase activity; Cellular component= chromatin; Biological process=DNA integration
  Homolog annotation: Hit_ID=Q1SPQ1; Match level="QueryCoverage=54%, HitCoverage=37%, E-value=3e-29, Identity=42%"; Hit description =Polynucleotidyl transferase, Ribonuclease H fold
  Pfam annotation: Domain name=rve; Domain location=97-249; Score=-7.0; E_value=0.023; Accession=PF00665.16; Description=Integrase core domain
MTYLGHFISQQGVEADPEKLQAIWAWPQPFSATILRIFLGQKSYSRVYTDQQSLRGMVNQVIQTPTQQKWLAKLVGFNFEILYTPGKDNLVTDALSRISEPPELLFLAATTCHPLFLDQLRQFYQDHSLGQQIIRKGMGEIDSNFTAATLAPIFLSDINRLHDMLRTIVSDHERVFGAHSGANSLASKERLYPSTDVQTKVTNRTLETFLHCFVCDSPGNGVQYFPLAEYWYNTTYHSVIKMSPFVALYYHSPPSLWSYIASSKVVTALDSTLSQRHSQLQVIKDNLAAAQISMCNQANTHRQDRSFKGGNVTYDFHEAHPNTKTLDPIASIYLKFQMLKLGQLRHKSPRGAGPNE

SEQ ID NO: 167529 - protein, 112 aa, Glycine max
  Coding DNA Sequence Number=SeqID_50751
MGKKNTIGHHLEKKNFDNIFNILMNVSDKTKHNEKARKDLALLANQRLAPLDLALEESIRSRCWAKAIGGKTKGRLYRAGDLARDYQGGDSSLTQKSKASSSFHLIQKRLSS

SEQ ID NO: 167530 - protein, 120 aa, Glycine max
  Coding DNA Sequence Number=SeqID_50752
MKVNGPKPSDLNVAIIKLEGSRSCNEELQRRWQSSEDIARSDFGVGYQPAKKTSDITLRASQCWLENYVDGNEIKFDGGDSSLGQDTAWVVSRYFKRKSSYAPFCYDSEESGLENPTSKG

SEQ ID NO: 167531 - protein, 78 aa, Glycine max
  Coding DNA Sequence Number=SeqID_50753
  Gene Ontology: Cellular component=extracellular region; Biological process=sexual reproduction
  Homolog annotation: Hit_ID=Q9AXE4; Match level="QueryCoverage=59%, HitCoverage=16%, E-value=8e-10, Identity=69%"; Hit description=Beta -expansin-like protein
MGSSWSYIFRTTQRVVGRMVRGACGYIDSVRNPPLSIMASAGGPSLFLGGRGCGACYQVHAARWLKEAILLVLNNILK

SEQ ID NO: 167532 - protein, 74 aa, Glycine max
  Coding DNA Sequence Number=SeqID_50754
MALAQQRQWLTVVDNEIQLELRRRRFGPRDFQGWFALFKAHLTLGSLEEKTAAVAGGGDAGDSQNRIVPALISC

SEQ ID NO: 167533 - protein, 421 aa, Glycine max
  Coding DNA Sequence Number=SeqID_50755
  Gene Ontology: Mol. function=motor activity; Cellular component =flagellar hook; Biological process=flagellum biogenesis
  Homolog annotation: Hit_ID=P26416; Match level="QueryCoverage=90%, HitCoverage=85%, E-value=1e-42, Identity=35%"; Hit description =Flagellar hook-length control protein
  Pfam annotation: Domain name=Flg_hook; Domain location=224-366; Score= 126.9; E_value=5.8e-35; Accession=PF02120.7; Description=Flagellar hook-length control protein
MNTLPTLLTQLAKTGKAQPSAAVDNLSAADTLPQGFITELGNRLLTLVKQQGNGAQSADLAAEIDAKNVTKASLSALLLALDKPEALNALLQPENTKAGLKSADDNDKRAASSLTASDLQNVQALFAMLPAVVENRSSPPADNSTALETRGEARTSLNAALLNSSLQSALKEEQAKPDGQPSKGSDALTSLTGVSHSPVQSAAASGTPASNSGMTLDESFQQVLSTLSKPEERREMLSSHDSSAPAISSPLSSTSPLVSTTASTSSAPSTPMLNAQLGSNEWQQALSQQIVMFSRNGQQNAELRLHPEDLGAIQISLTLDKDQAQLTMVSSHSHVRAALEAALPQLRTALAESGINLGQSNVNSDAFAQGQSYQGQQEGRRDGQYGSFTLSQDSDNEITPIAVPAALQARATGNGAVDIFA

SEQ ID NO: 167534 - protein, 285 aa, Glycine max
  Coding DNA Sequence Number=SeqID_50756
  Gene Ontology: Mol. function=motor activity; Cellular component =flagellin-based flagellum basal body; Biological process=ciliary or flagellar motility
  Homolog annotation: Hit_ID=P06974; Match level="QueryCoverage=48%, HitCoverage=41%, E-value=1e-63, Identity=87%"; Hit description =Flagellar motor switch protein fliM
  Pfam annotation: Domain name=FliL; Domain location=12-149; Score =98.8; E_value=1.6e-26; Accession=PF03748.4; Description=Flagellar basal body-associated protein FliL
  Pfam annotation: Domain name=FliM; Domain location=171-285; Score =123.1; E_value=8.1e-34; Accession=PF02154.6; Description=Flagellar motor switch protein FliM
  Pfam module annotation: Pfam domain module=FliL::FliM; Domain location=12-149::171-285
MSDNAKAKGRKRSLLIPVLLIVTLAACSVAGYAVWRMMNKHEGDKPEAAKVEPPPAPVFFAMDTFTVNLVNPDNDPDRVLYVGFTLRLPDEDTRRRLNDYLPEVRSRLLLLLSRQSASALATEQGKQALVEQIKQVLAPPLAEIDALLNGDSDSAEVENSSKGADGDIRPYDPNTQRRVVRERLQALEIINERFARHFRMALFNLLRRSPDISVGAIKIQPYHEFARNLPVPTNLNLIHLQPLRGTALVVFSPSLVFIAVDNLFGGDGRFPTKVEGREFTTPSSA

SEQ ID NO: 167535 - protein, 50 aa, Glycine max
  Coding DNA Sequence Number=SeqID_50757
MSVLVMSCKLAGDEEGSPSTEAMDILRYSNGYTLLGKFTTSGLSVKWPRV

SEQ ID NO: 167536 - protein, 116 aa, Glycine max
  Coding DNA Sequence Number=SeqID_50758
MKYGHSSPLPCPVFECSICVCVRVNVRLRHNTRITFYILNITGVHMFVSVSISVLVSVLHSHVHRKESRYCNGKFHRMVSYSCINLKRRHLLLLRLQRLHVINWSANDAAPEVGFQ

SEQ ID NO: 167537 - protein, 88 aa, Glycine max
  Coding DNA Sequence Number=SeqID_50759
  Gene Ontology: Mol. function=protein serine/threonine kinase activity; Cellular component=chromosome, pericentric region; Biological process=protein amino acid phosphorylation
  Homolog annotation: Hit_ID=Q1S0R7; Match level="QueryCoverage=96%, HitCoverage=31%, E-value=4e-33, Identity=76%"; Hit description =Protein kinase
MEILTSLRHTNILRLYGWFHDADRVLLILEYAHKAELYKELRKKDCLTEKQAATYILSLTKALAYCHEKHVIHRDIKPENLLLDHEIS

SEQ ID NO: 167538 - protein, 532 aa, Glycine max
  Coding DNA Sequence Number=SeqID_50760
  Gene Ontology: Mol. function=transmembrane receptor activity; Cellular component=membrane; Biological process=signal transduction
  Homolog annotation: Hit_ID=Q8ZPA9; Match level="QueryCoverage=96%, HitCoverage=95%, E-value=1e-155, Identity=59%"; Hit description =Methyl-accepting chemotaxis protein III
  Pfam annotation: Domain name=HAMP; Domain location=188-257; Score =50.6; E_value=5.3e-12; Accession=PF00672.15; Description=HAMP domain
  Pfam annotation: Domain name=MCPsignal; Domain location=288-510; Score=374.8; E_value=1.4e-109; Accession=PF00015.11; Description =Methyl-accepting chemotaxis protein (MCP) signaling domain
  Pfam annotation: Domain name=TarH; Domain location=30-169; Score =32.2; E_value=1.8e-06; Accession=PF02203.6; Description=Tar ligand binding domain homologue
  Pfam module annotation: Pfam domain module=HAMP::MCPsignal::TarH; Domain location=188-257::288-510::30-169
MPLFSMIFGGILLLFALCIGLASYFLIQSNNSLNDATDEIQVRMGISNSSNHLRTARLNVLQSGAAARIGEMDGYRADLARTETRIKQAREGFKIYMDRKMKTPADLALDGPLTTSFNAYIDKGLKPMIESAKQGSFEGIVAQETDVTRKLDDAYNAVLLKAIKIRTERAEAINAEAAHQSRVGFIAMAAAFAAALLLVLLTFVFLRRVVINPLRLSVGRIERIAQGDLTAPEQAYGRNEIGSLLHNLQLMQASLVRTVGTVREGAVAIYQGSSEISAGNTDLSSRTEQQASALEQTAASMEQLTATVKQNAENAHHASQLAADASGKARSGGELVSGVVKTMNNISGSSKKIAEITNVINSIAFQTNILALNAAVEAARAGEQGRGFAVVASEVRNLAQRSAQAAKEIESLIAESVDLISNGSHQVGEAGSTMGEIVEAVRRVTDIMAEIAAASDEQSRGIQQVSLAVTEMDNVTQQNASLVEEASSAAASLEDQAGKLTQAVAVFRLNDTPASLVAAAPQSALKAPALAP

SEQ ID NO: 167539 - protein, 759 aa, Glycine max
  Coding DNA Sequence Number=SeqID_50761
  Homolog annotation: Hit_ID=UPI00006B2F46; Match level="QueryCoverage =42%, HitCoverage=85%, E-value=1e-112, Identity=56%"; Hit description= conserved hypothetical protein
  Pfam annotation: Domain name=Hydrolase_3; Domain location=4-219; Score=-32.0; E_value=2.5e-05; Accession=PF08282.2; Description =haloacid dehalogenase-like hydrolase
AASEWLARLKQQQIPLVVCSSKTAAEIIPLQKRLGIAGAPFIAENGARVAFAGEAQIAEEPGADYLALCATLSTLQADFRFTGFHDFSDAEVARFTGLTLTEASQSRLRDASEVIVWRDDETRLDAFRAALAQHQLALTQGGRFWHVMPAGSGKGVALEQLLQQLQQQEGTKRTTIGLGDGPNDAPMLERVDYAVVIKGFSKNPVVLQRSDHHNVYHTAHVGPEGWREGPALDNIVNELAKVPYLEEIVIGLDRADRDQFLFAREFFSRLPQRHRILWNDGPRLKALDAELDKEGLSPSQPGKGRNVWFCTGYTLASDRSQCVALHDCDIVTYERGMLARLLYPLANPAFQYEFAKKVYGHSEYLDYLTSFRYPLSGEFAMRTHVLNGIKIPGDWGLEIGVLSEIYRNYTTRQTCQVEIADNYDHKHQPLAEEDGTGGLKRMSNDIVQSLLRKLATMGVPLTSDSFRVLKATYYRNALDMMEIYNHEATMNGLKFDQHIEEAAVEMFTQAILDAGQSFIERPNEKPFIPSWSRVQSAFPDILQRIYQAAAVRYRLQTFCMVTALLSTAADTCRQRNAKGGAGVDQNGFGRQPAADTLRHALRLSQRGVRQHDTKLLAADASGHVVRAQRMFDDAGHAHQRLIARVMAPAIIDLFKMIDIELDHRQRLLLLFAAPRQRDKLVEKGAAIKQARLPVASPGGKSPDALAPVTARTAATCPTETALPAPAPATIPGAGSARESPASAGRAARGSMPHRAVPAA

SEQ ID NO: 167540 - protein, 72 aa, Glycine max
  Coding DNA Sequence Number=SeqID_50762
MLDFFVIQAMRVFKILKIGFFKILRMGCSTVNSGSFGQVDEEDSIGRGLGWELYFARCLHTIRNIEESQFDK

SEQ ID NO: 167541 - protein, 92 aa, Glycine max
  Coding DNA Sequence Number=SeqID_50763
  Homolog annotation: Hit_ID=Q9M205; Match level="QueryCoverage=94%, HitCoverage=40%, E-value=4e-23, Identity=56%"; Hit description =Regulatory protein-like
MLLLMNFRNSYFARVGGLRTNELNELELEFLFLMGFKLHVNVSVFESYCCHLEREVSIGGGYHIERTLRCAEEIKAKNIEERGYTQITRVML

SEQ ID NO: 167542 - protein, 68 aa, Glycine max
  Coding DNA Sequence Number=SeqID_50764
MTRITFLARFCIRKFKEGGRCMEGGVGIRNFGVYGMLGMSLLFEWDHPKCNRCLCARWWGLSQNTLAL

SEQ ID NO: 167543 - protein, 130 aa, Glycine max
  Coding DNA Sequence Number=SeqID_50765
MVKFVYPYTTSIILPVQWRIHPKSIGGASARPQMAVGPPLLRDMVHLLAILEVPLLRYHLWGRFWLFQSSQVPTDSNSKSSANKIEEEARGGKYSSHSLEKVAAMICNKISLYGVKFVSDLTSCEFGDLG

SEQ ID NO: 167544 - protein, 156 aa, Glycine max
  Coding DNA Sequence Number=SeqID_50766
  Homolog annotation: Hit_ID=Q47522; Match level="QueryCoverage=34%, HitCoverage=66%, E-value=3e-25, Identity=100%"; Hit description=LacZ protein
MTIRILKSFRCSISSVSIYYVPNSDIRVKSYDHSNSRELPLFNFEHPDILSPPPLTFVESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 167545 - protein, 117 aa, Glycine max
  Coding DNA Sequence Number=SeqID_50767
GAGPGARKKPCLNYVVACHFPSLSCPPYRIRTTRVEDFDYKVRYRIRLGEVPFSPTEQDKNRLAGLTSYSYPGRGKDALSFPIDIVFSRIELHSILVGKAAKVPFIRDYNLHQPMQK

SEQ ID NO: 167546 - protein, 119 aa, Glycine max
  Coding DNA Sequence Number=SeqID_50768
MGETHEIPHHNLADFEPWLGYATEGQAVGGIPFENTLEGPQFRPQPQPWHFAVGRAPPAMAEEGKADHLKERLRAIERGEDYAFAKPRKVVPNTQTWSFPSSRCWTLTSTRGLLVSRTI

SEQ ID NO: 167547 - protein, 155 aa, Glycine max
  Coding DNA Sequence Number=SeqID_50769
  Gene Ontology: Mol. function=chitin binding; Cellular component =extracellular region; Biological process=chitin metabolic process
  Homolog annotation: Hit_ID=UPI0000612705; Match level="QueryCoverage =78%, HitCoverage=92%, E-value=2e-20, Identity=30%"; Hit description =UPI0000612705 related cluster
  Subcellular localization annotation: CTP_CleavageSite=73; ConfidenceScore=5.62e-01
MARACNPLKARACSPLKARACSPLKARTCSPLKVRACSLLKVRTCSPLKARTCSPLKARACNPLKARVCSPLKARMCSPLKVRACSPLKARTCSPLKVKACSPLKARTCSPLKARTCSPLKEIGSSTQGSTPMRKQEIDSSIVLIIPNSKDLDIK

SEQ ID NO: 167548 - protein, 110 aa, Glycine max
  Coding DNA Sequence Number=SeqID_50770
MVTWCNGPISSQEALCTRIPRQYARKENEDYEDIARGIATGSRKQHKSPSKGQWSTLNLYTKVTLSSCLHVPNTRSIICQLYNIAFGGFCDATFATLKFDNKKVNLQGKL

SEQ ID NO: 167549 - protein, 214 aa, Glycine max
  Coding DNA Sequence Number=SeqID_50771
MEGAKPMKTPTHASNPLSRDESSKLVDHTINTGLIYTFNVALPWDRTKIGKTFHKKDIILKALEETTPKTQFQIAINKHVLYQKANCYKGKELLIEDNGDAPPTKYAKVHLESLKHETELFNMDWYAIKRFYRLKECYSGLEPDEKPPVDAVHHEIGFFFTHHVDPIIEKFECDVEDASDSVVVQVYDPQPSRAYVRLLEDELARTREALTQAL

SEQ ID NO: 167550 - protein, 98 aa, Glycine max
  Coding DNA Sequence Number=SeqID_50772
MELRSTFTTCFFLLILILALPRFSRGESEALHTEIYEIDYRGPETHSSGVPPPHHFHIGKQHSTSHPQKGSVRGTKALGLRDSTYDENKAKYSTIHSS

SEQ ID NO: 167551 - protein, 422 aa, Glycine max
  Coding DNA Sequence Number=SeqID_50773
MWPILLLVAVAGSTGFATKRFLTRRNTIEGENVNLHDPSAFDFSSSESTSQMHNNDGVFTFSSSKSESLTQQDGPESRRSRASNDGVRAPKVEARSEKRNGGTKLHFRMKKREITRNVAAKAPVRSSKDDSLFGRGLCSGIMCMMSAGKAEINKLNKTMDETAKLVQELKSELNRRKSSHALQNLDSVGNGVTNSCKISGRNEVMLKKTNSELRDVDVKIWSPCVNDCGECGSSALTEEPEPQVLEMDQLEAELEFELQKLSGCATDGPCDEKIKPNLDELEAPGEGYHGTDHGVSASELHQKLSHLLIKQQENQIMELESELHQAQSNLHEKEAELQALKDCVKRLTELSLSTVSGMIISRIMTHSSCSQTPHRLAYDEAQVLSDPKGTSDYGNNNMHSESKHSVIGTKRPLDSESFSCYM

SEQ ID NO: 167552 - protein, 187 aa, Glycine max
  Coding DNA Sequence Number=SeqID_50774
  Gene Ontology: Mol. function=galactosylgalactosylxylosylprotein 3 -beta-glucuronosyltransferase activity; Cellular component=membrane; Biological process=cellulose and pectin-containing secondary cell wall biogenesis
  Homolog annotation: Hit_ID=Q599J6; Match level="QueryCoverage=65%, HitCoverage=36%, E-value=7e-49, Identity=78%"; Hit description=Beta -3-glucuronyltransferase
  Pfam annotation: Domain name=Glyco_transf_43; Domain location=66-186; Score=-22.4; E_value=7.2e-08; Accession=PF03360.6; Description =Glycosyltransferase family 43
  Subcellular localization annotation: CTP_CleavageSite=51; ConfidenceScore=5.12e-01
MGSLERSRKKVMLWKKAMVHFSLCFVMGFFTGFAPTVPQLKPRRLIIIVTPTSTKHPFQTVILTRLANTIKLVPQPLLWIVVEGQTDSTELWKMLRKTGIMYRHLVSKENFTDLEAELNHQRNLALKHIVHHRLSGIVHFAELSNVYDLEFFQQLRHIEYDSSLSILCTSSISLITLMMMMMIINID

SEQ ID NO: 167553 - protein, 227 aa, Glycine max
  Coding DNA Sequence Number=SeqID_50775
  Gene Ontology: Mol. function=binding; Biological process=protein transport
  Homolog annotation: Hit_ID=Q9LYX8; Match level="QueryCoverage=95%, HitCoverage=49%, E-value=3e-63, Identity=56%"; Hit description =Importin alpha-like protein
  Pfam annotation: Domain name=Arm; Domain location=115-156; Score =33.5; E_value=7.1e-07; Accession=PF00514.13; Description =Armadillobeta-catenin-like repeat
  Pfam annotation: Domain name=Arm; Domain location=178-218; Score =21.5; E_value=0.0031; Accession=PF00514.13; Description =Armadillobeta-catenin-like repeat
  Pfam module annotation: Pfam domain module=Arm::Arm; Domain location =115-156::178-218
  Subcellular localization annotation: CTP_CleavageSite=49; ConfidenceScore=5.11e-01
MADSGFTSDRRDPIKSSVGNAAASRRRQHAVTVGKERRESLMRAKRLCRVGIGGGNGEFSVDSVMLTDEEQSILESQTLAAVENLKSALAFQGKGAVKKRVGALQELRRLLSRSEFPPVESAINAGAVPLLMQCLSFGSPEEQVLEAAWCLTNIAAGNPEETEALLPALPLLIAHLGGEELRNVLLVQGALLPLARMMLPNRGSTARTAAWALSNLIKDFSFMKMKI

SEQ ID NO: 167554 - protein, 46 aa, Glycine max
  Coding DNA Sequence Number=SeqID_50776
MASMKRAAEHTDMVLRTYDVCDAADVRLGYFPNTPLSRPALIGLGA

SEQ ID NO: 167555 - protein, 78 aa, Glycine max
  Coding DNA Sequence Number=SeqID_50777
MPLPVATGNQEPNTVISGSNINIHRKGSSLIMGHTVNKVFAEPAGFSFHILLSLRDPLSLLLKISLHFPPFTGEIEFR

SEQ ID NO: 167556 - protein, 534 aa, Glycine max
  Coding DNA Sequence Number=SeqID_50778
  Gene Ontology: Mol. function=RNA-directed DNA polymerase activity; Cellular component=exocyst; Biological process=RNA-dependent DNA replication
  Homolog annotation: Hit_ID=Q1SRI1; Match level="QueryCoverage=97%, HitCoverage=85%, E-value=1e-132, Identity=43%"; Hit description=RNA -directed DNA polymerase
MGIQQNDMLVERFTEDEVKRAVWSCGNDKSPDPDGLNFKFIKQFWDIIKSDFLRFFDEFYVNGVFPRVLNASFIALIPKLVDPQVLNHYRPISLIGCTYKILAKVLANRLKKVMHLIINERQSTFIQGRHMLHSVMIANEVVEEAKRCQKPCIIFKVDYEKAYDSVSREFLTYMMTRMGFCTKWIQWIAGCLKSASVSVLVNGSPSSEFLPQRGLRQGDPLSPLLFNIVAEGLNGLMSKAIEKRLYRGFLVGTHKVDINLLQYADDTIFFGEASMENVRTIKAILRALELASGLKINFAKSSCGAFGVSDLWISGAANYLHCSVMSFPFTYLGIPIGVNPRRRQTWDPIVTKCERKLVRWKQRHLSFGGRVTLINSVLTSIPIYFFSFFKVPKKVVDKLTRLQRNFLWGGASEQNKIAWIRWETVCLPKEDGGLGVKDINSFNISLLGKWRWKLFQNQGELWARVIESKYGGWRNLNEASSIVWKVGRGDKFKFWEDSWIGEDNHLLEKYPRLHSISLQQDHFIQQMGDFKDSG

SEQ ID NO: 167557 - protein, 282 aa, Glycine max
  Coding DNA Sequence Number=SeqID_50779
  Gene Ontology: Mol. function=hydrolase activity
  Homolog annotation: Hit_ID=Q1T2K5; Match level="QueryCoverage=81%, HitCoverage=44%, E-value=1e-105, Identity=75%"; Hit description =Alpha/beta hydrolase fold
MTRVPEMKISRVLNSYCAAMLAPMINPYDTDMTKEETKRTWEKWLQRRKMMYSLARRFPKLLTFFYRKSFLPEKHDEIDKLLSFSLGKKDKLMIEEPEFEEFWQRDVEESVRQGNIRPFIEEAVLQVSNWGFDLKELHVQKKCQTRGILLWLKSMYSQADCELAGFLGLTHIWQGLDDRVVPPSVMEYIERVLPEAAIHKLPNEGHFSYFYFCDQCHRQIFATLFGTPQGPVERQEETATVLEEEVSQARLRLDVNTTGGSTARWSLKEKRMIDIVLGILNR

SEQ ID NO: 167558 - protein, 63 aa, Glycine max
  Coding DNA Sequence Number=SeqID_50780
MRDFNGGDSLVVGVTHINIMRVTEDEDVTPTLCRRCVRIVSKSVTIDELGLVPKSDHFCVVLM

SEQ ID NO: 167559 - protein, 74 aa, Glycine max
  Coding DNA Sequence Number=SeqID_50781
MSKTWDNSSFFDLQNLFNVEGQMMVITIYTNRKSLILGDFQEAQIRVRPLLYASVTTSSLDTIRIPEHVNRETG

SEQ ID NO: 167560 - protein, 134 aa, Glycine max
  Coding DNA Sequence Number=SeqID_50782
  Subcellular localization annotation: CTP_CleavageSite=80; ConfidenceScore=5.49e-01
MEAMLSKFILMMPKTQVKNQKSRKFQESKSRSIKASFKNQRVIQSKQVSRIKESFNQELRFKVLHSGNRLPEGNNRLPVVATYPFAGERGKRGRSLPPCSPRRARLLPLEGTAFWWNFLEGLSGSGCYLHPPVY

SEQ ID NO: 167561 - protein, 79 aa, Glycine max
  Coding DNA Sequence Number=SeqID_50783
MPVCGRSLLVAWTSNGNELRATFRWKKCRDSETKFNKLDKSTRKEKVAQGPTYISQISDTNWKNVNPFKEDQGMIAIHP

SEQ ID NO: 167562 - protein, 289 aa, Glycine max
  Coding DNA Sequence Number=SeqID_50784
  Gene Ontology: Mol. function=ATP binding; Biological process=cell killing
  Homolog annotation: Hit_ID=Q4BCQ3; Match level="QueryCoverage=59%, HitCoverage=32%, E-value=3e-22, Identity=37%"; Hit description=Zeta toxin
  Pfam annotation: Domain name=Zeta_toxin; Domain location=119-289; Score=103.1; E_value=8.3e-28; Accession=PF06414.2; Description=Zeta toxin
MKTRQTAEQVPTRPQSSPPVPAKLQEMLKDYPEYIERLQKALNSVKDRRIKSTPPFEAAVWLLEDHLSGFIAEARAELATAETSGNPQAIAQANEKLELMFMARSGGGGMLNITPSAVLAPATHAEYLERHVIPRSGFNSANHHEVPRAIVLAGQPGAGKRKLNDAAKIDLGYDVVPIDPDDLRDTHPDVERLRQQHPYTWAGHTHEDASQWAKELRSAAIGGRRNLILDTTLGNGDSAVTLIKDLQAKGYDVEIRGVVAHRLESELGVDARFADSLNSAGFGRYVPED

SEQ ID NO: 167563 - protein, 146 aa, Glycine max
  Coding DNA Sequence Number=SeqID_50785
MVGAGLKKDLRVSRVVPGGSLKAFLFLLIGVISQRLAMESIDSLPIGWTVGAMIYFTGEVSAQLVELRSCNWVVAITGWMSNCPGGNDSILRAVKNVEEGFLIWDPGEEDQAGPCEQLDALSPFNPLSEMWQKEKESMDRPHRLHP

SEQ ID NO: 167564 - protein, 134 aa, Glycine max
  Coding DNA Sequence Number=SeqID_50786
ADSLNTFLETLVILEPGETLPTYSKFCKLRPDPQELAAQLCIPGRGFVLNAEGLPWKLLRKDLTTLAQTWSILSYFNLAPTSHTSNLNLDRASLAINLAYIKKNSWNLDDPTVSFPGTRKARARGSESPSSTTP

SEQ ID NO: 167565 - protein, 165 aa, Glycine max
  Coding DNA Sequence Number=SeqID_50787
LGKARLAKEKFRSAATNIRKECAELREENAANARVLEQETKRARKEEHGRDKFRGALWGSNNELTLRRKERDQSRVHGMILKEGLAACSRSKKSLAQHLEAMEQSMLAIIGQYKEELNQSLTHEQKLVEDFAQAYAEKEARGRVRLDLEWKSRPPVTTSQSNGHR

SEQ ID NO: 167566 - protein, 134 aa, Glycine max
  Coding DNA Sequence Number=SeqID_50788
MEKKRKGIALKTSSSKENHKEDSSDDQDAENLNLIVKKFGKFLKRSTDKKFSKPSKKLKTNNNTFTCFEWKKDGKLRKAYIAWEDNVSRSSNSSSEEEIANVCLMADSTDDTSVKNHLVATISLLYTMLISIFK

SEQ ID NO: 167567 - protein, 257 aa, Glycine max
  Coding DNA Sequence Number=SeqID_50789
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=100%, E-value=2e-28, Identity=31%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=21; ConfidenceScore=5.02e-01
ATRPHLKRTTCPRLPRVTRIRLHRAACPRLLRTTRPHLQRTTSPRLLEDYMSSPLEGYTPSPSEDYTSSDSEDYTSSPSEGYMHSPSEDYMSSLLEDYTGLHAVVFRGLYILPLRGLHVFTIRGLHVLAFIGLDVLAFRGLHVLAFRGLDVLAFKELHALAFRELHALARLHLKRTTGLHVLTFRGLHILAFKGLLVLTFRGLHVLAFRRLLVFAFKGLHVLAFRGLHVLAFRGLHGLAFRGLHVLAFRGLHVLAFR

SEQ ID NO: 167568 - protein, 81 aa, Glycine max; identical to SEQ ID NO: 119452
  Coding DNA Sequence Number=SeqID_50790

SEQ ID NO: 167569 - protein, 141 aa, Glycine max
  Coding DNA Sequence Number=SeqID_50791
MVSPQGRNTWTADDLVPYVEKIVILSEEQERITEPLAHGPISERRFPPQQFHMLQSSVETQGFDRRREMYQYPFEGHDTDMSASEHSFGGVLICVTSFLLRLSNKGGDSAQEEILIVKPEGGIDHVTHPHAITDTIMTDFD

SEQ ID NO: 167570 - protein, 239 aa, Glycine max
  Coding DNA Sequence Number=SeqID_50792
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=1e-26, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHALTFRGLHVLAVRGLHTLTFRGLNVLTFRELRALTLRGLCVLAFRGLDVLAFRGLHDLTFRELHVLAFRGLNTLAFRGVHILTFRGLHVLAFRMLHALAFRGLHVLAFRGLQVLAFSGLHALAFRGLHVLTFRGLHALPFKGQHALALRGLQVLAFKGLCALAFRGLRLHAPAFRGLHTLAFRGPHVLALRTTRPHLQRTTRPRHQWATRPRLQKATRPHLQRTTHPRLQTTTSPRL

SEQ ID NO: 167571 - protein, 79 aa, Glycine max
  Coding DNA Sequence Number=SeqID_50793
MRRGAKRKTKQGQEAKHDAPEDNKPKAQHRAKRAKTSKPQSEPKYFEDKRNLCTLYLPLFWFAALRHVLVWHVGSTKKE

SEQ ID NO: 167572 - protein, 32 aa, Glycine max
  Coding DNA Sequence Number=SeqID_50794
MTLTPHESHSLRIHFGMKDKLKDKQLVRGNYQ

SEQ ID NO: 167573 - protein, 298 aa, Glycine max
  Coding DNA Sequence Number=SeqID_50795
  Homolog annotation: Hit_ID=UPI0000D9B3B9; Match level="QueryCoverage =84%, HitCoverage=79%, E-value=2e-09, Identity=23%"; Hit description =PREDICTED: similar to splicing factor 3a, subunit 2
  Subcellular localization annotation: CTP_CleavageSite=45; ConfidenceScore=5.58e-01
MNSLPSAVHASSTNESGGSRIDCLTLFASSPFSTFILSPMNSLPSAVHASSTIESGGLRIDCLALFPCFPFSTFIRSPMNLLPSAVHASSTNESGAPRIDCLALFANSPFSTFIRSPMNSLPSAVHVSSTFESGAPRIDCLALFANSPFSTFIRSPMNSLPSAVHASSTFESGASRIDCLALFANSPFSTFIQSPMNSLPSAVHASSTNESGGSRIDCLALFPSSPFSTFIRSPMNLLRSAVHVSSTFESGALRIDCLALFANSPFSTFIQSPMNSLPSVVQVSSTFESGAPRIDCLA

SEQ ID NO: 167574 - protein, 796 aa, Glycine max
  Coding DNA Sequence Number=SeqID_50796
  Gene Ontology: Mol. function=transferase activity, transferring glycosyl groups; Cellular component=integral to membrane; Biological process=response to oxidative stress
  Homolog annotation: Hit_ID=Q9FL59; Match level="QueryCoverage=98%, HitCoverage=98%, E-value=0.0, Identity=80%"; Hit description =Anthranilate phosphoribosyltransferase-like protein
  Pfam annotation: Domain name=C2; Domain location=221-303; Score=66.2; E_value=1.1e-16; Accession=PF00168.20; Description=C2 domain
  Pfam annotation: Domain name=C2; Domain location=385-478; Score=86.2; E_value=1e-22; Accession=PF00168.20; Description=C2 domain
  Pfam annotation: Domain name=C2; Domain location=58-139; Score=85.3; E_value=1.9e-22; Accession=PF00168.20; Description=C2 domain
  Pfam annotation: Domain name=PRT_C; Domain location=641-796; Score =422.2; E_value=7.1e-124; Accession=PF08372.1; Description=Plant phosphoribosyltransferase C-terminal
  Pfam module annotation: Pfam domain module=C2::C2::C2::PRT_C; Domain location=221-303::385-478::58-139::641-796
MSSSQAAPKGNQEDYKLKDTKPELGEKWPHGGQRGGSGWIYNERATSTYDLVEQMFYLYVRVVKAKDLPPNPVTSNVDPYVEVKVGNYKGKTRHFEKKTSPEWKQVFAFSKEKIQSSVVEVFVRDKEMVARDDYIGKVEFDIHEVPTRVPPDSPLAPQWYRLENLRGEARSRGEIMLAVWMGTQADEAFPEAWHSDSASVKGDGVYNIRSKVYVNPKLWYLRVNVIEAQDVEPNDKSQPPQVFVKGQVGQQVLKTKLCPTKTPNPMWNEDLVFVAAEPFEEKLVLTVENKASPGKDEVAARISLPLNKFEILLDHRAVHSHWYNLERFGFGVLEGDKRNESKFSSRIHLRVCLEGAYHVLDESTMYISDTRPTARQLWKQPIGILEVGILSAQGLQSMKTNNGKGSTDAYCVAKYGQKWVRTRTITESFNPKWNEQYTWEVYDPCTVITFGVFDNCHLGGGGGQTQVAKVDSKIGKVRIRLSTLEMDRIYTNSYPLLVLKTSGLKKMGELQLAIRFTCLSMAHIIYLYGHPLLPKMHYLHPFTVNQLDSLRYQAMNIVVVRLGRAEPPLRKEVVEYMLDVDSHIWSMRRSKANFFRIVSLFSGAISMSKWLGEVQQWKNPVTTILVHVLFFILICYPELILPTMFLYMFLIGIWNFRFRPRHPPHMDTKLSWAEAAHPDELDEEFDTFPTSKAQDVIRMRYDRLRSVAGRIQTVVGDIATQGERFHALLSWRDPRATSLFVIFCLVVAVALYVTPFKVVASVAGIFWLRHPRFRSKLPSMPSNFFKRLPSCVDGML

SEQ ID NO: 167575 - protein, 164 aa, Glycine max
  Coding DNA Sequence Number=SeqID_50797
  Subcellular localization annotation: CTP_CleavageSite=42; ConfidenceScore=5.46e-01
GSSGNTPKKGSSGKVFRNFETSSGSARLPEEVFFRKTFGYFRKNTSSGNFPENVLPELPEEPLTGLPEDSSVSHFRHFFRRTLVLSPLVFYPKLRVRGRGTNLFAEKKKKALARLAEKKLHGEEKKQVPGEEEAVPGEKKLCSGTGEKKNLFEKKCSGNDLRFL

SEQ ID NO: 167576 - protein, 68 aa, Glycine max
  Coding DNA Sequence Number=SeqID_50798
MENSPPKMRPRCDDKLQSADPSARRRGSSWLHATICRPSWQFGFVKPVGSLGSLKTGQVWPSHPKPHA

SEQ ID NO: 167577 - protein, 103 aa, Glycine max
  Coding DNA Sequence Number=SeqID_50799
  Homolog annotation: Hit_ID=Q1S735; Match level="QueryCoverage=30%, HitCoverage=6%, E-value=3e-08, Identity=78%"; Hit description =Probable transposase [imported]-Arabidopsis thaliana-related
  Pfam annotation: Domain name=zf-C2HC_plant; Domain location=26-80; Score=7.0; E_value=0.0061; Accession=PF07567.3; Description=Protein of unknown function, DUF1544
MLSVEAPSSQASSTPNTSQNVRKKNDPAWGHCKQINEGATKVTMMCIYCDKRVKGGIINRLLEKEFPKLHWSPCAAHCINLMLQDFGKFEERHNRRPGRGLKN

SEQ ID NO: 167578 - protein, 112 aa, Glycine max
  Coding DNA Sequence Number=SeqID_50800
  Gene Ontology: Mol. function=catalytic activity; Biological process =metabolic process
  Homolog annotation: Hit_ID=Q8H2B0; Match level="QueryCoverage=63%, HitCoverage=10%, E-value=1e-31, Identity=85%"; Hit description=Beta -amyrin synthase
MWRLKIADGGKDPYIFSTNNFVGRQTWEFDPEAGTPEERAQVEAARQNFYNNRFKVKACGDLLWRFQQFNFKVSFVKRQVNHAIHYLVRASRSHAWNHVLDNIPISLLVLLL

SEQ ID NO: 167579 - protein, 100 aa, Glycine max
  Coding DNA Sequence Number=SeqID_50801
MLNHNRKFEALILLGLDNAVDGLCRWVLLVSRKHAMPSKKDVGRRLVIAACWKETWWWLVDVGKNLCGGSWTQEMVLHNAFKLDDDNTSQKEEWEHILKF

SEQ ID NO: 167580 - protein, 390 aa, Glycine max
  Coding DNA Sequence Number=SeqID_50802
  Homolog annotation: Hit_ID=O48901; Match level="QueryCoverage=31%, HitCoverage=16%, E-value=1e-31, Identity=49%"; Hit description=DNA polymerase delta catalytic subunit
  Subcellular localization annotation: CTP_CleavageSite=64; ConfidenceScore=5.88e-01
MVPHSPLLPPCYPITATPSTRRKLTSATTPASSSSSRQHQLSSPRSRQNSSTETHRGGILQGVRPFSIWKHRAFGHMEEVMAAIRVMFEKLKEEVDSDLDGFAGDLVGILEKNVVSDREWKERLEDLWVVTLQCLWKLSNNPLEAKSQARMPATWPKVSKVIKFAWILCVLWFDRDMQRFLAESTVGNESTNSTICDEVCQLKSSLLEGILVPVLRGNIPCRTVLQSIRCENMRVVNMKIAEFPILGCIRNNRVRVKDTTFSSSMGPGKVMQRDYKLSSYSLNSVSSHFLSEQKEDVHHSIIFDLQNGNAEIRRRLAVYCLKLLSQLLRKTRQRNLLIPNAKQAGSEQGTFEGSTDACDSTSLATTSGDNRCRKGKLTDVESSISSSAIS

SEQ ID NO: 167581 - protein, 265 aa, Glycine max
  Coding DNA Sequence Number=SeqID_50803
  Gene Ontology: Mol. function=DNA binding
  Homolog annotation: Hit_ID=Q1RUD8; Match level="QueryCoverage=93%, HitCoverage=54%, E-value=9e-22, Identity=28%"; Hit description=IMP dehydrogenase/GMP reductase
MGLDQAPSFKKRFYHVKVKNLELASLCKLGQRIDQVQHQAFSKVYGKIWNLVMIEVSIEAFTSLTQYYDQSLRCFTFGDFQLAPTIEEFEGILRCPLGGRKPCLFSGFYPSMARIEIMVKISEQELDRVKQNRNGVAGIPRKCLEEKAEALASQEEWATFTDVLALLVFGTILFLNIDGLVDLAVIDAFLAYHHNKESPVIAVLADVYDTFNLRCKKSSARIVCCTPSLYVDMSVPYKVIACDPERLGYPMRGAPSKEIIEPFIA

SEQ ID NO: 167582 - protein, 72 aa, Glycine max
  Coding DNA Sequence Number=SeqID_50804
MKMLLIPHDVAPSRACRPWIFFINGVICFLKINGSRMEKEESEFQLWFNPLIQDQVRDSPLSVLRCHEACKA

SEQ ID NO: 167583 - protein, 316 aa, Glycine max
  Coding DNA Sequence Number=SeqID_50805
  Gene Ontology: Mol. function=catalytic activity; Cellular component =cellular_component; Biological process=metabolic process
  Homolog annotation: Hit_ID=Q9MB42; Match level="QueryCoverage=92%, HitCoverage=41%, E-value=1e-158, Identity=81%"; Hit description=Beta- amyrin synthase
  Pfam annotation: Domain name=Prenyltrans; Domain location=34-77; Score=36.8; E_value=7.5e-08; Accession=PF00432.11; Description =Prenyltransferase and squalene oxidase re
MSSSPGSFLFLFVINVFLPLLLTPRHLDSVFPEEYKKEILRYMYYHQNEDGGWGLHIEGHSNMFCTALNYICMRVLGEGPNGGHDNACARARKWIHDHGGVTHIPSWGKTWLSILGVYDWYGSKPVPPEFWVLPSFLPMHPSKIWCYCRLTYLPMSYLYGKRFVGPITPLILQLREELFTQPYEKVNWKKARNQCAKEDRYHPHSLIQDLVWDSLYIFIEPLLTRWPFNKLVREKALQALYMLACWVEDPNGDAFKKHLARVPDYLWVSEDGMAMQSFGSQGWDASLVIQALLATNLMEEIGPTLAKAHDFIKKTQ

SEQ ID NO: 167584 - protein, 151 aa, Glycine max
  Coding DNA Sequence Number=SeqID_50806
  Gene Ontology: Mol. function=catalytic activity; Cellular component =cellular_component; Biological process=metabolic process
  Homolog annotation: Hit_ID=Q8H2B0; Match level="QueryCoverage=85%, HitCoverage=17%, E-value=1e-60, Identity=82%"; Hit description=Beta -amyrin synthase
MWRLKIADGGKDPYIFSTNNFVGRQTWEFDPEAGTPEERAQVEAARQNFYNNRFKFKACGDLLWRFQILRENNFKETISSVKIEDGEEITYEKVTATMTRAAHYLCALQTSDGHWPAQIAGAMFFVPPLVVANIFAKIWVECVWKMDQIQK

SEQ ID NO: 167585 - protein, 92 aa, Glycine max
  Coding DNA Sequence Number=SeqID_50807
MVGLSWSGWGFHVRGCGFDLREWNLLQLRCISCSDFGGFDWSGFFTGSEVGSSRRTRRCFSRTWIWLRIITNPWKGATSCIVCQRGREGITE

SEQ ID NO: 167586 - protein, 61 aa, Glycine max
  Coding DNA Sequence Number=SeqID_50808
MGAGVITVMAIAKIDLLFHYIRSFSQIKLDRVGGFYDNTISQMYVILDAEISMMFDSFSII

SEQ ID NO: 167587 - protein, 223 aa, Glycine max
  Coding DNA Sequence Number=SeqID_50809
LRLPAIRQPLILQFKAAFHCDKDAIEIPGFYQRQWLPNYPEIVEFKYDGETYEIQVRQQKDKLYFADGLTRFRTELQIYESVTINFLACDHPAKFDLHFTPPLDQQKCKRRRATRKHIWTYEITQSMLGAPYPLQLPTSVTQCLIHCGDHMTILRRFGPPLQWNVVVLDKGIGDKYVTLPWYKFLQEGDFSHGDELSFYYRRAEKIWEVVIKRAIDWDDSDID

SEQ ID NO: 167588 - protein, 110 aa, Glycine max
  Coding DNA Sequence Number=SeqID_50810
MEGGAAVRVFIRTDGEGGGGGRECGSGSGDGGRGAFGAEELAEGLNEFHDSTEDKAEDVLERVVVGGSRVGGTVVVEDHVVDADDDVFDLRDEGVEAVLALWRVKEREEE

SEQ ID NO: 167589 - protein, 81 aa, Glycine max
  Coding DNA Sequence Number=SeqID_50811
MFGLGLVVLLLFCSGAVLIVMARSPDKIKSIDGSKETLKLSVRISDLWFIGTPNKSEQAEMVFVDSDGDEIHAVCKQDQLK

SEQ ID NO: 167590 - protein, 189 aa, Glycine max
  Coding DNA Sequence Number=SeqID_50812
  Pfam annotation: Domain name=zf-C2H2; Domain location=14-36; Score =19.7; E_value=0.01; Accession=PF00096.16; Description=Zinc finger, C2H2 type
MKRKIEEVEEENQFSCMFCSKKFSSPQALGGHQNAHKKERNLLISMDKEKEMNALGFSPANVPMQSRAPFYPYSSHLYMSNLPLQARTLPYNGAYMHPMTEPGYCINQRFSLPTSPLITRSESTRPIVGSSSSVGAGFGQLQGSPNGPFVKVVVWKLYYDAQLAFGQLLDFCCVSLAAKVLRTYGKFTR

SEQ ID NO: 167591 - protein, 168 aa, Glycine max
  Coding DNA Sequence Number=SeqID_50813
  Subcellular localization annotation: CTP_CleavageSite=35; ConfidenceScore=5.20e-01
MDMNVGALISGQITLMAQSNSSRLGFPALITTLCMAQGVTSDSLTFKSLSPAINLAYIKKNCWNLDNPTVSFPGTRKARTRGSEGPSSVAPQTSTAPAPIPSTSVPDTSDPSAQSTYLMMAMLQSIHQGQYLVMQSLHSLAQHQPIMSIEEFSLQVAWPGVQPSSHGG

SEQ ID NO: 167592 - protein, 148 aa, Glycine max
  Coding DNA Sequence Number=SeqID_50814
MSSIVCKDRARKTPSGPGEVQQGHGVSSSDYGPLSVLRGARRRQQGVGRDTTTAWRWPAAGNRCTATTSKAPQLIYKGWSVAYDSWSTSRRPSPKSKVAKIPFAIMTREFGGMRRHPTVTRTHPFAIQRPESPEACGGTLWLSAPLVI

SEQ ID NO: 167593 - protein, 137 aa, Glycine max
  Coding DNA Sequence Number=SeqID_50815
  Homolog annotation: Hit_ID=Q9LTF9; Match level="QueryCoverage=79%, HitCoverage=33%, E-value=3e-15, Identity=45%"; Hit description =Arabidopsis thaliana genomic DNA, chromosome 5, BAC clone:F6N7
MPRAVPLACGPSNTSVDESILIEKQERVDNGANDGRFSVNQFHGRSRHKVDPARDLSIQVLEKFSLVTRFARETTSQLFGENQSNGFSPIDRRTHIQTNLDHPKSSNVEENTFVESPVVLDSQELTIYYKTGVVRCA

SEQ ID NO: 167594 - protein, 47 aa, Glycine max
  Coding DNA Sequence Number=SeqID_50816
MVLWVRIIVEESRVGDDVDPSQLSSGKFQIGVELLVKFRVKNWYEGQ

SEQ ID NO: 167595 - protein, 43 aa, Glycine max
  Coding DNA Sequence Number=SeqID_50817
MAKHHESSISSSNLRKHSEQEHLVVHVRETKFMTVMDCTICGI

SEQ ID NO: 167596 - protein, 532 aa, Glycine max
  Coding DNA Sequence Number=SeqID_50818
  Gene Ontology: Mol. function=isomerase activity; Cellular component =integral to membrane; Biological process=protein folding
  Homolog annotation: Hit_ID=Q7F1F2; Match level="QueryCoverage=95%, HitCoverage=88%, E-value=1e-144, Identity=50%"; Hit description =Putative 70 kDa peptidylprolyl isomerase
  Pfam annotation: Domain name=FKBP_C; Domain location=156-253; Score =33.1; E_value=9.9e-07; Accession=PF00254.18; Description=FKBP-type peptidyl-prolyl cis-trans i
  Pfam annotation: Domain name=FKBP_C; Domain location=275-363; Score =60.7; E_value=4.7e-15; Accession=PF00254.18; Description=FKBP-type peptidyl-prolyl cis-trans i
  Pfam annotation: Domain name=FKBP_C; Domain location=40-134; Score =156.0; E_value=1e-43; Accession=PF00254.18; Description=FKBP-type peptidyl-prolyl cis-trans i
  Pfam annotation: Domain name=TPR_1; Domain location=383-416; Score =0.4; E_value=4.8; Accession=PF00515.18; Description=Tetratricopeptide repeat
  Pfam annotation: Domain name=TPR_1; Domain location=432-465; Score =10.6; E_value=0.29; Accession=PF00515.18; Description=Tetratricopepti de repeat
  Pfam annotation: Domain name=TPR_1; Domain location=466-499; Score =34.6; E_value=3.4e-07; Accession=PF00515.18; Description =Tetratricopeptide repeat
  Pfam annotation: Domain name=TPR_2; Domain location=383-416; Score =1.9; E_value=20; Accession=PF07719.7; Description=Tetratricopeptide repeat
  Pfam annotation: Domain name=TPR_2; Domain location=432-465; Score =12.4; E_value=1.2; Accession=PF07719.7; Description=Tetratricopeptide repeat
  Pfam annotation: Domain name=TPR_2; Domain location=466-499; Score =28.4; E_value=2.5e-05; Accession=PF07719.7; Description =Tetratricopeptide repeat
  Pfam module annotation: Pfam domain module=FKBP_C::FKBP_C::FKBP _C::TPR_1::TPR_1::TPR_1::TPR_2::TPR_2::TPR_2; Domain location=156 -253::275-363::40-134::383-416::432-465::466-499::383-416::432 -465::466-499
MALSQLSHSLENELKGAEDSEFPLKEIGNEGLTKRILRKGVTWQTPFSGDEVEVHFNGQVENGASLESSYDKGSPFRFKLGQCEVIKGWDEGVATMKKGERAIFKIPPNLAYGEEGSLPLIPPNATLIFDIEMLSWSSIRDLTGDGGVKKKIIREGEGWATPREADEVLVKYEARLENGMLVSKSDQGVEFNVSDGYLCPAMSIAVKTMRKGEVAELAMRFCYGLSQNSSRITELEGVLPPDSNLTSIKLELVSWKIVADVTGDKKILKKIKNLGEGFDRPNEGSQVKGEDGTIIESKGSEEEPFEFTTQEEQVPEGLERAIMTMKKGEQALVTVDAEYLCDYNNSKGNTANNKVLYYEVELVDFVKEKPFWKMDTQEKIEACERKKHDGNLLFKVENFRHASKKYEKAVKYIEFDHSFSEDEKCRANTLHLSCNLNNAACKLKLGEYIEASRLCTKVLEQDPLNIKALYRRCQAYLKTSDLEKAEADIKRALIIDPNNRDIKLEYKELKLKQKEYSRHEADIFSTMLSRMN

SEQ ID NO: 167597 - protein, 68 aa, Glycine max
  Coding DNA Sequence Number=SeqID_50819
MEHCRSGVFVMKDSRGDSGEHNVTMILCHHDEAHNLRQRGTTKHKAGHESLQCHQKKERKRGVCKELG

SEQ ID NO: 167598 - protein, 147 aa, Glycine max
  Coding DNA Sequence Number=SeqID_50820
  Homolog annotation: Hit_ID=O22207; Match level="QueryCoverage=59%, HitCoverage=9%, E-value=1e-23, Identity=59%"; Hit description =Ubiquitin carboxyl-terminal hydrolase 5
MMSNSVNKDTTNSKAPPMPLPTLPLLLVDDNNACIDLSMGEEKVVKLSPLSPKILVYIDWSQKLLEKYDTHTLETLPEVLKYGPVTKKARTEPLSLYTCLEAFLREEPLVPEDMWLVHPAAHSILSSYLSFSCLVTIQMECTLIIVS

SEQ ID NO: 167599 - protein, 551 aa, Glycine max
  Coding DNA Sequence Number=SeqID_50821
  Gene Ontology: Mol. function=cysteine-type peptidase activity; Cellular component=lysosome; Biological process=ubiquitin-dependent protein catabolic process
  Homolog annotation: Hit_ID=O22207; Match level="QueryCoverage=99%, HitCoverage=50%, E-value=1e-162, Identity=65%"; Hit description =Ubiquitin carboxyl-terminal hydrolase 5
  Pfam annotation: Domain name=DUF1055; Domain location=183-321; Score =234.0; E_value=3.2e-67; Accession=PF06337.3; Description=Domain of Unknown Function (DUF1055)
  Pfam annotation: Domain name=UCH; Domain location=394-551; Score =71.9; E_value=2e-18; Accession=PF00443.19; Description=Ubiquitin carboxyl-terminal hydrolase
  Pfam module annotation: Pfam domain module=DUF1055::UCH; Domain location=183-321::394-551
MTEVLMCIASVSELSPDEERILIRDIALASQANSKEGDTFFLITQRLQPTKVGSVGKERTLIPQGLGFDSHCQCEDLVGRKDKNFTLPQSIGLHMLTAYNQNHKKQLPCMCLSSQCAPKTGNKWWQHWIEYVNQDQTNTSYDASSLSEQFDLANSSALKRPAGIDNSDLIDDAVLEDSGTGIEIHDTLLEGRDYVLLPQEVWNQLFRWYGGGPTLARKVISSGLSQTELAVEVYPLRLQLLMLPKNDRFPIRISKKETIGQLHRKACEIFDLQPDQVCIWDYYARRRHALMNDMDKTLDDANLQMDQDILVEVINNTNNTSFAQENGSAQREANSALVEPSKSSLSIAGGLSASRGASKGYNTDLSSSQNLNSPVRDVENPYGTSGVTTRSSFLGLTGLLNLGNTCYMNSAIQCLVHTPEFARYFREDYHREINWQNPLGMVGELALAFGELLRKLWAPGRTPIAPRPFKAKLVRFAPQFSGHNQHDSQELLAFLLDGLHEDLNRVKHKPYIKSRDADGRPDEEVADEYWANHIARNDSIIVDVCQTQLMA

SEQ ID NO: 167600 - protein, 119 aa, Glycine max
  Coding DNA Sequence Number=SeqID_50822
  Gene Ontology: Mol. function=transporter activity; Cellular component= membrane; Biological process=oligopeptide transport
  Homolog annotation: Hit_ID=Q96400; Match level="QueryCoverage=72%, HitCoverage=14%, E-value=1e-33, Identity=75%"; Hit description =Nitrite transporter
MEIEKSTKGSAEIGEKEEKKKKQHRRGGIRTLPFILANEVCDRFASAGFHGNLISYLTQELNMPLVAASNTLTNFGGTSSFTPLIGAIIADSFAGRFWTITVASLIYELVSYPLLSNLI

SEQ ID NO: 167601 - protein, 117 aa, Glycine max
  Coding DNA Sequence Number=SeqID_50823
LLGCFLAFKVKVQPRFRNSVVLKYSDESELINVVLDMIPDSEPCCKIENSILESTDPTVLESQSLSITIDHDRSMLGSSEPTKFESQSVSVTEDHDPLLRIPLTPTTRVSSDELDNE

SEQ ID NO: 167602 - protein, 80 aa, Glycine max
  Coding DNA Sequence Number=SeqID_50824
  Subcellular localization annotation: CTP_CleavageSite=37; ConfidenceScore=5.29e-01
MWQFSKKGHTSNLTHQNDNKPSKRDRWGSIGSETTSRSGQRRNKMGEGISNWDVTTTHRMMATNIAIDLFVTRRVVVLFA

SEQ ID NO: 167603 - protein, 209 aa, Glycine max
  Coding DNA Sequence Number=SeqID_50825
  Gene Ontology: Mol. function=transcription factor activity; Biological process=regulation of transcription, DNA-dependent
  Homolog annotation: Hit_ID=Q8D1L2; Match level="QueryCoverage=90%, HitCoverage=64%, E-value=2e-92, Identity=87%"; Hit description =Positive regulator for ilvC
RDDEADRPGGSVNPASAGMQQAPKGVDQRIAEALFLDADPQLERFDHRDVIQLRDAVAYRLRAVVHHYARDQCDAAAQSDHRHDGFVAADGGVNQRIADAVAAEPQLDAFSRRAVLRQDERDLGPVGPVGERLAAHRAGQRRRDQHQRDFADFGERHAGGQRFRPAGDAEIGLVGLHFVDRVGGVAGGQLNLHQRVLRAEAIEDRRQVA

SEQ ID NO: 167604 - protein, 166 aa, Glycine max
  Coding DNA Sequence Number=SeqID_50826
  Gene Ontology: Mol. function=oxidoreductase activity, acting on diphenols and related substances as donors, oxygen as acceptor; Cellular component=integral to membrane; Biological process=electron transport
  Homolog annotation: Hit_ID=Q7WMT0; Match level="QueryCoverage=76%, HitCoverage=39%, E-value=5e-49, Identity=73%"; Hit description =Putative ubiquinol oxidase subunit II
MKNEFITVDEEQPLPVQRHHFDHQRLGAGRNLAAFGQARQRPVGIELVGADPGERAQRDDDQQRRRPDQQLQHGGVVPVGVVVRVAVAGAIAPREQESQEDHRHDDQQHQAGGDDDQVALLQRDVTGWREQYRIASGEQRQGGEQQQSAEPWERRHGHTPKRNRGS

SEQ ID NO: 167605 - protein, 68 aa, Glycine max
  Coding DNA Sequence Number=SeqID_50827
MLVRMIHTRLFAVARVKPCPGVAQEKELIKGNTGPITGSASLGEDVQPSEGEGMQLSEDVWSSEGEGV

SEQ ID NO: 167606 - protein, 153 aa, Glycine max
  Coding DNA Sequence Number=SeqID_50828
MEDNVVVVAATSIVAGVDPTPLSGLNQVNHPASDMVGQGGETLGRRTHEVPHHNLANFEPRLGYTHEGQTIGGVPLPNTLEGSQYYLQLKPLHFAVGSVPPAMTEKGKFDHIEERLKAIEGGGDYAFVDIIEWCLVPDVIIPSKFKVPNFDKY

SEQ ID NO: 167607 - protein, 186 aa, Glycine max
  Coding DNA Sequence Number=SeqID_50829
  Homolog annotation: Hit_ID=Q2QYN0; Match level="QueryCoverage=93%, HitCoverage=21%, E-value=6e-13, Identity=34%"; Hit description =Expressed protein
MEAEKERSKSSHPSKEKGSRKEAERKRQEKRKEKDKGSSKSNSDVEELDRRASKETDRKRDFDKKSETDRREHQKSGFESGKGQNTDNTHSKNVAANSYNRGSTGTRYLDRMRGTILSSSKAFGFGKGANAPGTVVKENKFNGSVDHIHSTSSRKDICPPDRSTARSNLNGDDRNINHSLAWLKCD

SEQ ID NO: 167608 - protein, 222 aa, Glycine max
  Coding DNA Sequence Number=SeqID_50830
  Gene Ontology: Mol. function=electron transporter, transferring electrons within the cyclic electron transport pathway of photosynthesis activity; Cellular component=plasma membrane light -harvesting complex; Biological ...
  Gene Ontology: Cellular component=process=photosynthesis, light reaction
  Homolog annotation: Hit_ID=P56761; Match level="QueryCoverage=99%, HitCoverage=77%, E-value=1e-112, Identity=77%"; Hit description =Photosystem II D2 protein (Photosystem Q(A) protein)
  Pfam annotation: Domain name=Photo_RC; Domain location=1-222; Score =233.8; E_value=3.8e-67; Accession=PF00124.9; Description =Photosynthetic reaction centre protei
TTFVTSWYTHGLASSYLEGCNFLTAAVSTPANSLAHSLLLLWGPEAQGDFTRWCQLGGLWTFVALHGAFALIGFMLRQFELARSVQLRPYNAIAFSGPIAVFVSVFLIYPLGQSGWFFAPSFGVAAIFRFILFFQGFHNWTLNPFHMMGVAGVLGAALLCAIHGATVENTLFEDVTGLWMSALGVVGLALNLRAYDFVSQEIRAAEDPEFETFYTKNILLNE

SEQ ID NO: 167609 - protein, 210 aa, Glycine max
  Coding DNA Sequence Number=SeqID_50831
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=92%, HitCoverage=26%, E-value=1e-111, Identity=98%"; Hit description =Photosystem I P700 chlorophyll a apoprotein A1
LFVCVVWKEEDSMIIRSPEPEVKILVDRDPIKTSFEEWAKPGHFSRTIAKGPDTTTWIWNLHADAHDFDSHTNDLEEISRKVFSAHFGQLSIIFLWLSGMYFHGARFSNYEAWLSDPTHIRPSAQVVWPIVGQEILNGDVGGGFRGIQITSGFFQIWRASGITSELQLYCTAIGALVFAALMLFAGWFHYHKAAPKLAWFQDVVSMLITI

SEQ ID NO: 167610 - protein, 213 aa, Glycine max
  Coding DNA Sequence Number=SeqID_50832
  Subcellular localization annotation: CTP_CleavageSite=67; ConfidenceScore=5.90e-01
MGSPPASSPPPPPPPPPPPPPPPPAPSPPPPPPTSDTSASTSTVKRTLKALRLRSLSTRPPGVERPVVNADPTIEKADGPHKKKLRTYLGIVAHDKVDITYENWKEAEFDIPEASDSRTKRRDGGSLNQTSRGNGPLQPIRTVSRTLSVTNTASDLRIKTQAIQKQNTAPHVLSRGGYDYLKQKLLDEKTKKKLHSQEVLMASSTLYPQSDAM

SEQ ID NO: 167611 - protein, 74 aa, Glycine max
  Coding DNA Sequence Number=SeqID_50833
  Homolog annotation: Hit_ID=Q9SD67; Match level="QueryCoverage=56%, HitCoverage=5%, E-value=8e-11, Identity=76%"; Hit description=FtsH metalloprotease-like protein
GIEEKTAKLKGSEKALVARHEASHAVLGTAVPNLLAGQPHVEVWTLEYLILEFIYLVLWWEIKEKYKSVMCDIQ

SEQ ID NO: 167612 - protein, 113 aa, Glycine max
  Coding DNA Sequence Number=SeqID_50834
MPFYEGSQRYANPQSESSFKNQDSRIIKIKIQESREDSIKIIVATYPSSGGRHETQGCIFQERKIRGVTTNVYSRKTSKNWKRCGLRTLSVKGSGVVFIHGEGISTPRIRHKG

SEQ ID NO: 167613 - protein, 144 aa, Glycine max
  Coding DNA Sequence Number=SeqID_50835
MLPPPKHKLLLKLWMIPLYVGSLVILLTLVRTCSIELCTLHCCNHRSGARHDWSSHGIICKIIMKGNEQFRFSMQNLITTQFSNLGVVLLQNLQQAHMSMLRVVVEPTPMPIPIPLILEPTPSSIEPTPPPPTTQPPPPPPIQD

SEQ ID NO: 167614 - protein, 151 aa, Glycine max
  Coding DNA Sequence Number=SeqID_50836
MERSMINATSGGALGDMTPIEARNLIEKMASNPQQFSERNDVIVLRGVHEVVTDSSSSTENKKLEGKIDALVNLQSGVNEQPEAYAANIHNRPPQQQNQQNNYDLSSNRYNPGWRNHPNLRWASPPQQQQQPVPPFQNVAGPSKPYVPPPM

SEQ ID NO: 167615 - protein, 104 aa, Glycine max
  Coding DNA Sequence Number=SeqID_50837
  Subcellular localization annotation: CTP_CleavageSite=44; ConfidenceScore=5.12e-01
MGRPFPPASSCRRGIVLGSACRPQQGHQVPPTNRAFIKKFCVSRQAQGETPQQPGDGRQRATDAPPSPLEFTSAHPQKGLSIAYTTWPTNRRPSPKPKDAPSCS

SEQ ID NO: 167616 - protein, 140 aa, Glycine max
  Coding DNA Sequence Number=SeqID_50838
EEICPQEEGQPLLVKKKCKETLVSTPTPLGLEVIIQVKKLMDEGIVMHQIPKISDMMNVLSVATIVCKITHAPNIFIIHVHRDSLGVPTDPKRIKVIPDWPTPPREGMMQSYPQRVLDRGFQEDWARAAKEGPRVLMNLR

SEQ ID NO: 167617 - protein, 52 aa, Glycine max
  Coding DNA Sequence Number=SeqID_50839
MAWKNRHIRWVYVSTPMILKLHKLVKQQYRIEENFYVSPLAFKASHYPFESF

SEQ ID NO: 167618 - protein, 68 aa, Glycine max
  Coding DNA Sequence Number=SeqID_50840
MTHLLKHMFPNSRWQQRLWTKHLQMHMLMQSSLNIQRSENNIVDPCTKGLMRQQVLELSKGMRLEFII

SEQ ID NO: 167619 - protein, 107 aa, Glycine max
  Coding DNA Sequence Number=SeqID_50841
  Gene Ontology: Mol. function=actin binding; Cellular component =cytoplasm; Biological process=cytoskeleton organization and biogenesis
MGDRLEDMIHDLGQESFNKHMLLYTEFEEMHKCPRCGVSQYKVKDDDECSSDENLKKGPLEKVLWYLSIIPRFRRLFAKGDDAKDLTWHANGRNYDGMLRHPADSSK

SEQ ID NO: 167620 - protein, 127 aa, Glycine max
  Coding DNA Sequence Number=SeqID_50842
LGRIDGDPGLRKTRIWATWEYVSSVGGGQQGMSGTRRYVARVRRPWGRQASSWQSTDKRNKHHKARRLVWWLASCELCLIYGIWALVIDYQGVATYPSAGGRRETRGMRVPRMEYARSRHQRLFEEN

SEQ ID NO: 167621 - protein, 83 aa, Glycine max
  Coding DNA Sequence Number=SeqID_50843
MDYAIVPSLASGMLRNFTDCALMLPFDSRHVVELHGLPNDGCQVPRSGQAKVASHQTDGPRMKLGYDTRIYSRRIFRLSAGSL

SEQ ID NO: 167622 - protein, 147 aa, Glycine max
  Coding DNA Sequence Number=SeqID_50844
MKNSGKPSRNRPWKRLGSVTEAPRLGFSSLKQFFSLILSDSHIPGGLNILFCPPSPIYRGKEGGGCRPARLGELGCFHQKAPPSVGRSWKAQMSYRMSRHHASEHADYMCPYEQIKQVNNTRELFTQFGATSPTSGGYQAREEIHSQ

SEQ ID NO: 167623 - protein, 70 aa, Glycine max
  Coding DNA Sequence Number=SeqID_50845
MEKIIIMFVFKAQVTITKLNEERRRNTQEKDLLLRQEELDNLLFRISQISPLGVHSWLLEDAISNKYLLI

SEQ ID NO: 167624 - protein, 74 aa, Glycine max
  Coding DNA Sequence Number=SeqID_50846
MNALGGATLFSKITRAPNIFMICVHRDSLGRNNQHENTEKGVPMNPKRIKFIPEWPAPPSVLRKKAQSFKNLGI

SEQ ID NO: 167625 - protein, 90 aa, Glycine max
  Coding DNA Sequence Number=SeqID_50847
MKSIKEGYVNSKYYHMVVNWKRRRNMLLGVDVDGTWVKESRRAKEFFEERFKEMPLERPGLEGVELQKINEEDNNFFISNYEEYEVKQVV

SEQ ID NO: 167626 - protein, 58 aa, Glycine max
  Coding DNA Sequence Number=SeqID_50848
  Homolog annotation: Hit_ID=UPI00005C1F9B; Match level="QueryCoverage =96%, HitCoverage=14%, E-value=4e-08, Identity=42%"; Hit description =PREDICTED: similar to OTU domain containing protein 3
AVADQLEGNEEEHGKYRSMVVKHILDNREMFEPFIEDEVPFDEYCQSMENDGSFSCNA

SEQ ID NO: 167627 - protein, 86 aa, Glycine max
  Coding DNA Sequence Number=SeqID_50849
MNGSRTVASDDVSFICCGTWAVGASSSLSCRCGKKISWPRLRPPSPSNKNCQIIKIPIVLPDVGQVNDWAQALKSEVVRDNPSSST

SEQ ID NO: 167628 - protein, 120 aa, Glycine max
  Coding DNA Sequence Number=SeqID_50850
  Gene Ontology: Mol. function=protein serine/threonine kinase activity; Biological process=protein amino acid phosphorylation
  Subcellular localization annotation: CTP_CleavageSite=61; ConfidenceScore=5.25e-01
MALFYSRISPSKTPRFAPPWSASCWRTNAAIESPSGLDRFDSISSGSGFSCGVLKGSDRVRCWGVGSIARKMEKEVTTLVKLMFLKEVLWSFLVWHLGLSTLDVPRIGSRPKPSRGGPYQ

SEQ ID NO: 167629 - protein, 242 aa, Glycine max
  Coding DNA Sequence Number=SeqID_50851
  Homolog annotation: Hit_ID=Q67XQ0; Match level="QueryCoverage=96%, HitCoverage=45%, E-value=4e-67, Identity=62%"; Hit description=MRNA, complete cds, clone: RAFL25-31-I24
MGKILARGHSRVPVYSGNPKNIIGLLLVKSLLTVRPETETPVSAVSIRRIPRVPSDMPLYDILNEFQKGSSHMAAVVRARGKGKTIPETTDEETYEENKGVGGDSQLTAPLLQKQNEKSESFIVDIDKFSRSPSINKSTGLQRSDSTRNGSFSDNIEDGEVIGIITLEDVFEELLQEEIVDETDEYVDVHKRIRVAAAAAASSVARAPSIRRLTAQKGAGGQSKPGLTLKKSAEDGSNTRSQ

SEQ ID NO: 167630 - protein, 178 aa, Glycine max
  Coding DNA Sequence Number=SeqID_50852
  Gene Ontology: Mol. function=protein binding; Cellular component =membrane; Biological process=induction of apoptosis
  Homolog annotation: Hit_ID=Q6K688; Match level="QueryCoverage=97%, HitCoverage=40%, E-value=3e-55, Identity=60%"; Hit description =Putative tumor differentially expressed protein 1
  Pfam annotation: Domain name=Serinc; Domain location=1-178; Score= -204.5; E_value=3.3e-06; Accession=PF03348.6; Description=Serine incorporator (Serinc)
MCISVIFTRFIAKFGAGLFLLIQVIILLDFTHTWNDAWVEKDEQKWYIALLAVSVGCYIAAFTGSGILFFWFNPSGYDCSLNIFFFVMTMILAFVFAIIALHPQFWSGILPAGEWELVAFCCDFSLLCLCVLYTGLSSEPRDYECNGLNKSRAVSTSTLVLGMLTTVLSVLYSALRAG

SEQ ID NO: 167631 - protein, 673 aa, Glycine max
  Coding DNA Sequence Number=SeqID_50853
MECVAKMTKVVQQKDVLQFDSAGESLPSLELAEFLVSYICWDNNVPILWKFLEKALTLQIVPPMLLLALLSVRVIPCRHVQPAAYRLYLELVKRHAFELKSQINRPDYQKVMKSIDAVLHLSNIFGMSQSEPGILVVEFIFSIVWQLLDASLDDEGLLEFTPDKKSRWATLYHDMELDRHDNYSEQRTEHHEKLQNANTLMAVEMIGQFLQDKISSRLLYLARQNLPAHWLSFTQRLQLLGENSLALRKSRTLSPEELLELTSDSCMVLSRECKTNSQKKFQTVMSFEYLSSSASLCHGASHSALWIPLDLVLEDSMDGYQVSATSSIETISGLIKTLRAINGTSWHDTFLGLWLATLRLVQRERDPIDGPMPHLDTRLCMLLCIIPLVVGDLIEEEEERTPVDEKDSGLTDCWKEKKVAGKCHNDLVSSLQVLGDYQSLLTPPQSVLAASNQAAAKAMLFVSGITIGSAYFDCLNMTEMPVDCSGNMRHLIVEACIARNLLDTSAYLWPGYVNGCINQIPQCMPAQVPGWSSFMKGAPLTSVMVNALVSSPATSFSFSFLKPGMSDALFCKFTKSLAELEKIFEIAIGGSEDEKISAAAILCGASLIRGWNIQEHTVHFILRLLSPPVPAENTEGNNYLINYAPILNVLFVGIASVDCVQIFSLHGLDLEFI

SEQ ID NO: 167632 - protein, 70 aa, Glycine max
  Coding DNA Sequence Number=SeqID_50854
  Homolog annotation: Hit_ID=Q67U53; Match level="QueryCoverage=95%, HitCoverage=31%, E-value=1e-08, Identity=40%"; Hit description=Plant viral-response family protein-like
MRWKWGGEAVKDEDEGDVREEGERDGVFKVMEVIGGDGEVRVKGCHDEEEFKVLVFGGWEPWWSSVEGWI

SEQ ID NO: 167633 - protein, 323 aa, Glycine max
  Coding DNA Sequence Number=SeqID_50855
  Homolog annotation: Hit_ID=Q5N757; Match level="QueryCoverage=29%, HitCoverage=46%, E-value=3e-14, Identity=43%"; Hit description =Pentatricopeptide (PPR) repeat-containing protein-like
  Subcellular localization annotation: CTP_CleavageSite=40; ConfidenceScore=5.24e-01
MQEEKVTLSMSMSMSMSMNRGMMVHCNNNNNVNNTNNVCNCKHSPSATLDLLILLLVLFSGAFLLSSYLCYIFNSLSLLLPSVPLSYLLPFLLFFALSLATADFCCGARSRRCQRQGCKGLKKAMEFDLQIQRFGSSVPSSAEIDKLPWKGGTEANPDYDCLRSELRKMAPPNGRALLLFRAPCGCPVAKLEASGPKKAKRHKSNGFFECLIFQFVDICLPYSGFYLSERSGWETISQSQGSFLWFGLPSVFSASAVLDSSAWLLGVPNITQVAACFVPHQCEIHALPNQILTVSDIQFGLAEDLIDCLIRIPALEARLGTDS

SEQ ID NO: 167634 - protein, 115 aa, Glycine max
  Coding DNA Sequence Number=SeqID_50856
  Homolog annotation: Hit_ID=Q1T1V2; Match level="QueryCoverage=42%, HitCoverage=63%, E-value=9e-09, Identity=53%"; Hit description =Cyclin-like F-box
MVMMTRKRRRMTAVTAACRRGQQSAAIEVRVQAVEIPSGGSPIREEAFAHIALGHHGSRVQCHGGHERVSIVAQLCPCLDMNELAQLDNILVVVRSLKGSLEMIKVDVQAIKERE

SEQ ID NO: 167635 - protein, 196 aa, Glycine max
  Coding DNA Sequence Number=SeqID_50857
  Homolog annotation: Hit_ID=Q8H6Q8; Match level="QueryCoverage=70%, HitCoverage=5%, E-value=1e-19, Identity=35%"; Hit description=CTV.20
YSYWDYIDAWTNVFWHQNSKFKHSWLIYFKNNTVYNFPNWFLQWWNYFRPIPQIFPQEVQQGFQQFSKLFNSKESRISADLKHAFVKWWSQFDTSKAAPEQVKNWFQSNPEFLKPADPETSLFLNQKSQLAAFLASSKSKESLAQNLKEVLQLLQQEEEEEPPKKEAESSENNDDQEDDPFYQNEDDCFGISLDDD

SEQ ID NO: 167636 - protein, 295 aa, Glycine max
  Coding DNA Sequence Number=SeqID_50858
  Gene Ontology: Mol. function=pseudouridylate synthase activity; Biological process=tRNA processing
  Homolog annotation: Hit_ID=O22928; Match level="QueryCoverage=94%, HitCoverage=52%, E-value=9e-77, Identity=52%"; Hit description =Putative tRNA pseudouridine synthase
IEKELETAIFMAGGMRDSNFGDLNKVKWGRSSRTDKGVHSLATIIAFKMEIPENAWKGDDYGIALANRINSYLPNTIRIFSILPSTKRFDPRRECNLRKYSYLLPADIIGIQSHFSQDEIDFHILEFNSILNVFEGEHPFHNYTVRSKYRKKYQVRQSSGNDGMPDRIGSSSLASACESESEESDDDDDDDFVSGRPTTLSDKEESHKPPESSESNGFSSQNSTVVVRAKWLYEPDETDRLNASHFRKVFRCSCGKLETSLGYDYVEVHVWGDSFMLHQFDYDNSNLGGQTLKVM

SEQ ID NO: 167637 - protein, 135 aa, Glycine max
  Coding DNA Sequence Number=SeqID_50859
  Gene Ontology: Mol. function=pseudouridylate synthase activity; Biological process=tRNA processing
  Homolog annotation: Hit_ID=Q10LR0; Match level="QueryCoverage=95%, HitCoverage=25%, E-value=3e-35, Identity=54%"; Hit description=TRNA pseudouridine synthase family protein, expressed
MVGTAVAVKRNLIPRDAILLSLSKFSRIVFPLAPPEVLILRGNAFKMRASAGNFTRQEMVSMVESEPILKAADEFYTSVVLPEVSKFLDSSSSPWAKWVENLDKYSSIPDVELDEVRKAWKTWKENFRVKSESEA

SEQ ID NO: 167638 - protein, 64 aa, Glycine max
  Coding DNA Sequence Number=SeqID_50860
MGLWMRFLELVSEKGSQLWSEIELQGSARDQVSTVEKRKREPEPESEFEFEGVAAWKQGIICLK

SEQ ID NO: 167639 - protein, 297 aa, Glycine max
  Coding DNA Sequence Number=SeqID_50861
MAATATAKTNNDNNPEITREEIQTAIAKAVELRALHTALTQGSSPGTNNARFPSPSPASHFSAQDYPVFTPSYEDEAHQNPTRSRTISESWDENGVEGRNSMAPSDYKEKLNSRKELPFGFGNLDTHMCPADDSKSVTGSCANHITFLQTSPAAVANDYFKSRRRNSLGDLKPLSSCNRCNPAVITSEYESTRNNKSSNIVVPLTDSHVSFQTQPKSKGVISWLFPRFKKKHKNVSSPSRTESEEVSQVLKDMGIVSVEALKRELMEANESRDTALMEVSEMRSSLGELKQKLEYLE

SEQ ID NO: 167640 - protein, 454 aa, Glycine max
  Coding DNA Sequence Number=SeqID_50862
  Subcellular localization annotation: CTP_CleavageSite=20; ConfidenceScore=5.57e-01
MDDEAIANANGAPSPPCVVSVSALSGSRRRLSTSFLELSRRPVSSSEKLKPMAWISLQGRLLNADEASSARTICGGFSAELALAWNLFPPIHRFLVVAVIGTAVARSRKDLQIFQLKNSVHLRDQVLLNMQQKLDSLCELVNNSKLHSTNKSCDKDGELQLNETLGSGKINFVDCGCWHCEQHSAFLNELMVDSVARTSGANEVLQYKMPFSNEDQEERRMSDMSDWASSVTSSADIQLNNLAVEQDIYNLRRDCEEKDTTIKELTTLLNSNEVAKCKRIAELEDIIRRKNTTISKLKKDMLVLEQKVVQLTRLRRPSFSTSGSNDIQLPHIMIDNLLYDMESTTSPSSSSDSDSSSVIKARDRPADVVLNQNLASKINQKPSPAKVSSSSGRFFECHSKSQSVSPRKELSSSQKSNAASSSAQKLLSARGDLKKNRRRSLNGDKSTTEHKRWV

SEQ ID NO: 167641 - protein, 107 aa, Glycine max
  Coding DNA Sequence Number=SeqID_50863
  Gene Ontology: Cellular component=nucleus; Biological process =regulation of progression through cell cycle
  Homolog annotation: Hit_ID=Q2PHL0; Match level="QueryCoverage=97%, HitCoverage=26%, E-value=2e-13, Identity=41%"; Hit description =Cyclin B1-1
  Pfam annotation: Domain name=Cyclin_C; Domain location=16-107; Score =43.8; E_value=6.1e-10; Accession=PF02984.9; Description=Cyclin, C -terminal domain
MEKAILERLEWNFTVPTPYVFLVRFIRTFGLPPDQQNFSLVHYETANLSPPSMTAAAAVYAARCTLNRKHPWNEILKDMAGYTTAQLREFCTLDRGRKALLSPTKDI

SEQ ID NO: 167642 - protein, 279 aa, Glycine max
  Coding DNA Sequence Number=SeqID_50864
  Homolog annotation: Hit_ID=Q47522; Match level="QueryCoverage=18%, HitCoverage=70%, E-value=4e-14, Identity=70%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSLAAIREKMAYTDVPKPLQGLGITFITVGLMAMASSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 167643 - protein, 708 aa, Glycine max
  Coding DNA Sequence Number=SeqID_50865
  Gene Ontology: Mol. function=zinc ion binding; Cellular component =nucleus; Biological process=transcription
  Homolog annotation: Hit_ID=Q9SWG3; Match level="QueryCoverage=86%, HitCoverage=75%, E-value=1e-167, Identity=47%"; Hit description=Far -red impaired response protein
  Pfam annotation: Domain name=FAR1; Domain location=28-229; Score =330.9; E_value=2.2e-96; Accession=PF03101.5; Description=FAR1 family
  Pfam annotation: Domain name=SWIM; Domain location=506-542; Score =35.9; E_value=1.4e-07; Accession=PF04434.8; Description=SWIM zinc finger
  Pfam module annotation: Pfam domain module=FAR1::SWIM; Domain location=28-229::506-542
MDSSAVVGSTISEPHNDMEFESHEAAYAFYKEYAKSAGFGTAKLSSRRSRASKEFIDAKFSCIRYGNKQQSDDAINPRPSPKIGCKASMHVKRRLDGKWYVYSFVKEHNHELLPAQAHFFRSHRSSDPLSNDVRMRRRKNSNAVSKLFTANQNVDCLENFVKHQHDKGRSLVLEAGHAHLLLELFMHMQEENPKFFYAVDLNEEHRLRNVFWVDAKGLEDFTYFSDVVSFDTTYFTSKYKIPLVLFIGVNHHIQPTLLGCALIADETIYTFAWLLQTWLIAMGERTPQVFLTDQNEAIKAAVAAFLPGTRHCFCLWHILEKIPKQLEFLGAWHDSFLEKFNNCIYKSCTEEQFDKRWWELVDDFNLRDVEWVQSLYDDRTCWVPTFMKDISFAGLSTSSRSESLNSLFDKYIQVDTSLRDFIEQYRVILEDRHEEEAKANFDAWHETPDLKSPSPFEKQMLLVYTHEIFRKFQVEVLGAAACHLKKENDCMTTTYTVKDFENNQTYMVEWNTSTSNICCSCHLFEYKGYLCRHAIVVLQMSGVFSIPPKYILQRWTNAAMSRHPIGGKMEEVQSKVRRFNDLCRRAIILGEEGSLSQESYYMALGAISEALKQCANLNSSVENGMRPDASSTHVVCNVEKEYQSIITSNNKIPDPKLNTGKKAVRTGMAGRSLGSVENSEGNKGKVSQVEEGMVKDGFQQMDMVSIKQ

SEQ ID NO: 167644 - protein, 785 aa, Glycine max
  Coding DNA Sequence Number=SeqID_50866
  Gene Ontology: Biological process=polysaccharide catabolic process
  Homolog annotation: Hit_ID=Q029P0; Match level="QueryCoverage=70%, HitCoverage=78%, E-value=6e-76, Identity=34%"; Hit description =Hypothetical protein precursor
  Pfam annotation: Domain name=DUF1680; Domain location=105-647; Score =445.4; E_value=7.2e-131; Accession=PF07944.3; Description=Putative glycosyl hydrolase of unknown funct
MAFLFAFVAIVVWGCAAGKECTNNDAQSHTFRYQLSTSTNETWNIMSHNHLTTKDDHLLADLLPRKLLKEENQRNLDMLRKIEKVGVLKPPQQPQGFLKPVSLHDVRLNQGSIHAQAQRTNLEYLLMLNVDRLLWSFRKTAGLPTPGTPYGGWEDPKMELRGHFVGHYLSASALMWASTHNDSLKKKMSALVANLSICQEKIGTGYLSAFPSEFFDRLEATKYVWAPYYTTHKILAGLLDQHSIAENPQALKMVTWMVDYFYNRVQNVITKFSISRHYQSLNEETGGMNDVLYKLYSITGDPRHLLLAHLFDKPCFLGLLAVKANDIAHFHANTHIPVIVGSQMRYEVTGDPLYKEIGTLFMDLVNSSHTYATGGTSVNEFWSDPKRMADTLESTDNEESCTTYNMLKLLHCPLSTRKKNNFPGFTPLVYMDQKRTEPGVMIYMLPQGRGVSKAKTYFGWGTKFDSFWCCYGTGIESFSKLGDSIYFEEQGENPTLYIIQYISSLFNWKSGQIILNQTVVPPASWDPFLRVSFTFSPAKKTGALSTLNFRLPTRMHKNGEKGILNNETLTLPGPGNFLSITRKWNAGDKLSLQLPLTLRAEAIKGIFLMEKLIMYFTILIWCFESNTDDRTKYASIQAILYGPYLLAGHTTGDWNIKTAANASIADWITPIPASYNIHLFYFSQAFANSTFVLTNSNQSLAVKKVPEPGTDSALGATFRVIQGKSSTKFTTLTDAIGKSVMLEPFDHPGMQVIHQGIELPLTVKRMHSHSWGIPFILKKGKMQLY

SEQ ID NO: 167645 - protein, 93 aa, Glycine max
  Coding DNA Sequence Number=SeqID_50867
  Subcellular localization annotation: CTP_CleavageSite=44; ConfidenceScore=5.07e-01
MAEELKAVKVLGKGGMGTVFLVQLHNSSHVALKVVDKSSTKLVRKKTTSHFSGPICIPFCLLPLSDSIKFLFTECTFMHNPNTYWVCMCLDSN

SEQ ID NO: 167646 - protein, 176 aa, Glycine max
  Coding DNA Sequence Number=SeqID_50868
  Gene Ontology: Mol. function=nucleic acid binding; Cellular component= intracellular; Biological process=regulation of transcription
  Homolog annotation: Hit_ID=Q9SVY1; Match level="QueryCoverage=83%, HitCoverage=38%, E-value=8e-78, Identity=87%"; Hit description=Zinc finger-like protein
  Pfam annotation: Domain name=zf-C2H2; Domain location=124-149; Score =7.7; E_value=1.5; Accession=PF00096.16; Description=Zinc finger, C2H2 type
  Pfam annotation: Domain name=zf-C2H2; Domain location=98-120; Score =13.1; E_value=0.4; Accession=PF00096.16; Description=Zinc finger, C2H2 type
  Pfam module annotation: Pfam domain module=zf-C2H2::zf-C2H2; Domain location=124-149::98-120
MQCNKGGVCIGNVVSQWDFWTISIVPNILLMHMWGHGSQYRKGPESLRGTQPTAMLRLPCYCCAPGCKNNIDHPRAKPLKDFRTLQTHYKRKHGIKPFMCRKCCKAFAVRGDWRTHEKNCGKLWYCSCGSDFKHKRSLKDHIKAFGNGHKAYGIDSCLDQDDEAGSEIEQENNESF

SEQ ID NO: 167647 - protein, 262 aa, Glycine max
  Coding DNA Sequence Number=SeqID_50869
  Gene Ontology: Mol. function=metal ion transporter activity; Cellular component=membrane; Biological process=metal ion transport
  Homolog annotation: Hit_ID=Q6H7N1; Match level="QueryCoverage=99%, HitCoverage=94%, E-value=1e-108, Identity=78%"; Hit description =Putative Zinc transporter zupT
  Pfam annotation: Domain name=7tm_4; Domain location=6-208; Score= -150.8; E_value=0.1; Accession=PF01461.8; Description=7TM chemoreceptor
  Pfam annotation: Domain name=Zip; Domain location=6-261; Score=50.9; E_value=4.3e-12; Accession=PF02535.12; Description=ZIP Zinc transporter
  Pfam module annotation: Pfam domain module=7tm_4::Zip; Domain location=6-208::6-261
  Subcellular localization annotation: CTP_CleavageSite=83; ConfidenceScore=5.21e-01
MDSQVAVALALSLVGGVSTSIGALFVIVNKTPSLKMLGLLQGFAAGLMLSISFFDLAHNALNSLGFLKGNLWFFAGVIFFAVVASFIPEPTLTPTSDVKGRKKNGDEGDKDIMKKHRRQVLFSGIVTAVGISLHNFPEGMAVFLGSLKGLRVGLNLALAIALHNIPEGVAVALPVYFATQSKWQAFKLASLSGFAEPLGVIIVAYLFPSSLSPEILEGLLGSVGGVMAFLTLHEMLPLAFDYAGQKQSVKAVFLGMAFMSAR

SEQ ID NO: 167648 - protein, 97 aa, Glycine max
  Coding DNA Sequence Number=SeqID_50870
MRNRTGTIARTSRETSRKGTKQNWFRTEASSDAAERSSGRGGLRDVEDAVTENGVFLSYLSVRVSEHWAFGLWYTGFKLAEARVILREYSKNFSILE

SEQ ID NO: 167649 - protein, 142 aa, Glycine max
  Coding DNA Sequence Number=SeqID_50871
  Homolog annotation: Hit_ID=Q9FIL3; Match level="QueryCoverage=50%, HitCoverage=56%, E-value=1e-26, Identity=65%"; Hit description =Arabidopsis thaliana genomic DNA, chromosome 5, TAC clone:K19M22
  Subcellular localization annotation: CTP_CleavageSite=34; ConfidenceScore=5.70e-01
MASALSSRVESVRNSPFLRFSLNFIRALSSSSSSSSAVSSAENLKKSKRRKKKNLFEVAQFLPNWGIGYHMAKTHWNEDGRHGKAWGIAFKNGLPLADAPKKISGVHKRCWRYIPNVVKALESSTNLTSSTDSGLKVETEAS

SEQ ID NO: 167650 - protein, 447 aa, Glycine max
  Coding DNA Sequence Number=SeqID_50872
  Gene Ontology: Mol. function=DNA binding; Cellular component=nucleus; Biological process=regulation of transcription
  Homolog annotation: Hit_ID=Q2QXB1; Match level="QueryCoverage=75%, HitCoverage=80%, E-value=1e-69, Identity=44%"; Hit description =Expressed protein
MNSSGLGGGFLSGPSGEILDLESPFHRHQHTQLGHPSITGQQHMNMMSGLESDHPIGLIEVKSLNAALNFGKGKAVAPSNSNELSEEDEPSYAEEGNCENLDGGKSKKGSPWQRMKWTDNVVRLLITVVSCVGDDGTIGGMDCHKRKSGVLQKKGKWKTVSKIMIGKGCHVSPQQCEDKFNDLNKRYKRLNDILGRGTCCQVVENPVLMDSMPNLSAKMKDDVRKILSSKHLFYKEMCAYHNGQRIPNSHELDLQGYSLEHGRDSRDNNGSEDEDEDNNDSEDDESDDEININAHEDGGRMQQLCDRNKLSEEDVHFGPQTSRMDKFEVEMARVFQDPTKSLHEQREWIKIQMLQLQEQNISYQAQALELEKQRLKWLRYCSKKDRELEKLRLENKRMKLENERRILKLKQKELEADFSTSEMSLDPASLGINRPQGREHISLGRQQ

SEQ ID NO: 167651 - protein, 732 aa, Glycine max
  Coding DNA Sequence Number=SeqID_50873
  Gene Ontology: Mol. function=protein translocase activity; Cellular component=chloroplast envelope; Biological process=intracellular protein transport
  Homolog annotation: Hit_ID=Q6H7M7; Match level="QueryCoverage=77%, HitCoverage=100%, E-value=0.0, Identity=62%"; Hit description =Putative outer envelope membrane protein OEP75
  Pfam annotation: Domain name=Bac_surface_Ag; Domain location=434-732; Score=165.0; E_value=1.9e-46; Accession=PF01103.13; Description =Surface antigen
  Pfam annotation: Domain name=POTRA_2; Domain location=187-260; Score=- 5.6; E_value=0.1; Accession=PF08479.1; Description=POTRA domain, ShlB- type
  Pfam annotation: Domain name=Surf_Ag_VNR; Domain location=108-186; Score=11.1; E_value=0.11; Accession=PF07244.5; Description=Surface antigen variable number repea
  Pfam annotation: Domain name=Surf_Ag_VNR; Domain location=187-260; Score=15.8; E_value=0.037; Accession=PF07244.5; Description=Surface antigen variable number repea
  Pfam module annotation: Pfam domain module=Bac_surface_Ag::POTRA _2::Surf_Ag_VNR::Surf_Ag_VNR; Domain location=434-732::187-260::108 -186::187-260
  Subcellular localization annotation: CTP_CleavageSite=93; ConfidenceScore=5.37e-01
MFRNDDVCIVSSSIKIPLPYISKRPTCPLRTAHSHIANATNSIAQLVNSFTSHSTELTRSVLQKSSLLCSATLSLTGDLERKCPIRRLASLSLAEEAQQKARQNEERVLISEVLVRNKDGEELERKDLEAEAAQALKACRPNSALTVREVQEDVHRIINSGYFSSCMPVAVDTRDGIRLVFQVEPNQEFQGLVCEGANVLPAKFLEDSMRDGYGKIINLRRLDEALSSINNWYMERGLFAMVSAVEILSGGILRLQVSEAEVDNISIRFLDRKTGETTMGKTKPETILRQITTKKGQVYSMLEGKRDVETVLTMGIMEDVSIIPQPAGNNYKDGLPFLQNGMLTHSAVLERLHLPIQRLRAYLKCNLSVTTVIKTVVTDFQSVNSSTYTGKVDLVMNVVERPSGGFSAGGGISSGITNGPLRGLIGSFAYSHRNVFGKNQKLNISLERGQIDSVYRINYTDPWIQGDDKRTSRTIMIQNSRTPGTIVHGNADGNGSLTIGRITGGIEFSRPIRPKWSGTHAGVRDEQGIPIIKDCYSSPLTASGNTHDDTLLAKLETVYTGSGDHGSSMFVLNMEKGLPLLPEWLSFTRVNARARKGVEIGPARLHLSISGGHVVGNFSPYEAFAIGGTNSVRGYEEGSVGSGRSPSLLGHTTGLSGQYGPVEGVIFSDYGTDLGSGPTVPGDPAGARKKPGSGYGYGFGIRVESPLGPLRLEYAFNDKQDKRFHFGVGHRN

SEQ ID NO: 167652 - protein, 88 aa, Glycine max
  Coding DNA Sequence Number=SeqID_50874
MGETHEIPYHNLADFKPCLGYATKGKVVSGIPLQNTLEGPQFFPQPQPLHSTAGKSPPAMVEMEKLDHLEERLRATEGGRDYAFKSCS

SEQ ID NO: 167653 - protein, 43 aa, Glycine max
  Coding DNA Sequence Number=SeqID_50875
KLKKSETLIWVDFVECPKVEVVYGSSWKSGDLKMEDLDIDLME

SEQ ID NO: 167654 - protein, 141 aa, Glycine max
  Coding DNA Sequence Number=SeqID_50876
MARTHDAILYYNGKWNMSPQNKFVGCAFTGKNPKKFQIPSTCTIDELKNLIKQVAPKGIPHLGIHESQTVRRLFFCQPAHFEYSDTVIKYEINELMTNKELLKVLVQSNYWKKYGPIEILAVFTKYVVKIEDEVSWTSLNN

SEQ ID NO: 167655 - protein, 336 aa, Glycine max
  Coding DNA Sequence Number=SeqID_50877
  Gene Ontology: Mol. function=transporter activity; Cellular component= membrane; Biological process=transport
  Homolog annotation: Hit_ID=Q2CE10; Match level="QueryCoverage=61%, HitCoverage=73%, E-value=4e-64, Identity=62%"; Hit description =Permease protein of suger ABC transporter
  Pfam annotation: Domain name=BPD_transp_1; Domain location=153-334; Score=35.4; E_value=1.9e-07; Accession=PF00528.12; Description =Binding-protein-dependent transport s
DVGILSEPYNILSDPQLAMWGPVIANVWFGIPFFAITLLAALQSIPKDLYEAAAIDGASGWQQFRRVTLPFLAPMIAITVMLRTIWIANFADLIVVMTDGGPAGSTSILSSYIFTTAYRKLDFGYASAMAGVTLLPGGFTLSHFAKVLTDSDFPTFFINSLIVSCSTAALTTLIAAGAGYAFSRFQFRGKMVMAALLLFTQMFPLVMIIAPIYRVMAPLGLTNSLLGLILIYSAFNVPFATFLMQSFFDAIPKDLEESAMLEGCTRFQALYRVLMPLTLPGMAATLGFVFTAAWSELLFSLMLINKNEVMTFPVGLLSFVSKFAVSWGEMMAAAVL

SEQ ID NO: 167656 - protein, 94 aa, Glycine max
  Coding DNA Sequence Number=SeqID_50878
MAHFIPCKKVDDASHVADLFFKEIVRLHDGESDLRTNHSQEGENDEDMTKSKGKDPLGGPMTRVRARKAKEALQQVLPILFEYKPKFQGESPRL

SEQ ID NO: 167657 - protein, 46 aa, Glycine max
  Coding DNA Sequence Number=SeqID_50879
MNRWMTMKNLMLEDTGTQRSDRMYALNQITAEYEHVHYAGKNPSRC

SEQ ID NO: 167658 - protein, 74 aa, Glycine max
  Coding DNA Sequence Number=SeqID_50880
RLGLFVRAQPKLCWGRHRLVFICLARKTLANLDDEDITKDHEALEGPMTRGRLKQAQHVIETRLVICIAVIDDD

SEQ ID NO: 167659 - protein, 41 aa, Glycine max
  Coding DNA Sequence Number=SeqID_50881
MSTAPIRNPKRYGILKYTVEDVVKKRFLSHRWTMNKEKDIK

SEQ ID NO: 167660 - protein, 118 aa, Glycine max
  Coding DNA Sequence Number=SeqID_50882
DCARKTPSGPEEGQQGLGVASSNYGPLSVLRAFIKKYCAPRQAQGATPQQLRDGRQRAIDALPPPPKNLSSSTKKLVRCLRPMADQQATKYKAKDKKSTRSVTDKSSSVQLKTLKKRY

SEQ ID NO: 167661 - protein, 164 aa, Glycine max
  Coding DNA Sequence Number=SeqID_50883
MTGRLLAGSLAFESRILHYSNCADFASTILPILPKFLRKDLVIMWAFHTGRQLDWAHLRSFLIGAAVIASFGYRKDHDGSWVKKGAQPADEEGNLPVEDNSTLLRRLMDKFDGLQTFVGDKFDAMELQVDIRFDAMESRITKVEEDVSFIRTCFDPPPPPPSSS

SEQ ID NO: 167662 - protein, 41 aa, Glycine max
  Coding DNA Sequence Number=SeqID_50884
MDTLEPYIGAMRGTVHEPQVMTKDNNWYLKALHWGNEGHRA

SEQ ID NO: 167663 - protein, 484 aa, Glycine max
  Coding DNA Sequence Number=SeqID_50885
  Gene Ontology: Mol. function=phospholipase A2 activity; Cellular component=integral to membrane; Biological process=cell adhesion
  Homolog annotation: Hit_ID=Q3BMW5; Match level="QueryCoverage=99%, HitCoverage=33%, E-value=1e-132, Identity=51%"; Hit description=Rhs family protein
ERVFLEAIAGIVQRVVNRVARVVLDIGQAQRRIVDIGNAAAVGLGDLLHLAGRPVADLGDPILGSGRATYGDRGWPAASMVGVVGDHAVGILDRQRPSESVVGQSLDRLAQRIGHAAQVALAIGAGTSRRAPCIIRRVIGIGNGIGHIRARAIHTLQQPLHRAAACRCHISGFAVRVVGDARLTGSGVGHGVGRRLASGIEGRAGFAATDPGGQYRIGFDVARRGHHTLLGKADRFGHGMDADGTTAHRIGALRIGVLGLDAAAIGVGIQTPAEVDTLVVVGSADRSLRIRQAGHLARRSAIASGRQGVVGLPPQRVRHDRTAVGAVGQRHAIGTAGVLTGNDTTVGIIGKSAVATPVLRRDAGQMLGEVLVLVVIRAHTTTRIGHRGDLVLRCVGVGGERNALDQHRTDQRLIVVGLIDELQRAATAVGDGCKAVAVVIDVGQRRAIREALGGKTPVRAEGRDGIGRVQCPVAVLDQTIATVV

SEQ ID NO: 167664 - protein, 215 aa, Glycine max
  Coding DNA Sequence Number=SeqID_50886
  Homolog annotation: Hit_ID=Q47522; Match level="QueryCoverage=24%, HitCoverage=64%, E-value=9e-24, Identity=100%"; Hit description=LacZ protein
  Subcellular localization annotation: CTP_CleavageSite=38; ConfidenceScore=5.87e-01
MARLAPDVRAPGRAGRASGAGSPRPRRGSSRRGRARVRGGSRRNRGGGPAGRRRAGARGRCRWRGRPRRPARSRSASSRARRDSGSRRAAPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 167665 - protein, 118 aa, Glycine max
  Coding DNA Sequence Number=SeqID_50887
  Gene Ontology: Mol. function=transition metal ion binding; Cellular component=cytoplasm; Biological process=fucose metabolic process
MGGVTKASHHFFKWCRICFQRKTHCQKFTIRRRKYYVRWVWSTGRFKHALMIAHLKDDGECSSDQSTKKGPLAKVFWYLLIIPRFKRLFANADDAKDLTWHVDGRNYDGMLCHLIDSS

SEQ ID NO: 167666 - protein, 172 aa, Glycine max
  Coding DNA Sequence Number=SeqID_50888
MGRGPPALVEREKFDHIEERVRVIEGGGNYAFADMVELCLVLDMVIPLKFKVSDFNKYKGNTCQKNHLKMYCRKIGAYAKDEKLLMHFFKRVWQYQYNSDIASDRMQLQNMCKREQESFKEYAQWWRDLAAQVAPLMMEREMITMKVDTLLVFYYEKMVSYMPSSFADLVFA

SEQ ID NO: 167667 - protein, 79 aa, Glycine max
  Coding DNA Sequence Number=SeqID_50889
MTKIIQLIEGSKDTVIIQGVEGSAACCREVVSATGAEGSGVASRDFSEVVAASWVTTTLLFLIKGSGVEDSDDSSSGDG

SEQ ID NO: 167668 - protein, 61 aa, Glycine max
  Coding DNA Sequence Number=SeqID_50890
MKTEYNDGYSPNRYISKKVATPLLITPATTVNSSKSKGYLISKGKLDLVGIEEPHEVLVDM

SEQ ID NO: 167669 - protein, 86 aa, Glycine max
  Coding DNA Sequence Number=SeqID_50891
MGSKIYPKVHENPRAFFSSSSPSLLESSIKYPWGVGLHQLALSSNPLTRAKCEGEDLHRIPEHTTVPISEKELWRQQEEQLLKRYL

SEQ ID NO: 167670 - protein, 275 aa, Glycine max
  Coding DNA Sequence Number=SeqID_50892
  Gene Ontology: Mol. function=siderophore-iron transporter activity; Cellular component=outer membrane; Biological process=siderophore transport
  Homolog annotation: Hit_ID=Q8PGJ6; Match level="QueryCoverage=99%, HitCoverage=36%, E-value=4e-76, Identity=55%"; Hit description =Siderophore receptor protein
VRVAAHVAAGAQARQCIRAAIATGVIQIVRIRLVQVRCLECTGDTPLHHPVAVDAELRIEAGAGVVAELAVVIEAQARGDDPALTQVDVVFDEYGGGLRIGLAARAIGRQPRNAAAAAAGLAHRVRVGQAAVQVFKAQRPDVLGAAQRGREAHFAVQLVVAQARGRPVGAVEAALRATGQAFVDARVVHRLHCRRYPRGHITPAAAMGDRAGVAVHAVGLGLLLGQGPQIDRCRGAGGADRAVTCIDVALAAGAGFELDHLVGGHVPAQQRVDVA

SEQ ID NO: 167671 - protein, 86 aa, Glycine max
  Coding DNA Sequence Number=SeqID_50893
MPPSSTKICDLKVTRGSVGSLEGPVCGYGCRGEWMKVAVVHANDGAVHSLVMVLWCHVRYIQVVRGVRESGSERARKSRFVFGIWV

SEQ ID NO: 167672 - protein, 90 aa, Glycine max
  Coding DNA Sequence Number=SeqID_50894
MLRFSNHASYPRLGHPTRTWPKAIAKDPGRSVQDAPHDHTQHPTYERGQKVVPKTLEGQCTVPPTNIHNMHMPMHFQHQSTNRISMSFTT

SEQ ID NO: 167673 - protein, 1223 aa, Glycine max
  Coding DNA Sequence Number=SeqID_50895
  Gene Ontology: Mol. function=DNA-directed RNA polymerase activity; Cellular component=myosin complex; Biological process=regulation of polarized epithelial cell differentiation
  Homolog annotation: Hit_ID=Q9AV25; Match level="QueryCoverage=98%, HitCoverage=71%, E-value=6e-30, Identity=19%"; Hit description =Putative kinesin-related protein
  Pfam annotation: Domain name=M; Domain location=1048-1068; Score=3.0; E_value=50; Accession=PF02370.7; Description=M protein repeat
  Pfam annotation: Domain name=M; Domain location=1128-1148; Score=8.4; E_value=9.8; Accession=PF02370.7; Description=M protein repeat
  Pfam annotation: Domain name=M; Domain location=1152-1172; Score=2.5; E_value=60; Accession=PF02370.7; Description=M protein repeat
  Pfam annotation: Domain name=M; Domain location=1194-1214; Score=7.4; E_value=13; Accession=PF02370.7; Description=M protein repeat
  Pfam annotation: Domain name=M; Domain location=804-824; Score=8.1; E_ value=11; Accession=PF02370.7; Description=M protein repeat
  Pfam module annotation: Pfam domain module=M::M::M::M::M; Domain location=1048-1068::1128-1148::1152-1172::1194-1214::804-824
MIPQSGWDKLFISFIPADSVKATSKTTKANVRNGTCKWADPIYETTRLLQDIKTRQYEEKFYKFVVGMGSSRSSILGEANINLADFVDALKPTAVALPLNGSEPGVTLHVTVQLLTSKTGFREFEQQRELRERGLQTTSDKGTHDESADSKESSPDQNVNNHINKVHSRVKLKRESKDLPRISSLEEESGVNEDYADSAAGFDGSSSTSESIYTEKHDISSTHEVDSLKSAVSCDLGGLSLSQSSQPEKGEAPDNQFPAQGSDRVHGWSIDYSAANNLAAASEDRNSSRLMGNLEAVKSSIFDLKLKVSSLQNHADEIGVETHKFSEQLAAEISSGEELVKEVAVLKSECSKFRDEFEQLKSSNLSLAFPQKEPTGTDPDRLFQNLQLKWLKGLLLMEGKIRDIQKVSMGFPERDCRFLNLELEALAEILQNLKQESGEPISGAKVVNERENKKMDLHKSEQFLTDIGSDAGLFQPESMTHYLTIPGPVSHESDSVDPTLPMKEKVFALLRELDESKTERESLVRKMDQMECYYEALIQELEQNQRQMMAELQNLRNEHSTCLYTISAGKTEMERMHQNMNEQIMKFSEDKRILESLNSEFERRAVSAEAALKRARLNYSIAVGQLQKDLELLSCQVLSMHETNENLIKQTLSDSSLPNTDGSPEPVTYPKLSEGHTSNRLLCRNHSSSLQKQHLGEDILLSDLKRSLQLQEGLYRQVEEEISQMHFANIYSDVFSKALQETLLEASLDIQLMKEKIVQLSQQLELTNESNELLVLRLQNAMNDILSLNEYKEICTANSNDIALQNQILEANLKDLAHENNLLTEKINELEVLLTQYRSYEGKYMACSTENSELKSLLKKESLEKNNLHDELSILQEELKSIRAKYDEQVSMKDNLQNNVIFLSNKLQKLLTSYEERHSELSLCSRSACLDSECEDLEGLLLQLEELQQSAFRRILLLIEEKENLVHEKLMAQVSLNTTESDVLVMKQKFEHDLQEMLHKITVSGALLQKLQLDFEVIISRINAGFEAEEFFSQHHKEFLSGLDHLEAELQQLNSRNQDLAQEIIKLDTSSSDLEMYKLTLATIKEQKNDLDLSLREKTEESAKISSELDFLKKNLDSLHNELHAEKTAREKLEKTVSNLTTELNEKQSQLQEKKDLKSSLQEKTEESAKISSELDFLKKNLDSLHNELHAVKTVRENLEKTVSNLTTELNEKQSQLQGKKDL

SEQ ID NO: 167674 - protein, 476 aa, Glycine max
  Coding DNA Sequence Number=SeqID_50896
  Gene Ontology: Mol. function=protein binding; Biological process=red or far red light signaling pathway
  Homolog annotation: Hit_ID=Q69S84; Match level="QueryCoverage=99%, HitCoverage=100%, E-value=1e-147, Identity=52%"; Hit description =Kelch repeat-containing F-box-like protein
  Pfam annotation: Domain name=F-box; Domain location=41-88; Score =45.0; E_value=2.6e-10; Accession=PF00646.23; Description=F-box domain
  Pfam annotation: Domain name=Kelch_1; Domain location=170-215; Score =57.8; E_value=3.6e-14; Accession=PF01344.15; Description=Kelch motif
  Pfam annotation: Domain name=Kelch_1; Domain location=217-266; Score =56.1; E_value=1.2e-13; Accession=PF01344.15; Description=Kelch motif
  Pfam annotation: Domain name=Kelch_2; Domain location=170-215; Score =29.1; E_value=1.5e-05; Accession=PF07646.5; Description=Kelch motif
  Pfam annotation: Domain name=Kelch_2; Domain location=217-266; Score =23.9; E_value=0.00059; Accession=PF07646.5; Description=Kelch motif
  Pfam annotation: Domain name=Kelch_2; Domain location=337-382; Score =5.1; E_value=8.3; Accession=PF07646.5; Description=Kelch motif
  Pfam module annotation: Pfam domain module=F-box::Kelch_1::Kelch _1::Kelch_2::Kelch_2::Kelch_2; Domain location=41-88::170-215::217 -266::170-215::217-266::337-382
MGAFFSVASTKPDQRECSEISPNEACKRQRMSPTVDEENPRLIPNLPDELSLQIIARLPRICYFNVRLVSKKWKSTIMSSELYKLRKELGTTEEWLYLLVKVGENNLLWYALDPRSKIWQRMPNMPNFVNKEESKKGSSRLWMWNMVEGIRIAEVIRGFLGQKDAFDEMPFCGCAIGAVDGCVYVLGGFSKASTMRCVWRFDPIQNTWSKVTSMSAGRAYCKTGILNNKLYVVGGVSQGQAGLVPLQSAEVFDPSTDTWSHVPSMPFSRAQVLPSAFLADMLKPIATGLTSYMGRLCVPQSLYSWPFFVDVGGEIYDPETNSWIEMPAGMGDGWPARQAGTKLSVVVDGELYAFDPSNSMDSGRIKVYDQGEDAWKVVIGKVPIYDSADSESPYLLAGFHGKLHVITKDANHDIAVLQAGLRDNLDSSPSLSTLSQSTLQESPELAAESDAAVVWRVVASRDFGQAELVSCQVIDI

SEQ ID NO: 167675 - protein, 87 aa, Glycine max
  Coding DNA Sequence Number=SeqID_50897
MEHQTPSKDFKGNTNFPFEKELKRKNSIMTPSLIKMKKTIDNLLVFTNKTNKIFHTSSHQKQKMQIQQKETPKAKQFFRTSPSQDTQ

SEQ ID NO: 167676 - protein, 875 aa, Glycine max
  Coding DNA Sequence Number=SeqID_50898
  Gene Ontology: Mol. function=protein transporter activity; Cellular component=cytoplasm; Biological process=intracellular protein transport
  Homolog annotation: Hit_ID=Q9FLL5; Match level="QueryCoverage=81%, HitCoverage=65%, E-value=4e-22, Identity=21%"; Hit description =Similarity to myosin heavy chain
  Pfam annotation: Domain name=Flg_hook; Domain location=68-205; Score=- 27.3; E_value=0.069; Accession=PF02120.7; Description=Flagellar hook -length control protein
  Pfam annotation: Domain name=M; Domain location=107-127; Score=8.7; E_ value=8.9; Accession=PF02370.7; Description=M protein repeat
  Pfam annotation: Domain name=M; Domain location=173-193; Score=8.7; E_ value=8.9; Accession=PF02370.7; Description=M protein repeat
  Pfam annotation: Domain name=M; Domain location=337-357; Score=3.9; E_ value=38; Accession=PF02370.7; Description=M protein repeat
  Pfam annotation: Domain name=M; Domain location=41-61; Score=4.9; E _value=28; Accession=PF02370.7; Description=M protein repeat
  Pfam annotation: Domain name=M; Domain location=594-614; Score=8.7; E_ value=8.8; Accession=PF02370.7; Description=M protein repeat
  Pfam annotation: Domain name=Myosin_tail_1; Domain location=1-790; Score=-508.1; E_value=0.048; Accession=PF01576.9; Description=Myosin tail
  Pfam annotation: Domain name=Pox_A_type_inc; Domain location=100-122; Score=1.4; E_value=51; Accession=PF04508.3; Description=Viral A-type inclusion protein repeat
  Pfam annotation: Domain name=Pox_A_type_inc; Domain location=166-188; Score=1.4; E_value=51; Accession=PF04508.3; Description=Viral A-type inclusion protein repeat
  Pfam annotation: Domain name=Pox_A_type_inc; Domain location=20-42; Score=3.5; E_value=25; Accession=PF04508.3; Description=Viral A-type inclusion protein repeat
  Pfam annotation: Domain name=Pox_A_type_inc; Domain location=214-240; Score=5.9; E_value=11; Accession=PF04508.3; Description=Viral A-type inclusion protein repeat
  Pfam annotation: Domain name=Pox_A_type_inc; Domain location=428-450; Score=0.7; E_value=65; Accession=PF04508.3; Description=Viral A-type inclusion protein repeat
  Pfam annotation: Domain name=Pox_A_type_inc; Domain location=548-567; Score=0.2; E_value=76; Accession=PF04508.3; Description=Viral A-type inclusion protein repeat
  Pfam annotation: Domain name=Pox_A_type_inc; Domain location=699-721; Score=5.4; E_value=13; Accession=PF04508.3; Description=Viral A-type inclusion protein repeat
  Pfam module annotation: Pfam domain module=Flg_hook::M::M::M::M::M::My osin_tail_1::Pox_A_type_inc::Pox_A_type_inc::Pox_A_type_inc::Pox_A _type_inc::Pox_A_type_inc::Pox_A_type_inc::Pox_A_type_inc; Domain location=68-205::...
  Pfam module annotation: Domain location=107-127::173-193::337-357::41- 61::594-614::1-790::100-122::166-188::20-42::214-240::428-450::548 -567::699-721
KKDLESSLHEKAEEAAKISSELDFLKKSLHSLHNELYAEKNVREKLEKTISDLTTELNEKQSQLQGKKELELSLEEKAEESAKISSELNFLEKSLHSLHNELHAEKTVREKLEKTVSDLTTELNEKQSQLQGKKELELSLEEKAEESAKISSELNFLEKSLHSLHNELHAEKTVREKLEKTVSDLTTELNEKQCQLQDSDLNRQELVHLKQMVTDLEFEKSRISDLLEKSEKHLTDALKESSSISCLETRLSEMHEFSIATDVVMTFTGAQFEDHMEELAEKLHSTCRQLDVLHKKNLDVESELDGCLSRERICIEENTRLLASLDFLKYELEDLTAQNRALIDQNSELKSELKEHKSRKEKVSDTSYVCERQSVLEVARLEQLLASCCRDAEELFLSKEETELECIVLRGKLDELESAFTSLKQSDDELLRLQNQCNELTKRLAEQVLKTEEFKNLSIHLKELKDKAEAECVNAHDRRGHEGPPVAMQESLRIAFIKEQYESKLQELRQQLSLSKKHSEEMLWKLQDAVDETENRKKSEASQIKINEELGMKILELEAELQAVLSDKRNLLNAYDLLQAEKECSAISLDCCKQEKQELEASLVKCNEEKSKIEVELTLAKELVETSRSHVNSLNEGNGAFSSFNPQENSTCAACSHEPESASINMQSEDPLAFSVMNGCQTLGTEKDLQLEEVMKHVASTESLKSSIDHLNKELERMKNENMLPSVDGQSHESSFPGLQRELMQLHEANQELGNIFPVFDKFSISGNALERVLALEIELAEALRTKKSSNIQFQSSFLKQHSDEEAVFRSFRDINELIKDMLELKTRHSAVETELKEMHDRYSQLSLQFAEVEGERQKLMMTIKNTRASKKASN

SEQ ID NO: 167677 - protein, 63 aa, Glycine max
  Coding DNA Sequence Number=SeqID_50899
MDVHIITRRTPKAKGHFGVVAACPGELKLNPEAVSSPRRTGFFTMKLFGGPSEPEASLDQNSE

SEQ ID NO: 167678 - protein, 81 aa, Glycine max
  Coding DNA Sequence Number=SeqID_50900
MKNDEERWKIFTKSPMETSQKREKREVVACPACPGELGCFHQKAPPSVGTFWKAQNVTELYGLRINASFRLPTCRGTSRIA

SEQ ID NO: 167679 - protein, 151 aa, Glycine max
  Coding DNA Sequence Number=SeqID_50901
AINLRGSRLDGGGHMNSARQSIHGSPNKIENGELANSARQSIRGAPDSMAINLRGSRLDGGGHMNSARQSIHGSPNKIENGELASSARQSIRDAPDTMAINSRGSRLDGGGRMNSARQSIHGSPNKFENGELANSARQSIRGAPDSMVVDT

SEQ ID NO: 167680 - protein, 210 aa, Glycine max
  Coding DNA Sequence Number=SeqID_50902
  Homolog annotation: Hit_ID=Q9FKM4; Match level="QueryCoverage=27%, HitCoverage=8%, E-value=2e-16, Identity=70%"; Hit description =Arabidopsis thaliana genomic DNA, chromosome 5, P1 clone:MUA2
MRHAFTANKHSALDDAYAMESISDDPLAVSSGQVIVGVESRYRIVYRLMNDIYVLSITVIDQDNSVNVFECIHIVNQVVSVVVTTCRDVDRHAREDQSQRRGKETVVRRGHEYSIKMGDSRITMRLASEEECGYPDEELAKEASNETERCGDLDLRECVTYDGPGPGPWEVFQLHHSDSDPFLKGTGFGDLNTYLGRPASAPLRPMTPVM

SEQ ID NO: 167681 - protein, 270 aa, Glycine max
  Coding DNA Sequence Number=SeqID_50903
  Gene Ontology: Biological process=multicellular organismal development
  Homolog annotation: Hit_ID=Q9FKZ3; Match level="QueryCoverage=54%, HitCoverage=47%, E-value=4e-50, Identity=68%"; Hit description =Protein ASYMMETRIC LEAVES2
  Pfam annotation: Domain name=DUF260; Domain location=8-108; Score =225.0; E_value=1.6e-64; Accession=PF03195.5; Description=Protein of unknown function DUF260
MSSSSNSPCAACKIQRRKCTQECVFAPYFPPDNPQRFAYVHKVFGASNVAKLLNELNAAQREDAVKSLAYEAEARLRDPVYGCVGLISILQHRLKQLQNELHHAKKELASHIGSHTMLPPAPSLLPPEQQPRTFSLFPFKPASTHQHDLFGFHDDGGASSASHAGGFNSHLAAVFSPSPAVDHAFSHAPMQSLTLPHHQHLMRSPMQPKPQTDPECFSLFNFPFFGLAVMVLLHRIKEGLLSSSQLEANGCKGGRERQTCRKRMKGGGDR

SEQ ID NO: 167682 - protein, 135 aa, Glycine max
  Coding DNA Sequence Number=SeqID_50904
MERSMIDAASGGALGDMTPAEARNLIEKMASNSQQFSARNDVIVLRGVHEVATDSSSSTENKKLEEKLDALLNLVTQLAMNQKSTPVARDCGWRNHPNLRWTSPPQQQQLVPPFQNATGPSKPYVPPPMQQQQQQ

SEQ ID NO: 167683 - protein, 167 aa, Glycine max
  Coding DNA Sequence Number=SeqID_50905
MTGRLLTGSLTFDCRIMHYIIVRILLPHSSNLAQASEEDLILMWAFLTGRQIDWAHLVRYRMHKALRANAPLPYPQLVTLFLRHFQIPLDDEPFVQVKHSFTIGVGVVTSFGYRKDHDELRGLHTYVGERFDSLDGRFEGMDTRITQLEEDVTYLHRCFDLPPPSKS

SEQ ID NO: 167684 - protein, 81 aa, Glycine max
  Coding DNA Sequence Number=SeqID_50906
  Subcellular localization annotation: CTP_CleavageSite=34; ConfidenceScore=5.10e-01
NPCGVYLDLSSFTGSGVYPDLSSFTGSGVYPDLSSFTGSGVIQISVACIKRSAPRNIWLAWTSDILKRRDKLLLFWRTCPS

SEQ ID NO: 167685 - protein, 116 aa, Glycine max
  Coding DNA Sequence Number=SeqID_50907
MSRTHDAILYYNGKSNMPPQNKFVGCAFTGKNPKKFQIPSTCTIDELKNLIKQVAPKGIPPLGIHESQTLITNEELLKVLVQSNYWKKYGPIEILAVFTKYVVKIEDDVTGTSLNN

SEQ ID NO: 167686 - protein, 137 aa, Glycine max
  Coding DNA Sequence Number=SeqID_50908
  Homolog annotation: Hit_ID=Q9LVZ6; Match level="QueryCoverage=36%, HitCoverage=18%, E-value=3e-07, Identity=50%"; Hit description =Arabidopsis thaliana genomic DNA, chromosome 3, P1 clone: MSJ11
MAKPSSSKHSCGMSFMKWTMADAIHVATHHWMSCLFALGLLFFMAMEYTLLMVPPFDLGFIATIPLHTLLESSLNLNTLFAGLNASTKHRDLANLSMCYGSQRGLSTGELHLSFLTKETIFSVRHLHPRPKGSATAG

SEQ ID NO: 167687 - protein, 166 aa, Glycine max
  Coding DNA Sequence Number=SeqID_50909
MWSFCTLLSSRGGGPDDTWRQNLVIPHPFAIQTQSCPMARRDKIWSFCTLLSSRGGGPDDMRRQNLVIPHPFAIQTQSCPMARRDKIWSFCTLLSSRGGGPDDMRRQNLVIPHPFAIQTQSCPMARRDKIWSFCTLLSSRGGGPDDMRRQNLVIPHPFAIQSRRAR

SEQ ID NO: 167688 - protein, 126 aa, Glycine max
  Coding DNA Sequence Number=SeqID_50910
  Homolog annotation: Hit_ID=Q6CQF3; Match level="QueryCoverage=44%, HitCoverage=59%, E-value=3e-07, Identity=72%"; Hit description =Kluyveromyces lactis strain NRRL Y-1140 chromosome D of strain NRRL Y- 1140 of Kluyveromyces lactis
PRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGV

SEQ ID NO: 167689 - protein, 172 aa, Glycine max
  Coding DNA Sequence Number=SeqID_50911
  Gene Ontology: Mol. function=RNA-directed DNA polymerase activity; Biological process=RNA-dependent DNA replication
MELLLLRAGLREEERTSIARFLSGLNLEVRDKVEVLPYRDLDDLVQLFIRVEKQLKRKPTSKSYGSHSYPKKDQGQGILEAAPSKPIDDKGKTIEKQPLSTIKRSHSYWGKRLVSKLSLAITSHLKPYKPQWLNEQGEMIVNQRVKVPFFIGTYKDEGICDVVPMEARHLLL

SEQ ID NO: 167690 - protein, 153 aa, Glycine max
  Coding DNA Sequence Number=SeqID_50912
MGAKHLTRTKEWSHVIKDRKVSPRIIMTKLGLCVPTDTTVSKWQRGADNRKVSPRIMGISAYHVCRMTKLGLCVPTDTTVSEWQRGADNRKVSPRIIMTKLGLCVPTDTTVSEWQRGADNRKVSPRIIMTKLGLCVPTDTTLSEWQRGADNRK

SEQ ID NO: 167691 - protein, 156 aa, Glycine max
  Coding DNA Sequence Number=SeqID_50913
EELATQLAQASQVASSRSNRLLEEHPGRPKWAGLRDLTGHAITHFLAFGMLQNLTDCVTMLPFDFRHGAQYLEAVKQRLHAIKQWYPDEIREPIGKITKKPHFPVTGGSALDNGGHMNSARQSIHGSPNKISRVEDRRTALGKSIRGAPDSLVEDA

SEQ ID NO: 167692 - protein, 150 aa, Glycine max
  Coding DNA Sequence Number=SeqID_50914
  Gene Ontology: Mol. function=N-acetyltransferase activity; Cellular component=cytoplasm; Biological process=metabolic process
  Homolog annotation: Hit_ID=Q165L9; Match level="QueryCoverage=97%, HitCoverage=98%, E-value=1e-31, Identity=44%"; Hit description =Acetyltransferase, putative
  Pfam annotation: Domain name=Acetyltransf_1; Domain location=58-142; Score=57.9; E_value=3.4e-14; Accession=PF00583.14; Description =Acetyltransferase (GNAT) family
MNPSNPEVTIRRINGDDKAQWLALWQGYLDFYRADVAPQVTDRTFERLGQDEQVYGLVAQDADGQLLGLMNLVFHPSTWSAVGYCYIEDLYVSPQARGHKVSEKLFEQAYRLAEARGSDRVYWMTQEYNAPARSLYDKIGRRSSFIVYTR

SEQ ID NO: 167693 - protein, 431 aa, Glycine max
  Coding DNA Sequence Number=SeqID_50915
  Gene Ontology: Mol. function=adenylosuccinate lyase activity; Cellular component=cytoplasm; Biological process=purine ribonucleotide biosynthetic process
  Homolog annotation: Hit_ID=Q6D4E7; Match level="QueryCoverage=59%, HitCoverage=56%, E-value=1e-132, Identity=89%"; Hit description =Adenylosuccinate lyase
  Pfam annotation: Domain name=DUF489; Domain location=1-183; Score =289.6; E_value=5.9e-84; Accession=PF04356.3; Description=Protein of unknown function (DUF489)
  Pfam annotation: Domain name=Lyase_1; Domain location=189-431; Score =125.0; E_value=2.1e-34; Accession=PF00206.10; Description=Lyase
  Pfam module annotation: Pfam domain module=DUF489::Lyase_1; Domain location=1-183::189-431
MAGISQSARLVQQLAHEGQCNREAFQTSLKSLLQMDPPSTLAVFGGEERNLMVGLETLMGVLNANNKGPGAELTRYTISLMVLERKLNANKQAMNTLGERLSQLERQLAHFDLESDTIISALAGIYVDVVSPLGPRIQVTGSPAILQNPQVQAKVRATLLAGIRAAVLWQQELLPMELSSLTAVSPVDGRYGDKVSALRPIFSEYGLLKFRVQVEVRWLQKLAACAEIKEVPAFDADANAFLDKIVAEFNEEDAQRIKTIERTTNHDVKAVEYFLKEKVAAVPALHAVSEFIHFACTSEDINNLSHALMLQSARQDVVLPYWRKIIDALKGLALEYRDIPLLSRTHGQPATPSTVGKEFANVAYRMERQYRQLERVEIMGKINGAVGNYNAHIVAYPEVDWHQFSEAFVTSLGITWNPYTTQIEPHDYIAE

SEQ ID NO: 167694 - protein, 413 aa, Glycine max
  Coding DNA Sequence Number=SeqID_50916
  Gene Ontology: Mol. function=potassium ion transporter activity; Cellular component=integral to membrane; Biological process =potassium ion transport
  Homolog annotation: Hit_ID=Q6DB92; Match level="QueryCoverage=82%, HitCoverage=54%, E-value=1e-140, Identity=74%"; Hit description=Low affinity potassium transport system protein kup
  Pfam annotation: Domain name=K_trans; Domain location=85-413; Score =60.8; E_value=3.6e-23; Accession=PF02705.7; Description=K+ potassium transporter
  Subcellular localization annotation: CTP_CleavageSite=49; ConfidenceScore=5.43e-01
MTTNAADHATKSRLNPASNTPETRRRRRTAQNCADRRRKSPARRRELIVAAANKVRRLHLYCQREPSNKDLHMHVKNKQPLPAVTLAAIGVVYGDIGTSPLYTLRECLTAEEGITMTPASIYGFLSLIFWLLTLVVSIKYICFVMRADNDGEGGILTLMSLAIRRLDARWVPAAVLIGLVGGSFFYGDGVITPAISVLSAIEGLQIIAPELDSFIVPLSLLVLTALFAIQKRGTGSVGKLFAPAMVIWFLTLALLGIGGILQHPGVLRALNPYWTVNFFLEYKTVSFFALGMVVLSVTGAEALYADMGHFGKKPIRLAWFTLVAPALVLNYFGQGALLLTNPAAINNPFFLLAPTWALIPLLVIATLATVIASQAVISGVFSLTRQAVRLGYLPPMRIIYTSDQESGQIYIPV

SEQ ID NO: 167695 - protein, 293 aa, Glycine max
  Coding DNA Sequence Number=SeqID_50917
  Gene Ontology: Mol. function=tRNA (5-methylaminomethyl-2 -thiouridylate)-methyltransferase activity; Cellular component =cytoplasm; Biological process=tRNA modification
  Homolog annotation: Hit_ID=Q669Q4; Match level="QueryCoverage=79%, HitCoverage=63%, E-value=1e-120, Identity=87%"; Hit description=tRNA (5-methylaminomethyl-2-thiouridylate)-methyltransferase
MNETSFFMSRDTLVLGKRPWYLRVRGKVFQLLQRNALRAPDLFEIPPNRVIELGAQLRQALFDDAAAEADFALVEHCRLAGGDGGDRFVETHFDAFAVERGHGARDILLAIAGLHRAAERAAQRQAIHPVQLLRDKAGRHQARVIVPLGDHQHVVGHVFIHHVPRIFAAVFQAADAQPFALAQGVIHQALVFADGLAVNADDRARLRRQVAAEEVAELALADKADAGRIFLLGGDQLQLLGDAAHLRLLQLADREQALRHLLVAQGVEEVALILVAVDAAQQAALAVYVLAAH

SEQ ID NO: 167696 - protein, 75 aa, Glycine max
  Coding DNA Sequence Number=SeqID_50918
MSNFTTLMRFACYGTSHGGTSHIKANLSPSMVWFKDELGESGGYVTPRMNHPRKKRDAEAMCGVPKLMTGLIVMI

SEQ ID NO: 167697 - protein, 102 aa, Glycine max
  Coding DNA Sequence Number=SeqID_50919
  Subcellular localization annotation: CTP_CleavageSite=31; ConfidenceScore=5.39e-01
MPISPCKSISWDRTHKTPSGPGKVQQGPGVSSSGYGPLSVLQGARIAPARHPVDPKKSNRFYRVPITSSKGIRPPTDRAFIKKYCVPRQAQGETPQQHWDGR

SEQ ID NO: 167698 - protein, 124 aa, Glycine max
  Coding DNA Sequence Number=SeqID_50920
MTYPLLINRILYVVVCYCIKDHGFSTCLPSSSSSSSCSFGRIGFAVYREADMQASRLRSLSTRPPGADPPVVHVDPATGKANGPHRKKLRIYLGIVVRDKVDVTYENRKEVPTAQKDLIWEDIK

SEQ ID NO: 167699 - protein, 463 aa, Glycine max
  Coding DNA Sequence Number=SeqID_50921
  Gene Ontology: Mol. function=transporter activity; Cellular component= membrane; Biological process=transport
  Homolog annotation: Hit_ID=Q1XVS5; Match level="QueryCoverage=100%, HitCoverage=49%, E-value=1e-133, Identity=52%"; Hit description=TonB- dependent receptor precursor
VLVLLNGKRRHTSSLVNVNGSPGRGSVGTDLNALPAFAIERLEVLRDGASAQYGSDAIAGVINVIMKKNTNAFTSAITAGGFNSKGSNDHSGGWDGGKYQLDLNYGTAIGKNGFINFTASLMKREETRRANAATGQIFNAYNAIEQRALENGVNISSLFGNIGNTPNSQQIIDYIHLYAQNVNYFSPAFQTEIQNANSISQLQTLLKTDVSENEMAYRGLARNDFNMRVGQSRLTSGQFFMNSEFDLASSVKGYAFGGISYRSGNAGGFFRRPYESRASTSIYPNGFLPEIASDVIDLSLATGFKGKIGNINYDISNTYGRNTFDYTIKNTANASMLYPSKTEFKAGGLNFSQNTVNADFDTKVDWLQGFNIAFGGEARFERYKIQSGEQDSWALYDINGNVQDVSTPANLKPTDFFGAVRPGGAQVFPGFRPANSLNKGRSSVAGYIDTELDVTDKWLISGA

SEQ ID NO: 167700 - protein, 69 aa, Glycine max
  Coding DNA Sequence Number=SeqID_50922
MGSSQAPSLKKRFYQVKVKSLGVTSLKELGQLMGQLQRQAFRKAYELHRSDFLFNGGYVEAKAPLLSTS

SEQ ID NO: 167701 - protein, 268 aa, Glycine max
  Coding DNA Sequence Number=SeqID_50923
  Homolog annotation: Hit_ID=Q9AVH2; Match level="QueryCoverage=73%, HitCoverage=99%, E-value=9e-40, Identity=64%"; Hit description =Putative senescence-associated protein
AESQWIVAARPLCHLQYPVAYLSRLQRILPAARWELRFKASRRANPPHEGHQRHVPLGGRGPLLLVGKRTAGARVASSPDSDLEAFSHNPTHGSFGPLAFQPSAMTNCANQRKEPTSEGSKKQRRYERLAATSQLSLVGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWES

SEQ ID NO: 167702 - protein, 694 aa, Glycine max
  Coding DNA Sequence Number=SeqID_50924
  Homolog annotation: Hit_ID=Q1RVN3; Match level="QueryCoverage=49%, HitCoverage=57%, E-value=4e-24, Identity=25%"; Hit description =Nucleotide-binding, alpha-beta plait
  Pfam annotation: Domain name=RRM_1; Domain location=75-145; Score =12.5; E_value=0.01; Accession=PF00076.12; Description=RNA recognition motif. (a.k.a. RRM, R
MKGGVRRGVDGGRGDSWRWENGGGAFHTKVQSDDGWNLVQYRKRWDGGRGSGYTKPDIYQSRDQRSKEQLQSTTIYITNFAEEMNAKHLFNSLRSYGDLQEVVIPARRNRLGKRFGFARFCRIQEPERFTMKLDNIFIGGDKIFANLPRYQRDQAKKMPGGPISKESVSVVWKSTQVWKPKVIGQASKITNGSMHVQMGGELKYEAKVEDMKRLSKAMVGVVIHPGQSYLIQEHFAMQGVFTILVTPLGANMVLLEGSVGVEDFQGYIEEAKGWLQQWFKEIKPWNASIVDEERLVWVRCYRVPSHVWDSDFFSFLTKDIGVFVNSDDNTMKRKTMDVARLMVRTVKKEEIHMIRKVCINGVSFSIKMVEDWFGPIQWSSLQDQSKRELYNDENSSSDDEVWPESSPEDDLVKEDDEAGSYGNNSALNEALIGISISNSNEGNNELVSKSGNQELEEDYMEEIKDHSKDNLLCWNSAGDFMKQLESQQVGEYSANSHVSATRGSGGCKEGFCEESPGNSLSSFGPIVSQNHLGPVFNNNSGPLVERLSSIQRNNLSSQIPRMKQRKLSKRGFLSKPGRASRSNRFNHDLKSISQQSSMNEAPVKSRTATEQAATHFSGGSVLCGGSLSSADMRLCNNKFWVLQSKSVVQRVWEEARHIGVEGTEKDEVYIQQINLCESRDAVAKQQRVNNNGVS

SEQ ID NO: 167703 - protein, 66 aa, Glycine max
  Coding DNA Sequence Number=SeqID_50925
MRKEVAITKGGMPLWHHRCRGRRPIHMNLVDDQGALGEIEQNEAADRKKEKKGERMGRGKREKVRK

SEQ ID NO: 167704 - protein, 148 aa, Glycine max
  Coding DNA Sequence Number=SeqID_50926
  Homolog annotation: Hit_ID=Q1EMR0; Match level="QueryCoverage=95%, HitCoverage=79%, E-value=3e-27, Identity=49%"; Hit description =Putative nitrilase-associated protein
  Subcellular localization annotation: CTP_CleavageSite=70; ConfidenceScore=5.52e-01
MGRGVSAGGGQSSLGYLFGSGVPASSANSQPANGARTQNASAPSPPVDKQSPAPAPAPAPASSPIDKQIPAGIPGSLKNNYHRADGQNCGNFLTGEPWCNGKVAALGPIGLCFQGQVKPAEDRPSTKVHAAPGGGSSLNYLFGGPPGN

SEQ ID NO: 167705 - protein, 443 aa, Glycine max
  Coding DNA Sequence Number=SeqID_50927
MSHAPQCSGQALALGEKFVWYAPHSGFSNQLSEFKNAVLMAGILNRTLVVPPILDHHAVALGSCPKFRVVDPKDVRISVWDHVIELVQSRRYISIAEIIDVSSLVSPSLVRVIDLRDFVSIWCGISLDLACVKDTKLQSSVSESLKQCGSLLAGLHGSIEKCIYAVNEDCRTTIWTFHTDGHEDGKLDSFQADEQLKQKKKISYVRRRKDVFKTLGPGSEVESASLLAFGSLFSAAYKGSELYVDIHESHQDQRFRSLMDKIKHLPFVPEIMIAGKQFVKETIKAPFLCAQLRLLDGQFKNHQKATFHGLRQKIESLRKEGPLPVHIFIMTDLPGDNWTGTYLSDLISDKHNYKVHFLKENDKLVRRAAIKLMAAGHGQRFISNSDSTISKRYCSSQRLPDLLLYVEQTVCSCASLGFIGTPGSTIAENIELMRKFGSSSQQC

SEQ ID NO: 167706 - protein, 84 aa, Glycine max
  Coding DNA Sequence Number=SeqID_50928
MHSAVLGEKNIFREENPSRDASVTLPRHFREQIREGFPSFFTVLRSSTGLISSSQLRIRRSKSPSFVDHPKRSLMVQRQNISLL

SEQ ID NO: 167707 - protein, 571 aa, Glycine max
  Coding DNA Sequence Number=SeqID_50929
  Gene Ontology: Mol. function=sequence-specific DNA binding; Cellular component=nucleus; Biological process=regulation of transcription, DNA-dependent
  Homolog annotation: Hit_ID=Q66Q67; Match level="QueryCoverage=93%, HitCoverage=74%, E-value=0.0, Identity=76%"; Hit description =Homeodomain protein HOX3
  Pfam annotation: Domain name=Homeobox; Domain location=25-81; Score =83.3; E_value=7.4e-22; Accession=PF00046.19; Description=Homeobox domain
  Pfam annotation: Domain name=START; Domain location=224-448; Score =199.4; E_value=8.4e-57; Accession=PF01852.10; Description=START domain
  Pfam module annotation: Pfam domain module=Homeobox::START; Domain location=25-81::224-448
MEFGSGSPGDRHHHHDGSSDSQRRKKRYHRHTANQIQRLESMFKECPHPDEKQRLQLSRELGLAPRQIKFWFQNRRTQMKAQHERADNCALRAENDKIRCENIAIREALKNVICPSCGGPPMNDDCYFDEQKLRLENAQLKEELDRVSSIAAKYIGRPISQLPPVQPIHISSLDLSMGTFASQGLGGPSLDLDLLPGSSSSSMPNVPPFQPPCLSDMDKSLMSDIASNAMEEMIRLLQTNEPLWMKGADGRDVLDLDSYERMFPKANSHLKNPNVHVEASRDSGVVIMNGLTLVDMFMDPNKWMELFSTIVTMARTIEVISSGMMGGHGGSLQLMYEELQVLSPLVSTREFYFLRYCQQIEQGLWAIVDVSYDFTQDNQFAPQFRSHRLPSGVFIQDMPNGYSKVTWIEHVEIEDKTPVHRLYRNIIYSGIAFGAQRWLTTLQRMCERIACLLVTGNSTRDLGGVIPSPEGKRSMMKLAQRMVTNFCASISSSAGHRWTTLSGSGMNEVGVRVTVHKSSDPGQPNGVVLSAATTIWLPIPPQTVFNFFKDEKKRPQVVTCLTQLSYLMLSP

SEQ ID NO: 167708 - protein, 73 aa, Glycine max
  Coding DNA Sequence Number=SeqID_50930
MLLPSGPEEESVSLSWGQMSYRMSRHHASEHADYMCPYEQIKQVNNTRELFTQFGATSPTSGGYQAREEIHSQ

SEQ ID NO: 167709 - protein, 71 aa, Glycine max
  Coding DNA Sequence Number=SeqID_50931
MVGAFSQNIVTLTGLPMILLSESDLTNPLCGVSCYVLLSAPGWFFTDMMNRWMTMKNLMLEDTGTPHSDRM

SEQ ID NO: 167710 - protein, 67 aa, Glycine max
  Coding DNA Sequence Number=SeqID_50932
MTCSKVLDPVKFDHLENEAAIILCELEIEIKCRGPVYLRWMYPVERYMKILKEYTKNLHHPEESIVE

SEQ ID NO: 167711 - protein, 103 aa, Glycine max
  Coding DNA Sequence Number=SeqID_50933
MHALLGSFNSGNWSDSKVLGSTGLNCSAITGDRGTLVPLDLEIDATLRRNRVERRRKLLQDRTVASILEEETHFYDSLSPDSPSSGESANQHFETTTMADEHD

SEQ ID NO: 167712 - protein, 60 aa, Glycine max
  Coding DNA Sequence Number=SeqID_50934
MVVESDVGNDDGQKILSDCRTSRTDEGIATMGETLNPIHDYDSFFWVHLPLNFNFSRTID

SEQ ID NO: 167713 - protein, 179 aa, Glycine max
  Coding DNA Sequence Number=SeqID_50935
  Gene Ontology: Mol. function=transferase activity; Cellular component= intracellular; Biological process=translation
  Homolog annotation: Hit_ID=Q7PC91; Match level="QueryCoverage=83%, HitCoverage=31%, E-value=5e-35, Identity=50%"; Hit description =Putative transposase
MRSRLPRKYIDRDREEGQLERFFNDYVSNNAIYIDEQFQQRFRMCRDVFLRIVQALGNQDSYFQQQVDATGRMGLSPLQKCTVVIRILAYGSPVDSIDDYVQMGETMTLLCFDKFVRGVYDVFEAKYLRRPNNNDIQYLLQISEHYGFPSSDNDINVFNKFPMFKDVMEGEVPSKICSK

SEQ ID NO: 167714 - protein, 539 aa, Glycine max
  Coding DNA Sequence Number=SeqID_50936
  Gene Ontology: Mol. function=catalytic activity; Cellular component =protein complex; Biological process=translational initiation
  Homolog annotation: Hit_ID=O60735; Match level="QueryCoverage=59%, HitCoverage=84%, E-value=4e-33, Identity=28%"; Hit description=GA17 protein
  Pfam annotation: Domain name=PCI; Domain location=345-447; Score =82.5; E_value=1.3e-21; Accession=PF01399.17; Description=PCI domain
MEGQYQLREARVCKRHGRQKVCKVASDCGRDRHERVECENCACKINWADLDTHPVIFFLFCAALSLAVTETMTTVVPTSEEDAALSVVRFASELAWADAGPEPTSPGGIRPLFFVLRDKVAEPQVSRLCMEAEEFIVMGKWLELASLMITSAELVFSKVSETDIESIFTIICNLVTKTENPDEVMEIVKVITAKIIQQPNEKPAVRLKTLINLYNLLETPYCQFYVYMKALNLAVNGKVTEYIIPSFKKIDSFLKEWKIGIPEQRELFLTISNILKENKSMSKDAFKFLSNYLSTFSGEDAHVLSEAKEEAARAIVEFVRAPDIYQCDLLDLPAVGQLEKDAKYALLYQLLKIFLTQRLDAYLEYQAANSTLLKNYGLVPEECISKMRLMSLMDLTSDGSGQIPYELIRDTLQINDDEVELWVVRAITAKLIDCKMDQMHQSVVVSHPTDRVFGQHQWQALRTKLATWRGNIANVISTIQANKITEDGSQAAQEKEKILLPNFVTEPFCFKLFHFDVMFDQPHDSVEYIIPVDCCPSSS

SEQ ID NO: 167715 - protein, 101 aa, Glycine max
  Coding DNA Sequence Number=SeqID_50937
MKGLLLVLMIILIHYKVVNANYNKECATENCLIGNDLESEFSFGSRVARMLYDVSQSVSGKTGNSNNKAVNCTQTKDYRSCLPPKNGGGPNQRCGDYTRNC

SEQ ID NO: 167716 - protein, 80 aa, Glycine max
  Coding DNA Sequence Number=SeqID_50938
MKGLIVLLFILIHYKVVVNGNYNNVVIGNELETEFSFGSHVARMLYDIQKQKIASIKSYSAKMYIDSMSIWSNYERSCNQ

SEQ ID NO: 167717 - protein, 284 aa, Glycine max
  Coding DNA Sequence Number=SeqID_50939
  Gene Ontology: Mol. function=chitin binding; Cellular component =extracellular region; Biological process=chitin metabolic process
  Homolog annotation: Hit_ID=UPI000044A8F0; Match level="QueryCoverage =75%, HitCoverage=99%, E-value=8e-30, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=41; ConfidenceScore=5.47e-01
MPSPSEDCTSSPSDGFTSTPSEGYTPSPSVGFMSSLLEDCMSSTSAECMFSPSEYYMSSPSAECTSSPLEDRTGLHVLAFGGLHILSFRGQHALAFRGLRILSFRGLHILTVRGLHVLAFIGLHALTFRGLHVLIFSRVQVLTFSRVHVLVFRGLHALTFRGLHALTFRGQHALAFRWLHVLSFRGLHVIAFRGLHTLAFRGLHVHTFRGLHALALRGLHVLAFSGVNVLAFRGLHVIAFRGLHALTLRGLHALTFRGLHVLAFRGLHVLDFKGIHDLTFRGLH

SEQ ID NO: 167718 - protein, 98 aa, Glycine max
  Coding DNA Sequence Number=SeqID_50940
MVVTARADLGLGVTTRARGVVGNASAHPHSLTCRSATYRMHQDMERTSGCAMIDPEICISRNKKHVGAISPSYASASATGRATVVKVGAGARRLCARR

SEQ ID NO: 167719 - protein, 313 aa, Glycine max
  Coding DNA Sequence Number=SeqID_50941
MKLWSAQKTSNLTAEFDNLLLDSNFRGGGIAIKNSLRINIDNCYITHFSTTGILVQSGHETYIRNTFLGQHITAGGDKHERDFSGTGISLQGNDNAVTDVVIFSADIGILVTGQANTLSGVHCYNKASGFGGTGIYLKLPGLTQTRIVNSYMDYTNIVAEDPVQLHISSSFFLGDAGIVLKSVKGVVSGLNIVDNMFSGLNKGVDIVKLDQSNSHFNQIDQVFVARNVVRGMNLKATAAKMSLLGNGTSWTADFNKVLLFPNLIKHVVYSLSASGNTFPNHALRNVSQNRVVIETDEAVNANVFVTVDQGNAS

SEQ ID NO: 167720 - protein, 245 aa, Glycine max
  Coding DNA Sequence Number=SeqID_50942
  Subcellular localization annotation: CTP_CleavageSite=48; ConfidenceScore=5.28e-01
MANSNLTGSIPCDRAPPLYIATSRSSTRLTLYTTPKLPAPILLCREKLSMAAFNSAGVNNRPPTCPVTFDTLCDNHAETILVSSTEAKPWARDASKFEAVLLLLIVLSIAKEKPWTRNVLKVDAVPLLITLPTTEAKPWTGKVPKFDVVPVLLLMALSTMKEILWISDAPKFGGVLLLIGTSTWIVVTENKRGYISCGSGQVEGTSTWLFKENKGGYIPCGSLLVKAFTRLKRNLKDRRSLRDWM

SEQ ID NO: 167721 - protein, 156 aa, Glycine max
  Coding DNA Sequence Number=SeqID_50943
MATISRMWFIFLGITCFYVTYSYGENMPQRTLSRGTHQEALLGLKALKASITRRDSIASTPPSFSPSPTPSPLPPQEIKKPHVYLVTSYGADPTGNSDSTEALLAAIADAAKGPSEGFLMKDIKDLGGAQINLEGGKYIISQPLKLPLARAGNLMV

SEQ ID NO: 167722 - protein, 204 aa, Glycine max
  Coding DNA Sequence Number=SeqID_50944
METPVVLAEGETLPTYSRYYWLPTDIREIEAALCIPGRGFVLNAEGHPGKILRKDLTTLAQMDMNLGALISGQITSMAQSNSSRLGFLALIIALCKSRGVTSDSLVFERLSSVINLAYIKKNCWNPDDRTVTIRGASRARTRPAEAPSTSTAPPPARTPAAPSATAPADFQRLEAMLQSIHQGQIILLQSLQMVAPPNSIPSIE

SEQ ID NO: 167723 - protein, 203 aa, Glycine max
  Coding DNA Sequence Number=SeqID_50945
  Homolog annotation: Hit_ID=Q8TGM5; Match level="QueryCoverage=19%, HitCoverage=58%, E-value=1e-07, Identity=74%"; Hit description =Uncharacterized protein ART3
  Subcellular localization annotation: CTP_CleavageSite=50; ConfidenceScore=5.45e-01
PESIGRTGSHRSTSDRDTSPAPIRFPPDNFKHSLTLFSKSFSSFPRGTCSLSVSRQYLALDGIYRPIGGCIPKQPDSPTAPRGATGSGHDGALTLSGAPFQGTWARSATEDASPDYNSDAEGDRFSWWAFPGRRALGLMASGATCVQRLDGSRDSAIHTKYRISLRSSSMQEPRYPLPRVIVCKCCVVTTPAGHRLRAPGSRT

SEQ ID NO: 167724 - protein, 72 aa, Glycine max
  Coding DNA Sequence Number=SeqID_50946
MDYKRDRYLAENVNRRIVATDNELVEIIIKKGEGYLRRQSECSKKERRMDCDGGAAEDGGDDKQTTKDVRLQ

SEQ ID NO: 167725 - protein, 116 aa, Glycine max
  Coding DNA Sequence Number=SeqID_50947
PFVKVKRSFSIGANVVTSFGNRKERDGSWVKKDAPVQATEDCSPSPHSQRDDSSSLLHNILERFDGLQTYVGERFDALERQVDTRFDAMDSRITKVEEDVTIIRDYLDLPPPPPLV

SEQ ID NO: 167726 - protein, 111 aa, Glycine max
  Coding DNA Sequence Number=SeqID_50948
MLRITQKAIFLLTLTLRYLEGQSRKPQTSNVIVKQPPWVKVLEESVLILGTWTRLMFSSVTSKKAKKIEEKKKIWSRPSPIRALSARHVLSEALSSRVVMCVERAIGAKCA

SEQ ID NO: 167727 - protein, 155 aa, Glycine max
  Coding DNA Sequence Number=SeqID_50949
FNAYIEFESSDNDDFKPSNMDEDNMQTSLDFETEFDDVVDASIEAHVIGIDEELFVDLSNIVDLDEDCLTKELQSDNDGERSVANKPMIYRFRQEDICKDFQWTLGMEFNTLAEFKDVVLQYSILISKEVKTLHFKHTLSRVFWNKNAKSKWVAK

SEQ ID NO: 167728 - protein, 1027 aa, Glycine max
  Coding DNA Sequence Number=SeqID_50950
  Gene Ontology: Cellular component=cytosol
  Homolog annotation: Hit_ID=Q10JI7; Match level="QueryCoverage=93%, HitCoverage=97%, E-value=3e-54, Identity=25%"; Hit description =Expressed protein
MSKKVLTSMKDENPDLQKQIGCISGFLQLFDRHSFLTGQSNSSHNQNIPNNKGGISNHIKEVNNTTQKATANNVKVARENQQFSTESSGTSMTSSSRSSSMSSLEFNRTIQIEPPPINQMKIPENSNSGAAMKQGSQGHQPLDFYDIVKESMHRDVHGLSVKTVAKEEKKGRILKYIDSPRPLEPSKFVNTGVMVAWDSPRLSYDGRDTQDTFKSATKPKELPRLSLDSRQGSIKSFNEGTKSRSLLKGPQKGYGSSSTMQLQEPETSRRPSSVVAKLMGLEAFPDCTETCDTPPRISSCATNKNETTAGPSTNDEYKQHQSAASSQRTIKGSTLLQFRRDASIMNMTPYSRFSLEPIPWRQPEASQGSQLQNSKRSESSAKASKLSLSVYGEIEKRIADLEFKNSGKDLRALKQILDAMQRYKESLDIPRDQVSNSLSDNRSNSSLSESSIVKSPRLRQKDPTSTTVEMSNSTQGSKSPIFIMKPAKAARKTNSPASTEMSFQGKSGPSKFSPANRTNGIMGDKLDRQTAKGIGPAITHATDPISQPFHSVNKSNKKRTSKLMQSSKVRQVINGENATNSSNTAEAKSPRLQKKFGLERRSPPTSPSSDLSSNRRQQNRQSVELSSPSTTPRQKFSEISNQRRDFKHEVDLEVIHIDHSDRINGNTIQLKGINQNNAAEELSKESFMAEKTITAEQPSPVSVLDASFYREEPPSPVKKKSDISKDLDDALNTYDSSEENSEDLPLSSNTTKANFSSDTDLRTQNLVEILQQIDNSDERFTNFRDNKDPDHRYISEILLASGLLSSPSSSQVFHSSSYPINPKLFLALEQIKTNKMCFNIEHNAKNITGLNSPEQMQRKLIFDVVNDILAQKIILESSTLWRQPNQQAGRKLSGQLLLDELCTEIDKLQHKNTNVNLADENENLTSLLWEELMHCPTIYTNSYSEIPNVVLDIERLIFKDLITEVVRSELANHSGSAPPEVLNASIVDLLLPSIQYFCILPMLVHGNGSNSGSRNEFMANLDFSIQE

SEQ ID NO: 167729 - protein, 88 aa, Glycine max
  Coding DNA Sequence Number=SeqID_50951
  Gene Ontology: Mol. function=galactosyltransferase activity; Cellular component=membrane; Biological process=protein amino acid glycosylation
MDIVEWIHGSDIPKKHMEGPEHKVFRDWMRWACHETNRFNAKWFMYNYPDPPSGCSHNLWNDILLHFICGRIRRSGFRLSPISTTPML

SEQ ID NO: 167730 - protein, 292 aa, Glycine max
  Coding DNA Sequence Number=SeqID_50952
  Gene Ontology: Mol. function=nucleic acid binding
  Homolog annotation: Hit_ID=Q10CM8; Match level="QueryCoverage=72%, HitCoverage=31%, E-value=2e-37, Identity=39%"; Hit description =Expressed protein
MDSESTIAGKRKNDKVLNSYTDEMKMVSAASIINEDFSSEISKFSLDGTQVRSLKKRLIVLDINGLLADVVSPPPKDHKADATIARRAIFKRPSYLKFLEFCFDKFEVGIWSSRMKKNVDGVIDYLMGDMKNRLLFCWDLSHCTETSFKTLENKHKSVTFKDLRKLWDKHDLNLPWKKGHFNKTNTLLLDDSPYKALLNPPNTSVFPRTFTYKDGSDNSLAEGGELRVYLDGLTNAEDMHKYVEEHPFGQEGISETSECWDFYRQVIDSLSADILEANKRGARSNLEVQETT

SEQ ID NO: 167731 - protein, 1576 aa, Glycine max
  Coding DNA Sequence Number=SeqID_50953
  Gene Ontology: Mol. function=RNA-directed DNA polymerase activity; Cellular component=chromatin; Biological process=chromatin assembly or disassembly
  Pfam annotation: Domain name=Chromo; Domain location=1469-1514; Score= 28.4; E_value=2.6e-05; Accession=PF00385.14; Description='chromo' (CHRromatin Organisation MOdifier
  Pfam annotation: Domain name=RVP_2; Domain location=415-527; Score= -21.5; E_value=4.8e-05; Accession=PF08284.2; Description=Retroviral aspartyl protease
  Pfam annotation: Domain name=rve; Domain location=1163-1319; Score =106.5; E_value=7.7e-29; Accession=PF00665.16; Description=Integrase core domain
  Pfam annotation: Domain name=zf-H2C2; Domain location=1104-1145; Score=26.4; E_value=9.8e-05; Accession=PF09337.1; Description=His(2)- Cys(2) zinc finger
  Pfam module annotation: Pfam domain module=Chromo::RVP_2::RVT _1::Retrotrans_gag::rve::zf-H2C2; Domain location=1469-1514::415 -527::649-818::162-252::1163-1319::1104-1145
MRGYNNQHSSQNKGPKGKYPSQHTLEIISEESFPYLNSFSEATGPRNQEFFSSSLYQFGALVAPPMANSPSADKIEELLIRLTTQQLSLSTKIDDFISHITPLVSPPASIPSSFPRLFPAPAPQHRIKLDVPRFDGTDALGWIFKINQFFEYHGTPEYDRLTIASFYMEGRALAWFQWMTSNGQFTSWPTFLQALQARFAPSQYEDPTGALCKLMQKGSVTAYLSEFEDLANRVVGIPPAFLLSCFISGLLPEIRREVQAHQPLTLSQAAGLARLQEEKLSDLRHPAPPIRPRPPSLSSPSLSRPPSLSPLLPSPPPRPTNPSPPFKRLTSEEIASRRERGLCFSCDEKYHRGHRCASRVFLFITDGDEPSDPSLLTSPDPTLEPEPDPPDTQDPYPAQLSLNSMAGHLAPETLRFVATVAHIDIVLLVDSGSTHNFIQHQLVAKLGLQPTSTAPLRVMVGNGQQLDCSSMCEAVPISIQNIRFTVDLYVLPISGANVVLGVQWLKSLGPVLTDYNTLSMQFLSEGRVIKLQGDLDAKLNALTPTQLRRLSRTQGEARFYHITLFPNLSSPATHAFPAPIQQLLLRYKALFDPPSTLPPSRATDHHIHLLPQASPVNVRPYRYPHYQKHEIEQQVDAMLQKGLIQPSTSPFSSPVLLVKKHDGSWRFCVDYRALNALTVRDRFPIPTIDELLDELGGASYFSKLDLLQGYHQIRMNPDDIPKTAFRTHHGHYEFKVMPFRLCNAPSSFQATMNSIFQPYLRRFIIVFFDDILIYSASMDEHLLHLETAFQVLLTHQFALKLSKCFFAQQQVEYLGHLVSTKGVEPLAEKVAAVRQWPRPRTAKALRSFLGLAGFYRRFIKGYATIAAPLVKTTTLDPFHWSDEAQAAFERLKLALSSAPVLALPDFHSPFMIETDASGVGPGAVLSQKGHPIAYFSKPFSPKLLRSSTYVRELFAITAAVKRWRQYLLGHRFVIITDHRSLKELLTQVVQTPEQHMYLARLMGYDYEIHYRSGAANQAADALSRVPEHDSSLVMLLSVPNLSFMDELHTQLQQHPEFNRRRLEVINHPATHPGFSVVNNLILYRHRIWLPRDIPIISTLLHEYHATPIGGHSGIAKTLARISENFYWTGLRADVTAFVSNCLDCQTTKYEARRSTGLLCPLPVPHRPWEDLSLDFILGLPEYKGHTVILVVVDRFSKGVHLGMLPTAHTTFMVATLFLDMVVKIHGVPRSLVSDRDPLFLSKFWQELFRRSGTHLRMSSAYHPQSDGQTEVLNRVIEQYLRSFVHRRPRTWGKLLLWAEWSHNTSWTSATGTTPYELTFGRKPFNFPDYLAGASANDAIDTLCSDCEATFQLIRKKLIKAQEAMKRKADAHRRDVTFSPGQWVLLRLRPSRQVSVRNHPHITGKLAKRFYGPFQVTEAIGKVAYRLQLPPGAKIHPVFHCSQLKQFHGDPTQPDIPPLPPQFCNDQPLIQPAAILASRQTSDATWEVLVQWHGLSPDETSWEDWSTLRQDYHLEDKVISQGPGSDTREQITEMSNNIEQHIAEVSKEHEGVQQSTQLTEQRPKRKVSKPTYLRDYI

SEQ ID NO: 167732 - protein, 135 aa, Glycine max
  Coding DNA Sequence Number=SeqID_50954
MEESLQDERVRYLHHLATGNMPPPEFVIVDDYISKAQPSCCVELGFFKLGGSLTKHDVRFTEFVHGGRGKWNQCSWATMFGYDLIVPFNMRCKLSHPSCNLDIEKLRCLVLLTSCIPAHQLMELILRRLIVSCPS

SEQ ID NO: 167733 - protein, 508 aa, Glycine max
  Coding DNA Sequence Number=SeqID_50955
  Gene Ontology: Mol. function=prephenate dehydrogenase (NADP+) activity; Biological process=tyrosine biosynthetic process
  Homolog annotation: Hit_ID=Q1RX89; Match level="QueryCoverage=82%, HitCoverage=84%, E-value=1e-153, Identity=63%"; Hit description =Prephenate dehydrogenase; NADP oxidoreductase, coenzyme F420- dependent
  Pfam annotation: Domain name=NAD_binding_2; Domain location=75-204; Score=-63.3; E_value=0.0023; Accession=PF03446.5; Description=NAD binding domain of 6-phosphogluconate dehydrogenase
  Pfam annotation: Domain name=PDH; Domain location=80-343; Score= -48.8; E_value=6.2e-06; Accession=PF02153.8; Description=Prephenate dehydrogenase
  Pfam module annotation: Pfam domain module=NAD_binding_2::PDH; Domain location=75-204::80-343
  Subcellular localization annotation: CTP_CleavageSite=55; ConfidenceScore=5.29e-01
MKGRVGTMLSVSSFRPPAVYPTLLHCPRLHHVNVSLFCSLSNGASSSCRSLGILRAIYRESEVPAQQLHHVQNQKLKIGIIGFGKFGQFLARTLVRQGHTVLAHSRSDYTHVALELGVTFFENPHDLCDERPEVILLCCSILSARHVLLTLPLQRLEPGTLFVDVLSVKEFPKKLLLDVLPSNLDILCSHPMFGPDSASCGWSGRRFMFDKVRIRNEERCNKFLDVFKRERCEMVEMSCEDHDKLSAKTQFITHTIGRVLGMLDLEKTRIYTKGYESLLNLKENTAKDSFDLYYGLFILNKNSPDMLGRLCFAFQELRKQLLKGVHVVVREHLFENPVTAKVQNLQDTASFHSDVSEYKSSLSSDYSYNNLKLKIAIVGFGNFGQFLAKTIVRQGHQVLAYSRSDYSTVAKELGVTYFRNADDLCAQHPEVILLCTSILSTEGVLKSFPWQKLERSTLFVDVLSVKEFHRNLFLQHLPLDFDVLCTHPMFGPQSAKDGWSGFLFVFDK

SEQ ID NO: 167734 - protein, 1255 aa, Glycine max
  Coding DNA Sequence Number=SeqID_50956
  Gene Ontology: Mol. function=RNA-directed DNA polymerase activity; Cellular component=chromatin; Biological process=chromatin assembly or disassembly
  Pfam annotation: Domain name=Raffinose_syn; Domain location=886-1236; Score=-422.6; E_value=3.1e-05; Accession=PF05691.3; Description =Raffinose synthase or seed imbibition protein Sip1
  Pfam annotation: Domain name=rve; Domain location=492-648; Score =87.3; E_value=4.6e-23; Accession=PF00665.16; Description=Integrase core domain
  Pfam module annotation: Pfam domain module=RVT_1::Raffinose_syn::rve; Domain location=12-181::886-1236::492-648
MLVANLIQPSHSPFSSPILLVKKKDGSWRCCVDYRALNVVTIKDRFPMPTIDELLDDLGQAAWFSKLDLRQGFHQIRMAEEDIHKTAFRTHQGHYEFKVMPFGLCNAPSTFQAAMNDTLKPFLRKHVAVFFDDILVYSVDLATHVSHLDSVLDTLSARQFLLRRTKCLFAQNQLNYLGHVISSDCIAPDPEKISVMLAWPVPTSPTALRGFLGLTGFYRKFIKSYTAIASPLTSLLRKEQFSWSAEALQAFQALQQAMVQAPVLANPNFSRPFTIETDASASAMGAVLLQDDLPIAHHSKVLCPRLQRASTYIRELHAITSAVRKWRHYLLGTSFTILTDHRSLKDLMSQMLSRIVPAEATCFTLVMPHFTFLEQLRKSLMVDPQYLNLLKDIQSKPEAHSDLSLHQDLIIRNRRIWIPFPCPFTERLLEEFHSSPIGGHTGAAKTLHRLRQNFDWPTIQKDVRHFVGQCSICQQTKYETKKPAGLLQPLPIPATAWEDLTVDFITGLPCSHGFTVIMVVVDRYSKGAHFGALPTHYSAFKVAVLFLDCVCKLHGFPHSIVSDRDPVFVSHLWRELFKLSGTKLRMSTAYHPQTDGQTEVLNRTLEQYLRAYVHNHPSHWFRFLSLTEWSYNTATHVGTGMSPFEGSTVAAVDHLLSSRETIHATLQRRLRKMQEAMKATADRHRRDLSFRVGDWVYVRLRPYRQTSVAPAYSKLAKRFYGPFEVVECIGAVAYRLQLPPSSRIHPVFHVSLLKLHKGQAPENSSWERWDELCRVHNLEDKAVFGEGSVDRNTGQGDTVLLWLLVFPPPPPPPPKPLSSTYKERVRVTMASSSDCLALGIPTTKPLISTYKDSFLRFSATFPTRTRFSNGAFSVSCCKNMEPVVYLNHDKQQLMVNDRPILKGMTENFTLSSVTEGHGHFLEVNNSAHVVSLEVLSCLSFTASFRRDRWYMARETGDWGDLKWDGVWIQSNVENKDKLELHLHPEAKGFTRVIFLSAGSDPFKLVHDAFCFMEESLQDERVHYLQPLATGNMPPSEFVIIDDYVSQHLSRRSPSPKDVSLLKIWRGNKYGGVMGMFHCQGVAWSSASSKLGGSLTELDVRFTEFVHGDRGKWNHQFAFYAHCEERVFVGNNVRLWLNRPFQHEVLVVAPIMKFGDRVVAVFGFIDLLYPCSSIEGIDFEEVDHELPKVKEYLVNVKLKGNGKFAVYSSFKPAFCLILGKMVEFNYNYEDHLVTINVDPRSDGNPSQDVSLVWLTY

SEQ ID NO: 167735 - protein, 121 aa, Glycine max
  Coding DNA Sequence Number=SeqID_50957
MCKSSILLWWWVCYGNISVFCTSWKAIQWNASNFSDMSSWSYLIKQAVFLKLWMGCCYFCEAVDDEWQQNGERKRERRRHFKEKMSLEEAHHHRRPWIRAWRKKEMNEGRGREEHEILCSK

SEQ ID NO: 167736 - protein, 68 aa, Glycine max
  Coding DNA Sequence Number=SeqID_50958
MSTETKIVFDQLTEDAMKLMENDVYHEMQEVFDREADKQDLEAVYCHNSSDEFLEKYYHTVPPDSFSA

SEQ ID NO: 167737 - protein, 97 aa, Glycine max
  Coding DNA Sequence Number=SeqID_50959
  Subcellular localization annotation: CTP_CleavageSite=65; ConfidenceScore=5.43e-01
MDSKPFSTVATYPSAGGQRGTHGCVFQVRKAHGVATNVYWRKTLKTRNVWSTNFNREKVRELFLRTRKGVSLAPTYPQFVMRNSDLCSSCKSGEVTC

SEQ ID NO: 167738 - protein, 77 aa, Glycine max
  Coding DNA Sequence Number=SeqID_50960
MATLVSACYRTLESDGRNETFSRSRPEDAYISGKGAGVSACHRTLGSQDSKKCARITIRCLRVPSDSQVTIAKSVHG

SEQ ID NO: 167739 - protein, 307 aa, Glycine max
  Coding DNA Sequence Number=SeqID_50961
  Gene Ontology: Mol. function=chitin binding; Cellular component =extracellular region; Biological process=chitin metabolic process
  Homolog annotation: Hit_ID=UPI00006A17C9; Match level="QueryCoverage =51%, HitCoverage=100%, E-value=8e-13, Identity=28%"; Hit description= UPI00006A17C9 related cluster
LHVLTFRELHVLTFTGLHVLAFRRLHVFTFRGLHALAFRGLHALAFRGVHVLTFRGLHVITFRGLHVLAFRGLHVLAFRGLDASPSEDYMSSPLEGCMPSPSMGDTSSTSEDCMPSPFKVLGSPLDPGGGPTVRAQPEEEAITQLLCILGQDFTRAVAKRDRAHKTPSEPEEVQQGPGVLARITGLWITPTRHSVGPEKSNRVLGFPALITSLRQFYGLPAAPSKARGRQVITRLAQDVKKALLGGNLELTTKKLPAKWSRKGTIEEGSSVAPKADTGFDKHRFQSVEHQYHFEAIKGWSFLRQRQG

SEQ ID NO: 167740 - protein, 55 aa, Glycine max
  Coding DNA Sequence Number=SeqID_50962
MDIENDRGYNCNGSNNTREEEIQKEDESEVEVHWGDDETAVTGRKMQCRGGGRWQ

SEQ ID NO: 167741 - protein, 33 aa, Glycine max
  Coding DNA Sequence Number=SeqID_50963
MGWYCRAMEEPIGVSHNRLLVELLRIIRTLAKE

SEQ ID NO: 167742 - protein, 89 aa, Glycine max
  Coding DNA Sequence Number=SeqID_50964
MAPKKLLTKRARKATAEEGSSAALQVEIEFDGHHFRSEEHQHRFEAIKGWSFLKERRVQLREKEYTELQVEIARRRWTELTEPMAKYDP

SEQ ID NO: 167743 - protein, 173 aa, Glycine max
  Coding DNA Sequence Number=SeqID_50965
  Subcellular localization annotation: CTP_CleavageSite=71; ConfidenceScore=5.79e-01
MSPSSSAPSSSPEASATGKGWGPSATGAVYTGRSYRSTAPSLYGLSSTGQPNAACRAPSSTCELRWTSEMVADVEVSVVHLQPVAAAGPASTIVPALACNILNERPVNGRPDELCGCNRYPIELTKTNCYMASEISWVSRRCDAYKLVDGIRDKLGYMNTNLGQDSVDQLEFR

SEQ ID NO: 167744 - protein, 81 aa, Glycine max
  Coding DNA Sequence Number=SeqID_50966
MSPGFNEGRIGGFVVYRILEISFEDSAPIKLFFFVWGSYGKQRRLVAVTGGEWWWRRSLRGVGEGLGEWKEEEVAVFHCCT

SEQ ID NO: 167745 - protein, 68 aa, Glycine max
  Coding DNA Sequence Number=SeqID_50967
MGHTQHTNFFVDELRGFGGGGGVPVARCQPSPGCCGVSPCACLGAQYFLMKARLMGGLMTLLGATGAS

SEQ ID NO: 167746 - protein, 306 aa, Glycine max
  Coding DNA Sequence Number=SeqID_50968
  Gene Ontology: Mol. function=transition metal ion binding; Biological process=proteolysis
MGLNELNQAHLYILNNTQEVVPYIAAHKEFLKDNHPKMSKKQLLQKHNKSFLKWFTNTIFGDNNAYEMLRNLANGPNQNVRTWKGYDINNYSFYTKSQDDKSKVQNSGVSLDVESKHFCSASNNNPKLVSMPYFGVIEEIWKLDYSRFRVPIFKCKWVNDNSTVQIADMGFTLVDPNKVAYKDKPFIMAKQAKKIIFMSNIPLAQDGQWFYKTPCFSKLMPTIIEEHEVDDVYANCNDHMAEHSDLTVLYIRHMATPPSSNPPSPSIASQSTSKRSRQSTRLRKLFVRHLDEQKLLVHVDLDTGKL

SEQ ID NO: 167747 - protein, 216 aa, Glycine max
  Coding DNA Sequence Number=SeqID_50969
  Gene Ontology: Mol. function=nucleic acid binding; Cellular component= endoplasmic reticulum membrane; Biological process=DNA integration
  Homolog annotation: Hit_ID=Q1T010; Match level="QueryCoverage=88%, HitCoverage=18%, E-value=2e-43, Identity=40%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MCDPKWVNTMEEELNFVEKNQTWELVNLPHDKKPITLKWVYKVKVKPNGEVIKHKAILVGNGFLQKLRVDYTNIKGWSMHELYVKSAFLNWPLDKEVYVIQPLDFEILDQEEKVLRLRKALYGFKPAPYDLLAIGSNEMEIGEFKKKMMKEFEISDLGLLFYFLGIKLKTIKNGTMMHQTKYATDLLKKFNMFKCNLVVKPLKLDWYLRRKGLRNL

SEQ ID NO: 167748 - protein, 80 aa, Glycine max
  Coding DNA Sequence Number=SeqID_50970
MTNEEHRMKNDVEVDYSRDSVVPLLRFLFFLLLHPYFSQNLSMLNARTLYSTSLTPIYSKKWPSGPWQIAQASQRLAWVS

SEQ ID NO: 167749 - protein, 200 aa, Glycine max
  Coding DNA Sequence Number=SeqID_50971
  Gene Ontology: Cellular component=integral to membrane; Biological process=defense response to bacterium
  Homolog annotation: Hit_ID=Q6K4V2; Match level="QueryCoverage=98%, HitCoverage=86%, E-value=4e-51, Identity=55%"; Hit description =Putative NEC1
  Pfam annotation: Domain name=MtN3_slv; Domain location=76-162; Score =122.5; E_value=1.2e-33; Accession=PF03083.6; Description=MtN3saliva family
MEERISGAVLSSAIPSHIDELHGCVIEIIYVTLFLLYSDRTKRLKVFLWLFLELVFIAVLTFVTFTLIHSVKKRSAVVGTICMLFNVAMYASPLSVMKLVITTKSVEYMPFFLSLASFGNGVSWTTYALIPFDPFIAIPNGIGTTFSVAQLILYATYYKSTKKQIAARNAKQVNLSEVVVGNSTVQDPNNNKISAAPNGL

SEQ ID NO: 167750 - protein, 108 aa, Glycine max
  Coding DNA Sequence Number=SeqID_50972
MASEKGGCMHTEFEARLSQARSYATSSVGKSQLTPLNPAEEQRLRTQYWVVAAGPKRKGRLYDTRDLVHTYKCGDDNFMHHMQGSSSHSQDATKIHQLGEEFCQSKEE

SEQ ID NO: 167751 - protein, 117 aa, Glycine max
  Coding DNA Sequence Number=SeqID_50973
  Subcellular localization annotation: CTP_CleavageSite=17; ConfidenceScore=5.46e-01
NFRGARKPRVRPADVPSSSTLPAPSTSATPTPAPPDSSTQDSQHFEFMLQSLHKGQILLMQSLQVVAPLGSILTMEQFLERVSWPGTLPSLERKGGGLSAQLPQQVRHKTATPERSP

SEQ ID NO: 167752 - protein, 266 aa, Glycine max
  Coding DNA Sequence Number=SeqID_50974
DGTKRESHSFKEEDYYISSTPENQIIPFDTPSASNTDSNLSIEVLEETDLTYNQVDKCSTPIMLDEARAPEENDNLHQEPDWDPIAELENMLCDSYKSFPMSTLSTSISGPNVAAILEKLETLLETSLENISCDDEVKQQFHQVLDQLVQFEDQVPVKLRPVINKLKTFIEGVDARYVTAQEIIQDYNKLLQSRSPLSKHLESARARQYQINSKVSEAKIQVEKINFEIVKLEQKIRVLIETRNKLKRDLDNCDVENNKLKTKAAQ

SEQ ID NO: 167753 - protein, 802 aa, Glycine max
  Coding DNA Sequence Number=SeqID_50975
  Gene Ontology: Mol. function=identical protein binding; Cellular component=cytoplasm; Biological process=negative regulation of enzyme activity
  Homolog annotation: Hit_ID=Q9ZTT3; Match level="QueryCoverage=93%, HitCoverage=93%, E-value=0.0, Identity=83%"; Hit description =Subtilisin-like protease C1
  Pfam annotation: Domain name=PA; Domain location=362-459; Score=55.1; E_value=2.3e-13; Accession=PF02225.12; Description=PA domain
  Pfam annotation: Domain name=Peptidase_S8; Domain location=126-609; Score=57.8; E_value=3.5e-14; Accession=PF00082.12; Description =Subtilase family
  Pfam annotation: Domain name=Subtilisin_N; Domain location=2-119; Score=49.6; E_value=1.1e-11; Accession=PF05922.7; Description =Subtilisin N-terminal Region
  Pfam module annotation: Pfam domain module=PA::Peptidase _S8::Subtilisin_N; Domain location=362-459::126-609::2-119
MQSYIVYTGNSMNDEASALTLYSSMLQEVADSISTLSHLLTAINGTDRLQCNCITPSSVGKPIFCLQSFVSNAEPKLVQHHFKRSFSGFVAMLTEEEADRMARHDRVVAVFPNKKKQLHTTRSWDFIGFPLQANRAPAESDVIIAVLDSGIWPESESFNDKGFGPPPSKWKGTCQTSKNFTCNNKIIGAKIYKADGFFSDDDPKSVRDIDGHGTHVASTAAGNPVSTASMLGLGQGTARGGATKARIAVYKVCWFDGCSDADILAAFDDAIADGVDIITVSLGGFSDESYFRDVIAIGAFHAVRNGALTVTSAGNGGPRPSSLSNFSPWSITVAASTIDRKFVTKVELGNKITYEGTSINTFDLKGELYPIIYGGDAPNKGVGIDGSSSRFCFSGSLDKKLVHGKIVLCDSRSQVSGPFDAGAVGALVQGQGFRDIPLSFPLPGSYLALQDGVSVYDYINSTRTPTATIFKTDETKDTIAPVVASFSSRGPNIVTPEILKLMEKLLYSPIPPRIYGPQQSPNVAPGVSILASWSPVSPPSDIEGDNRTLNFNIISGTSMACPHVSGAAAYVKSFHPTWSPAAIRSALMTTAKQLSPKTNLQAEFAYGSGQIDPSKAVYPGLVYDAGEIDYVRFLCGQGYSTRTLQLITGDNSSCPETKNGSARDLNYASFALFVPPSNSNSISGSFNRTVINVGSPTSTYKATVTSPEGLKIKVNPSVLPFTSLNQKQTFVLTIEGQLKGPIVSGSLVWGDDIDYPINICVTEKRLKLPAFPIALRNAILPSEMDFLKCNGKWQAINGIFRT

SEQ ID NO: 167754 - protein, 133 aa, Glycine max
  Coding DNA Sequence Number=SeqID_50976
PPAAAEGPPHNEVSLFLEEGPPPFFQTANAVQDPLHGCSHKRWIDGRQVLPKGSQGLLPLGLLAILTRQLESGSVQTHVIRIRLRTRRASSYPDNSSFTGFYLSFTGLFVPSFMMDSPRPIVTRQQLRPSVGD

SEQ ID NO: 167755 - protein, 272 aa, Glycine max
  Coding DNA Sequence Number=SeqID_50977
  Pfam annotation: Domain name=Transposase_23; Domain location=199-258; Score=-3.5; E_value=0.0027; Accession=PF03017.5; Description =TNP1ENSPM transposase
MQIWSSTLHSPIARHEKWKKARTNKFGQMTSTAAQEIADKIDELQEQAKQGALVPHGRQDILNTAIGRPEHPGRVRVGGHGVTITSYFGHASCASHSSSPAITAERLVEIIQTIKQEVKKEVEDENKDCMDKMKMELDAIKTELSQIHTQQSAPPRPSNPDIFVARVSTKESCAEAANNVVGNERSTFDTCSMGLYIVCGDSTQLVAGGKVFGVGGTIHTVAYGDDVLRVCVDTVYDGEAIVPLPTSEIQYVRDVVNSFIGWPRHLVKPLSY

SEQ ID NO: 167756 - protein, 185 aa, Glycine max
  Coding DNA Sequence Number=SeqID_50978
ASILNFERLDILRDTIGHPNKRASILNFERLDILRDRIGHPSKRASILNFERLDILRDTIGHPSKRASVINYEHLDILRDSFIHPTEKALGLPALITGLCQSFRVPVTPSKAPDASPPPHQADPAGSFDTERYLRHLVCQQAANHRGQISSGQRSHGPEIGLRPRQGRRPQRLLAMERRPAWMRR

SEQ ID NO: 167757 - protein, 388 aa, Glycine max
  Coding DNA Sequence Number=SeqID_50979
  Homolog annotation: Hit_ID=UPI00006A17C9; Match level="QueryCoverage =40%, HitCoverage=100%, E-value=1e-15, Identity=33%"; Hit description= UPI00006A17C9 related cluster
GLHALVFRRLHVLAFSGLHILAFRGLHVLAYRGLNIVTLSGLHALTFRGLHVLLFRGLHVLAFRGVHALAFRGLHVLALRGLHVLPFRGLHVLAFRGLHVLAFRGLHVLAMPSEDLTSSPSEDYTPSPSVDYTTTCPRLQRAARPRFQRAPHLRLQRSQGASSFHLSVAWPPPDLRGGPTVRAQPEREAIVQLLCISGIDFAQTATGRRLRIMRTTTTLIFPCRSGSRPQDTQWTRGSPTGSCGFQLWLWASVSLTGDCACKTPSGPAEVQQGPRVLALITSLYRFYGVSVAPNKAGAGRGTTTTWGRPTDAPPPPSEFTSAHLQGLDTWSTSRHPTTGTGTSRYWARDQQITIRCPAQDIKEVLLGGNLELATNKLPAKRSRKDTIE

SEQ ID NO: 167758 - protein, 80 aa, Glycine max
  Coding DNA Sequence Number=SeqID_50980
MSHSPTRCPFPPPPTRDQPTRHPVDQEEYNRVLGFRALITGLCQFYGELVAPNKVIRPPINWAFIKKYCTPRQAQGEASQ
